United States Patent 8,877,916 (PROMOTER, PROMOTER CONTROL ELEMENTS, AND COMBINATIONS, AND USES THEREOF) - sequence listing, part 11

SEQ ID NO: 12807 - DNA, 3000 bp, Unknown
  misc_feature (1)..( 3000): cDNA_ID_2712623_gDNA_ID_2214573_Annot_ID_135108 3000 nt of promoter + ATG
gtctcggaattgagaagcccttaaccacccgacttgagccatgtgggcatatacacatgatttgccatccagaaatgctacttacggtatggacaccattgagcccaaatgcctttaaatgcaatgtacatggtgcttggaagactgacagggaaattagaggcattggttgtgtccttagagactcaaaatagattgtttgagttatctgaaatttttcatggctccatctacatcttttatcttggagtagcagcaaattggaaaccatataactaccatgatttatagcactttaaactgaaaaatatatagatgaaataattttaaatatgaaaccgtttgatgatcaagatcccaagtcgattataagcgtcaaaatttcattaaagatagagagatcatctgaaacatatccaaagctaatggaaacaacacaaaaactctttgatataatgcaaacttagaggaaagggagatcccttaacgattggccttagcaactctctcaatctcatctttcttcttgatggcatagctgcaagacaagagaagatgctattattagcttaactaactaacaataaagtgaagccatcaagagacagactatgtagatagagtgttcttacctgttggaagatccctttgcagcattgatgagttcatcagcaaggcactcagcgattgtcttgatgtttctaaaggcagcttcacgtgcaccagttgtaagcaagaagatcgcttggttcacacgtcttagaggagagatatcaacagcctgcctcctaaccacaccagcagatccaatcctggtagcatcttcacgtggaccactaattcacataaagaacaaaccttcttaattagattcagttcatagtaacaagcacgcaagaattttacaggtttcagtatagcaatcttaatatacctgttaacaatggcatcaatgataacttgaatcgggttcaagtcagacaagaggtggataatctccatggcatgcttgacgatcctgacagccatcaacttcttaccattgtttcttccgtgcatcatgagagagttagtgagcctctcaacaattgggcactgcgcctttctgaacctcttcacagagtatcgtccagcagtatggggaacaaaagttgcgtgcttcgatggctgaacaccaatgtagtccacaagactaatatccgtaacctacataacaccaatatgcagatcaaaaacaaatattagcacaccaatcatataaaacacaaaaaatacatgacctttagtgtcaaattagtgttataatcaaaacaaacacaacatgggtttcagtgaagacggacaaagattataatagctaagatctagtaagtgactaagtgaggactataatttgatataattcacacaataaagctaatgtaactactcatatcaatataaaccaatcatttcaatgtctatcatacagctaaataagaattagatcctagacaattctcaagtgtctaaagagatattctaagagaagggattggtgaggaatataccgaaacgtcatcaaagctccaacggttgaagagcttaacctcattggtaagctgctgttgaatctcagcgtcgatttctgcggaggcggccatgactggaggatcaatagaagattagtaaaaacccgtaaataggaaattagaaaatgaaaaaacaggaatcagagaatggacctgaaactctataagtgtcgagagaagtagggatctttagccgcggcttgaagaagaagaagagaaggaagctcaagcaatgaagaataaaccctaaaaatgagtgttagtaatgttctgtttataaaatgggttttattgggcttatgttgggcttttgtgttttgttttagtttagtttctctccgaattggacacagtttggctattgggttgtatttatgttgagagactgactagattaggttttatcttttcttggcaatagttgaagatacggttttatcttttgtctacataaatcatcatacgttgcatcgaacaaagttctcaaaatgcttaccaacttgatttacaagtgacattttattattcttaagaacatgaagaatacattcttctttgtaatgatgaccatacagtcatcttttttcttttctgtctcaaccatccatcatactttattagtactaatttatattactattatatgaaaagaaaaacacgcatcaattaagccctaaatatcggctttgacgtgcgtcgtagtgactttaattattacaaggagcatattagcgactagcgactatccaaagtatgagcttcagaactaactttttattacaaaatacataattatcgtttatgatttcaatgtgtaaactgtgatatgaatctttttaatatttgataaaataaaagaaaagtcgcagagtgggaaggatataataatttttttcatttttatttcttactgcacgtgggaattaagaaactacacaagttttccaacttattaagctattagtcaacttcttaaaaatataagtcttactttattggttgaattgaacgacatgtgtattgctactttaacttattcgagttgttaattttttttttttatcatcatcattcgagttgtttaattgtttaatcacaaaaaattaaaatggaaaattacctaaaaaaacattatattatgttgttgagaatattgatagttagtatgcaacaattcttttagtaagatcatgatgttattacctttaccttctaccacctaactgtttgaaaacacattttactcaattcatatattatattttacacatatacataagaaggagacaaatgcatatttcttaattgatttctgagcatttcaacagagagacaaagaacatagggacccgttgaggcatggctcctttgggtgtagaagaagagcaatagttactgtgagtggagcttgcagagattggaaaaaaac

SEQ ID NO: 12808 - DNA, 3000 bp, Unknown
  misc_feature (1)..( 3000): cDNA_ID_2712619_gDNA_ID_2214573_Annot_ID_135109 3000 nt of promoter + ATG
tttttttgggggttttaggttcatttccctcctctctcaagtctcaggggatttgaatctggatctgtttttctttatttgaagttggaaatattttgaattttcttagtggtaagttgattttaaagtatgatggtgatatgttccttattgaatgaacattaaatgacatgatctaacaacacattggtcttactattgttattttttagtttcttcttttgcagttagttgtgaagttgaactttaagattttaccaatttagttttggttggttgaatgaaagaaaaaacagtatgagtatgaccattgatccctctaattacaacacaaaatgcaggtgggcttctctctctctctctcattctctcttcatatagatatatatgtgtgatttaagaactttaatatagagattgaggaattatatttgtcttcttttctttttttttggttaagaacaaattttgcaagtaagaagatggaagaagaagaagaaaaggaagaaggtcagagaactgtggagtgtttaagaggaagattacttgcagagaggcaagtttcaagatctgcaaaagaagaagcagagcttattactagaaaggtaactttgattaaatcctatctttcattaatcttgtttaaaaatatcagggtttgatcaagaaccaagaaagaatcacttactctgttctcgtttcttggaccaaaaaggtgttgtttcaaagtagttgtagtgttgatctggatttggtttttgttttactcaaagacaacctttaatctcttggaaacagatggaagagttggagcgtaatctgaaagaagagatcagattgagggaaaaagcagagaagagactaaagcttctgatgaagaaacttgaattcattaaagggtcacgcagttcggagggatcaagttcatctgaagtttcttgcatatcatcggtttgcacttcagcctccaaggaagaagaagaagaaactcatgatagtggagccgtggatgaaggaaaaactgaccatgcaactgaaaatgttgcctccacggaagaagctgattcaagttcaaagctcaaagatgtttcttctggtgaagcaagtgttgttgcttcaacctcaagtcataaagaagaatcccagtttggtaatgagttttcttggtactcagatgcaacttaagagttcaagaatcaagaatatcaatcttttattccctaaacaactttgatcagaaccttttctcatggtcgatcataaagttactaatactattactttattagtatatactacttttgttaatcaccagtttaagaacaagaagaaagaagccaagatcaaatgtgggtttggatacagtggacaatggagagagagagaggtggcatgtgaataaagggattgattaggctttaggacacatttgagtttggtagtaataaattcaaagtgttagtagagatggggaggacgacacgacacacatgacataatgtatgtctctttcttcttgtgttttttgttatcaaagaacgaaagtgacctttcttggaaattagtgatatagaccaaacaaaggaagaagcagtatgtttttcattgcacttgcagcgatggaccctgacccttattttcctttacttcatttcgggtcgaaactcactcggcctagtattcaaaactttcgcaatggtcaaagagaatgagttcaaagctcttaaagtgacactattttccctacggatttgatcacttaatctcttttttttctttttctttattgtttcaattcatttcttctaattacatctatcatcatccttaatcatccgtatcaaattcacataatgaacgttgttcctaaaataaatgacaaacagtaaaattatttcggctatcatatttcgttaggaacctatttttgatgacttcaagtaatttttttttttaaatggattttacattatgttcaaatagtttatttttcatcattttatctctttttctttactttccattcatttgttctagttgcattacattgtccacgtcatgtataggtggacttacaaacttcactagtaatccaacaaaatacaccacgtggattaaagtagattcactctctcgatagacatcgggtctaattgccagtatttttttgtaacaagcagacagaaatttttgttcaaattaagtgattttttttttggttcggatgttcaaattaaatgatagaattaacgttacgaaactatgaaggttctttgctataatcgtttcgaaattcatctttttaattttctatataattttttttgctggaaaacaaaataaacaaagagtttgatcgtgcatgaccgatcatgacggagcaacacttgtttgtcgtccacaactatctaagagacaggtgattttttttaatccacaatagtatattttaacaatctcgtcctgattaatcggaaatctctcgttgacgatttctcgatcgcaacagcacgaaactaaccgatcgatgatcctagactttctttttgatcttatcgtcgtttcggtttaatttttgttgttatagttttacatgttaaaatcattaagcttgtgtacggatttgagttttgcgagtgtagtaatgtaaagtaaagcaatgggaattagtagaaataggtttctttgtgaaatatgttgttatctttggtgagcaagcgctcactagaggtagattccaggtaaaattatatttctctaatcatttactaatctcgtgattaagatcataacatttatttgatgaattttgatttgcagggacgcctatggatttgccttgagacctcaacacgttcagagatatcaagaataccttagcatctatacagtgagttcttcttgatcatgcttcatttgctttttctcagataatttagtagttgaattttttttcatatattagctatgattgcattattagaattcatgtatgtcatg

SEQ ID NO: 12809 - DNA, 3000 bp, Unknown
  misc_feature (1)..( 3000): cDNA_ID_2712607_gDNA_ID_2214573_Annot_ID_135113 3000 nt of promoter + ATG
tcatctcatcaaacaatgctcttgcataatccaagctaccacatttagcataaaaaccaatcacagcattacacaaggataaatccatctgaatatgattttcaatcatcttcttgtgaacttccaacccgaaaataagatcgcttgactgtccgcacgcctggaagacgcttatcacagtgactccattaggcttaaaatcagagcaagctaacatcgctttatacatcttcttacagtcctcaaaagacccactttgagaataccctgaaatcatagaattccacgaaacaacatctctctcagacatttcatcaaacactttcctcgcagactcgatgttatcacactttgtatagtacgttatcatcccattgcccacgaagacatctgaatcaaatccacctcgtataacaaacccatgaacttgtcgagccaatgaacccaaccagaaatcatcacagcctgacagtgccttcaacacacaagagatgctaatagaatccggtctggcagcatcggaagagtaacaagaggatccaatccaggacaagaacaacgagaaagcatcgaaatacatctcacgcgaagtataagcgatgagaagtgcgttgtaagagaaggcatttctaacggtaatttcgtcgaacacatggagtgcttggcggaaacgatcctgcctagtgtaaaaactgatgagctttgacgcgaggaagttgtccggcttgatggagaagacgacaatacgcgcgtgaagctgaagcacgtggagaggaagtcggtgacgggtgaagtgctggatgaggtgaccgtacgcaccgccgtcgaccgccgccttgtttagcaagccttgcaaggctcgttgaatttcgaatcccaacttcattcatatctaaccaaaagctaaaccggagaaataaaacaatatgaatatatagaggcaatttaacgggcttattaatgggccttaaagcccatagtgtcgctgtattacagaacggagttttgaaatcgatttgacttttttagtttcatgtcttgtctgagaaattattattgtcgagctttcggttataaacagtctcgatcttgctacagtcgatcactgaatcgtgaaatagctaacgagtcatctgaagttgagagacgagctcgttctctgagagttttggatatcatatcttcgaaatctggtggagtttcgaatcgtcaggaccattttggtttcgttcaggaatttcgacaaacagattcgtggcgattcagaggtcaggcaatttccgaggattttgatctctcaagaaccaaaaatggagtttcaagcgtgctcgaagaagttatgctggaggattcttcaagctctgtcaagcgagatggatggagtttcgatgcttatggtttatcatccgccgtgagatcttgtgggttgaatcgagactttagaaccggttctgggtttcattgtttagcgttgaaaggtgggtttatctcagatgtctacttaggaagttctctggtcgttttgtacagagattctggtgaagtagagaatgcatataaagtgtttgaagaaatgcctgagaggaatgtggtttcatggacggctatgatttcagggtttgcgcaagaatggcgagttgatatctgcttgaagctttattcaaagatgagaaagtcaacctctgatccgaatgattacacattcacggctctcttgagcgcttgcacgggaagcggagccctagggcaaggaagaagtgttcattgtcagacactccacatgggattgaagtcgtatctacatatctcaaactctctcatctcgatgtactgcaaatgcggtgatttgaaggatgcttttcgtatctttgaccagttttcaaacaaagacgttgtttcttggaactctatgattgctggttacgcgcagcacggccttgcaatgcaagcaatcgagctctttgaattaatgatgcctaaaagcggaacaaagccagatgcaatcacatatctaggagttttgtcatcgtgtagacacgcaggtcttgtaaaagaaggaagaaagttcttcaatttgatggcggaacacggcctgaaaccagaactcaaccattactcttgtctagtcgatcttctcgggagatttggtctgttgcaagaagccctggaactgatcgagaacatgccaatgaaaccaaactcagtcatatggggatctctgctattctcttgccgtgttcacggcgatgtctggaccggaatcagagctgcagaggaacgactaatgcttgaacctgattgcgcagccacgcatgtccagctggcaaatctttacgccagtgtagggtactggaaagaagcggcgacagtgaggaagctgatgaaagataaaggactgaagacgaatccgggttgcagttggatcgagatcaataactatgttttcatgtttaaagctgaagatggtagcaactgtagaatgctagagattgttcatgttcttcattgtctcattgatcacatggagttcctctaatattcagggttctctctcattagttttatagtgcataccagatccagatcttttctataatggatcaagttttgctttgaacgttttcaacataacctctattactaatgaaaagactttaatttgtatagttgagtaatataaacacactaatttaataattaaccaggtaatgaaatgaatgtagctgtataatgcggtaaaatgcaccaagagtttctctatgacgtaatgtgaagttgagaaacacacgccatcaaaattttctttggttaataattaaaattttaaggtacaagtttgcacgattaattcaaaatttactacacaagattcataattaaggaatcgaatataggaaagtgtccaactggtcctctcttatatacccttctccactaataccgcactcagaagacgacgacaaaacaaaaaagttgcgagagacagagagaaacagagac

SEQ ID NO: 12810 - DNA, 3000 bp, Unknown
  misc_feature (1)..( 3000): cDNA_ID_1379041_gDNA_ID_2214573_Annot_ID_135114 3000 nt of promoter + ATG
gataaccgcgagtatctcaagagggaaactcgtctctggagcaacgaacaacaactcatcaaacctaacaccatcattccaaacattcgccaatcctttctggattgaaatgatagtaataggcaaacgtgctatattaaactcaagaagacaaccagaactcctcggaatgagactaggagctgtaatggtcaccggaatcatcctagctacaatgttcactaacctagacaattccccaaaaggagcacaagaacgtttaggattcttcgcattcgcaatgtcaacaacattctacacatgtgcagaagcaatcccagtctttctacaagaacgttacatattcatgagagaaacagcttacaacgcttaccggagatcctcctacgtcctctctcaatccataatctcaatcccggccttaatcgtcctctccgcaagcttcgccgccacaacattctgggccgttggtctcgacggaggcgccaatggtttcttcttcttctacttcacaatcctagcctcattttgggcaggaagctccttcgtaacgttcctctccggcgttataccaaacgtaatgctcggattcacagtcgtagtagcgatcctcgcttacttcctcctcttctccggattcttcatctctcgagatcgaattcctgtttactggctctggttccattacatctccttggtgaaatacccttacgaaggagtgttgcagaacgaatttcaaaatccgacgagatgtttcgccagaggagttcagttattcgacaattcgccgttgggggagtttccgaacgatgtgaaagtgaatctgttgaagagtatgagcggtgtattggggacgaatgtgacggcggagacttgtgtgacgacggggattgatattttgaaacagcaagggattacggatattagtaaatggaattgtttgtggattactgttgcttggggttttttctttagggttttgttttatttcactctcttgattggtagcaagaacaaacggaagtgattaaacagttgttctttttttttttttgaaaaaaggtttgttgtaattttgtttcctttttctttcaattatataattgtatgtccttgctatatttaatcgattaattaaagaataataaagtcataatttatgaaatgaaaaataccggtgatatttatatatcttcattctttttattctgtaaaaaatgaaagtgctttaggaaaaaaaaatgctaaatgttaaaaaaaaaacagaaaataaaaatctaagctaattgctattagtatttctttaataacaaaataggattataggcggactttgatttgttcatcaaagaatagtttataacatgaattggtaaacggtaaaatttatcctagaaggtagaagatagatgtcataaactatgcataaatagatagatgtcataacaaatctgatcacttttagatgttgtaagtttttaaagattagaggatccaatttgttataatgaatttgcataactagatatatagtttagtctggataactcattactattagtctttaagcaaatgtgatcagagtgtgcaacatagaagaataccgagacatacaaaacttgcaatttgtaaaccaccattcttattttacaatttacacaaattaaatgggccttattaatataaggcccaacagattgcaaaatggtgaatatggcaacatcgattcttatctctttttaaagatatttaccgttggtttaggacacaacaccaaattattaccgttggatttagtcggttctgtctgaagcccatttttgtttttttctgtcagcgtctgaagcccatttataaacacttgaaaaccatactttagctaccttacgctgttcttcccctttccttccgaaattagggcttccgtgtttcgcagtgctctccttcaatccccaggtatcgaaactctgctcaattcgatgattcatattgaaatttagtgctttcactgctcggaattacgattttatattggttcgatgcatctgcggtgatggtttccttagcttctgtctttccgatttatcgcttccttgtctctgaattaactaaatggcgtcttctttggggcttttttataggtcttgagttagtgaatttttgttacgttcttgttttatagtttctaacaggttatgctcaaaaatctgtggtttctttgtcccttttttttgattttgtagcttgacaatgcctcgctatgatgatcgctatgggaacactcgtctttacgttggccgattatcatcgagaactaggacccgagaccttgaacgtctttttagcagatacggaaggtaattgactcttctatctatgattatggacgaagtattttgatttctcggtaattggaataaatgatggtctcaatgtgatttttctagttatatagtacgtaaattgctattgtgcgaggaaacaattgcagaaagttaaaagtatcgaggagcataatgcttctttatcttgacatattgatttctatgtgttggggttagttaaatgagagtcttcatgcgcctttctatatatcttggttatgaaaattgttagtgcgagggagagatgcagaaagtcgtcattaagcatcgaggggcatagttttggttctgtattttgatatttgtgttcttgagggaaagttgtggaactaggtttagtcattagtgtatgtttttaacttgaatgatcttattgaaggtctctgggattttgcctaacctggaggtgtttgatgagtgggtggacttggtggaaattctcgccaagtgtttaggggacagggcgccttggcgattctgtttgtagaattttttaatgtgttttgatggaaatggagactcagtctcaaaaatggtgtttagaagtaccttaaagtaatgatggccttacttttctgccaacaatttcttccgcagagtgcgagatgtggatatg

SEQ ID NO: 12811 - DNA, 3000 bp, Unknown
  misc_feature (1)..( 3000): cDNA_ID_2709670_gDNA_ID_2214573_Annot_ID_135117 3000 nt of promoter + ATG
tagatttgactgttactgagcagctagctgtccaaatcgtgccaaagcggcaaactcgtacctatcttattaaaactaacgttacaatattgtcttattttattttattagtgtaaaactgtcgttatctttttttgttgacaaatgaaaacatttcttttcggaggaatgaggatggttgatattttttattgagagataccacaaaataacatgttttggatacttaagtatctagcaagattgtttgaccaaaaaaaaaaaagtatctagcaagatttttacaaaaaaaaagtatatctagcaagagaaaaagtcacattattcggatgtaattcagtacttgtcctccataatcaatcgaacaaaaacaaattgttcagaatcagtcacatacttgaggtggcaaaatatttaattagcaaacgagtaagaagtggcaaagtattataaaaggaaaatatttgaattaagcaacaaaaatacaagttaaattttgattaaaccaaatatatatctctcaagtatattactcactcattactaactgactatatctgaaaagttcataaaattttacgtatgccatttcgatttcgattgaaaacatgagagcacaacttaaattacgagagattatcaagaaataagtaagcttatatgtggaacattatcacataggtatcctgagcaacatgggcatatagtaatctaaatagtaattagaaagtcactggaacataaatgtggacacgacttcaatagtatgagtgggttacacgaaaacccaaaattctcattaacgtgaaaaaataggcatataatacccaaaagaaatgcattatataagactaacgtggagaagtaggcatataaaacgtttggtatggctgttatatctgttttccagaactttatactatacgcttcaatatataagacctagatgattctatttacccattcttacaagagatcacatgatccacataaatctgtatacgtaatactatttgtttgttttatgacgcctgtccctttcaattttgtttaatagttaaaataaatgttgaacaaattcttatatctatataaacaaatgttatcaaagagaaccagttctggcagctaatttggtcgaacatgattgagggcctgttcctgtttgctagaaaatataatataaactttcgaatataactaacgaaaaatatccaagaatatctgtttttcgatgatctcttcattgtcccttattatcgaaattagtcgtagttaatctttgtttgtagtcatcagtgatatagatttgatcaaatcatgatcgttttgaaatcgttagcaatagtgacaagttatagtgataacaatatattgcatcgattgaattatgctatagcaactgcaaaccagttaacaaagtattttgatggtcgttgttgctagcgaccgcaaacaaacaaacaaaaactatcatataattttgcatattaccttttgagcatgcgaatattacctttcaaaatctaaaaacctttatgtattgctagattaggatgtatataagtcaatgcccagaagctgaaatcacaattaccggaaaaagcaaaacatgtagcaaacactttataacttattcacatagagcgcttgcaagagaccattctaagctaagtgtttgtgcttgagtcttagaaaactgaatttcatatcgtcattgtcacgtacaaggaacttacaagctataagcaaacatttttaatttctttctatgttattatatcttcaatcttttaaatgtcttctctcgaaattttagttttcaagtggtacaacaatactctatcatctaactttccagttgctaccagttgacgaactatgaattgagcaaacatatagcaagttaactagcatcagagacgtccaaactatgaattgcttaaggctgctacggctagaattgaccaacactattctatatatatatatatatattttgttgcctccaacatcaatctatgcatacaaaaatatgttctggtaagacttataattgtttgctataattttgaccagactttgtaagtgtgtttattatgattaaagaagacttggtaaaaatataagtctgatatggcttacgtaattgtgctatgatcacgacatacttacttaaaaatctctatgactacgacagactaacatcaaaccatgcatgggagagttataagttataacattgttttactattagttacacaaaaatagtcaaatagcaacatatttttcagcacgggatatgtgactattcgtgaataacatacaaatattggccgcaaactacatctgtgactgtaaccatgacaacaaaaaccggctggtaaatttggcccattcaatcacgaactacaaactcgtggccatggtcactatatcatcaatatgtgaattttgctgcaaaaataattgaattcttttttttctaactaaatgttatttgaggagaaaaaaaagattgatgggctattaattttatctattttcaaaattttattatatgagataacgttttatattgacatcaaattatgtaaggaaattctatcctatcttaaaaagatattactttttgaaagaataaaatctagttttgataagacacaactggcgtaaataaatgcaaaataactaactggattataataatttggtaatccaattattaaacaagtccaaattgcaaaacctaaaaaaacaaaaaaaaaagacacgtaggaaaatgttgaaaagaacacgctgcgtctgacttggtctccaatctctcgcattgttgcactctgtttttgtttggtctctctccatgcgatcttattcttctccaaccagtaatatcgtttgaaacctgaacaagaccctaattttagcctaattcaaaactcaaaatccgatcatcgagagaccttgtgaaattttggagaagaagaaagaatctcggcg

SEQ ID NO: 12812 - DNA, 3000 bp, Unknown
  misc_feature (1)..( 3000): cDNA_ID_2712599_gDNA_ID_2214573_Annot_ID_135122 3000 nt of promoter + ATG
gatctctttccttaatccgaatattgttggtgtgaccaagcttttgtgatcctacttactaagaagtaacaagcacaacaattatcatgaatcagtactgctaaggatatatgattgttgttagaactgttcatcttctgatcagtctgaagatttcacaaaccactctgattgatctttttctgaagttttgaagtacttgctgtgactacaatataattgctgtgtttgagttgtgtggatgggctaagatattggaccaagggattcatttccaatgctcaaacattttccactggcgaatattgttaaaatctataactacattatttaagaaccaacaatatctgtggaatggtttcacaaagagaatattcctagattgagtgcataagctcattgaaacataaccataagtgaaaagagagagaacatagcatgctgattcttccatgaacaagaagaattcagctgagaacttaggatagacaaaaagacgacgaaatggaattgatagttgaggcagtaggtaaaccattggatgacagagaaatagatgtccacaaagcttacttgaactcaaatgatggcaccggaggagcatcaaaactctccaacacctctgttttactttcactgcctggttgcacctcctcctttttcttatcaaaaagccctccaaaccatgatgatgatgatgatgatgaagctgtattctggttttgactctctgaccttatctgtgcttgactctgcatctgccccatctgcattccttgcatcccaggcattccttgcattccgggcatcccaggcattccctgcattccctgcatcccaggcattccttgcattccagggtcctccatcatcatattctgaggctgagccagtaccttgttcaacatgatcccagctccttcaatcaaagcaagcaaaacccctccaaaaatagctgatctcgaagcagcaccagccccttgccgcatagacagaaaccctccagttgcagcaccagcaatgatagagttccaaggatcctccttttgccttaggtacaccatggtacagtcaaatgtcgagaataaacctccccaaacagcaaaactgcctccagtacgaggtgcgttcatgctcaccgattgtgttcctccaacaaagcgactacctttaggagaattgtaagtccctttaatgaaatgaaaggcagatcctccaacagctcccataccaaaagcaccaccgatatcatcgagtatacgatcagggcaaggctcccgagatgtctctggtgttcccattattagatgcctcaggcaatgattctatcaaacctgtaatcaaatgaatattgattcattaacaaatagtaagaaatttagggttttgtaagtcactgcgaaatcaacaaatagatctctgactaattccaattaaatactgaacatatacaatcgaacgaagaagattagggtttatcaaagatccgtactttacgatcgaaagcaaaccatagaaaaaggtggaaactttgtgtatagaaatgaatctaagagaattgagaaagcactgttgttgatgatagatgagaatcgaagaagcatacctgagactaacgaggaattaatcgacggacgagttttagagacgagtttgagagagagagaaaaaatgaaggaggtgcgacggtgagcgagagaaggaaggtaaaagaagaaacggcgtcagggtttattagggttggctagaaaaaaataaacaaaaaagttacagcgaccaaactattttgcgtttaattttttgtcagctttatttttccgacactgttgcgttttttttttttttttttaatttccctctcttttttgccggcatcgctcatttttcttttcttttcgaatatggttgctttattttttattgttttaggataatttcgttcagtaaaatttaaaaaaggagccaaaagttttttcaattgcccaaactagttaaaagaaagacctgagagagaaagtaattaaacctattaataaaagcccaaatagttagtagaagatttaaagtagagaagcccaatttggagtagcccaagtttggagtagcccaagtttggagtagcccatagactaagaaaagattaaaggatgttgttgtctgtttacccgtcttgaactcacgcttaaaagctcctttataatgcaagaatgtcattaactctcttacaacggtacgttagtgtataatgtatacagattgttaatatatattggtcttcacaagttacaacatttggattaatcacacatagaacagttggagactgaattaaatactctcatattcaattacaaattcttttgtgttttcttttctttctctctaattttgtcaaatcaatgataataatgagctaatgatcatttttttaatttatccatctccaatagtgctgattccaaattctttccccaaaaaaaaagaagtagtaaatccatctcacatatatatgattgtattggcaaaagtgtttatttaagaataaaatcagaaagtagtagatttacaattccttttttttttttcccttttttccatgtttacaaatcataaagttgttggattattggaacaattttttgactgaaatatttaatatcataatacctgtaaataaataatctagcaatatatgaatactgagacaaaaaagaagaagatatttgcgacttttaaaaaaacttttgaaattaaaggtagtgttgagctctctagtaattcgaatttggatctgcttccactcccaacggttacttaccctaatctttttttgttcttcaaattctctctcaaacttgaaaagaagtctctctttcgatctccaggattcggctctgtttcctgtaagtgaatcttatttagaattcgaatctctgggattctgatccaacctttctcaattgattagggaatttgaatttgatttcacagaaatcgaag

SEQ ID NO: 12813 - DNA, 3000 bp, Unknown
  misc_feature (1)..( 3000): cDNA_ID_2712591_gDNA_ID_2214573_Annot_ID_135124 3000 nt of promoter + ATG
agtacatcacatttcatttatgtctatatttgtgaggagtttaataagtttcaaagaacgattggagaagacgattgaataattgagttcattctcgtaagtaattagttaatttgactatcgtaactaaatcctacatgtttcgattatactcataatttcaatgttatgacaaaaccgtgggctcaatatgaaacttgtgtcaagaagtcaaccagacaagaggattcatttgagaaatgccaaggagttgaccggaatttttaaatcgttggaaaatgtaattcatgttatgttattttgaagcgagtccaaattatgaatgattccactttaatagtctaaagaataaaaacttactaaggacctttcattcaatttatattttatttttttggatcgtattttattattatagattcaaatatgttaataagactttatatccaaattcatactaatattttgtgaatatttaatagacaaaaggtattcttgatccacacacatttcctaatttctaggtctcccataaccaaaaatatactaaatttccagtattacaaagaaaagaaaaccgtataacttcctttttccacaaaccttctataattaacacgattaccatagctttctactactaaccttcccatcctaattcacatttaaataaccgtgcctaggtaatgtaaagtatcattaaatactaaaaatatcacacataaaatattggtccaatgagtccacctcacacataacacaacttttataaattccaatttacagccgtataagtgcacaatgtttctcttcatccttcacaacttttctctctctccctcacaagtttctttcttctcctcaaaaatttaaactggcccttctccattttcgttcacaaaaccttgttttgtataacttatactcatgtaagttctgctactaactctgtaataacctttttgttccttgatgaagaagtcgttttcggacaagactgtttattgtttgaactcactaatgtcttcgcttgaattttcctgccgccttcttctttgttactcgctctgttttcttcttcatgaaagctctgtttcctcattttctcctttaacactatgacacacaattttttccatctcctctataataaatactttccaatttttatcctttatctcatcgattaaaactatcaaatcgatcttgttattgcaccttcctaattcaaagatgggtacgcttatatttttgtataattagcttttatttcgaaatcaagaaacaaagtttcaattttggttttgtctatgtttccatacactctgtttttttcctctcttaaatgctaagcttaaaccaaactccaaaagcatttacatctaaacatggcttcttccgtatcatgcatgatatgtgttaattaaattttccaacatgctttttacataattctccttaattaagactcttggtctggtctctgttttgttattaaaaatcttagtttctggtttccatacactctgttttacctctttgtaaaggaagcatctagattgttccgtttcatgacatgtattaattaaattttccaacatgcttgttatagaattctccttaattaagagcctctaattaatcatttctctagtttttaaaatatctgtctccaattctcctgcaactaggatttttatatacttcccgttgaatttcttagctactagtagtattatttttggttcaatttttgtcttcgttttcttattttacattttaatttctgtctttcttgcttgttgattggacccaaattgcttaagatatattattcgtcattatttttcattaatttcgctttcatttacgcgcactaatatcttgcttacctctaaatttgcagatcctcatcctttataatcctctagattgtggttctagacattttacaaacaacggtggcggaaaaaacggcagaacgttctattacacaaatatgggcaagatcttgaaatctaaggtacgttctgtaaacaatgaaactacatctcgtttattattctcctttactttctttgctgaaaacggctccgtttaacagtcttcttggccaagaaccgtcgtgaggaaatggttaaacctacgtagcggcgcttacgaatttcactctgattacccagtcaaaggtgagatattaactcgtgccgttttagatatttttgctcaaatttcttgccgtttttttaatattctcgtctgacttaccggaggtttttttttctttctagggatggagccaaggcgaaaaagctgctccgacatgatcgtgccggaaaattttcaaggtaaaaatataaaaactagctcatgaatttgatttaattatactactattgttttgttgcatcgaaaacggcgtcgtatctattgtccgtagaccgtactgaattgagactgtctccgtaccagataaagctttgggtccatctctaaccgtaggattagacatctgtgttaaaaacgacggcatataagaaactgagattttctcttgaaaatcgtgttttttttgtcggaaaaaaaaaaaaaaaaaaaacgagtttacaaatgaaaattgtatcatctgtatccacgtgtagggtgagagattaggtttaggcggtaagtttaaaaaagtctttggttttaggtgtacttgccactctcaccattcaccagtttttgttttatccacataatatctctgtctgattataatagtctaaatactaattaagtgaagtatataactaattggttttgtttatgttttgtggttgaaataggttggttgggccaaggaaatggggatttaaaacattcaaccggtgaacaacatgtgacacgcgttgatgacaaacttgatcttaagtaataaatacttccatgattaacctataatttagctctggtctataattagctatgatcattaacgtcgtaattgtttaattgttg

SEQ ID NO: 12814 - DNA, 115 bp, Unknown
  misc_feature (1)..( 115): cDNA_ID_1381793_gDNA_ID_2214573_Annot_ID_186267 3000 nt of promoter + ATG
tcctctagggtttaaggtttgattttcagacaaaagtataatcaatcattctgtaacttaaggtttgatattcagacaaaagtacaatcaattcggcgattggtctcagaagatg

SEQ ID NO: 12815 - DNA, 3000 bp, Unknown
  misc_feature (1)..( 3000): cDNA_ID_2994470_gDNA_ID_2214573_Annot_ID_186266 3000 nt of promoter + ATG
aagtcagccaatggaatggatcaacccattagatatatatgctcacaaaaaaaaattgattccatattcatttgcaaataaaaaatgaagtgacgtcttaaaactcacgtgaaaaataagctggagaatactactacacatggatggagaaggtagacagtagatatactcttttgatattgaatcaaatctgcctcttgttccctactagaagaatcttgttgacattgttagaagcgtgctgctcaatgttacggatcggattcctgatgtctactcacagtaataaaaaagaaaagaaaagaatgaatgtgatcttagtagataatatttgctaactaatatgtagaagtaagagaaaaaatagatctgttgcaaatgtaattttttgttgcacaaggcctgaaattgaactaattaaaactgtgatctaaaactaagagtaaagataatagtttagtttagaaagatgattcaactgtgacttgatacacaagtaaaatgccaatagctccaatatgtagtatgttacgataagatcaaaccagttacgcgatatttccagattcccaccataataaagaaggaacacatccataaaacaaacagctaaataaaggataaaaaagcaaaattaagtggatagattcttagagaatatcacaactaaacatgttgtgattataaaaaaaacggtcttatcacaaatctgatgcttaattcacttcccatcaagctgaatggtccataacttgaaattaatattgtcaacacgcagttccactaataagtggaaatagacaaaaactttgtctcaaagaaaggagaagcagagagtttttgctcgttggcaaaagctgtgactgtgatgaagtgaaggctttagcctcactagtcatgggccttgagctataactttcagatccagcccaataaaaggagcgatgcatcagatattcagatggcagagatcctaaataatctcaaccgttctagagatcctaaataatctcaaccgtttatttatttaagccacgtcatcgatcctcgcgaaaaacaaatacccatttacaagcagttacatatctgtatataaacaattatcatcattcagcatcaacgcgtctctcaattctcacattctcaaaatcactaaaatcaaactcaattttcatcaaatatctctaatggcgccgaaagcagcggagaagaaaccggcagagaagaaaccagccgggaaagctccggcggagaaactcccaaaggcggagaagaaaatcagcaaagacgccggaggaagcgagaagaagaagaagaaatcgaagaagagcgtcgagacttacaagatctacatcttcaaggttctgaaacaagttcatccagatgttggaatctctgggaaagctatggggattatgaacagtttcatcaatgacatcttcgagaaacttgctcaggaatcgtcaaagctcgctaggtacaataagaagccgacgattacatcgagggagattcaaaccgctgtgagacttgtgttgcctggagaactcgctaaacatgcggtttctgaaggcacgaaggcggttaccaaattcaccagttagggttttcctgtaaatttccggttaagtgtttggtttagactcggtttgtttagatgttttgagtttcgtgaattgtttgatgatcactctaatggttcaaaattgatggttgaatttgattcttcttcttcctttcagtgatttataattgttttatttaacgtttgagtccctggaatttggataatatgcaaattgctccatcaggtatttataaactaatttctatccatcaattgcgttatagagttgcgtttgtgtgtgacatcgacaaaacaaactaaacgctatttctctaattagtggattttattacaagagaaacttgttatatcgtcgtcttctacaccaacaggccgttgaatcatgagacgctattgataagaccgacctaataattaggtagatttttttggtgtagtttatttccagtctattattctcagcccattagacccaaaaggaaaatatcaaggcccgtaaggaaagtctaaaaagataagggacacgtgtacagtcataaatctatctaaaggtaggccgccacatctatcaccgttggatattctagtttaaaatcgtcatcaatcataattattcatttcttcttcgtcttcttcttctttctcaaattagcttttctttatcgtcttcctcaagcgtgagattcgttgtggatatagtttttctccttgattctctggttctttccatgatccaattttaagggtttcacggcttcgtttttttgggtatatctagctctatcgttcgtggtggttttctttctggatcaaagttttctgagatctctgcgatttctgggattcgaaaattggagaattagggcttttttacggtaacagggtttcgaagagcataagataagaatgccttcggtgccctctaagcttcttcctctcctgtctttgattccttcgttgactccttatcattctggtttgagttctaatcgtttgaaacctcttgaaaagtgtgattggcgtggtaatcttagttaacatttcctttccttcttctctcctttttaccctttcttctctcgccctcgtttacttcttgagattttcttagctcgatttgatctttggtgctttaacttctggcggtgtttgatttgcagcacaaaaaggtgattttttttttgtttctttgacttctgcaaatttaattctgttcaatttgggatctaaacacatagtctatgttttaattcatgggcttctataatatcatgcgagtagagtgaataaaatttgagcatgagtctttgttttcgttgtgtgctctaaagatcatatttactgatgataactttaaatttgtttgtgcagttactactactactgtgattaccttgtactgttagttggat

SEQ ID NO: 12816 - DNA, 3000 bp, Unknown
  misc_feature (1)..( 3000): cDNA_ID_3026564_gDNA_ID_2214573_Annot_ID_186262 3000 nt of promoter + ATG
gaaaaacaagtgaagagaaaccgtgccatttcaacgttcactaaaagagggagagggaccattaaacaaaactggtttgagttcctgaatttttctattatccataatttgtataggtttcaagtgttcaaccaacttttgacttatattaattttaattaagtttaaatagattctttcaacgttttaaaaagaatatttctattataaaaatgtataagtattgtccatgcaaaacgtggataaacttctctagattttatgaataatttttaagattatgatatttcttgagacaaaagattttacatcatattataaaaataaataaaataaatttacatcaataaatatcacttatagcattattatagcaccgaaactgagctcatgagttaaataaattttgcagatttattaatatcatgagcccactgcagctagagccaaacaactttaaatttgactcaccaaaaaaaaaacaactttaaatttgatatacgtcttatatcgtgaatattcataccttccaagtgcagaataatgaatcaaaaacgttctattgatagagaaccgatgctcctttttctataacaaaattatatggaagaaaataatgaaagtgattccaccagaaactaagtggcacaatggaaacagtacaaaggacccaaaatattggcgattatacgcacttacatcaataaatattccatgaactaaaataaattacaaaataacctaattaaaaaggaaaaaaagcaaatctaaccaatgatcactctacccaacagtgtcggtatatcgtgactcattaatcattagttcatttttatactttatagattggaaagaactcgattcatcaacacctctcctggagttaggcgaagatacatatatggaacattagtgaatgggcttggaataatttacaaattatttttcttatataaatgatgaaaaacaaattatacaactcttattctgagtaacagctcttgtatttcacaaaaaacggcacaatatcatatatactgttttacacacacacacacacagaaaaaaatcatgaaacaccacttaaaattttctctaatttccaatacagacaagctcttggattagaggcctaatttgtgttgtaattggtatttatcaaatcattcttaaactatgccctatggttcacaaatcattcagttttctatgttttaataatctaataaataaaattagcatttacgtcaatattttttttttgatatatactctctcggctcattttaaataatatataaagtctttgtacatagattaagaaattatatctctcttatactaaaattttatttttacatatctaaaaaagttcaaccagtgaaaaagtaaatagaagaatagaaagaattaaaaacaataaaaaaagacagtaaaatttacattgaaaaattaaaacatcatacaaaatgaaacaacaaaaaaaaaaaaaaaaccaaacatcaagtaatatgaaacggatgatacatttttaacaatacattttttatgcggaaatacatgatggtagttgacatgatggtaacatatatacaatgttattatcatgaaaatcaatcagatgagagatagtgatactagcgttcgactttgatgaaatttgcgaatccacggcactctgtattttgtttaattagttcggttatgtgacgatcaaatacaaatttctatgtctttttgttgataaggtaaagaaataagtcccatgatttcagggtacggtttggaaagtagcctcaaaatacataacaaaaaggaaaaaaagaaaatttacacgcatatttatttacactaataagtttacgtagagagaagaatgttcacatcacatcacatccttttaactttggctctatataaagagagatagccaagacaatcataacaactcatatcaattttttaaaaaaaactctccatatatctattacttctacgctaactagagagggagattattgctcttaagtgatggaggaagtaaagaagagggattgtatggagaaggcaaggccattcatttcaatggtagtgttgcaagtagggctagcaggaatggatattctctcaaaggctgttctaaacaaaggcatgagcaattacgtccttgttgtttaccgtcacgccgttgcaaccatcgttatggccccgttcgccttctatttcgacaagtacactctactttcccttctttacatatgtaccaactcataaacataagtaaaatgttttgtttaagtaggtagattcaaggccatgacaacagaatatcaacctagctagtttgatatattctgatgaaattagtttgcctagctaggattattattttgtgttttgagttttcagggtgtgcaaacgcaaaataaaataaaaattgtgaccatattctacaaaacagattatatcaaaaacatgaataatcatttaatatattattgagtgttacgttgtctaatttatttttgtgagtgatgcttagtgtttgaagcttgaaaagatgagagtagcaaaaagaaaccatgatgcttttgacgtaatatatgataagaaagggtcactcatatgttaaaagacaaaagacttgtaaccgttttatatttggtttttgtgtggtttctgccaatgtcatgcactgaatgtgagtccttacttttttagtgtctctttacaaaaagaaacactaattcaatttttagtgcgtaatcaaaatgtgtgtatgcttctgcaattaattatgactgtaatccagtaatatttacacagatttgtacgtaactaatttgaaatgattctagttatctatccatggagaatatttgtcctaatcaatttttccttttttattgaaattaatttttagtttagatgattctcaaatattattttcttacaacgattctcatataatccaatgtccctaataaaaataaaataatg

SEQ ID NO: 12817 - DNA, 3000 bp, Unknown
  misc_feature (1)..( 3000): cDNA_ID_2994839_gDNA_ID_2214573_Annot_ID_186257 3000 nt of promoter + ATG
ggcataatccaaagtacttaaagtttcctctagggaatgagcagatggagagattgtagcaatgatacaagtttttgtctttcctcctagagagtcccgtaaaagccttgtcagcttactatccctgcaaccacaagtatgctttcaaaaaacacaaatattaccacagtagacatatatagttgtaggacaaggcaagtacctgtaaggtacatgagaagaatgttccacaagggcattaatcacacggcctagtgtaagcaaactcttgttaatctctcctgcttctcgtgcacggccatctcgagctcctgaccgtaagatattctcagatcctgctagatccacaaggttaagcttcccacatttgattaactcttcatctcccatagactcttcctttatatggacagtgatagtaaacactgaatgagatcgactacttctcttattcaacaaagtatcagctgtacgccttttagatgaacctcgttcaagaagagcatatatatcattagcactgtacacaacttcttcttcaagacctcttaaaaccacagaacccttcccatcctccatcaaagaaatgggcttcctctgcttatcctcagaagatcttgaggaatcatcttgagctaacaaatccgtaacttcctcattgtaaagctccaagaatgttactttcatactgtaatcagcattttgcgcctcaagagtatcgaaaatatgtctaacagctctgggaatcaccccagcctccgcaggtaaatcccctccctttttcctcattccaccttccatagtgtaagtcttcccagttcctgtttgtccataagcaaacacagtacagctaaaaccttccaagacttcatgaacaataggtgcaatagcttgatcatatatagaccgttgttgtgacttaggaccaaaaacctatagaataaacaccatcagagacccttgaatacaaaaccatcaagtagagaaagagaccaaccaaccttgtcgaaattgaaaagacggtctacttgcttattagcaatagtatgaagaacattgacttctcttctcatttcattacaagagatgactctaggaacactagatttctgctcttcttcacttaatggtttgcatcgtagaatcacttgaacattgacttctttattatctctatcgagacggttagagaaagaatcaggtcgtcttctctcgagacgaggagttagaaacggtgcaggtgatggaatcactcctactccacttttccttgataccacctctggcgtaaacgacatcttcgatttctgtgaaatcaaattcaaattccctaatcaattgagaaaggttggatcagaatcccagagattcgaattctaaataagattcacttacaggaaacagagccgaatcctggagatcgaaagagagacttcttttcaagtttgagagagaatttgaagaacaaaaaaagattagggtaagtaaccgttgggagtggaagcagatccaaattcgaattactagagagctcaacactacctttaatttcaaaagtttttttaaaagtcgcaaatatcttcttcttttttgtctcagtattcatatattgctagattatttatttacaggtattatgatattaaatatttcagtcaaaaaattgttccaataatccaacaactttatgatttgtaaacatggaaaaaagggaaaaaaaaaaaaggaattgtaaatctactactttctgattttattcttaaataaacacttttgccaatacaatcatatatatgtgagatggatttactacttctttttttttggggaaagaatttggaatcagcactattggagatggataaattaaaaaaatgatcattagctcattattatcattgatttgacaaaattagagagaaagaaaagaaaacacaaaagaatttgtaattgaatatgagagtatttaattcagtctccaactgttctatgtgtgattaatccaaatgttgtaacttgtgaagaccaatatatattaacaatctgtatacattatacactaacgtaccgttgtaagagagttaatgacattcttgcattataaaggagcttttaagcgtgagttcaagacgggtaaacagacaacaacatcctttaatcttttcttagtctatgggctactccaaacttgggctactccaaacttgggctactccaaattgggcttctctactttaaatcttctactaactatttgggcttttattaataggtttaattactttctctctcaggtctttcttttaactagtttgggcaattgaaaaaacttttggctccttttttaaattttactgaacgaaattatcctaaaacaataaaaaataaagcaaccatattcgaaaagaaaagaaaaatgagcgatgccggcaaaaaagagagggaaattaaaaaaaaaaaaaaaaaacgcaacagtgtcggaaaaataaagctgacaaaaaattaaacgcaaaatagtttggtcgctgtaacttttttgtttatttttttctagccaaccctaataaaccctgacgccgtttcttcttttaccttccttctctcgctcaccgtcgcacctccttcattttttctctctctctcaaactcgtctctaaaactcgtccgtcgattaattcctcgttagtctcaggtatgcttcttcgattctcatctatcatcaacaacagtgctttctcaattctcttagattcatttctatacacaaagtttccacctttttctatggtttgctttcgatcgtaaagtacggatctttgataaaccctaatcttcttcgttcgattgtatatgttcagtatttaattggaattagtcagagatctatttgttgatttcgcagtgacttacaaaaccctaaatttcttactatttgttaatgaatcaatattcatttgattacaggtttgatagaatcattgcctgaggcatctaataatg

SEQ ID NO: 12818 - DNA, 3000 bp, Unknown; identical to SEQ ID NO: 12811
  misc_feature (1)..( 3000): cDNA_ID_3026595_gDNA_ID_2214573_Annot_ID_186252 3000 nt of promoter + ATG

SEQ ID NO: 12819 - DNA, 3000 bp, Unknown
  misc_feature (1)..( 3000): cDNA_ID_2992894_gDNA_ID_2214573_Annot_ID_186250 3000 nt of promoter + ATG
caaccggatcgcaaaagatagcctcaggggatccattaccttaaacggagaagttcttgaatcaagcatgcagaaagtcatatcggcttacgtgatgcaagacgaccttctcttcccgatgcttaccgtggaggaaactctaatgttctctgcagagttcaggctccctcgttcactctccaagaagaagaagaaagcaagggttcaagctctgattgaccaattaggcctaaggagcgctgcaaaaaccgtgattggtgatgaaggccacagaggagtgtctggaggagaaaggagacgggtatcaattggaaacgacataatccatgacccaatcatcctctttctagatgagccaacctcagggctcgactctacaagcgcctacatggttatcaaagtccttcagagaatcgcacaaagtggcagcatagttatcatgtcaatccatcagcctagttacagaatcatgggtcttctagatcagttaatcttcctttctaagggaaacacagtctacagcggctcaccaacacatctccctcagttcttctcagaattcaagcacccaattcctgaaaacgagaacaaaacagagttcgctctcgatctcatccgagagctggaatattctacagaaggaaccaagccacttgtcgagttccacaagcaatggcgagcaaagcaagcaccaagctacaacaacaataacaagagaaacaccaacgtatcttctctcaaagaagcgataaccgcgagtatctcaagagggaaactcgtctctggagcaacgaacaacaactcatcaaacctaacaccatcattccaaacattcgccaatcctttctggattgaaatgatagtaataggcaaacgtgctatattaaactcaagaagacaaccagaactcctcggaatgagactaggagctgtaatggtcaccggaatcatcctagctacaatgttcactaacctagacaattccccaaaaggagcacaagaacgtttaggattcttcgcattcgcaatgtcaacaacattctacacatgtgcagaagcaatcccagtctttctacaagaacgttacatattcatgagagaaacagcttacaacgcttaccggagatcctcctacgtcctctctcaatccataatctcaatcccggccttaatcgtcctctccgcaagcttcgccgccacaacattctgggccgttggtctcgacggaggcgccaatggtttcttcttcttctacttcacaatcctagcctcattttgggcaggaagctccttcgtaacgttcctctccggcgttataccaaacgtaatgctcggattcacagtcgtagtagcgatcctcgcttacttcctcctcttctccggattcttcatctctcgagatcgaattcctgtttactggctctggttccattacatctccttggtgaaatacccttacgaaggagtgttgcagaacgaatttcaaaatccgacgagatgtttcgccagaggagttcagttattcgacaattcgccgttgggggagtttccgaacgatgtgaaagtgaatctgttgaagagtatgagcggtgtattggggacgaatgtgacggcggagacttgtgtgacgacggggattgatattttgaaacagcaagggattacggatattagtaaatggaattgtttgtggattactgttgcttggggttttttctttagggttttgttttatttcactctcttgattggtagcaagaacaaacggaagtgattaaacagttgttctttttttttttttgaaaaaaggtttgttgtaattttgtttcctttttctttcaattatataattgtatgtccttgctatatttaatcgattaattaaagaataataaagtcataatttatgaaatgaaaaataccggtgatatttatatatcttcattctttttattctgtaaaaaatgaaagtgctttaggaaaaaaaaatgctaaatgttaaaaaaaaaacagaaaataaaaatctaagctaattgctattagtatttctttaataacaaaataggattataggcggactttgatttgttcatcaaagaatagtttataacatgaattggtaaacggtaaaatttatcctagaaggtagaagatagatgtcataaactatgcataaatagatagatgtcataacaaatctgatcacttttagatgttgtaagtttttaaagattagaggatccaatttgttataatgaatttgcataactagatatatagtttagtctggataactcattactattagtctttaagcaaatgtgatcagagtgtgcaacatagaagaataccgagacatacaaaacttgcaatttgtaaaccaccattcttattttacaatttacacaaattaaatgggccttattaatataaggcccaacagattgcaaaatggtgaatatggcaacatcgattcttatctctttttaaagatatttaccgttggtttaggacacaacaccaaattattaccgttggatttagtcggttctgtctgaagcccatttttgtttttttctgtcagcgtctgaagcccatttataaacacttgaaaaccatactttagctaccttacgctgttcttcccctttccttccgaaattagggcttccgtgtttcgcagtgctctccttcaatccccaggtatcgaaactctgctcaattcgatgattcatattgaaatttagtgctttcactgctcggaattacgattttatattggttcgatgcatctgcggtgatggtttccttagcttctgtctttccgatttatcgcttccttgtctctgaattaactaaatggcgtcttctttggggcttttttataggtcttgagttagtgaatttttgttacgttcttgttttatagtttctaacaggttatgctcaaaaatctgtggtttctttgtcccttttttttgattttgtagcttgacaatg

SEQ ID NO: 12820 - DNA, 3000 bp, Unknown
  misc_feature (1)..( 3000): cDNA_ID_3026615_gDNA_ID_2214573_Annot_ID_186242 3000 nt of promoter + ATG
tctctcaaaaggtgcgacctttttttttctttcccattttctgttactgtgattctgatggagattctcttctttgttcgattttggatccatatagtctgaaattgaatgtttagctaatcggactttcattattggatctgaaaatttccgtctatctctcgatagatctagtgagctaagtccatttgaaagtgtttctaactacatttgatcagtatcataacagatctattcatatatattaaagtcaatggctttgttttgtttgttatctgtatgcataattgttaaacaatctcttgttacttgatgcagctatcggagattgtaaatcagggaaaattggtttctgatgagatcattgtagacttattgtccaaaagacttgaggctggtgaagctagaggtgaatcagggtttatccttgatggctttcctcgtaccatgagacaagctgtaagtattattcgttttaagcaatttttgataatcaatctccattatcatttctaacagtggattgtcttttggttcaggaaatactgggagatgtaactgacatcgatttggtggtgaatttgaagcttcctgaggaagttttggttgacaaatgccttggaaggagaacatgtagtcaatgtggcaagggttttaatgtagctcacatcaacttaaagggtgagaatggaagacctggaattagtatggatccacttctccctccacatcaatgtatgtcaaagcttgtcactcgagctgatgatactgaagaggtggtgaaagcaaggcttcgtatatacaatgaaacggtaagcccctctattgtccttttccattgctagtttatgaacgatcaggtgttaattagtgcctttttgtatttttctatatgcagagccagcctcttgaagaatactaccgtaccaagggaaagcttatggagtttgacttacctggaggcatcccagagtcatggccaaggctattggaagctttaaggcttgacgattacgaggagaaacagtctgtcgcagcataagttcactatcaaatcccggtatttaaaattctttgcatgtggaatacatatgcgtaatcaattttgtgttggaaataaaagtaaaaagaaaaccttagattgtttttcacctcaatagaaataatcatacacacttgcgcaaactattatttttccaccagccggggattttggctccatgagagaaatatgatgtatcatgattgtttgagattgctagtgacattacaggaatgtatcaatacttctacaccacttgttatgcattgagtttaatcgttatgctcttgtgatatgttttttttggaaaatgtgatgaatgatgatattgcggctggccgagctggctggttaaagaactcaaccagacagtaaagtaaaacagccgcatagattaaacgggaacttataaccagctcttgactgtcctagcattggcggtgcgggatagaatcgttccttacatcatggaattgatgctctcattatcggtcattgtgtattacttgctctgttatttgttgtgatcaaaacctagcttctgttttacgtttgccgtctctgaatttttttttggtttttaactctccctacgtgagtatggatggtaaatacagattcaatttgaaatgctgaacgggacttggctcatagcaatctaaatcacagtgacaaacgtgtacttcgattgcctttgtgatggtcaatcaaagctgtaatgttgttggtttttgacgctaaccggaactaaactcctttcactgagaggtctcgatgagagaaatcattgtcatgaacgaaataatttaaaacatgatttaagattacagaaaatgcctaacgcaaaattattgacgaatcacaaggcaaggaagaagtagagaggagagttgataagaaaagagaaatcttcatagaaactaaaactgtgtacaagtgtttatatacattgattaagcttcaacaatcttcttaattaaccacattgattagcttcaacaatcttcttaactaacctaacatattagttagacaattaataatgtcaactccaatatttgttgaaactccaatattgttataaattgcaagctaacaaagtaacaattgataggtttaataaatattttcgtcaaatgatcattgggtagtggtatttaataatattttattaactcatgtagtgaaaagtattggacaagatgactgaattttcttcgtctcttatctaacagaggtgtaaccgaaataaaccgaattcaatttggttgggttgagttaaaataaaataagttggtacagttcagttcacgtgtttacttcgaacagaacaggctcgtgcgcgtgtcaacaaccaataagttcttttggtcgctgtagtcttcaactaaaaccaaacgacaccgttccttgtggccgcgttttccaactaactttcaacttcaactaacgttcaacgagtgtccatctcctctatctctctttttccttttcattggcttcttcatcactatagagactaaaactgaccttgatccatccaacgttccctatactgacacgtgtatccatcacagtgtcggctaaagctcaaggaactcataccaagaaatacatcatcatctctcaataatcacaaaccggatccggatcaatttggatccatcagattttcttcgttccctaactcctaaaaaggagagattcttcaaatccttatcacaacttcagtttttgcattcaccgtcgtgagtgttctacttttggtaatgattcactagtcaagtttctttctttatgctataacttgcaactagatcttgtactaatggaattgatgtttctccaatcatcttctttgattttgctccatctttcttttcctaatttggaaaaatgagtctttacctatagaatctgataaatatgtctcttacataattgattaaggtcaagta

SEQ ID NO: 12821 - DNA, 3000 bp, Unknown; identical to SEQ ID NO: 12804
  misc_feature (1)..( 3000): cDNA_ID_3409207_gDNA_ID_2214573_Annot_ID_186241 3000 nt of promoter + ATG

SEQ ID NO: 12822 - DNA, 3000 bp, Unknown; identical to SEQ ID NO: 12803
  misc_feature (1)..( 3000): cDNA_ID_2990697_gDNA_ID_2214573_Annot_ID_186240 3000 nt of promoter + ATG

SEQ ID NO: 12823 - DNA, 3000 bp, Unknown
  misc_feature (1)..( 3000): cDNA_ID_2709644_gDNA_ID_2214573_Annot_ID_135125 3000 nt of promoter + ATG
taaatttttcaaagttgaatctgataaattttcatttcatgtctcttgtcataacaggccagtgatcgaccagaacttatactatctcgggatgaaatatacgacagctacatttgcaaccgccatgtacaacgtcctacccgcaatcactttcgtccttgcctatatatttggcctcgaaagagtaaagctacggtgcattaggagcacgggtaaggtggttggaacattggctactgttggaggagccatgatcatgacacttgtcaaaggcccagttctcgatctgttttggaccaaaggagtctctgcacataacacagctgggaccgacattcatagcgccatcaaaggcgcagtattggtcacgattggttgttttagctatgcatgtttcatgattctccaagtaaggcaaacaaaaaatatataaaaaaacacttatggatcaattttgacaatgaatcaatgtttttcaggcgataacattaaggacttaccctgctgagctctctctcacagcatggatatgtcttatggggacaatagaaggaaccgccgtggcattagtgatggagaaaggaaatcccagcgcatgggccattggttgggacactaaacttcttacagccacctatagtgtaagcatacatatctcagtagactagtgatttcatggactacaccatatatgttgataacttaaaattgttggaatataaaatggatgcaggggatagtgtgctcagcattggcttactacgttggaggagtggtgatgaaaaccagaggtcctgtgtttgtgacagctttcagtcctctttgtatgatcatagtagcgattatgtcgaccatcatctttgctgagcaaatgtaccttggaaggtaagcaagacacaaacaacatctaaaacgagttttaaacaccaagattgaaaggaggtaataaaaaaactttttctatggcagggttcttggtgctgtagttatatgtgcaggattataccttgtgatatggggcaaaggaaaagattacaaatataattccacgctgcaattagatgacgaatcagcacaaccaaagctagaactaagcggaaacgggaaggataatgttgatcatgaagtcattactataagcaagcaaggagaacaaagaagaacagctgtagaaacagtctaacttaacggtatcggcacaaatgtttttcatggaggagtaattaacgtatagcagtttcatttgttgtccattatgtttcagagcacaatgtcatagaattgctaactaccatgggagaataataattgtctaattaagaggactaaagatgcaaaaaaaaagatgaaattattggattcattcaaatacagaatgaatatattgcagttgtattggctacacctaaacagagaatatatcgactgtttgggacaatgatttcggtaaaccggtttagttttcggttgactttgagtcaaatgacaatgaacagaaaatagtgattgaaccggtatgtggtctgtctgaggtctgacttctgaggatctcgtctattccctcacgtaccacatttgtttcctcctatcacctttccacaagatttaatttctcacctattagcacttctctgttttgctgctaatttaagtattacgacgccgtttctatatcaagcacttgactttatccaaaaaaaagtctcacaaatacgattgaagagcaaaacagcgaaacacttttcaacaccggttggttgttgacgtacttcattcttgcgctgaatctcctccgattatatttgataaatctctcattggacttcgtctacctttttcttacatgatttcctatttgaatttgtttacacagctcagttttggggtttaattgatcaattaagagtttatcggtctagttttatgggtgtttctgatccatttctagcacttgaaagatctgttatccattcaagtggtaacaaactgaattatctatatttatataataatcatttaaaagatttgttatcaattttttttaatttaattatttggatttactgatttctcaattaatattagatatgcataccctaccacgtacatgtgggcatcagctagagatttaagcaaatcttctgtctaatccttgacgtggcaacataatattattttacgtaactgagagtttctaccgatccgtattaatttaattaatttactgtaattcacaaccacataacaaacgattaagaattgaaaacttcatatgtttaaaaactgttactcaaacatttttcataatttcttactcattgtccattattgtttcgggtcgatcgagaatctttagaaaaacgtgaaaatcttgtcctcttaaatatttctgtcacatctgttttttttttttgtgggtacaaagtcacatctaagtttcttctgacatcgtcgccttttgttctacagacggacaaacgaagtacttgtgctattaagaaccaactgtttacttccataacgttactactagttagatagagaaaatgagagaatattgatacaacgtgcgttcgacttaggtcaagttaaataggtgagtccacagcactagcatttcaggtaggatttggcatcttgcctcaaagtatataacaaacaaataatacaaaattacacacatattgacatattatgtgataataatatatttgggaaattttcaaaatagactgttttcttaaaacttaattaggaatttgggcagtttcaatatttaaattagaaaataggcatgttttactgtgcaacactatgtagaagattttctaactctcaaaatctttgtttatttactatttgtgccattgaattttttttttctaatgtttccacttacttttttttctttctctctcccccttatctcttccatcgattattttcagcctctttcctctatttttttgttgaaatcctctaaatgatcttgcagagatg

SEQ ID NO: 12824 - DNA, 3000 bp, Unknown
  misc_feature (1)..( 3000): cDNA_ID_2709695_gDNA_ID_2214573_Annot_ID_135126 3000 nt of promoter + ATG
ataattgattttgaaaattttgaagttaagaatttggttaagagattgaaattttggcaatatgcaatggtggactcttaacttgagttcttaaaaaaaaaattgaaaaaaaaaattagaaacattataattttaaaaaaaacttaataattattacaactcataaaatttgaaacatacatgacataaaattttaaacaaatatgacaaacagttagatttaatacttaatttatctaagaattaagattaattgaattaaaacattatatttaatacctaatttatttaagaattaacctaaaaaatattagattagatttaatacttaatttatctaagaattaagattaattgaattaaaacattatatttaatacctaatttatttaagaattaacctaagaaatattagatttggctcttatataagagttattcttaacaattaattgaattataacattaaatttaagacctactttatgaaagaactaacctaagaaactatcaataatgatggtcttatactttatgttcaacgagaactcgctagacatagaaaatctggattgtatttgaacttagatgctgattttcgcttgatgaacaactaacttccatcaaaaggtttaatcctgattcataatcctacaacttataaccgccacaacattaaaataatacacacgtatacccatataaccatattaaaggatcaaactaaatcgttgtgtataaactatgatatctacatctattgtttggttctttgggatagtgggatactatacttaactaaattactccatattaaaattttaatatacaggattgtgggatactatacttaactaaattactccagttatcttgaacttaataattagatgataatctattctagtcgtatgtagattactaaaaatatttaaatagtatatttagttaagtatcatctatcttgaaaaacaagtgaagagaaaccgtgccatttcaacgttcactaaaagagggagagggaccattaaacaaaactggtttgagttcctgaatttttctattatccataatttgtataggtttcaagtgttcaaccaacttttgacttatattaattttaattaagtttaaatagattctttcaacgttttaaaaagaatatttctattataaaaatgtataagtattgtccatgcaaaacgtggataaacttctctagattttatgaataatttttaagattatgatatttcttgagacaaaagattttacatcatattataaaaataaataaaataaatttacatcaataaatatcacttatagcattattatagcaccgaaactgagctcatgagttaaataaattttgcagatttattaatatcatgagcccactgcagctagagccaaacaactttaaatttgactcaccaaaaaaaaaacaactttaaatttgatatacgtcttatatcgtgaatattcataccttccaagtgcagaataatgaatcaaaaacgttctattgatagagaaccgatgctcctttttctataacaaaattatatggaagaaaataatgaaagtgattccaccagaaactaagtggcacaatggaaacagtacaaaggacccaaaatattggcgattatacgcacttacatcaataaatattccatgaactaaaataaattacaaaataacctaattaaaaaggaaaaaaagcaaatctaaccaatgatcactctacccaacagtgtcggtatatcgtgactcattaatcattagttcatttttatactttatagattggaaagaactcgattcatcaacacctctcctggagttaggcgaagatacatatatggaacattagtgaatgggcttggaataatttacaaattatttttcttatataaatgatgaaaaacaaattatacaactcttattctgagtaacagctcttgtatttcacaaaaaacggcacaatatcatatatactgttttacacacacacacacacagaaaaaaatcatgaaacaccacttaaaattttctctaatttccaatacagacaagctcttggattagaggcctaatttgtgttgtaattggtatttatcaaatcattcttaaactatgccctatggttcacaaatcattcagttttctatgttttaataatctaataaataaaattagcatttacgtcaatattttttttttgatatatactctctcggctcattttaaataatatataaagtctttgtacatagattaagaaattatatctctcttatactaaaattttatttttacatatctaaaaaagttcaaccagtgaaaaagtaaatagaagaatagaaagaattaaaaacaataaaaaaagacagtaaaatttacattgaaaaattaaaacatcatacaaaatgaaacaacaaaaaaaaaaaaaaaaccaaacatcaagtaatatgaaacggatgatacatttttaacaatacattttttatgcggaaatacatgatggtagttgacatgatggtaacatatatacaatgttattatcatgaaaatcaatcagatgagagatagtgatactagcgttcgactttgatgaaatttgcgaatccacggcactctgtattttgtttaattagttcggttatgtgacgatcaaatacaaatttctatgtctttttgttgataaggtaaagaaataagtcccatgatttcagggtacggtttggaaagtagcctcaaaatacataacaaaaaggaaaaaaagaaaatttacacgcatatttatttacactaataagtttacgtagagagaagaatgttcacatcacatcacatccttttaactttggctctatataaagagagatagccaagacaatcataacaactcatatcaattttttaaaaaaaactctccatatatctattacttctacgctaactagagagggagattattgctcttaagtgatg

SEQ ID NO: 12825 - DNA, 3000 bp, Unknown; identical to SEQ ID NO: 12815
  misc_feature (1)..( 3000): cDNA_ID_2994470_gDNA_ID_2214573_Annot_ID_135129 3000 nt of promoter + ATG

SEQ ID NO: 12826 - DNA, 3000 bp, Unknown
  misc_feature (1)..( 3000): cDNA_ID_2712649_gDNA_ID_2214574_Annot_ID_135141 3000 nt of promoter + ATG
agatcgtgtttttgcagaggcaaaaaaatactttgtgttacggtctccacctgacagccatgttttccggctcttaagtctctagaattcttcttcagcagcataagccttcgacagctgcaatctgagctctcggatgtgttgagttgttgtgccatcagagtgagctctatcaattctgtttttgagaagggctatatcttcttgggcatttgatcgatatcgcctcttccattgagatatttctcttctgcaggcagtgagtcgtgatcgtagattgtcgtcctggtgaaagattctccggttccacccacgtctgacagcatcactgaacccatcacgctcaaccattcttccatcaaaacagaactggttatgcttctgctcaaaatcgctcgtgattgttgtgatcactggtcgatgatctgattctattaactcaaggaattccatgtgggatgcgggaaattgagttaaccattcgttattcaccaaggatcgatccaagcagcaggcaacatcatgagtgtgtcgttttccgacccaagagaaagggtctcctgtaaacttgagatcatggaagtcacaggtttgtatcattttcctgaaatcaaagaaagagctttctggcctcaagttgcctccttttttctcatggttgcctcgtatttcattgaagttccctatagccatccaaggacctgttctttgtgttgctgttcgttctaatctttcccaaaccaagtgtctatggataggatttgggtgaccatatacacaagataaatagaacccaaatccattaatattaacaaaagtatctacaaggtttggggattgataaagaacagaatacagaaatactacttttccacattaaagcaattccaccacttagaccatttggaggaaccattacaaccctatcataacctacatcgctgcaaatatctctgacgatgtcattcctttacttcgtttccatgagaacaatgatgtctggagagaatttcttctttatctcctttagacgtcgaactgcgaggtcattgcccagtcctctgcagttccaagcggctgtcctcatggaggaagagggggttctgggcccaccgcgcctctccccacgtcattcggctgaaccgtctctccggagcaaccactgctttccccagcctcacggatcaccatcttagaaggctcgtgttcttcatcttcttcgatggtgtcctctctcttgcgtttgcccctatccgctgccacatcctcacgaacatagtctctgttcactccattatttgtttccatctctccatggtacgtggagtaacgacatggctcccaatcctggaaatcttccacggcttcatgatgggcattcatcactaatgagagttattttatttattattgtccacgtatttattttgtttttaatgtatttttttttttttttgccttttacagttcctaatccagatttaaatctggatataaccctataaattataagatatactcgtccacataatattatcaagttttttagttttttagaaaataaaaatctattctaaaatttgagaaaatcaagtgagataattttgtgcctcacaagtcacgagattacttagctcggaagggttttgggctctacgtgtgaaaggcataagatattttagttacttttatgctttacaatttacattactagagtacaaacaaaacaacagctatcatggatttttatgacatcatcaatttacgtgtgtcatttgagatttataatctttattttattatcacttctattttgttttaatgagttcaagatcttttcttgaaagacatatgaagactttaacccaaaaagctaagtattgtctttgatgaaactttgaaatcgagaagttttcaaaattttaaacgatgtcaaccagtattttttatttataaaacagtatttttctctaaatatttgacaagatttttttacccccgcattagctaaaacccattttcgtacatatgtttacaaacagtgtccgctcaacaatttcatgggtgtaggataatttttttttatattttgttataaaattttttgtatgataatttagttaacaaaaaaaaaaaaaatgcattaaaaaaattataggtccattctaaattttatttttgtgttatatctaatttttaaaaatattttttaaaaaatatatgtcccttaattgttaaaacatgggtttggattcttggctgtcgcaccgcttgcccctctatttaaaccggcactgtttacaaattaaacattatagaaaataattcttaaaaaccggactaagtaatgaaaattttaaattacaaaaacgaagaatactaggaagctagaactagggaagaaaacttgaagcaccacattagtcaaagagatcgaagaaagaagccattctctaagaaaatttaccattaagattgactatgcactttatttaaaacacttgccaatatatctttttcaaaagtttttttttcataactcatattaagactttcatcttcaaattaaagggggatgagctttccggatgatacttagacctgagttgagtcaaaatcgcatctccctacaaacaagttcatcataaaccagtcgtagggtccaaagactttcacgatccattaaactgacatcttagtgttcaaagatatttttcttggtgttctaaaacatatatcttctgaacatggctcaattgtgactcctctcaagaaaatttaaaggacttgggggaggactatattattatttttagttccccttaaatatccacataataattactgtttgttgttttctttttaattcaaacatacaccattccaaagagacctttgatagttttctttactaaaatattattgaaaattacttataagatttattattaacatgttttagattgaaaattgctcatacaggcacataaacagattgag

SEQ ID NO: 12827 - DNA, 3000 bp, Unknown
  misc_feature (1)..( 3000): cDNA_ID_3026660_gDNA_ID_2214574_Annot_ID_186290 3000 nt of promoter + ATG
atatgattttccaaataaaaaaactgttacagtagttagtattattctattaaaaaaattatgaaaaaagaaaattataaatcagtcaccataaggatttcaaattacaaatctgtcgtaacataaaaaaaatttaaggtcattccagtaatttattttattttttattaaacctggcatcaaaccacagatttatggtaatataaatttatctgtcacaacataaaataactctgtcataacacaaaacattatattttagaaaacaaatatgccatcaaacgatagatattgtgtaaaattacaagaatctgttataacataaaacaagtctatcataacattaaaaaaattggttatcgttagacctcattctagtaattaattttgtgacaacaaatttgttacaatgtgacatatttttttaacaaaattataaatctgccatcacttaatgtgaaaataatatataaaagtaaaatttcatatatctttcctatatatcacatgttatttaaaataaataaattattactgtatataaattccaaaattgtattgtgtatcaaaatatttggaaacaaatcagaatagattttgaattggatcctaaaaaatcaatcctacttaagatagtaataataataataaatactgccttattataaaattaagttatagttgaataacacactctctgatgataaattgtttacacgtaggttaactaaaaaagttttgttacacgaatttagccacacacacgtgtattatataaacacgaatacaaaggaagaagaagcaaagaaaaaacagcaaagagaagtagagaacaaactgaaaatggagatatggttacttatcttgggctctctcttcctctctctccttctcaatttactcctctttcgccgccgtgactcctcctctcttccgttaccacctgaccctaacttcttccctttccttggaaccctccaatggctccggcaaggcttaggtggactcaacaactatctccgctccgtccaccaccgtctcggtcccatcatcacccttcgcatcacttcccgccccgctatcttcgtcgccgatcgttctcttgctcaccaggctctcgttttgaacggtgccgttttcgctgatcgtccaccggctgctccgatcagtaagattatttcgagtaaccaacataacatcagctctagtttatatggagccacgtggcgtcttcttcgccggaatctcacttctgagattcttcacccctcgcgcgtgagatcttactctcacgcgcggcgttgggttcttgagattctttttgatcgatttggtaaaagcagaggtgaagaaccgattgttgttgttgatcatcttcactatgcaatgtttgcgcttcttgttctcatgtgttttggagataagcttgacgagaaacaaatcaaacaggtggaatatgttcagagacgacagcttcttggcttttccagattcaatattctcaatctctggcctaagtttactaaattgattttgcgaaagagatgggaagagtttttccagatgcggagagagcagcatgacgttttgcttccgttgattcgtgctcggagaaagattgttgaagagagaaagaatagatcatcagaggaagaagaagacaacaaagtgtatgtacaatcatacgttgatactctgcttgagctggagcttccagatgagaagaggaagctgaacgaagatgagattgttagtttgtgttcggagtttctcaacggtgggactgatacaacggccaccgcgttgcaatggatcatggcgaacttggtgaaaaacccggagattcagaagaggttatacgaggagatcaaaagcgtagttggggaagaagcaaaggaagtagaggaagaagacgcgcaaaagatgccgtatctaaaggcagtggtgatggagggtctccggagacatcctccgggacattttgtactcccgcacagtgtaactgaggacactgtgttgggaggatacaaagtcccgaagaagggaacaattaatttcatggtggcagagattgggagggatccaatggtgtgggaggaaccaatggcgtttaagccagagaggtttatgggagaagaagaagcggtggacataaccggaagcagagggataaagatgatgccgttcggggcgggtagaaggatttgtccagggattgggctagcgatgctgcatcttgagtactatgtggcgaatatggtgagggagtttgagtggaaagaggtccaaggtcatgaagtggacttgacggagaagtttgagtttaccgtagtcatgaagcattcgcttaaggctcttgctgttcttaggagaagtcactagtcgtctacttcttcaccaaagactaggttatgtttgaggttatgtgcattttgtttggtgaagtcaactatggaactctattttttgtaaaatacattttgtaccttggaataaaataaacgatagaaacaacaaaagaaattttaacgaaagtggcaaaaaaaagatttcatttcagtgtttagcaaagtgagatttcaatctcaatttttggcacttcatttgttttatgacaaatatactcctaatgagatcaaccaaaccgttgggttgcggtttgttttggtttagttcctgcggtttaatttaaaaaaaaaaaaaattgaaacgaagaaatcgaagaagaagaaaaagagaaagcaaaagagagatttgagtagaaataagttcgaattcatcaactccttcgtttttcgacatcacttcaaattgttgggtttatgatttccgtcgaactttccacattcagtgaactctaaaatccggtgaagtcaaagttcaaaattcggcgaagtttcgacaattagtgaactccaaaatccggcgaagcaaaaatcgcactttttccggcgaagaggaattgagaaacctccggcgcgagatagcaacttcgttatg

SEQ ID NO: 12828 - DNA, 3000 bp, Unknown
  misc_feature (1)..( 3000): cDNA_ID_3026623_gDNA_ID_2214574_Annot_ID_186305 3000 nt of promoter + ATG
aaacctattcactactcagacatcataacagaaagcataaacgttgaacaagttgaaaacatgataacaacagtgtaacagcaggatgataacagaatgaacaacagtaaacgaaatctagaacaaaagctgaatactgaatagataaagagaaatccggattacaaaaggtctagaacacaaggtctgcggaaataaaactagataaaaacttcttgtctgcgaaaatgagaagtacatgctacttatagccaaatatcccgaaaccctaatactcaaaacgacgaagtattgggacgggttaagaactgtactcgacccatgtggtcgagtgaatagctggagtcctcttttcttccttgtgctcgagtgtctggttgagtgcagaatgaagaaggctctgaagcttgtcatcgagtatgcagtcgagtggtgtaagaagatactcgacttccaggttgagtgacgaggtcgagtggtggtctgatgatggaggtgaagacactcgacctcatggtcgagtgaagtgatcgagtgatggtctggtgatggagatgagggcactcgaccctgaggtcgagtggtgaagtgcagtggtgatgtcctttactcgcctggtggtcgagtggtctcttgagatcttgaagctcctactcgacctctgggtcgagtggtttgtcatgatcaggtccgcttcttccagatagctcgtcaacagctccaaatcacctgaaatcaacgcaaatatgcaacatgcatgcaaaactatcctaaacatgcaaagtgatgacaaatgatgtgaaatggtataaaacagtgatgatatgatgctaaagtgatgacaaatggatgctcaaaacatgcaaaatacacacttatcaactcccccaaacttagtctttgcttgccctcaagcaaacaatcaagaacaagctggaggtgaggtttgaaagcagtgactcagagcgaaagcaccagatagacgagatgaaatcaatgtccaagttgaaagttctaagctgcaagatcgaattctacttaaaaacgttagccatgcctcatcaatcaatcaatccgactcatacgctcgacctacccaagttttcaaatctaccaattcctttaacattgattagttctggaacgtgaatcaagcaatgcatcatcaaagaactcatttggctaaggtaaaaggtcaagagacaaagatggtcccttacagaataggcttaagtaacaggggatctctaaaaaaaaatgattaagctttagtagaatgctaaaggtaagtcccaatctatgcatacagagataagatcccatctacccagagtatatcaaatgaagctctaatggtaatcccatctccaatcccaatacaagaactaaactctaccctttgcattcatgaatcttttaagccctttttctaatcattcttttcttttctcttaactctaggagaagctttctcaacactttgatacatctagcggatttggatttctttaacaactaaggttcctgtttttaacattttaaaaccaagggcttttgcccatcttcaatagctaacaggaactctttcttttttttacaaatcccaaaacctttactagactttttctgcttctttagcttacttcacttagagtcttttactttttcttatcaatgaatcaacccccttttttttttctttaaaacacatcccaacccaaagtataagcacccagctagtcctatctagtccgaaaaatgcgaactagaactacatgagacactatctctgtcgttacgaacctaacactttctaccaagcttaatcggaataagacctcacaaacactcacaagtgatatagggcttgaaagaaagtctaggtttgggtttgggtgatcaatctaaaactagcaataagaataatcaagatgaagaactctaagattaatcctaaggggttttcgatctactaatccatctaaatccctatagagactcactaaacccaacaaagtgataactcagacatgacaacagaaacacaaatcataatttgaatagtttgcattgatgaattataaatagagtaaaaggagttcaaaatcctctctgtagggattggattcttctctcaaatgtatatcaatctctaaaacaaaacttaggtctaacaatgaacaaataattaggtatattcgtgactaaaacgtgcaaggactacattgcaaatcaggaaaactctagggcttctcaaagacttggcagaaaacagaaattccctcagccgaaataagggtgtcgatcgacataggtgtcgtgtcgatcgacaccatcgagtgaaaaacgtctttgataatcttcattgctgaaaagcttccaaaagcttccaaaattccttattatgctccatagctcccaaatgtgtaagtgtacctgaaatgactcataacatacgaaaagactagtaacactacaagaaaacaggtaaacgacgactacaatcagcgacaacaaacgtagtcgtaacattatatgactttttggcgacggatttacgactcgcatgcgacaacacgaaaaattgtagttacatagtcgttgttttacgactatcttatgcaatcggcaaagagtcggcaagtaacgactatttgacgattatattattgaagggataatgttgtcgttgcttagtcgctaattaacgactattctaccgtctattttatttagtcgctaatttggcgattacaggacgcctagacgtcttagtcggcctgtagtcgtagaaacgttgcaccgtagtcgtataaggtagatggaaaacgtgtttgcattggtaagtaggtacacctaattatttagttgtagtcgtaaattagttacaaaaattggcctatataataaacgttcacgcaactcttctttcaccaacaaatcaaaacaacaacaacatcaaagagaaaaaaaaaatattagttactttattgtataatg

SEQ ID NO: 12829 - DNA, 3000 bp, Unknown; identical to SEQ ID NO: 12826
  misc_feature (1)..( 3000): cDNA_ID_2712649_gDNA_ID_2214574_Annot_ID_186294 3000 nt of promoter + ATG

SEQ ID NO: 12830 - DNA, 3000 bp, Unknown
  misc_feature (1)..( 3000): cDNA_ID_3026676_gDNA_ID_2214574_Annot_ID_186284 3000 nt of promoter + ATG
ttagcaatcaacctctctctttggcatttcatcgagcatcttgtgggcgctcagcaacatcagacatttgcagccataaaaccatctttagcaaacccaaatcagtcttaacgcattatacgatgaacgtaatagccctaactcgtttttttaacaaaatcttgatgaaattagaatttgaagaaaatcgcgagagagagagcgaaaatatcgggcaaagaaaaatatttaactctccttctttctttctttttttgttaaaaatgcacgaccaatcagatggtgacatttaggcggctctctcaaattctaaaaactctctttagagagctggctctctcatttattttcagtttagatttatttttttgtaactttaacaagggaacccatacaaatgcaccagagaactccccattggagttggcctaaggctactaactttcaagactttaaaagtgatctaaagtcctaacaggatttttttttttgccaattaggctttttttactttatttttttgtaagttctcaaagttttttttatttttccttatgttttaaagcctcatatagaatcataaggaatttttttagtattatttataatgtttgtttattgtttgaaatttgttatgatactcctactaaatatgtctgcattggttagaccggtttaagtatcataagattttttgttacaaaatcaaaaattaatatattaaaacacaggattacaaaagataatattacaattaaaaaaatgtagaatatacttaagcaaaataaaacataaaattcaaaaaaactaaaaaaaatgttctagatagacggagatctacgtcataccggctgtagctgagaaaagatgagaagaaatcgtcagatcgccgtaagagcgaaagagaaaattttgaaagaaacaaaataattttttttttattttttttttattttttttaccaaaacaattaatgcgacaaatcatggcctgccacctaaattgatactgggtatcaaaagtctcaataaactgatacggctcaccctagttttatgtgtttagcatacatggtctcataaacaaggatttcaaagtttttcttttcttttctccaaattaattattaaattttttttttcttctccccaaaataattaacaactttgtaccagtttacatatattttttcacaaaatatttttaataaattaattattatcattttttaatctttcttctaaaatccatttcactaggaattatttcatttttcatcatcaccattaattggatgtaaaagcgttattgaattagttattttttggtgaacaaacaaaaattagtatttttcaaatactatacatttcacatatgtcattcaattagttcattaattgcttcatcattatccccacttattaatgtgtttagatattaaattttggcatgaaacaaaaaatgtaaataaatttgtttacttagaatttgttttctagatatttgtcatttattttaaataaagatttattatttaataatttgatttttaaaaagcaccttcgtaatgcaatgtttggttattaaaaaatgaatgaataatatatatctagtttatttcttcagaatatttatgtatccatttctttatgaatttttgtattttctaactttttatcattataaaattttattgttacataaaattatttctaacattgtttttatttattattaatattaatttataataataataataataataataatataacagtcatagcttctacaactttgttttaccaattaaatttttatatctaaagtttctacagcaaaagtctttacaaccaaattttctatagctcaaattttaaaagtcgaagtctttaaagccaaaactactaatcgctaccaatcgtcctatgtgtttacgtcttttggtttgtatatcttgctgtcatttgaaattttaaccctataatccggatctgaaccggatatcccattttttcaggaaatcctattactacctgtaacggtctcttgaatttaaaacaaaatacgtgtgttgcacgtgaggtcgaatgatcatctctcatgtcccctttgtgacaccacaaacctctaaaatccttttctactacatatccctttttctttaatgaaatgtgtttagaccattttgcccttatcaggattaaaggaaattcaaaaatgaaataaaattaaaaacagaaaataaagaagaaaacaagaaaaaaaaagaattcgtcacctacctcttttttccccgacgctcttccgacgagctcctccaccgtcgacgagctctacattgttgtcatttattttcttcctacgagctgcgtcgagcattgaagtccaagtatgtatttagaacaatctaaaagatttctctttgaatttacaaattttgaggattttgagattcaatccaattagatttgggttattgtgttctagcacctacattagaagtttaagtatagatttaggctcaatttggtctgttaatggataagcaattgatttcacatactgattcatactaaattgaactcaaatcgaatatttgttcttgtcgcgaaaataatactggtcgaactaggtatagttgtacggtacaacttgtaccgtaatttatatagatagtatgttttaatagcaccagtattacttagacacgtagtatttcatatatgtaatagtattactcacacatgtaatatttcggaattagtactagtaaaactgaaaatgtagtagaatcggtattactagtaatattgactgagtatgtgtattgttttggcaggttacaatgaaagagaacgtgatcatatattttaaattcgaaggtcacatgtataatgtgatgatgaagacattaggggagaagataactctttcaatgttagaagataggatattgacgaagcttggattagatgcaaataaggttaattgcatatg

SEQ ID NO: 12831 - DNA, 3000 bp, Unknown
  misc_feature (1)..( 3000): cDNA_ID_2706877_gDNA_ID_2214575_Annot_ID_135151 3000 nt of promoter + ATG
tatcaagttgcggataagggtttgatgccggtcatcggatgacctttagtattttaaagagctacatagaagaattgagaaatagttactgatttttcgtcctagcaaatcttgttgtggacagaaatatattcttaagtaaaaaagtacttttctttctccctttatctatgttttatctatttttgttcttttaccatttccattatatttatgtatctatattttttttgtcccccacatttatgcatatatctaaaatctaccaataacagtactgtttgaattacttggtaccttttcatgcatgatccatcgtctaagtagcaaaaataacaatgaacaactgttatcaattaaagctgttttctttttatgaacaaaaaaaataaaaatctagctctattatatatttggctagaaatagaaatatatgtatgaattgatcaataaatctttaagaaatcaataatgactaatatattagatgattcatgaactacttgtccagaatcagaaactaagtgatggtggttatttcttttcttttttcccttttttcgtgtgtggtatatgtgtttttcgtttgatgttatgatattttatgtagtgtgtacataattttggacctagaattcacatgacgtctacatgatgctctaaactttctatatgtaggcttcgctccaattaaatataaattgtatactaataaacacccaaaaacagcttgggctaaaataaaaaaatatgatatcgttttcttgacatcaaattaaaagttttgtttgatttgtttccgtttacatttgcatatttaatgttttaagaaatacaaaaaaattccgaaagtattatgtatatatagcttagatctacatatatggaacaattaaccaaagatggacctctagccaatattgatcgtcttctatcatttacacgtagtgagagtatatatgtattaatgtatgctgtattagaatgtgttaataattctatgtagttaaaaaaaaaaaagaagttatttcagtaatgtcattggtaacgtctctttcttctatacgaaagatcgatctaagtctgctgtaaattactgttcgactatatagattggactaatcatatttatatttgtgtgtgtataagaacattggagagtcgacaatcgttaagatctttaattagtttaattatgtcgttctcgtaaacgatcagtgcattattagtgttttttttttatatataattcttaattattcgggtatatcctcatttgtgctgagcaaaaaattaatgaaaaatcatttagactgttttggtcaacttttggttacatattagaaaacaattgcaaacatcattactcagccaaatcaaaccggtttgatcggaaatttggatctgtacgttaccgtatcagatgatcaaatcctaaacaactattatgtgcaagaaatcgtggaaattcaagacaatgtattaaaaaaaaattataaagaattttaatatataggttggtctgcgacaaaaaatactgaataatttcatattttaaccggaacaaaatgtgacttatctcacaaggccacaacaatctcatgccttttactaaaagattcagattgttgcgaccacataccacttcaagattaatctagtaccgtaactaagtaatgtcatttgttttttgttatgtcattgtttgcacagaagaaaaaactaaattatgtcatcttctgatagaaaatgactactttatttattctgaaagcttactgagctaagttattttgctagaacctgttctaaaaaagtcgaggcatttcgaattgtttgttgacacggacaaagtcagggaaaaattcaaataaattcaaaattacttcatacataattattttgcaacaaatacataggttataagttagtaggttacattatattgatcacattgcccacattggtacaactggtcatagtatatgatacatattatacaactgacagacataaaaatctctatctaaaccgttcaaatatcatgtagatagaactagaaaacttcagataataaagctgcacactaattataattaacaaattggccgtccaaaaaaattcgaatttgaaaagtattaaatggaatatatattcctttgaaggcgatttccatcccatcgatttcttcctaatgttggccaaacatattttactattaattatatatccaggactgcaagatccatatcggtgattaccaacaaaattcaaaacagatcaaattatatcttttgtttgttcctaaagtcaatagactgattttatataatccaatcctatgagtctacttcgtattctcttatattttttaagctatgtatttataaactaatacgaaaaattttatattgtactgcactatatcacttaagtaaacaacattgtttagaaataattcttttgagatttaataattaatagtggtccataaaaaaatagcatttataaactaattttagaacggactatcaaaatattattacgcctacactacaatcacttagtttttgatgttgttattttgtttatactttagacttagagtgttaattaaagcatttctacaatcaaactcatatattttgtttgttcaagtttatattaaaacatatcttaggactttaattattgattaaacaaaccaaagcaacaaatagaccgaaagacgaccaatcattgttcggctactaatcaaatttttttttttttacatttttaaacacttggtcctaaacgactcttatatatatatatataaagagatcaatacaatatagtcgtgatcagagtaatatccatctctggaatagcatttccccacccaaattcagaaacaaaactacaaaagtgtatcagcccacaagggttcctcagtcacaacaacaaaaagttattctttggttacttgtggtatacgtaagtataattgattagatg

SEQ ID NO: 12832 - DNA, 3000 bp, Unknown
  misc_feature (1)..( 3000): cDNA_ID_2709775_gDNA_ID_2214575_Annot_ID_135153 3000 nt of promoter + ATG
gatagaaaaaacgtacgactctgagctttacaacggctatttggcaatttacaacggatatggcgacttacgctattttactgtaaagattgaaaatgatatttgtgtgtcgttaggtaaaacattagtgaaaacaaaaggtggatagacaagatatggtcatatctatctaaccatacacagagacgtttgctgccatgcatgcatgatgcatatatatatatatatgtggatataaaatatatttaatttatatacacatagtccatagatagatagataaatagacgtagagagggagagagcaggagacaagaagagagtaagcacgcagagctttcgagcatgagcatgctagaaaaagagccatgtgtgctcactctcttctgtcgccttcgttattgctattcccttacctcctttagttgacttgcttcatcttcttgcatgcatatgattttgatgttatattagcctcggtccctaaaattactatatgatatgatgatatgatatgaaacagtttgtctgattttagggtctatatataaggattgctagggtctatatatgatgatgcatgcatagatttcatcatcatcatccactgaccactagctacgtttaatttatagaaagattccgccggattaaactcttatttcctgtcaatttgagcaacaagattctctcttttcaattatatatacataacacatgtctataatatacgtacaaaccaataaaattggactcttaacaaaattttgagagtgagagatcccacttaaaacgaaataaactatttgtttggtcattgcatgcgtaaacgaccacttgaacaattaagtatacataacataggtctagatctatgtgaaagattcccaaacttaagatctctagctagaacattcattgatcctccaatcaaaaaccaaaggaataaaaagtaatctttgtaagggcgaatgtaaaaccgaaacgtaagctagaggaattgatattaaaatggaagtaaaagcgaatattactaaaggttttggagttaattaaataaagacaaaagatgcaaggacaacgaattatgaacatcttcgaaatacgtttttaatattgttttggcatttgatttgatttgattctccttccacattcccttgttcatatgtgtttgtgtctcacgcaagcactacataagcggtccccctaaatacgtttctagaaacgtcaacgtttattcaatcataccaaaatttacatgtgtattcatcaatcagccgaccataaactacatggtccattagtcattacctatactgcaatttttctagcttttaacagccattatgtacttcacagtttggaatactggtatgacgaagaaaagtcgaggtaaaaaacgtattagaataaatgtttatcgtccaaagatcgcaccagcaaagaataagaaacctaaaccaacaaaggaacaattaatggaccctgaattttctgatgaagacgtacttaccagcttgggttttgatgatggcggttacataataccactaccgaaaaaatctctcatgttgattaatctaccagattcttttcgagatgagttgcaaacgatgcatgtcagtttttatctccgagaagttggcaaacttatgtttgggtgaggacaaatatgctctagtgaatagtactaagaagttgatgcttacagatggtctaggacggcttcatttgttttggatgaattcaattttttttccgaatcagtatttgcgaatgagatttatgtagccctagatgtgagatttatgaaagctggaagtgccaaaaagaaaggtggagattttaattgtaacaaaaacgcacagagtcttctttatgattttttcttggtagatatagatgaggagatatatgggtcaaaatttgaagagacggaagaccaaaagaagtggaacaaaaaattttgaattgatttgtcttcatcatattgtgctattaacattaaacacgaaatagagcatctgaatcttgaattctatggaatctctaaaacgaatagacagatctccgcggaggaagtgaaattctctactcatactgcattcaaaattaattgagtttttcaattacattggaggtttatcctttgatactttcggtttggtgatttgaatgaaatgttggttttgacagaaaaatgaataacacttgcattaaaatcatcaaaaattgaataacactagaatctaaggaggtgtattcgatcttatattttaagttatttgagtttttatataattttgattttttaaagaatttggatgaatttaaggaggttgttatgatttatggtaaaatcctctcaaattccacctaaaaccatgagatttaaaattatatatttttaactaagaaaatccacttaagtctcttaaagtcactaaaatccaatctttaaaatgttttcaataacagaagatttttaaggagattttaaaatcagtaattcaatagcattagatttcatgatacttttaaaaattcataattgaataacataggatatgttagtttgaataagatatcctaggtgttaatttactatttttaaaaaggtaagattttttttcatgtttttaaaaaatgtgagagtttttttacctatttttctattaaaatgaaatgtataaaattaaaattttgtttttaaataaaattactaaattaaatattacaaaatatgtatatattactatttagaattcaaatattatcgatacaaaattaaatttatttcttcaattcgtctatttaagcaagctagtaatttgatcgacaaaaaaaaaacaagctagtaaaatataattaacagaattactaaatcggccggtttagggattgctttctctcagtcgtcaattgcactaaaccactggtggtaatatcgctggcgtttcgcaagtatcaccgggaattgcaaagaagcagaggacc

SEQ ID NO: 12833 - DNA, 3000 bp, Unknown
  misc_feature (1)..( 3000): cDNA_ID_2709771_gDNA_ID_2214575_Annot_ID_135154 3000 nt of promoter + ATG
ttttaaagttttaagttgtatttgtttattttgttaaatgtttaatattttataattgtattttgattgttgtttctcggatttcacccgtagtacaccatcccatattaatatcgaatcaaacccgtcaattctaagatttcacccgtggtagtatttaattgtataattatattttaattgtcattctaggatttcactcctaattctatcgcaaattattatcaacccaaaccagtcaattctaaaatatcacccgtagtacaccatcccatattgatatcaaatcaagcccgtcaattctaggatttcacccgtgatagtatttagttgtataattatattttaattgtcattctaggatttcactcctaattctatcgcaaattattatcaacccaaaccagtcaattctaaaatatcacccgtagtacactatcccatattaatatcgattcaaactcgtcaattctaggatttcactcgtggtagtatttaattgtataattatattttaattgtcattctaggatttaactcctagttctatcgtaaattcttatcaacctaaacagtcaattctaaaatttcacccgtagtataaagtttaaatatttataatgtttaaatttctaatataagaatcaaaatttttttaaaaaaaattaaagttttaagttttttttttaatattgttaattttgtttagtgtttaagattatataattatattatgattgttattatatgttttttccatagcatactatcccatgttattatccactcaaatccgtcacaccatataaccccgtcccgtgaaattaaacacaaatttgtcattttattataaatttcaaatatttataaaattagaaactttcaaaatgattaatattgatccaaatttcatcattgaattttgagtgttatatctaagatttctctagcagtatatcgtcccgtattaatatcttttatattgtttaaatttcttgtaatatttaatttataattttttaaactttttaacgtttcaattttttaaaataaataaccctagtaaacaaaccattttaattttggacacctcataaatcaagtttcatgctcattcgtaatcgaaatcattttggtcctttttatagtatggctcttgaccattgtccaatttttttaagcgatgtggaacattctaaaatcgtaattattatccacccaaacccgtcctaccatataacccagtcccgtaaaattaaacataattttgtcattttcttataaatttcaatattataaaatttgaaacttaaaaaaatacaatatcgacccaaaattcatcattgaattttgattgttatatttaagatttttcctgtaatatatcgtctcgtattaatatattttttatatatttataatatttaaatttcttgtaaaattcaatttataattttaaaaacttatactttaaaactttataagttttaaaattataaatatttcaagcattttttaaagataaactttataaaaagattttaaaattataatatttaacttttgataaagttataatatttataatttcttgaaatattttaaagtttcaattctttaaaataaaaaatccgagtaaaatcggataactattttaattttggacgcctgataaatcaagctttctgctcattcgtaatcagaatcattttggtccttttataatatgggtctgaaccattgtccaatttttctaagcgatgtgggacattgtacatatattatttcttcataggttgaataatatatgtccgttttaaaaaatttaaattacatcatattcagaaaaatataatattttattaactatatatattttatataaattcaaaataaataaagtataagatcaaataaaaatgaaagaagatttatatatttatgtttaaattaggtagaaatattttaggaaattagttaaggtaaataaaaaatatggttagtttagagatattgtttatattaaatttggtaagtaaatcattaattttcgtttttaattattaggttttaggtaacttttccaaaaattaatgttatccaagatcagaacagaattaaacatgttatccaggatccgaacagagttaaaccgggtaaaacccacccatttgaattaattgttgaattatggttcaaatcttcaacattatcttcaaaaatcccctccaaaaatgtatatatagattaagaaagttgtgcttcatgagtaaaaacatagaatttcatatcttaatattaagatatatttgttagaattagagaatttataataactaaactatttgaataattttttttttgaatagaatttaaaagcttacaacccaataacaatgtattttactaaaactttaaaagaatccatgaattattgacaataaaatctgaaaattagaaaaattcatctaccaataaccactctaaaacatttgtcaaacataaaacacattgggtcattatttactgaccataaaaacaatacaataaaattctaaaagtgcaatgtttacttaaaacttttaatttgggcttttaccaaatacttccaagttccaagaaccaatcacaaagcatattattcaccgtcaagctcaatcagagaaagatcaaagcttaaaactttttttccggaaaagttaaagagagaaaaaagaatcaatctttttgcttgacgattgttactctcagtggaaaggtctagtccccattctcatttttttttgttaaaaatcgtatctttggctttatttttggttatctcgtagattttgcgtgaaaagctttgaactttatgatgttttgattgacctccatttaggaaaatgtaaatatcttcaatttctggggtttaagtgagattttacgagtgttcaagttaagggtttgaatttgggtgaaaacacctggtaagccatttcattgtttctcaggacgatg

SEQ ID NO: 12834 - DNA, 3000 bp, Unknown
  misc_feature (1)..( 3000): cDNA_ID_2709767_gDNA_ID_2214575_Annot_ID_135155 3000 nt of promoter + ATG
tataaatctattacaattagtgacaaccaatcatgatatttggttaaaacaatccatgcatatttgttaatccacaaaaaaagtttaaatatctaactctgaaatctctaaaatctttacacctatgcatctaccaataatgattctgaaagtttcagaaaaatgtctggaaatatataactgtgttgggttttcatttgaaaattatgatctcttactagtaataacgtcatggaaattgcaacacagaaaaagacttataaagttttctgatatttttctaatttaggattttctttttaaaaaatacaaagaaaaaccgactatagaaatgttggtgtaaattaaacaggaggaagagttttatccaataatacagtatacaagtaacaagatgaagaacctcgggaacttgatacgtttgagggttaacagtgaatcatattttttatataaccaagtcataaactagagaaaccatataaattgaacaaacgaaaaaagacaatctcacttccatggttagtaatctttcatttagaaagatcttaagggaaatatataattgtatattctctctctataccacacaattccgatgaacacacaatctggtatattgtacatttgtttataatgcttggcacgacggcttgtgataaggctttatcgtctcataaaaggaaaacgtagtcattcgatcatctcccaaagtttcaatcttctctactgtcttcgtttatttcaaatgattatgagttgattaattattcaaaacacagaagatctctctatacatatatatatatatatatatagaaacctttcaaaccatttcgcaaattggttgtttctcactttctctagcgtaaatctcgatgagcttaagttaaaacttaccttcagggtcatttgttttgttatgtgacaatcttctagattaatattccacttactacttcctgcttaaaatatttagttacatcacatgaccatgtaattgaatttatcctctttataatataaactacgaaaatctgaagaagaaaaaaattatcgaaaagagaatcatattctggtactagcaaaataaatttggtagaagatatatatatatttttctatatgtaaacttcaaaattaatgcctaagatatgctaaaaatttgcgaaggagtcagggggaaagcttgagaggaccaatgcatggcattgcttttactgacagtaaacagtgtcacgctcacgacccattcttcccgttccatttggttttatttatttcaaagtttaatattccttttgtataacattcaaatcttcacatgattgattgtgtgaaaaccccacagattttactacaatagggggagttgacttaaaatagctattgatgtcgaaaaaatgtattttagttataaattatactaaagaaaatttttgatttgtctgttgtttaagcatatgtattgttaaacttaaaaaaatatgtattgttaatcttaaaaatgtaggagtacacatcaaatactcgagcataatcaaaaccgtattcatagaccgatgtgagaatcaaatagaagataatgtgattttttaaaatatcgtatctccaaatcaatcacttagaagataatgtaattctttatgtgctacataaataaatatatatatatatatatatatatatcttgtatatatgtcttgacaaaaaattgccagtcaaaaaccatgactgaatcaaactataagtcggattgaatcaaactataagtcggatgagtattaatttccattatgtttctatactttacaaaccggaaaatagatattatagataccaaaaaagtagatttgtgtatattattagaagatttggaatttcatcattatcaggatctaaagtacttccctaattaaatcatgtcggttgaaaaagctcaatgaatgtttgaaatttggaaagtttattaaattcggatcttttttttttgtttgtcgtcccaaacatttttattttattacaaataatcaacttatccttactactaaatcatttcatatctttgataccaacaaatcatttcatattctattttgatgtttaagaaaacactatttaccagttacaaaatattataaggattgttgtttagaaaaaaaagtacaagttgaattctttttgtcaaatataaaattgactttttaatatataattgacttattgaacatgattacagaattaatcatctacaaaactttccaagtttataataaatacatttcaaagactattagttcttcttaaaatatttctaaaagtgatcaaagactaccacatataattcagaaaaagtagaagttgatttctttttgtcaaataaataattgacttaaaatagtttggaaagccattgaacttgattatagaattgataatgtacataaaaaaattccaagtttataataaatacatttttcaaatgctatatcagttcttcttaaaatatttcactaaaaaaacactcaaatatagaataaatttattgaataacataccaactgtaaaacagaatttgacaaaaaaaaaaaaaaaatgaaatgaagatgaagacaaaaataaatcaccagaggatcttatgcaaaaaaatatatgaatacacaataaaccatattgatatttttaaaataaaataaaaacagaaaaatatcccaacaccgcttttcaattaaaaatcttccgtcaccattgttgtcatcttcctctctcgtgaatcctttttcctttcttcttcttcttctcttcagagaaaactttgcttctctttctataaggaaccagacacgaatcccattcccaccgatttcttagcttcttccttcaatccgctctttccctctccattagattctgtttcctctttcaatttcttctgcatgcttctcgattctctctgacgcctcttttctcccgacgctgtttcgtcaaacgcttttcgaa

SEQ ID NO: 12835 - DNA, 3000 bp, Unknown; identical to SEQ ID NO: 12832
  misc_feature (1)..( 3000): cDNA_ID_1572338_gDNA_ID_2214575_Annot_ID_186311 3000 nt of promoter + ATG

SEQ ID NO: 12836 - DNA, 3000 bp, Unknown
  misc_feature (1)..( 3000): cDNA_ID_2712676_gDNA_ID_2214575_Annot_ID_135157 3000 nt of promoter + ATG
tgctctctcctcaaagaattttgcttccatctcatcatattggttctgcaaaggttaaaatacaaaaggaatcagataaatttgctccaccaaaaactcattagacctgaacagccagctaattcaaaaccaatacaaaatccaagatcatctaaaagctgaaaatttactcacctgaatctctcttagaaactcgacacgcttcctgactggtggagtcaagttttcaaggacatcagagtgttgtccagccaaattctgcaacttgttctgcagcaaacacgtaaatcaaatcaggaaaagtcacaaactttcaaacaaccaaattaagatgcatagacaatcctcaaaaccaaagtcaaattctctaagccataagaatcaaatcaatttctcaaaactagtcaggaagagaaaacaatccctaaaagttacaaagatgaatagcccaatctccagatagtcatacgcaaatcatatcgtgaagaaaaaactcaccttaagagcattaacaagcccggcacgatcctcctcgttaagagctataagcaaaacacaaaacaagagaagcttttttcaataaatcaagagaacaaaagagaatccaggcctcattctataggacaataagattataatatcttaccggtggagagatcggacatgttcatgctgtccttgtcgttgctcatcttcgcaagaaaagaatctggcggaggaagaggaaggataagaaaccttaaaaccctagatttttggggacaaatacgagacagagaatatatatataaataactaaaagggctttgagaaaatgaccagaccgaaataagacacaactaaagcgaaaataacaaatttttacatcaaaatttggcatgaatatttgtttttaacatttaagagcatttctgttgattttttttaaaaaaaggcttttaagagcatttctattggttagaagaaatctaggttgcatggaaactcgccccgaggtctatttcccatttccgaaacgttacgaaaacagaaactctccggaaacatgaaaaacgtaacggaaacgcgttttttaaaaatttatgtttggaaacacgatggaaacttacgttttaaagatagaaactcatgtttcccaaatagacatacgacaaatttttttcaactttgaaaatttaataactaaaattaaaattattaaaattattaatacatataactaattttggaagactttgagttttaagatatttcttttgataaaccagatttgaaaagagctttatattatctttgatgaaactaatgaaaatgaaaatgttggtctaaattaactatttgaacttgaaccttttaatttttatcttttagaattttagtttatttatttaatattgatgttttggacttgtattgtttaaaccattttttctttaatatagttttatgttaatgttatatatatatatatatatatatgtatgtatgtgtatacgtttccaatccctaattttaagaaaaaatcgtttccaatccctaattttaagaaaaaatcgtttctcgtttccgaaacgtttcgtattcgcgttttcgtttccatttcattgcaacataggaagaaactcacgagtcttttgatgatagaagtttatttatttaactaaaaatttatttattacaaaagtttaacctaatcatcaaaaaacaaatgtatataaaaaaaaagtatgtcatgagtttctcaagtgaaaaaagagtctactttcttttagctcgaagacaattctcatattctcatgaatgctagctgatcacatgttaatgcttaatctggattgatgcattgtcatgagtcactcaaatttcatattagcacactatagtaagcaaatctgattggaaaacatctagtgagatgctgctttgttagtttagggaaaaatgcttatttggtcctaaagatttcgacttaagaatagagaaatggtaaaaaaatgtagaacatcatgccaatcaaatgatacaaaagtaacataaccaccaaacgcatttgcatgatctatctaatattatatgtacctattttggtttaaggtcattaataaacttgttgattagtttttaataattttgtaaagtttctcaaacaatttctttatttttatgatatttttcacaactttattttgtaaaaaaaaagggtatgatatttttcacaactttattttataaaaaaaagggtagaaagtcataaaccaataacacaataatttaattcattataataatcatagattctttgttttaaatgaattacacaaaaaatttaataactttataaaaatatgaatccaataactctacatttatgaagattttatattactttttacaaatcttaaactaataacaccaaactttaacaaaaaattgaaaaatctttattgaataacaacaaattcttcataacattttaagtcactgaaacttcgaatacatcacaaaccaataacactccctaaataaatttatatatattactagaagtctggttatttgtttaaatgttaaaagatatatgaatttgtaaacttaagagatttatggaatttaggaaaatataaaaacaaaatccttattcttattataaagtttctaagaaatatactgtatatttttttcaccgaataaagatatttaataaattgagaaaaggaatagaaaagaccaaaagcaacaggctaagcgagacacacacacacgcgcagtcttcttcatcttgcttgcttctggttgcttaaccaaaacaccatggaatctccctaaatttcctcacctactcacttccaatttcaacctgctcgattcttcccctcttcttcgcaaaagccctagttttgatcatcgcacttcactctcctccgcatgagaaatcgagaaatccgctcgacgtagtagatagataaaaccacaaagttagggttttttcaattgggtatg

SEQ ID NO: 12837 - DNA, 3000 bp, Unknown
  misc_feature (1)..( 3000): cDNA_ID_2709749_gDNA_ID_2214575_Annot_ID_135160 3000 nt of promoter + ATG
ttttgtctaataggattctgtgaatggccaccgtcgagtaaaagcctataaaaatcctatatttcaataaaacaagcttcatgtagtgttgccacatatggtcttcattcacacggttaataaaatgcactttaaccaaacgatattttggatctaatgttttttcacttaagtagacatgatgatccttctttatttctattgcacattaatctaattattatttttttattttctaaactaaatcatcatttattagatgtttgaatacaattcaaccaataataaaataatttacatagtataaatagttaaaaccaatactaaaaagttaatcaattatttattgaaagttgaaaacatcatctatttaaaaaccaaatattacaaatgtttagttttgtagtgtacaaaaagcttctaccactaacaacaaattagtgcaatataaaatataaatataattattatattttaaaagtaacaaaaaatgtttcagtatatatttagttacattttattatacatttaagtatattaattacaccatgcaacgcgttggacttttgctagtaacagtataaactaaaaagatagatttgagtgtaaattagttttttggtttgggaaatatggtagatttaaaaaaaaaggatgaaagaagtggtagaatgtgaaaatgtggtatatatcatagttttcatagtatatggacagatggactaatcatccaatcattgaaatcaaactatttctaatcagataagtaattagacaaaaacaaattgacaaaatccattcttatttaataataataataatattttagttacatctaattatctaaagatggcagacgggcctgcccgcaacaattggctgccttggatcgttttttttttctgatccaaaacgtatcacatatggttttgctatgattccaaatcaaaatctaaacaaattcttgaaatcagttcttagtagctcagtatttggtttacatgacacatccactcctcttcgtcattctctcattcagaagcttatccatcatctcaaacagtaacctagtaggagtattcttccaaataagtaccaaacccatgtccattcatctttgttgtcctcctcttgaatctgagtggttctctggcaagttccatctcctcctcgcagctagtgagttcttatcataaatactctaatgaacataactaaaatagcacaaaggattgtaacataagattatgagtgattaaatctatcacccatgaatatacattaaacacaactgatcacaagaaccagaaactaattcgttatcttaaagacgcatccagctccacccgctgcgattaagtcctatacggttctctgaacactcagagcattcctcaaccaatatctgcaacaatgtcagaaagtgattattttaacagaagttatagaacagaaactgcaaacaaatatgacaacagttctgatattcttcaaatctcttcaatagtttaaggtagttatactagtaaagaacaaagaaaaattgcaattatctctatgcaaacaaagatcaagtaatcaactataactaaacaaagaccatttcgccacctgtcatgactttagcgaaacatcatatcattgtgattatcggtgccatatctaccaagatattcccaactttgttccagaattaaaagttctagtggttatttttggtgtccataaataactcgactactatagtgttctactataatcacaattttgtagatttttttctcgttcttcgtttatcaaactatagtgttctactataatcaaaacaattttatttatttcttgcttgttttatcaattgagagagagagaaatcgtatagatataacttgtcagagaaatggtggcatagacttttaaaatattttataaaaaactaatcttcacttcacagtacttagatactcaaactatgtcatatatatagttatgaaaagatcagtcgagagcatgaccgtgaaagaggagaaacataaggttaaaacttaaaacgaatgaattttatcattaagcggaaggaattttccaaataatcctcctaaatttcatatataaacctattagagaggctactctaaaaaaaattcacaattttcgagaacgtaaaattcataacataaaagggttgtttccgtaaatcctcgttctaagtacttacatgagtcagaacacgcctacatccatgtaaaacattccttgtcttactacatctcgatcatcttatctgttatgatgtctttgaatcaaaatcccaaaagttttggttcccgcaaaaataaaccacgacctacgtatatgatctttagtcaagttggcaagaacgtaatgcatgcctctccaatcggcagtttactttcaacggcatattcaccgaatcatttgcaaccaaatcaactccttgaactacccgactctcccctcgaccctcccctctaggcttttatgttatgacatgctggttcatggaaatgcacatacataaacataagttttttttaattcagtttcactctttaatatttttctcaacaaaccttagtgaaagctttactcgattttattccaagaaaattaatgtaaatttttttgttggttaatactaaattcaaattctaaaaagatatttatggatagatatggctaactatagtcaacaagatttattatatatctaaatatgaggatgtgccttgaagtattaattcaacaagttgacaaaacagtaagatttccttttttcatttttaggaattatttgagatttcattttgacttcaatatttattgtctttttttttttggtaggattccatattttatgttatacatacattcctacggtgtctatataagtaacaaattatagcgatatctaattctttcgttgtaattctcttcttcaaaaatcaaatcagagagagagagaaacataaacaaatg

SEQ ID NO: 12838 - DNA, 3000 bp, Unknown
  misc_feature (1)..( 3000): cDNA_ID_2709741_gDNA_ID_2214575_Annot_ID_135162 3000 nt of promoter + ATG
attagtttttttcaagtcaaatgtaatctcaatttacttccaaaacaaaacaaaataaattaatgtgttgaatttttaatgcacatcatatatttggatctctaattaatttctttgactgcattctgcaaacattatctataaatacttatttgatagtgtaatttttattcatccttaaattactcaatcaatttttatttctaaaagaacaaattattgttatggaaccactaggagatcgtcgtccttgctgcgtatgtatcaccaaaaatagaaattgtcctagattctgcgaatatgcggaatactttccatatgagttgtatactttttttaaaaactttttttccttactattatcttctgctaaacattttacttgatattaattaattttaattttcaggcgaagtcattatgaaagtactaatgaattgtttggcacaccaaagatcattaagatgatgaggcatgctcctgaagaaaaaaaacaaatgcttgcaacttccataatcatggaaggtaatgcttggacaaatgatcctgtaagtggtggatttggtatggtgcaaaagatcatgtggaagattatgttacacaaagcctaccttcatgaactcgaggagaagattaaggaagagaaggaaaaaatcgagcttcatctttaagtgatacattgtagcatatattatttatgcatcaaataatgattatttaatataaaatcatatttaagatgaatattaaattaccgtcgagcaagttaataccttatatttcttattcatatttcttgtgattaaattgtttgtgtatttagatgatcataaatgaaactttgaaatctagagaaacatattgtacatataataaagtaaaagtataaaaaattgataattttaaaaatacgagaacttctcgtttcttgttctaagtaaaataacattccaatatagaattagggtttagttgcctttggaaaattgctttgtaaaaagctagatattatgtttcgtttagtatatctttgactcatgatatttgacatttgattaaaaatcatgtttgccttacatgcataatatcttaaatgcttgtatcacatgtctctaactaccacgaaaaactttgtgtataaaaaattcaaatctttaatttttggacgacaaattcattagcgttactaatttcattgtacctatcagttttatgacgataataatacaatttatttcgtcccaaaaaaaataatatttatttattaagttaataggaaaataggtgtaaatatacaaatatgtatatgtaatatgcaattagagaatatatgaaacaccactatactatcaacattaatattagtaagatgagaaacataaattagatgatttgagtcaatatttttccctagtaatcttagtaatagttttttttttcttttatttgcatagttcatatacatatttgtatacatatatgttgtgcagatctaaaatttttgtttaatacctattttgcacctctaccaaataaattgtgttagaattttaaaaaattcataatcacaacaaaatttctaacactatttaatttgttgatcataaaaaatctgaatttttatgcacaaaacgtttcttaatagtcaaaactagtgatataagaagtgcaatgccaagaattatagagatttgaagcgaaattttaaaatgacatgattatacataacttttaagttctaaactataatcataataaaaaaaattaagatattaaatagagcgaacagacgtttaggtttttttcggatttaccatattcatcagattaatccatgctggattgagaaaaagcctcaagcttggaacaactacatgtaaatcataacctcgagatattttaaggctttcaatgtcccaaagaaagttatttggtgtcgaatccatgagtgaaaattgagcttttcacatagaacaaagagggatatgaaatagtacaattttatgttttaaataaagaagataaaatgaaaggtaaattttataggtttagccagcagagaacaaatgaaatgaatgttttaagtttagacaccaagaacaaacttagggttcaagtctaagcttagtcatatacttctgaacaatattggactttattgttcaagtattaaacaaacattgaaatcttcttaaatcacttttcaaaatgcaacgaggatctattctttttttttttttcagaagaagctacaagaaagaacaacaagtttggatatgaattataaagttagtaatccatgtaagagacgcttatattaattaatttatactgttaattatttcatccgtaatttttattattattcaataaagtatttattttactgaattaaaaaataataattatgggtgtttggatattcggtcgggtattttgggtttgagtttttcgggtttagaattttaagatccgttcgagtaattcaagattccgggtcgggtttggttcggtttcgggtttagttatatattgaaatatcaaaattttgtgtccgaatctattaaattatttgaaaatttcaaaaattccctaaacaacccgagtagttttgcttgaatatatttaaaaatacataaaagtaactaaaatatccgaaaaatcataatattgtctatatgtaaatataaatataaatattttagttatatttatatttaagatatgtttgggtaccagttcgggttcgggtttttcaggttttgaagtttagattcagtcggatatttgaaaatttcaggttcgaatttagattgggatttttggattgggatttttggatcgggttcagatcggttttttcggattcaggtattatgtccaaagtaaaaatggtaaacggtggttgttttgtttgtatttgtaaagcagaagagagagagatatagagacactgaaagcaaagaccaaaaaagaaaaattaaaaagagagagaggaaa

SEQ ID NO: 12839 - DNA, 3000 bp, Unknown
  misc_feature (1)..( 3000): cDNA_ID_1807613_gDNA_ID_2214575_Annot_ID_135164 3000 nt of promoter + ATG
agaagtctgatcgtgcagctaaaagccccgctgggctcttcttccagcatgctggtcacaggttcttaaagacttatcttgatttttcttgattgctttctcattttacttgcttctaagttcccttgtttataaaccatattagggacaaagttgttgatttccactggaatgcttcagacccttggactattgtcagtgtttctgatgactgtgagactactggtggaggtggaacattgcaggtaaccttgaaatctttcttggtaccttgataagcaattttattgacataccgttaaatgttgtttatactttcttctatggcagatatggcggatgagtgacttgatttacagaccagaagaagaagtcgtggcagaattggagaagttcaagtcgcatgttatgacttgtgcctccaagccttaagagtaaagaaaacccattgtctatctatctatcgcctatggtaaactaatgcgggttttagcgaggagtcttggtttttgtaaggctggtttgtcttttgagatattggtggtagcttttaggacctttccatatcagttaggggtacatggttctggttcatgatcctgtttcatcagactcttaggtgctgttttgttcaactgagatgttaatcaaatcggaccaactttatgtgttttggtttaaggtttcaatacttggcctgaacctaatgattccttctctgtaactagtcgagaccaacccggctacaaaaaaaatagttgcattgatgttcaaatgcaaagcagaaggggtcattataaaacaatatagtaataagcatcgcaaaatttggaaactgggttcttgatgattcgtcgcatcttaaataatgtttgcattgtcgttttcattagaaaaaaactgttaatcacgcttagcagtaggattaggtgattttcaattcacagatttattcgtaggattttgaagaaattttaagtattaacagtcactaaacaatcagaccattgcaaatcatacatagatcacctggtcatttcataaaactaaactatatgataatgttttactttattgggcttaacgttaatggtcctcccgcttaataggctttatgaagtctcttgatgagctagagactttaaaaatccaatcacaaagcctacatgagaccgtcaagatcagtcagagaagatcaaacgaagaagtttttgttccaaaagatactaaagagagaaacatgaatcaatgtattgcttgaggaataaggtagggaagctaatcaatcacaagtagacgaatcggagtatttcataaaattagggtttttagacctacattttcttttctttttccgacgatacttaaattgctcgagaaactctattagtgagaaatcccccatcggaatctcgatggaatcatctccttctggatccgaacctccgcagaaagtcgtttctaaactgcagaaagtaggctggcgagctacgatgatcttcaatctcggttttgcaggttagagaaatcttcattactttcttagtaaggtttttagttttacgtccgtaatgtgttcgatgtaatgcctagctgagaaagttctttcctttttctttattaatttttgagaatagaaaatacgaattcttctagcggtcgtctgatatatatgatactacaatttatcccttgaactgttgttgttgtccttgctttgattctcgaagaaagctgattgcattactctgagagtgtttgattctccactctattatcagatattagaacatgcttattgaaaggacattttttggatctgtatctctcagtcactgttgatgttttcagcgacattgaattaagcaaatgtagtatctagaaactatctatatctctgtgtgcgtgtgtgtatatatcttggctaagcatttttgcgttgaatagaggattcacacaggttcttgtaaattttctggttcatggacatgattgcacatcttattatcttgtactcaatacttttcaaatgtttcagcatctcgatttttagctggcagaactacaagcttggtctaaatcagaattgagaaaagcatgcttgcttgatttcttatgatatagcattcatgatagacaacttcaatgtttgctgatttgatcatttggttctgcagcttatatatttgcgataaaacgagaaaaggacattgatgcggacgagaagaagaaagttaaaaagggcagcgaggctagacataaaggtgtgaaaaagggtgctgttaacaccgaaatcgagaagaaaggtgcagaagaaactgataaggctaaggaagcagaaactgcaataccggagaaggaagaaaccaaactgatccctgaactggatccactgtttgaatttacagatgcaactgatcaatccatgtttcaaactgtggcaactgaacatgtaaaggtagcaaggaaaccaattccagaagatgagcaaaaggagcttttcaagtggatattggaagagaaaaggaagatagaaccaaaagacagaaaagaaaagaaacaaatcgatgaagagaaagctattctgaaacagttcattcgtgctgagaggattccaaaacttctacctgatgattccgttgattcttcacttcgtgattgggacaaattcttctccaagtagaacgaatacagaaactagtgtgtacttgttttttgttagtacaccaaatgaccattgttggctttttagttttactactctgattgttactctaatcaacgaatagtttaaatgtgatttcttgggggttgagagtggcacttttataaaactttggggtaatgtttctatttcttataatataaaggacttaaaatataaattcaataaaaataagggtgtttctgagaaagagggtataaatagcttaaaccctagagaaactgaagaatcctaaattgatcatcgtcgtcctttgagtaatttagaaaatcaaa

SEQ ID NO: 12840 - DNA, 3000 bp, Unknown
  misc_feature (1)..( 3000): cDNA_ID_2709735_gDNA_ID_2214575_Annot_ID_135168 3000 nt of promoter + ATG
ttcttcataccaaaaaagggtcatattatcatttgatgagtgttatagagctccttgctaaacacaacaccacgcatatccaaatttggtgacaccagaataacacattttacaagtacgccaatgacgcttagatgggtagtttagtgaagttttaaagaaaaaaaaaatcagtgaaaagaaaaacataatacacaattagacatgatggctaggtccatcgaatatgagtagggataagaaaaaaaaaaaaaaaaaaaaaaaactttccttgtgaagaagaaagaaacttcacataaatgatgttacaaggaaacacaatgggagtgacccaaaaccattaagaaattatgaaaaattcaaaaacttgtgatcacatggttgtatggactgaacttggacttttcttcaatcctattgttcattttacatttccaaagcagattcttatacaattttttattcattaaacgtaatgatgcttcaaattcaatgagttaacagaatagtgttgaaagaaactattgtttttgcctccaagtaggcaactatgcctcctaacacacaagagaaacagagatttaattttcacttatgcctataaatactctttctagattgcattcaacaaatctgtgtgtgagaaaaagtaaataaaaaagagatggttttgatcaaagagagagagatggagattccagttattgattttgcagagttggatggagagaagagaagcaagaccatgtcacttcttgatcatgcatgtgataagtggggattcttcatggtatgtataacatctttatgcacaaggcagtgttttctaagatatgtctactgtatatccttaaagagttagtgaattttcaggttgataatcatggaattgataaagagttgatggagaaagtgaagaagatgattaactctcactatgaggagcatttgaaagagaagttttaccagtcagagatggtcaaggctttgagtgaaggcaaaacctcagatgcagattgggaaagcagtttcttcatctcacataaaccaacttcaaatatctgtcagatcccaaacatttcagaggaactcaggtaaagtaattaagaattgaatagtaccaaaggctctaccatttttacctgtttgcttatttaactaaacaatgtgagagggtgaaattgatatttgcagcaagacgatggatgaatatgtttgtcaactgcacaagtttgcagagagactctccaagctcatgtgtgagaatcttggtcttgatcaggaagacataatgaatgccttttctggtccaaaaggtccagcttttggaacaaaagtggctaaatacccagaatgcccacgtcctgagcttatgagagggctgagagaacatacggatgctgggggaatcatattactcctgcaggatgatcaagtgcctggtcttgagttctttaaagatgggaagtgggttcctataccgccatccaagaacaataccatttttgtcaataccggtgatcaactagagatactgagtaatgggaggtacaagagtgttgttcaccgtgtaatgacagtgaagcatggaagtagactgtcgattgctacgttttacaatccggctggtgatgccataatatctccagctccaaagctcttgtatccaagtggctaccgttttcaagactacctaaagctttattcaactaccaagtttggagacaaaggccccagacttgagaccatgaagaaaatgggaaatgcggattcagcctaggatgcatctggaatttgacgcttctgtactcacatcataaaaactttgtcttcttcttgtgtttccttataatttaaataaccagccatgtcagaatcttgctgattcagctatactacttcactcttctttcttcacttccacttgaaaagttccaaagccaaactgaagcagtctcatcaagctctgtgtcgaacttgagattagacaaagagcttgtaatctaagctctaagattgacagtcaatttcatgatttataagatgtaattcaactcttaacgtaatccacaactccgccatcatctctttccatattctctctgatttgactcatttccttcccaattcctagaatcaaacaaatagcatttctatatcagcatctaaaactgaaagctaagtgtgtattgactcaaaattcttctccaatcgcaataaaatcgagatgagaaaaattcatccatatgttttggttcacacattctatcgagcagcttgtgtgcaatcccaatcctctgaaccaaaacaaaagcttatctcttgaccattacccgacatttcactcatcagccaacgacaaatcctgctccgaaacctctaatgcttggaaaagaagaaaattccgatttccgaacaatggaacttactccattttgcattctctgtcgaaagtaacatacgttcaatgcaaatgacccaaagtcgtcggtgccacgtggatagttctcactggttgatgcattcggtaactcgcagaatggaagaatattaacacaaaaggcatctcgcgtatccacgtgtcccgttcaagattccaaattctaaaccaaaagccggtccgaccagattaacaagttctctttattacatcacaacccaaaacttgttcaaaacctaacttttcattgctaaacatattttattctgacattcacatgttaactttaatccaatatctaattcttttttcttaaaaccaccgttgtcgaaaaatccaaatcagcaaaatcagtgattaaccggaccggaccaaaccgaacatcgttttctgtaaatagcagtaactggtttcacacatcccatcatctctaaccaccgacctcataagtcattaagacaaaaacagagacactcctctcactctcattatttcattttctttccataaaaagcacgaatcttcaagaacaaagagagagagagagagaaaatttaatg

SEQ ID NO: 12841 - DNA, 3000 bp, Unknown
  misc_feature (1)..( 3000): cDNA_ID_1835663_gDNA_ID_2214575_Annot_ID_135169 3000 nt of promoter + ATG
cccaacaaaaaaaagtaagttagatacttccaaaatataatcgaacgaagaacttctcttacgaatgctatactcaccttaaatctagctgcagtacagggtacttggattttggattggacattataaaaacgttgtcctggatcaaaatcgcagcaaattcacatcacgagaatgcctttacatatgggtacataacagattatacattcttcagcaatatatagtacaaataatttaggacgatcgaagcttaccttcctatctatcagtcttggagtatcctctacgccattctcgttatccaaattaaagaaggatctagaacaaaatcactcatatgttatagtttgctttaaccagtgaaacaaaagtaaaaaaacagccaaacagggcaaaataagcatcagaaaaactcacttctcctccttggtcttggtttcatttttctttggcttaactcgtgcaacagtctctagaaccgcctaatgagcacaacacatgcctttaattaaaaagaaagaaaacatagagtagttaaaaaaagatctaaacttgcaacaaccaacctgctgatcagcaacactattattgaagcttcctggatcaggaactgcaaaatcgaaacaacacaaaagcattaattgctataatgtgggcacaaagagagagtctaaaccactcagctaatcaatgataaatccctagagaagaaggatcaataataacaaaattgaaatccctagagaaaccctagctcaggtaacaaatagaagaaatgaagatctatctagtgagagaggaggaaccttcgttctggtcattatcaggaaactctttctcaagtgctcgatcgatcatatcagcgaaactatcttccctaggtttcgcactcgtggcattggactcaacgacggttccattgatctcacgtgtaacaactgagtcagtctcgttatctgactcggcggaataagcaaaggagaagaagaagaagaaagtacagatcagaagaagcgttagaagcctcatcgttatcacagagaatttgtcagtgttgtttttacaccgccgcatctcagtgaatgtggcgcggcggagcgatagagagaagaagaagaagtagaagaagcacacaaagatctctctctctctctctttccggtggttggagaacgagaaagcacaaagattgagagagagagggaaattaattttatttttttattattgtttattgtttgcttaagggcaaaatgttaattaaagtctccatcgattctggaaactaaaaagtgtgttaagaacacgcgccaccgttagcgcgtggttcagggagtgagaacaaaaatcatttatacaacaaagtgaacaaagtaaaggtgatagttgctgaatttgcaaattgcgtattacactttaacatttttataatttttgtttagggttcattgtaatgtttggtctcttttggcttgtttagtttggagtttaagtttaccaaattctcatacttaaaagaaaatgtacctaaattggaaagaaaggctcttggtgaagcagaaggtttaatggggttactaaaacaatatatgaagactctaaagaggtcttatgaccctaactaatatcaatagcatgaaatttgaaaacgtttagatatcttgacaaggtattaactttttgaataattaactccaacatgttaaaagttgaaatgttgaatcaattcgttgtaatctcaaatacacgcatgttaatgatatttaaagtccgtgttaacgataaaccatcatttcgaattatgtaacatattacaacaccaaatgaccaaaacaaaagattcaataacattaccatttcttcctcaaacagtcaaactaaacgaaacaaagttatatataactgaaaagtctttgtagattaggtcttggcccgtttacgctctaaggggccgtcatggttgaattttacaccacataaaaaatatatttgtcggtgctgatttatatagactagagctacactaactaacgatatccgaaatattcgaccccaaaaagtaaaatgataacattctttaaacacaatcccaaattctttacaaggtgttataaaatatgacacacaaaaatatatattcaaaaccgagagcgcccataggaggggccaattctttcgcttaattccgcttagacccacattatttctttttctattgcaaatggtgtgtagtactccggtaatctcaaaataaacaattcgatactgtaccttttcacaaatctattctcaagtaacaattcgatactgtagctttaggccaagtagatttcttcataccaaaaaagggtcatattatcatttgatgagtgttatagagctccttgctaaacacaacaccacgcatatccaaatttggtgacaccagaataacacattttacaagtacgccaatgacgcttagatgggtagtttagtgaagttttaaagaaaaaaaaaatcagtgaaaagaaaaacataatacacaattagacatgatggctaggtccatcgaatatgagtagggataagaaaaaaaaaaaaaaaaaaaaaaaactttccttgtgaagaagaaagaaacttcacataaatgatgttacaaggaaacacaatgggagtgacccaaaaccattaagaaattatgaaaaattcaaaaacttgtgatcacatggttgtatggactgaacttggacttttcttcaatcctattgttcattttacatttccaaagcagattcttatacaattttttattcattaaacgtaatgatgcttcaaattcaatgagttaacagaatagtgttgaaagaaactattgtttttgcctccaagtaggcaactatgcctcctaacacacaagagaaacagagatttaattttcacttatgcctataaatactctttctagattgcattcaacaaatctgtgtgtgagaaaaagtaaataaaaaagagatg

SEQ ID NO: 12842 - DNA, 3000 bp, Unknown
  misc_feature (1)..( 3000): cDNA_ID_2709731_gDNA_ID_2214575_Annot_ID_135170 3000 nt of promoter + ATG
ctttaggtagtcttgaaaacggtagccacttggatacaagagctttggagctggagatattatggcatcaccagccggattgtaaaacgtagcaatcgacagtctacttccatgcttcactgtcattacacggtgaacaacactcttgtacctcccattactcagtatctctagttgatcaccggtattgacaaaaatggtattgttcttggatggcggtataggaacccacttcccatctttaaagaactcaagaccaggcacttgatcatcctgcaggagtaatatgattcccccagcatccgtatgttctctcagccctctcataagctcaggacgtgggcattctgggtatttagccacttttgttccaaaagctggaccttttggaccagaaaaggcattcattatgtcttcctgatcaagaccaagattctcacacatgagcttggagagtctctctgcaaacttgtgcagttgacaaacatattcatccatcgtcttgctgcaaatatcaatttcaccctctcacattgtttagttaaataagcaaacaggtaaaaatggtagagcctttggtactattcaattcttaattactttacctgagttcctctgaaatgtttgggatctgacagatatttgaagttggtttatgtgagatgaagaaactgctttcccaatctgcatctgaggttttgccttcactcaaagccttgaccatctctgactggtaaaacttctctttcaaatgctcctcatagtgagagttaatcatcttcttcactttctccatcaactctttatcaattccatgattatcaacctgaaaattcactaactctttaaggatatacagtagacatatcttagaaaacactgccttgtgcataaagatgttatacataccatgaagaatccccacttatcacatgcatgatcaagaagtgacatggtcttgcttctcttctctccatccaactctgcaaaatcaataactggaatctccatctctctctctttgatcaaaaccatctcttttttatttactttttctcacacacagatttgttgaatgcaatctagaaagagtatttataggcataagtgaaaattaaatctctgtttctcttgtgtgttaggaggcatagttgcctacttggaggcaaaaacaatagtttctttcaacactattctgttaactcattgaatttgaagcatcattacgtttaatgaataaaaaattgtataagaatctgctttggaaatgtaaaatgaacaataggattgaagaaaagtccaagttcagtccatacaaccatgtgatcacaagtttttgaatttttcataatttcttaatggttttgggtcactcccattgtgtttccttgtaacatcatttatgtgaagtttctttcttcttcacaaggaaagttttttttttttttttttttttttcttatccctactcatattcgatggacctagccatcatgtctaattgtgtattatgtttttcttttcactgattttttttttctttaaaacttcactaaactacccatctaagcgtcattggcgtacttgtaaaatgtgttattctggtgtcaccaaatttggatatgcgtggtgttgtgtttagcaaggagctctataacactcatcaaatgataatatgacccttttttggtatgaagaaatctacttggcctaaagctacagtatcgaattgttacttgagaatagatttgtgaaaaggtacagtatcgaattgtttattttgagattaccggagtactacacaccatttgcaatagaaaaagaaataatgtgggtctaagcggaattaagcgaaagaattggcccctcctatgggcgctctcggttttgaatatatatttttgtgtgtcatattttataacaccttgtaaagaatttgggattgtgtttaaagaatgttatcattttactttttggggtcgaatatttcggatatcgttagttagtgtagctctagtctatataaatcagcaccgacaaatatattttttatgtggtgtaaaattcaaccatgacggccccttagagcgtaaacgggccaagacctaatctacaaagacttttcagttatatataactttgtttcgtttagtttgactgtttgaggaagaaatggtaatgttattgaatcttttgttttggtcatttggtgttgtaatatgttacataattcgaaatgatggtttatcgttaacacggactttaaatatcattaacatgcgtgtatttgagattacaacgaattgattcaacatttcaacttttaacatgttggagttaattattcaaaaagttaataccttgtcaagatatctaaacgttttcaaatttcatgctattgatattagttagggtcataagacctctttagagtcttcatatattgttttagtaaccccattaaaccttctgcttcaccaagagcctttctttccaatttaggtacattttcttttaagtatgagaatttggtaaacttaaactccaaactaaacaagccaaaagagaccaaacattacaatgaaccctaaacaaaaattataaaaatgttaaagtgtaatacgcaatttgcaaattcagcaactatcacctttactttgttcactttgttgtataaatgatttttgttctcactccctgaaccacgcgctaacggtggcgcgtgttcttaacacactttttagtttccagaatcgatggagactttaattaacattttgcccttaagcaaacaataaacaataataaaaaaataaaattaatttccctctctctctcaatctttgtgctttctcgttctccaaccaccggaaagagagagagagagagatctttgtgtgcttcttctacttcttcttcttctctctatcgctccgccgcgccacattcactgagatgcggcggtgtaaaaacaacactgacaaattctctgtgataacg

SEQ ID NO: 12843 - DNA, 3000 bp, Unknown
  misc_feature (1)..( 3000): cDNA_ID_3026705_gDNA_ID_2214575_Annot_ID_186331 3000 nt of promoter + ATG
gagtgtgatggagacgggaaattgagttgcgatgattgtgaatttggtttgtgcttcaagtgtgctattttaccgcaaaaggtaatgaggcataggtacgacgatcatcctctcttcttatcttatggcgaaatgggcgtggctggcaaatattggtgtgaagcatgcgaaacaactgtgaacccagaaaaatggttctatacatgcaatgagtgtgggatcacattgcatatttcctgcgttatagatacttacgcatattccatgccaggagcgttaacatggataggaacatttgtatccaaccactctatttgtagaccactttgctgcgtgtgcaactctcgatgcaagctccctttcgttcgtacgcttcccgaggacggagctgatctatacttttgttctttagaatgtgagaagaaaatttatcaggaacgtttcgaattttaaaattatgttctttactatgtttagaaaactatttatttatagatgataatgtttgctagcttgaatgactcgcaaatttggtagaatttgtgaggaatctgggtctgttaaattattacaagtccctacaataacatttggttgtgtacttgtgttagtgtaatatatatatatctcattgaaccctagggtgcattagtgtttgccaaataaaaaccagaaaaaatatcaacttatttatggatgtaagattggaaaaggttggatcaatcttgccagtcaatccactaaatgtttaagttcctacaagtcgaaatgtcaatgacaaaaacagagacgtggaagtgagaacagagcagagcaaaacagaacatagcagagtaagtcagtcagagcaggttgtgttgtagaatcacattagttctctgatagagaagccaaaaaactcagtttgtgttgttgaacttggaacagaatgagaacaagttaatcactaaaaaatgtttgtgtcaccgtcatgttgcgaccttaaaacagagccccctaataattttttgttacactggttctattgaatctattttatggaaaaactattacacaatttggtttaccaatacattgatccctatcaaggaagctatggtttcaggcactgagcacactgaagagtaatagagattaacaatgcaaacatcatcaagccatgtaattctgcagttttcaacttaaaaagtcaaaaaaattatgatttttcattcaaccaaagaaaactgatgctccattattacaacaaaactgtttccgtgtaattccacagaccattacaattgattcttcagactatctaggagaaaacaaaaaacctagatatggaattctagagctagaatacttatcgaattttcaaaactgagtaaaaaaaaaaaagtaaacatcaaacaacaaacaacattgattaacgatgtggtccaagacaagtctcttgttgtttgggtctggctgcatcaaacaagcttgagattttcggctgatcaattctttaagctaaccttcctcattgatttacgccaacttcatcctccttaacgcttccacaaacattacattcaagaactctcgaagcatcatgagtcttcgggggaagcggagctagagtgccaaaacaattctccttctcacacatatatctcacaaaaaagtaagcatgaggaaaattagattcatcatccacaccatttccacaaacttcttcttcattctcacctactgaatcttccatctcttcttgttcatcttgatcctccatctcttccataatctcattctcatcttcctcaccttcagaccaactaaattccactttgcaccgatcacagtcacacttaaaaccgtaatcctcaagcaatctcttttgtctactcgaatagttcatgttcacagggaagtagcttaaacaaacttctctaccttcaggaacatcatgaatcatcctaatgatgatatcagtattaccatcagaagcagagtcaacataatcgaatctacaagcattaggaagacaatcatgattgaaaaacgaagtctttggataaatcccataagctcgcacagatcttttctcattcgaaacagagcacggttccatcagaccaaaggcgttaactttatcctttgacagtaaagccgccgtgagatccggcgagatagacaccggaagagatggacacacggaagataaaagagaatgaagaaacccagcagctgcagaatcacccgcagaacaagaaggatctccattgctgctgccactaccttggagagagagcaaaatctggaaatcagaaggagaagcagcggcgagattgtaagcagagaggaggaaacgagcttggacttgacgatcagaaggttgatcggagaatgcagaggaggatgattggtgaagccggcgaagagattcgcagagccaaggagtatgagaggcgaagcaattagggctacaaaaggagacgagagagcaagattgacatttctgatgcgccgatgaagctaacaaacggaaacaatggtcgcagtaaggagaaacagaggaggagagaaatggaaaagcagagtagagaaggagaggagactctctgaggataacttgtccagcacgaagagactgtgccgccaccaaactccttcctcttccaccgatttctgcaaccctaagcagcgtctccggtttagctccgccgtcatttatcataatggccgtcgtcgattagggttttctacaaaactaaaactatttatatggaagaaacatgagaaacgctaaaacggtaacgtttcatcacgtttgaactttaaactcgttaggttatttggttgggccttatacaagcttggaaactttgggctatacgggctttctctcagtccatgtttttaccattgtgattaacttttttttggcttttacttgcctttgttttaccgcattggtttcttcttctacaaggagtctctctctcttagggtttatttatttcggccatg

SEQ ID NO: 12844 - DNA, 3000 bp, Unknown; identical to SEQ ID NO: 12841
  misc_feature (1)..( 3000): cDNA_ID_1835663_gDNA_ID_2214575_Annot_ID_186328 3000 nt of promoter + ATG

SEQ ID NO: 12845 - DNA, 3000 bp, Unknown; identical to SEQ ID NO: 12840
  misc_feature (1)..( 3000): cDNA_ID_2709735_gDNA_ID_2214575_Annot_ID_186326 3000 nt of promoter + ATG

SEQ ID NO: 12846 - DNA, 3000 bp, Unknown; identical to SEQ ID NO: 12839
  misc_feature (1)..( 3000): cDNA_ID_1807613_gDNA_ID_2214575_Annot_ID_186322 3000 nt of promoter + ATG

SEQ ID NO: 12847 - DNA, 3000 bp, Unknown; identical to SEQ ID NO: 12838
  misc_feature (1)..( 3000): cDNA_ID_2709741_gDNA_ID_2214575_Annot_ID_186320 3000 nt of promoter + ATG

SEQ ID NO: 12848 - DNA, 3000 bp, Unknown; identical to SEQ ID NO: 12837
  misc_feature (1)..( 3000): cDNA_ID_2709749_gDNA_ID_2214575_Annot_ID_186318 3000 nt of promoter + ATG

SEQ ID NO: 12849 - DNA, 3000 bp, Unknown; identical to SEQ ID NO: 12836
  misc_feature (1)..( 3000): cDNA_ID_2712676_gDNA_ID_2214575_Annot_ID_186315 3000 nt of promoter + ATG

SEQ ID NO: 12850 - DNA, 3000 bp, Unknown; identical to SEQ ID NO: 12833
  misc_feature (1)..( 3000): cDNA_ID_2709771_gDNA_ID_2214575_Annot_ID_186312 3000 nt of promoter + ATG

SEQ ID NO: 12851 - DNA, 3000 bp, Unknown
  misc_feature (1)..( 3000): cDNA_ID_2709761_gDNA_ID_2214575_Annot_ID_135171 3000 nt of promoter + ATG
tgctctacatggccagataactgtaggaactcttattcttcaggtatctctacctgataactctcaaaactatagcttctctattatcattttcacacgtttttttgtttttcctattattctaaaactgcatatccttttgatccgaaatatgattcaaatccaattccaataggtagtatgttgcatgcagcaagtacttttgttagaactttaatttactgtttcatgaatcaccaggattgtgctgtgggcttgctgtttgctctcctgccagttcttggtggcacatctggtgtccttcaaggagtgttgtccatggcgaaatcgtatgtatttttctcttccacgaatttctatgaaactatcgacaataccctgcttccattgttcacttgttacaataaaacctagtttttggttacactttctttttgactgggttttaatatctttccaggttggctattttgattgcgtttttgggagctttgtttgtattatcccgtacctgggtaccttggtttctaaaacttatgacaagcctttcttctcaggtatagacacatttcttacctgctccagttttggtctttaaattgtttatcaactcaagcgtttttcaatctttgacagactaatgagctctatcagttggccgctgtagcattttgtttacttgtcgcttgggttagtctgatccctttgttcttcttagctattggctgtttgcacatttgtgactctcgaattttcatttcttaaatccagtatcgttttggcttcttcagtgtagtgacaagctcggtctaagtctggagttgggttcctttgcggcaggagtgatgatctcaacaactgatctcgctcagcatactcttgaacaggcaagaagtcaagtttgactgtttcgaactagagggtctctacccatatattttggccactctcttattttgaaagtgtctttcttgcttatatactatcttggtttcctgatgaaatacgtttcctttctttggcacattctaccaaagtttttcatataaacctgttctgatcgcttctgtttccttgcaggtggaacccatccgcaatttttttgcagcactgttccttgctagtatcggcatgttgatacatatgcacttcttgtggaaccatgttgacattctgctagcagctgtgttactggtgatagtgataaagacggtggtagttgctatcgttgttaaagtctttggatacaataacaaaactgcagtacttgtaagaagcgaacccttttttttttccttctttctcatcattcgaaagaagccttaaggttttcttgtctgtaggttggtatgtcccttgcacagattggggaatttgcttttgttctgctaagtcgagcatctaatcttcacctaattgaggtaagctctctatgattattgatgcttagttatattatatgttagcatatatctttgaaaccgtgtgtgaccataatagatttctcataatttgcttttggtggagcgataagtaacaatgaaggggttttgtgtttatttgcagagcaaattgtacctcctgcttctgggaacaactgctttaagcctggtatggtctatttcctcatcatatttataataagttcatattcaaaaacgaataaacgaatattgacacggacgttgctttatcaatgaataacagtagaatttacatactccagtatcaatattgtataattactaaacaaattaaatgatgtaacaggtaacaacaccattgctattcaagttgataccagcagttgtacatttaggagtgctcttacggtggttctctcccgacagctcaaccgaggtaaatacaaatcatcgtcgtgtgtgtctctctcaatgactttggctcaaactcaactatgaactataatcttcatctgtacagattggtttcaaaggagagttgtatcactcagagagtgcaaagcgtatatcactgatgatccaaggttctcttcacgactcttgaagtgttgatggtatgttcacagcataacacgcaacatgaagccacatttggtctcaaggtaggcaaaggcaatgaatgggagcttccgaatgtatagatgctttgagatatcagaagagaacccccagaggaacctgtataaaatctctctacacgaagataattacagagacttgtaacttcacttcaattttttgttttgggattcttttttgagtaaaaaggtaggaagaggttatattttagtttgtttactttcttctcatgtgctctgaaacaaaataagaaacatctccaacgtattgtagtgattaccaaccgataaaaagctaaagaatttttgagttagtcgattacaaagtataaacacaaatttgaattgatacaccaaagatttctttaacatttcgtgggaggccgagtattatttggctttagcttcgaaccaagactctctggagatagaagctctggctaaatacatgacggactgagaggactacgggggctatcttaatttccttttatatgaatttttctatgttaatttaactttttagatattgatttccattgtaattaaaacgctgtttgtcctaattttattttatatatatattgtataggttccattaaccctacgatcaaaacagtttcatacaaactcgcctcatcttgttctctaagatcaacgtgtctgatcaagcttgatctgcttctcttttttttttgtttttgtaattattcttgcttgattcgatcaacgtgtctgagctttgattcaagtgggggtttggaggtatgtgagcgtcaaatcttcaagttttaattctggaattaggtttctcttagtgggttttttttttgtatcatccgagtgttgttgtttgaatataaatataaatccaaccactagaacatgttttacttactttggttttgttttacctccagatatataccgccatcgcc

SEQ ID NO: 12852 - DNA, 3000 bp, Unknown
  misc_feature (1)..( 3000): cDNA_ID_3026705_gDNA_ID_2214575_Annot_ID_135172 3000 nt of promoter + ATG
aaggagacgagagagcaagattgacatttctgatgcgccgatgaagctaacaaacggaaacaatggtcgcagtaaggagaaacagaggaggagagaaatggaaaagcagagtagagaaggagaggagactctctgaggataacttgtccagcacgaagagactgtgccgccaccaaactccttcctcttccaccgatttctgcaaccctaagcagcgtctccggtttagctccgccgtcatttatcataatggccgtcgtcgattagggttttctacaaaactaaaactatttatatggaagaaacatgagaaacgctaaaacggtaacgtttcatcacgtttgaactttaaactcgttaggttatttggttgggccttatacaagcttggaaactttgggctatacgggctttctctcagtccatgtttttaccattgtgattaacttttttttggcttttacttgcctttgttttaccgcattggtttcttcttctacaaggagtctctctctcttagggtttatttatttcggccatgaaaacgtctctgcgcttagaggatggaactaaaaactccttgcagatcccaattgatctcattatcgagatattcttgaggttgtcggtgaattctatagcgagatgtcgttgcgtatcgaagcaatgggcctccacacttagccgtccatatttcaccgagttgttcttgactagatctttggctcgcccgaagctattgttcgcctacagaaaaggtagcgattatttatttttatcgtcacctcagcttcaaaatcctgatgatgatcataagaagtcgtctcctgtagtcgtcaattatcatatgcatcatattttgaccttaggaagtggaaacatgtcatggagaacgatccaatgttgcataccacatcgttctttcgatggagggatatgcattgatggtcttatatattattatgctggggtcaacaacaatgatattgtgatagtttgctttgacgtcaggtctgaggagtttagatttattatcggagcactgcatcatggatctctcataaactacaatgggaaactaagtttgtatctgccgtcaacagtttattcccgttttaatggagtaataagaagtattaaattgtgggttcttgaagatgccaaaaggcaagaatggtctgagcatacatacatattgcctgcaatgcatgatataatgaaaaccacagatttacgttgtgttggaatgactcagacaaaggaatttgtcttctggtcgataaaaggtatgcgtttctacgttttctactacaatatcgaaagaaacacaatcaaaaaggttgaaatgcaaggaatggaagcatttaaagagagtaatgtttacacctttctggatcatgtagaggatgtgaagctaatgcaattcttttaattaggactttttaagttgacacctagctctttgtaatagaactagtttggatcttggttctcatctattcctctctgatcttagaacaatatttataatgctggattgactttcttatgacatttttgttttcagaaactcaaaaaaagaaaactgagtcccaaaataatatcacctcgtcggactgagtttcttatgagtattaaaatgtgggttctagaagatgatgaatctcataagaaaactcagtttggatcatgattcatcatcctcgttggactgagtttttttatgagatttttgttttgtttgaaaaaatatattgagaaactattaaatcgttaaagatttcaagttcaagagaattgtatgaaagaaagaatgtgattgattgatcctaataaaaaacagtatgttctatttttttttagtatgatatcaaaattttcttgattaactattaatgatataatataaaaatcgtcaaaaagcataaaaatggtaaaagttattaatctaacataaaatttacttggaaacaatacaatttgtttcttcttagccataaaattgacaaaacgatataatataccgtaaaatctctataaattaataatattgggactgcaaaatttattaatttagagaggttttaatttatcgataaattaatattcattattttatagagagattttcctaatttaataacttttaaaaaatttctataaattttttttcattatagaaaatattgttctaaaatcaataataagtaaaaatcatatcatatttagaaaacaacatcaaatgtttttgatacagtataatattaaaactaaattttaaataaaaataaatacaaatttatggaaaaaaatattagaaatatatttcaaagaaatttcttacatataaaatatatatataattgatacatttatgtaattattaattaatgatattgatggaaccatatatttacatagaactttcaaaaaaattattatcttattatttatcgatttgtgttaatttttatattggtttggtcccaaatattaatttataaaaattattaatttattaagtattaatttatagaagttatactgtaacttataaaaactacgaagatccgcaagtgaccaatcaaaacttcagctaccaaattagtagagataaaataaaatgaattatagtatgaataaaatgagaaaatgattacagaaacggcgccgtttaaagatcggtgcaaatcaaattgaagaagactcatcggcgtcggtgggaatgatttgattaaccgctggacaattaaacgcaacgcggctttgcttataagactcagacatcgagacagagagagagagagagataagtagtagtggtccattccatcgaagaagaagacaaagtgaaacccaaaagagccgttgaagcgtacaatctaaggcagtacccacaataaagcttaagactttattattgttgctatctctttcaatttcagtttcaagatagaaagagcaagaaaggcgcagtctttgggggtttctcgggtcatg

SEQ ID NO: 12853 - DNA, 3000 bp, Unknown
  misc_feature (1)..( 3000): cDNA_ID_2709783_gDNA_ID_2214576_Annot_ID_135176 3000 nt of promoter + ATG
ctaatatttattagtcaataaaaaaattcaacagtcattatggagaaattttttaaaagtaacttataattgacaaatattgattttttattattttatttttaaaattccttagttttttaatttgagtcattttacaaccaccacttttaaaaataaataagaaacccctatgcttattaaaatttatgtagtctagtactcttatttgtttaaaaatatatatatacaattagcatcaaaaacaattggaaaattatagtaaaaattattggtttaaagtggttaataaaaattttgatatcttatggatatattatctaatcatttgattgacctatatatgattgcatttgatatcttactacattggctatatatcttttcaaaatttgctaaaatctattaggaaaattgtcattggaactgatatttacatggtgtatatatgaaatggttgatttgttaacaagccaaaattaagagttagatttaaaaagtaaacgaattgattggaccaaattaagggacttattctgtgattttttttcattttcttttgttctcacacttggaggttaaactggtaaatactaaaataactaattattttattattattttaaagtaatttaatttataaatggtaattaagtctaacaccttttgtccagttatacaattagtcaataatttactttctttgaaagtaattaattaaagtagttaatgattttgcaaaactgcctaaataacacctaaatttattcttaacccatctatgtatatgtttactatgtatgtatatatatttatatatatatatatatatatatatatggccctctacttcatacttagaagcaagaagctcatagaaatttacttcaaaaattgacctcaaacgacaagctaaaagaggtgaagttctttttcctatcttttattttaaatatggctctgtttatatatctatatttatatattacttactgttgatttgaaagaaattttctattcgaatatgtatgtgagaggaaaggatatggttcaagtgtcattgttatcgggaatggcaaattatattcctttcctcaaaaaatttagcataacaaaactaattatccatcatataaaaacaatcacatcgtatttgttttctattgtcttatgctaaacaagttttatatataactcatgctcacgttaacgaagacccatacaaaaatgggttgattttcttgatctccttcattggagaacatgactgattttcaatagtcactaaagtatatacatagatatatactatatagttgtttttgatattttaaatggataaaaaaaaagatgacgggatctatcatttgggaaattattcatagatttatttaaatagttcctaactaattgcttgaatatgggaagagacgacgaaatatagttaaaaaattggagtatcctttttggtttttactttaccatatacatgaaaaatatatacaatcattcttctttttgtcttcttttatctttggaatatttcttttcacattcaatcttccatgacacacagacagacatatatatatgtgtgtatgtatgatatgataggaactttttaaaaccaaaaaagagagacccatatgagatgatgatgacgattgagacaaataattattttgacaatttaagaaaaacataagatgctttgtggattaacttttgaaaattcaagaaatctgtccctatatatatgaaaacattagctttagaatacaattttatgagatttatttagtttatagtttatagttttaaatttatatttatgtgttattaaaattgtaaaattatatgaaaacatagtcgcttagttttacaaccgctaatttatttcaaactcaaaatattatatttttattccttcttcggttacgtatttttcttatgagatattatatggtcaaacatttaaaattagttaaatgttacatacacacaaattccaacattttcatttctttttaaggaaaaaaccatttcatttctttaagatatataaaaccaaaaaaattatgtttttatatagcttagatcgtgatgctaaacttttcttgtaagagcaatctcgtatagatattttatgttagtgtcaaatatcttcttctacaatttctaaagtcatattacactatggtaattgttttctaaacccttttagatccaaaaaaaaaaaaacttgaaatttattattcacatatgttagcgagagagaggagctgttgagggttgtctcacgcaccatccactgtcgttttgtggcaaatggattgggtccaccgacctctgtagctctcatagtttcttttttttctaaaattaattacatatttagaaaaaatgatatcaaaaataattaatagctctgtatatgtgttagtgtctacaggcgacaccaaaattatataaatattcttatttaaatgcgttacaaacaaaagaaaaattatataaaattttacaaataaatgtatagagtttttagtatcatatgtatcatacatatgaaattagagctataccaaactaaccaagctagatttaaattcagtttgattatcttaccctatttttttaaccgaatatgaacttttaacactctaggctataacattgggtggtgacttatatttcttctttctttttactagcctacactctttttcacctgtcactttcaacttctctcttctattacctcacaagaatttctatgtttttttaataattttatatctatttaaaaaaagtataaccaattaattaaaaatctggaatatcccaattttagggctttattgagataagatatcagtggaagtcaaaaaagaatttaatgttaaagagtttcttctctctaatttcatttcatttctctttttttttttctttttcttctttctctctctcaccatcacatagaacacagaagaatcc

SEQ ID NO: 12854 - DNA, 3000 bp, Unknown
  misc_feature (1)..( 3000): cDNA_ID_2709787_gDNA_ID_2214576_Annot_ID_135177 3000 nt of promoter + ATG
aagactcaatcgacggcgttggattcgtcgccgcgcgagtcttcttcggagtccgtggtcgtttaagaactcgcgaagcgttaaacgagtgttgagaccactcttcctcggagatttcgtcgaaatcgcgtttcatcttccgagaatttacgaatcccagattgaattgaaattgagaagaaggggaaaaaaaattcacatgaagaaaattgaaaaccctagattgagattgaagtgactattattgcatcgaattgaagaagaagaagaagatgaaattaaaacgaatttagcggagaaggaagggaaaggtcaagatttcaaagaaaggttagagactcaacaacgtgttgcttcttacaaaagagcggcatcctccaaaagctatgcgcgcggacttaatctcttaatgggccccaagaaatgggctctaatgagtacttaatggtgaacttaagggatccgaagaaatgggcccaacgacttcactttctcgacaaatctaaaagcttgtggtttgtttgacgcacttgaaaagggtttttaaatccatggggtttgcttgaagatttggttttgaaatgatggttgaggtgagaaattatttggttgacatgtattcataatgtggaagaatctgagagtgtgtttcgttggatggtggatactggataggagtcttataagctggatatgtacattgaggggtatggtaatagagctttggctacgtttggaatgttgcggtaaagataacctcgtcgttctcgatcttaatcctcattctacaggttattatcatttgtatatatatgtttactagctaatccattaactctgaaaattaatattaactctcggaatggcagaaacagagttgttattgagtttctctgaccttgccatcttggtgacggcagtttcaaatactaaatatttccatacaattttggttcatctaaaacaactgggtcttgggctgtttgtggtatatctctccttatataggctcttttgtgtgcgtgactgtgtgctatttcatattactaacttgaaatcatattacaacccaatcagggaggccctgattgaatatggcccggcactgacccattgcagttggtacgatctcagtataacttaaaaagcatcgatggtaatgaagagaggatcaagttgagaagtcacctgttacttaaatatgttgtcgtttgtaaactaaaataaaactaaattgtataagattaaaaagcccaagtgaaaaggagaaaatcaaactttacggtcgaataataatatatcaataatattttctcaaagctcttaaagtgatattggagattttgtgatatatcgttttaaaatctattcagatcggttgagagttggttactcgttcaggattaattaggtttgattcaaaaccaatcggttcgattgttttgcattgaacattctgaaaggttgaagaattgaaccaaagaagaaaagcaatatattaattttcatacaagaatctaacaaattttaaaaaattctctattgattggtgtatcatgtgtattaatatacgatatgttatattataaacgattttattagataaaaacaattaaaaaaaagttagtacaacaaaacctaatcaagttaaatgaagagaaaacgagggttttgtcttaaagctcaccagaaagatacgaatgagaaaaatgtggtacccacaacacacccccgcatgtggacacatttcaccgttttaacagtgacacccaaaccgtaaccatccttcttaattctgtcaaattaaattataagaaagaaaaaaagtagctttattttatattaatcgaaataaaataaaatgatagagacagagaggggaccttagagacatacttttcaagatcatttcatatatggcttatttttaaaagaagaagaacacaaaacagtagagagagaaagagatatagagatagagagagatagggctttgaggtttgtgtttgtattataatacataatatataggaatagtgtcttcttcttcatcatcatcttctatctcatcatcatcatcatgcatcatcttcttcttggttctttctttagctccgatttatagcttttaattttgactattttttttccttcttctacttggtttctttctcttgatctcaggtacaagaaaaatacaacttagaaatctttcctcttaattctttcaaaagtttaggaacaaaaaacaaaagtataaactcttaatttgtttttctttgtttatgtcttctagtgaaatggtttttataaaatttcttcatgtcgtcaatctctatggatttttcctgttcttataattcctcccttcgttttcttcttaacttttttgtcttacgaattatttgtagattattctcttccacgcaaagaagaagatctaaagatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaagcaagtatctcttacatataaatctctatatatttatcacctttctataagaatcactatatataagctttaagataataccaagaagaaaaagaaccctaatcatttgttctattttgttttgtatatctagctagtatcaagatttcatatatattgacaggccagtatatcttatatgtttatacgtgtatatgtcatttgatttatgtttacatgtgtgtgtatcatttttttcgatatagtctacatagattgacattttgggtctaattggtgacttaatttaaatgattaaattctttaattatatgaaacagatcctgatgcggaagtggtagcattatctccaaagacactaatg

SEQ ID NO: 12855 - DNA, 3000 bp, Unknown
  misc_feature (1)..( 3000): cDNA_ID_2709791_gDNA_ID_2214576_Annot_ID_135178 3000 nt of promoter + ATG
acactttcctcttcacttctttggttgatttttgtttcagcttccatgggagattgtgtcctcttcggtgaagctgtagattttgttctctttgaaaccctttgttacatacatcgcatatgaatctgtttgtagccattagtgtctttggagataatgctaccacttccgcatcaggatctgtttcatataattaaagaatttaatcatttaaattaagtcaccaattagacccaaaatgtcaatctatgtagactatatcgaaaaaaatgatacacacacatgtaaacataaatcaaatgacatatacacgtataaacatataagatatactggcctgtcaatatatatgaaatcttgatactagctagatatacaaaacaaaatagaacaaatgattagggttctttttcttcttggtattatcttaaagcttatatatagtgattcttatagaaaggtgataaatatatagagatttatatgtaagagatacttgcttgggtttccgggttggtttcttcgtttcttgggtggtggagctgaggagttaggttgttgaatcattgacataaaagtatctttccggttaaagtcgttatctccggtgccggagctggtgatgaagaaaggctgagcagaggatgatgatgaaggaataacgcttgtgttatatgatgatgacgacatctttagatcttcttctttgcgtggaagagaataatctacaaataattcgtaagacaaaaaagttaagaagaaaacgaagggaggaattataagaacaggaaaaatccatagagattgacgacatgaagaaattttataaaaaccatttcactagaagacataaacaaagaaaaacaaattaagagtttatacttttgttttttgttcctaaacttttgaaagaattaagaggaaagatttctaagttgtatttttcttgtacctgagatcaagagaaagaaaccaagtagaagaaggaaaaaaaatagtcaaaattaaaagctataaatcggagctaaagaaagaaccaagaagaagatgatgcatgatgatgatgatgagatagaagatgatgatgaagaagaagacactattcctatatattatgtattataatacaaacacaaacctcaaagccctatctctctctatctctatatctctttctctctctactgttttgtgttcttcttcttttaaaaataagccatatatgaaatgatcttgaaaagtatgtctctaaggtcccctctctgtctctatcattttattttatttcgattaatataaaataaagctactttttttctttcttataatttaatttgacagaattaagaaggatggttacggtttgggtgtcactgttaaaacggtgaaatgtgtccacatgcgggggtgtgttgtgggtaccacatttttctcattcgtatctttctggtgagctttaagacaaaaccctcgttttctcttcatttaacttgattaggttttgttgtactaacttttttttaattgtttttatctaataaaatcgtttataatataacatatcgtatattaatacacatgatacaccaatcaatagagaattttttaaaatttgttagattcttgtatgaaaattaatatattgcttttcttctttggttcaattcttcaacctttcagaatgttcaatgcaaaacaatcgaaccgattggttttgaatcaaacctaattaatcctgaacgagtaaccaactctcaaccgatctgaatagattttaaaacgatatatcacaaaatctccaatatcactttaagagctttgagaaaatattattgatatattattattcgaccgtaaagtttgattttctccttttcacttgggctttttaatcttatacaatttagttttattttagtttacaaacgacaacatatttaagtaacaggtgacttctcaacttgatcctctcttcattaccatcgatgctttttaagttatactgagatcgtaccaactgcaatgggtcagtgccgggccatattcaatcagggcctccctgattgggttgtaatatgatttcaagttagtaatatgaaatagcacacagtcacgcacacaaaagagcctatataaggagagatataccacaaacagcccaagacccagttgttttagatgaaccaaaattgtatggaaatatttagtatttgaaactgccgtcaccaagatggcaaggtcagagaaactcaataacaactctgtttctgccattccgagagttaatattaattttcagagttaatggattagctagtaaacatatatatacaaatgataataacctgtagaatgaggattaagatcgagaacgacgaggttatctttaccgcaacattccaaacgtagccaaagctctattaccatacccctcaatgtacatatccagcttataagactcctatccagtatccaccatccaacgaaacacactctcagattcttccacattatgaatacatgtcaaccaaataatttctcacctcaaccatcatttcaaaaccaaatcttcaagcaaaccccatggatttaaaaacccttttcaagtgcgtcaaacaaaccacaagcttttagatttgtcgagaaagtgaagtcgttgggcccatttcttcggatcccttaagttcaccattaagtactcattagagcccatttcttggggcccattaagagattaagtccgcgcgcatagcttttggaggatgccgctcttttgtaagaagcaacacgttgttgagtctctaacctttctttgaaatcttgacctttcccttccttctccgctaaattcgttttaatttcatcttcttcttcttcttcaattcgatgcaataatagtcacttcaatctcaatctagggttttcaattttcttcatgtgaattttttttccccttcttctcaatttcaattcaatctgggattcgtaaattctcggaag

SEQ ID NO: 12856 - DNA, 3000 bp, Unknown
  misc_feature (1)..( 3000): cDNA_ID_1009528_gDNA_ID_2214576_Annot_ID_135179 3000 nt of promoter + ATG
gcacaattaagtacacgatattaatcttctagctgcaaatctcattaatttcccatcaatccaatgcaggttgaatatgtattaatggagagaaagcaggaagatgcatataaagaagccatagaggagtatcgtgctgcttctcaagcacggcttgtgaagctttcatcaaaatccttgaattctttagccaaggcacttccaaagcgtcaaatttcaaactattttactcaattccggaaggtaattctcagctactaatacaaagccccttttgtgccaaatgagtgtgttattcatgtgttattaaattttggttgtacagattgcaaaccatccattgttaattaggcggatatacagcgatgaggatgtcattcgcatcgccaggaaattgcacccaatcggtgcatttggatttgaatgttccttggatagagttatcgaggaagttaagggtttcaacgatttccgtatccaccaggtaaatgtttctctttccaaaagcagttgaatatccattaacaaacatgttatgcaattgaagaagctaactaacttgtttctttccatagcttttgttccaatatggagttaacgataccaaaggaactctctcagacaaacatgtcatgctctcagcaaaatgtcgggtacgtgatattcttcttcatttcataagtcttctttgtgaaactgattaagtataactaaacctgtgagcgatctaaatctccctttatgtatcagacattagctgagcttctcccttcaatgaagaaatccggccatcgtgttctaatatttagtcaatggacatcgatgctcgatatcttagaatggacacttgatgtcatcggcgttacataccgaagacttgacggcaggtaataaaagaaaaaagagtaatttgtcacatttttgacgattctacaaaaaggaagaagcttaagtcattttccttttgttttcaacagtactcaagttacagatagacaaaccatagtcgacacattcaacaacgataagtcgatattcgcatgtctcttgtcaactcgagcaggtggacaaggtcttaatttaaccggagcggatacagtcattattcacgatatggattttaatccacagattgatcggcaagctgaagatcgttgccatcgtattggtcaaacaaaaccagtcactatcttcaggtttgagctttaaatccttgaatcagtttagataactttcagaacaaaattgtggtttggattggtttatgtgtgctctgttttgtattctcacatatatctgtattaactctggcaatgctggtgcagactggtgacgaaatcgacggttgatgagaacatctacgagatagcgaagcggaaactagttcttgatgcggcggttctagagtccggagttcacgtagatgacaacggagacacgcctgagaaaaccatgggagagattcttgcttctcttctcatgggataacattattgttaccttttttgttttgaggtaaaattagtcaagaaacgaagttaatgtgttattctaaacatgtgtaaccactagctattattagacttaaatttaatagatcacgatagttatattttcttctacgcatgtaaattataacccaaaaatttccttctttagacctaaaagtcacaattgttccaaacactaaaatgtggatcagtgatcaaatgaagtgaaccttcaggatagtttagtcttcgatcatcaaagattgtataaaggagtgacttagctgtatttgtaggtatcaaaattgaaaacctcacgcaatgattaaaggtctcaagtatctttattcgtcagagttgtataagacacaaatctcactagattgttttcccattgtctttgccgaaacctaacaatgaacaactagttctattaggattggttcaagaatgtcacatagtataagtttttcttagctgaaaaattctagataacttggaataaattctagatagtcttttttttttgctacatttgaagataaatatctatgaaaatgttcaaattcatgattatattattgcgattaaataattgaatatgactatacaaaataattcactagtaaatcaaagccatactaagtttggattctttgtggtaactgccattgccaagtcacgttttgaaggtgttctcatggtcaatttacacttaaaattgaacctgaaaactaaggccaaccggaaacttgttgaattgtgtgaagtgagaaaatgataatcgtgtataacttataaagtcacatgataaagagaaagcaaccagctttttgtctgccataacagttctttaaaatatagccacaattatactacttaatttagagtaactaatcccaaatattacttatctaagtaataattagaaaagtattcgatatttattatcaattgcgttttaacttgctatataaatacaaagtttaatttttatataacccactaactttttcattttggtatatgataaaaatactctatcccgtgactattccacttgttgttactttttagttttttttttacatagccattatcattgtggactccacaacatccgcaaactcaattatttacttttctatacgtttatttgtttttttctgatacaaaatttggtgcatgaatgacttctcgaaacggtagatggactccacaacatctgcgtgtcttgtcaccttacgttacggaccacaatttacacctatgaaagtgtcggtaaagcaaataaaatcgagaaactcacaccactcttattcaaatccaaagtgaatactccaaaaataaagtaaatgatatttatccaaaaatatctaacaaacgcgtaaaatgtgaattatcttgaacgttttaatacctctttactctctttatatagtgccattttcctcactagcagcaacacacttgaacactactttcgaactctctctttatctctcttgca

SEQ ID NO: 12857 - DNA, 3000 bp, Unknown
  misc_feature (1)..( 3000): cDNA_ID_2712696_gDNA_ID_2214576_Annot_ID_135180 3000 nt of promoter + ATG
tctattagcttttacagaggcctgaaaaaacttagagttcttatccccacgagacatccatttatccctgcttttcaacctccaaaaagattcctcctctctaaaagcaatacccagctgattttgaataacagaaatcttattccaacaaggaaactggtaactcttttcttcatccaaatcaaatcttaactttttaattcgactctttgcgttataatcctttccttttttccagtgactaatagatgacctacagtcaaccagacggcgcatagaagaaggattatgagaagaaaaattacctatccatgctttgtgaatagcagcttggtataaagggtcttcagcataccttttatcaaacctgaaagttcctcggaaaagctcatgatcattaacaaacttcaccaaaaccggtctgtgatctgatccaagtttctccaaaaaccattgatgagaattaggaaacaaagaaaaccactgtgaatttccaaaacagcgatctaatttacattggatccattcttcatttcttttgcctccccaagtaaaactatttccagtgccccccaattcatgcatatcactggttgatatcatattcttgaagtcctgaaaggaagattccactctagatgggccacctattttctccttattagacaaaatatcattaaaatcccctatcaagcaccaaggagctgttctgttcactccaatgttactgattttatccaggagcaagtgtcttagcctctgtcttggattatcataaacacaagagataaaccatctcttacaaccttgagatatctccaaatccagcaagtttttgtcttcaacaaggaaatctgtatgaaggtgatgtttccaaaatattgctaaaccaccactctttccatccggttcaatagtatgaaagtaatcataacccaaccacctaaagactttcaatatgaacatgtcagaattcatggtctccatgaggaacaaaatgtcagggaaatatttctttttcatttccctcaagtgtcgaattgtccaagaattcctcagtccttggcaattccaactaaggatgccttattgatactgcggtggttcttgaggaaccaccgtaatgacagccttttccatacaatccactctttccaagtctgcaatttccttttttcgtttgatagcattagcaaactcaacattaagactaacctctttttcttttgaaccatcacgagctgcttgcttattgtgaactatagaagcctttctttttcttggattcttctgcttaatacttaatcctgatgcccccgattcattaaatccaaaagggaacccttccgaatctattgaagatgcttgatcagcggataaagaaggtaacttggtaggaacaatcttctctcctggattcactaaacaactctttccatcaagaaatcctgaatcagaaaaactaagatctttctttgattctttagagtttccgaggctaacaaaggggcaaacacttttctcatgtgtgagtcgttgacagaggaaacatctttttcgaatcctttcataatcaaaggaaactgaaatcaattcacccgatggaatcaggacttccttaaagttacgcaagggattccgaacatcaaagagcacttgaaccctgatataattttgtgcctgagatttttctaaatctaattccacagtcaatactttcccaacacatcctgcaatttctttgatagtatcttctgtgtagtagttgatcggaatatttcggagtcttatccagactggaagaaacaaaagagaatcatctgaaggtttttccacccaacgctccatcaaaacacaccactcatcctgagtccaaactccagattttaagatttcaattaaatcttcttctgatttgaaaaagaattgaaatctctcttgggataaagcaacacctcttacccttgaatacaacctccaaattctaggcatgtctaatatccaattagacatcctttggagtgacagattcaaaaacctatccactaaactgcaattatttctgtcaatcgagcaaaactgcgcttgattagacaaaataagaggctatcttcgttaattgacatttcctttatcgcttgatccaagtccatgttcatctccactgatagaagaagaaagcactttcctgatacctaaacttggtgaatatatctttgccgacagaaaacggggatatcttcggtacttacctcctctcaaatatcaaaaaactgatgtagagggagaagttcttatggtcaaatcgattgggacggctttattaacggcgaaggagaaattttccagaaaagctactatgaaagagaacagagagtttttttttttttttttaagtactattggagactaattattcatagtagttaccatttaaacacgtaatgttttcatttagatacgataaaaaaagttaacaaaactctagtgtccttgactacacttttcttacttttgacgtggtcactattattgtggactccccaatatctgactaactcaaattttacctttcttcatacgttttttttatctgtttgttaattaattccagaatgagttgtcaaaccagtaggatttctctgcatgtcgtgtcacttgcattttaaggacagattaacggttatgactagggtcggtaaagcaaataaatcgacaaaattagaaaacaaagaaaatgtggaaaaagcagtcaaaagaagaaaaatgttgacaaatgttacgaatttggtttaaatcaaaagtgaattatccgagaaagatgatatttacccccaaaatatctaaacaaatacttaaaaatgcaattctctaatagactatcaaatatcccgatacctctttatatagtgccatcttcatccttagtaatgtacacacacacacataacacttatttccaactctgtctctctcaattttctttctctttctccaaac

SEQ ID NO: 12858 - DNA, 3000 bp, Unknown
  misc_feature (1)..( 3000): cDNA_ID_4262185_gDNA_ID_2214576_Annot_ID_135182 3000 nt of promoter + ATG
atagaaggtagttttggtaagctactggtaatagttttcgtattaatttatactatatatctcgtgtttgtgtaattagaaaacaaacgtatatactgaaacctagacttatccatcacacatatagaaagtcaaatattctatgatgattcttgtgaatgcatgtatgcaacatacacaaatacactcatataaacatgtcttgtttttttgccttgtacgatattctatatggtttatataattctttagggggttcggtcacggtggaggcaaggatttgcaaatcgaggagccaaaagttcaagggaccgtgcgtgagtgaagacaactgtgccaacgtttgccacaccgaaggttttcccgatggtgattgcgacggactcctccggcgttgctactgcaacacacattgctgattctcattacatatatcaaattaaatcaactatatagtaaactaactctatatatttacatgtttattttcttcgatcttattgacgtacactttactttaaattcggttcatgcaacttatgtgaggaaaaaaatcctactatattatttgggaagtacattttaaatataaccttaatttttgtaagaaattacataggtatgccattagaaataaaattttaaagagtaaattaatttatctctttaaggattaaaaaatcaattactaatttaattaattaaatttaattaaaaaacgaaatacattattaattttcaaaaataataaccaatcaaaataaacatataagatttgatatctaaatttttattaatttaatttaattagaaaaacgaaatacattattaatttccaaaagagtaacctattaaaatcaacaaattagatttgatatctaaattatcatattaattttttattaatcattatagttcacttcttatctttatatgattctatttttgcaaaaaataatatcatcattataaaaaataattagagttttttcgcatatctcataatttaaatttttgaaaattgtgaatataaactgttcaatacatgaaaaatattataacgggtgaaaaatagatttaagaaaactttctactgagtaaggggtcatatttgaaatatttatattcaatttcatacatattatattgaaaatttataatcttatatactacaataattaataacatattagattattttatgtgtatgatatgattcaatttttaatacaagatagaaaatcctagaattgacgggtttagatcgatattaatacaagatggtatactacaggtgaaactcttaaattaacaatcaaactacaagtgtataatcttaaacactaaacaatatagataatatcaacaaaacatatacaactcacagtttacttttaatattttatatacaaaatcaattaaatcttaattaaatcttaatcacataaaaattagcacaaaaaaaaaaattcaacaattaaattttttatcaaatctctgtgttatataagttttgatactatattcgaataaagtgtaatataccttttcaatttgtattctttaactaattcaagctaactaatatatttgctaatcttatacctatcaaaaccgactatcgtttcttatctctatagtatttttgcaagacttttttggtggattggggtaaaaatgcattcgggtcatatggtatattcccctattaaataaaaatggtatactcctatgttattagctaaaatgtttagattataattcagagtcatatcattaataaaattaatattaataaaataaatggctttttggcaagacggatttggagtgacgggtttttgaatcaacattaataaaaaagtaaaatataattaatacaccgtttcaatacgggttaaatctttaatttattattttttaagaccactaatattaaacatatcaaatcatcctaatttagaaaagattatataaaaccaaaaatgttatgtggtatgtataatgttactatatataaaatataaatgtattagagaatgatataatttgcaaaacttttatctataaaaaataattcttaaattttaaaaattactactttaaaaaaagaaatcacgggaggggtaaagaaattatagaacgggttttattttggaattgggttatatggtggatgtatttgaatcaatatttataaaattttaaaatattattaatatgctgttttaatagaggttacaacttcgttttttaacaattgtctcatagattcgtggtatagccttacttaataacaattataaagtgtaaaatataaatattttataaaaataaaatttgcaaattttaatatatattacttttaaaaaataaatcgtcctgcggtataccgcgggttaaaatctagttatcatatatagtcgtaatttgtaaacaaattaacaaccaagaaaaagtttattaaagcaaattaacaattactaaacaaagtagtaattaaacacatcctgatttttttaaaaagtatttggagggtcgaatttaataattaatcaggatttcattatgtagcttaattaagatttaagggtgcaaatttaccataaacgtgtaaaatttattattcatctcttgtcattaagtaagatgtataaagaagagaaaaattagaaaagttttattcgttgatcaagacgattatgcattcttctttgttataagttttttccttgttctttaggattaaatactaatttgattatttaattgattggtcagcctttaattacgactgcatctatatgggtaaaggttttaactggttcacgttttgtttctattttttgtaaggccataaattatttatattaatttgtaaaaacaaaaccaaacattttaccaacaaaagaattcatcccctttatatagtgtcatcttcttgatcttcttaactaccattagctttctctaaacatttgtatcttaatctctttaaaa

SEQ ID NO: 12859 - DNA, 3000 bp, Unknown
  misc_feature (1)..( 3000): cDNA_ID_3026758_gDNA_ID_2214576_Annot_ID_186355 3000 nt of promoter + ATG
aaaacgttaggaataaattggctgctgacatcttcaccgaattagggtcagtcactttgtagaagtagcagacttctaatcaaaaagtagtggagtataagatagatttatcagcttttgtttcttatttcataaaactttgtcatttgaatattttatgaacatctgtatggaacaagatttatgaagtttatttagttcaactcctgttttacaaaattactgtataatggttgtttgggttaacaggtgctttgatttgaatagaaaacgactttaaacatgcttttaaacagggtttttaaaaacatgcttttaaacagggtttttaaacacgatttacaagctgctttataaggattttaaaagtgttgaaaaagctgcaatagcggttattatgaaaaaaaattacaatcgtttttaaaataatttacaaccgtttttaaaagggagaaaatgtcaaataattgccgaactttcaaaaagtggccgtttaatacgtcaacttcgtctaaggccatattaaacatcaacttatcgttgaccaaacttttaaaacatggaatatcgttgaccaggcccattaagacatctcgtaaactctgttaacagacccactaacagacgtttagatccgttaatacttctctgttagtggcgaaacgaccacgttttggtcctaatcgaaaatcccatatctgataaatccccaaaatcgaacttgaaatccctaaacttgaaattcaattccaattcccagattttgtttattcttcttcttctacattgtttatacgggattggagcttcaaatcttcttatcttcggaattctccatcctgagctcaagaaatgagttcaaattccgcgaattcgaattcgagtattgaagacggaggtcgttggggacgtgggttaccttccaagtgtatttgttggttagacgtcgttgtctacacatcgggttcacagacaaaccctggaagacccttcttccgctgtccaacgaagaaagatgtaagtttaattgattttgtgttttgaatttggtttggttgataatttgttttggattgaaatgtaggatcatctgtttaaatgggtcgaaaatggtgtgtacgaagaggttgttgatgctttaccgaagttgtccaacattgacaatgagattaacattgccaaatctgaagttgcagccgaaattgatgagttataggctatgatcgtagtactgaaggaagaaggaatgtggagctcaagggaaatcaagaaatgcaaattgatgatcaaagtgtgtttggtgagtcttggtttgattgtcattgtctttggtttcataatgttcggtaaaaccaaaaatcagaaacttgttctaggttactagtggtgttggtatccaaatgtttttttttctatctttgatgttgttgtctacatggtactttattaatcaaaatgctgttcatgttattgtcttgatggctctttattaatcaaaatgttgttttatgttgttgtcttgaaagacaaatttttagtgcaaatcaaaaaatgtcatacaagaggcaaacatgtcatgctctttatcaaagtcaaagctgaaacaagcttaagttgatacaaccaaaaaagccgtgataatgccttagttttgacaccaaaaaaaacgatagtgttaacaacattaagaggaacactcaagccgtgataatgccttagttttgacaccaaaaaaaacgatagtgttaacaacattaagaggaacactcaagccgtgataatgccttagttttgacacaaaaaaaacccgatagtgttaacaacattaagaagaacactcaaaccatgatgctaatccagcaagtccttgtggttgtgctgggttgcctaaacccgatagtgttcaatcatcgtttttaaaatgatttacaaccgtttttaaaagagatttacaaacgatttataagctgttttaaaagcgttttaaaagtgttgaaaaagctgtagtaactgttattatgaaaagatttacaaccatttttaaaatgatttacaaccgtttttaaaagagaatatcaaccgttgaaaaagttacagtaatgttaaacactgtatctgttactaattgggcctaggcctgttatttagaaaaacaaactgttttagtaaaaaaacactaaaagcccaaaaaacactaaagcccaaaaattcactataacccaaaaacaaaaaaggaagggaaccgtgaaaagacaacaaaaaagtaaccaaaaaaaaaaaaaaaaaaagaataaatgtcgtcttcgtcttcttcctttcaacaatctgaagaaaatctgattatccagcaaaaaggaagcaattgaaggtaactaatttacgaaactgaagtttaacatttgggtttgtttgatttttgccgaatctcttttttgttctagcatttctaggtttttcggttgaaaacgaaacaagtaaaataaattgatatttgggattttgagggagtgttgaaaattgttatataattttgacagatttatgttttaaagtttgatatttgggtttcaaaaaccttcaaagaagatttcaaatgccgattaacttctctgttgtagcaatttcaaagttttttcgttttgaaactttaacagtaaatagattgatgtttgggtttgtattttaatttatagatcctcacttaatatatgggttaccagttgattggagttggtttggaaaagggctttttgtttctattttcagcggttgtgttctttgaaaatgattaaaattttgtttttggaatggtttcaaaacggtctttaaaaaggattatggggtaatgactgtgttttacaagggtttttaaagtcttaaaacgacttctaatgactttgaaaaatggttttacaagggtttttaaagttctttaaacgacttgtaatgactatgtttatgtttcgaaaacaacaaatgcataatagatttacaaaaatg

SEQ ID NO: 12860 - DNA, 3000 bp, Unknown
  misc_feature (1)..( 3000): cDNA_ID_3026770_gDNA_ID_2214576_Annot_ID_186352 3000 nt of promoter + ATG
tggtgaagaaagcaagacttggaatatcaagcaagatatgttgcagaatctacaaagataacactgcaaatttagaaggttgacacaataaacaagtcaataagattaaaattacaatgatggtgaatgatcctaaacctctggttgcataaactgaacatttcgcctgaagacaaacaccacagcacgaactaccagatacaagatgagccaaatcaatcaatcaatcaacatgaacacacgaaatcaaaatccgcagcaacactaacctccattaacaacgaaattgagaaagtgaaagaccttttgcgtcgtccaaccatattcaggaactctcaattgtattctcacaagttgaatctaaaccaaaatcaaacataagatgttacaccaatttcatcgaagaatcatcaatcaaatccagaaacgaaacgtaccacagcaacgagggaaacgattccgtagagaacagcgagaacatggaagatacgatcctgccaaatcggagattcgtttacgtctgaccaccaattcgaagcttctttgagattcaacatctccaccgccgacgaagacgacgacgacatcatctccgacgcaaatttcgtaacctcgacgccgccgattctcatctacacgagtcagattccttctcgattcagattttgaatatacataatgagaactctctggatttgaatcacctctttttatttctttctttttttgttattttcccgaaataaaaaaatttggaaaaaaaacgacaaaaatgaaaaagaaacggccgacgtcggaaacgagaaccggagatagccggtaattatcgtcgggagagtcaagtagttgttgaaagttgactgacacgctgctccacgtggcacatgtggataaagagcaaaccaaagctggcttgatccacacaaagagaattcaaatattatgcctaatcaagtgaagcaaagtaagctattatgattagagaatgacagttatggtaatttttacttttttaattgatctttcttacaatagatatcttcagggccaggcccaacatacaagagtcctcatatgagatcattttgtttttgcataaaaaatttttttggtttttatttttaaagtgagagaaataaaaaaacgtatacctacaaaaagcttcgacgatagaaatttattagctgatttgcagattaatggaagtaagtatgtaagagatttccaacgatgtacaattataactgcttgttaggattctacgcaaaaaaaattgttgaaaaaatgtccatcaaaagcatgaaaaaagaaaaggtggtggcggctgtcgtagatctaataacggttggaaggaattgttcgtagtataatcgactatataacagtttatataatttgtaataaataataaatcgacgataaaaaaaatataattaattcgagattaagaatttttggaggtttgggttttgctagtaatcccaaaaaattatatctacgaaacgtagaaattttccaaaaattctaaacatcagctatattcgcactcgatttaagtacaatccgtgattctcactttggagctgcaggcttgaatctttgaaaaatgagaattgttagaagataatactaattatgtaggaattaatcttcatgatgaatcaccgactaggcattcgtgtgttgctgtgttggattggggagtacaatagctgtcataatactatatgatcatcttcttggtcaaatggaaccatttttgtctttgaccgtcaaataggcatggccttacttatgggccttcaaagacagcatgagcatcctatggaggccaggccaccacttttttttcttcgtaatgataatatacttttttttgtgtgcctaattgtaaaatacttctatagtcctaattagaggtgtcgaaatgatatgttagctcatgagatgagtcaactcagcttggttttttatcagtatgaatgaaattcatttaatagatgagttatataatcaagtataatttagagtacaaattatatgaacgagttttaacgaacatgagttaatttatgaattagacattttaaaaaattaaaagaatatatatacatatataacatatataactaaatacactaatatatatttttttgttgccaaattgtaatatacttctatagttctaatcaagaaataatgtttagtgaaaaatatatataacctaaaatctagtaagtttctcaaaaaaaattgcatttttgatatcgaatttttatcactttaggtatcaacaaaaaaaattaatttgttgtaaaataatttaagtacaaattaagaagtgcaaaagcaaaacagaattaaattaagtaattaactaaaataagatgtgtttttttgggggtcaaaagttaagattttaatattttgaattaatacttttttggggggtcaagaattacaacaaactctagtctatatagagaactgaccaaataatataactatagtattatttgggtaaaatttcgattcaaatagcaagtcctgcgttataatcaacaacgaatttggatgtgaagaattatgtaagatttatgaactatagatcaagattattgaatgtcccttaacttcttctttttttggcagatggtacaacagttgcttaacttaaaggctccatcactgtgaatgtcccttattttgatgtcagcttaagaccaaaaaaaaaaaaaaccaaaaaaaagaaaagaaaagagagaagctttgagaaagaaagaaagaaagacacagtgtgtatcaatctctgtactttcacaagcttccaagctctcttatcattcactgtactcttcctttcaaataatgcttctgagttctgataacaccaacaatctactactactattatattttcttacacattttgcatcactctttttcaggatttttggttctcgagaaaaaagtgaagatttttgagattctctttcgatg

SEQ ID NO: 12861 - DNA, 3000 bp, Unknown; identical to SEQ ID NO: 12858
  misc_feature (1)..( 3000): cDNA_ID_4262185_gDNA_ID_2214576_Annot_ID_186350 3000 nt of promoter + ATG

SEQ ID NO: 12862 - DNA, 3000 bp, Unknown; identical to SEQ ID NO: 12857
  misc_feature (1)..( 3000): cDNA_ID_2712696_gDNA_ID_2214576_Annot_ID_186348 3000 nt of promoter + ATG

SEQ ID NO: 12863 - DNA, 3000 bp, Unknown; identical to SEQ ID NO: 12855
  misc_feature (1)..( 3000): cDNA_ID_2709791_gDNA_ID_2214576_Annot_ID_186344 3000 nt of promoter + ATG

SEQ ID NO: 12864 - DNA, 3000 bp, Unknown; identical to SEQ ID NO: 12853
  misc_feature (1)..( 3000): cDNA_ID_2709783_gDNA_ID_2214576_Annot_ID_186342 3000 nt of promoter + ATG

SEQ ID NO: 12865 - DNA, 3000 bp, Unknown
  misc_feature (1)..( 3000): cDNA_ID_1835727_gDNA_ID_2214576_Annot_ID_135184 3000 nt of promoter + ATG
gtcagcttaagaccaaaaaaaaaaaaaaccaaaaaaaagaaaagaaaagagagaagctttgagaaagaaagaaagaaagacacagtgtgtatcaatctctgtactttcacaagcttccaagctctcttatcattcactgtactcttcctttcaaataatgcttctgagttctgataacaccaacaatctactactactattatattttcttacacattttgcatcactctttttcaggatttttggttctcgagaaaaaagtgaagatttttgagattctctttcgatggattacgaacgaatcggaaagacccaggtgagaaaatgcttcggtttcacgtttaccgaaactgggttttgcgtaaaattagggatatcaaaagccagatttgtcaattttctgatttcttacttcaaagtacaaactttccttttgcaaatcacttcatcatcatctctgtttttgatttgataaactctgtttcctccgatgaataggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatggtggagccccttaatcatttcttaatactctttttaataacgccttttgtctctatttgaatctaaagtttgcatctttttttctttgcttttgttgttttcaaatgttgtagttgctagtggattagatgattgcaaagatgttgatgttgtgagtgagattactgattgttctacttcagggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaaggtggtgttagctagctctttgagttattcagtttgtatgctctatttatcttctaaagccaattttacttgctttcttgcagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggtagtccaaagttgaattgtttgtcatagtcctctagttattctcgaaactttaagcttatgatgagttctgtaatctccaggttcagacgcgaagagatgaagattcaagcatgggagaatcatcagaaggcgaaatctgaagccgagatgaagaaaaccgaggtaaactacactaacatagctacgtaagttcaagtcatgattgtgaacaaacttggaaaaacatgaatgatgatggtggagttcttgatattgtaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgttgttaattctcaagaacacatctttctatcatcatttgtataataaaagctttgaaaaacttatttcttgtgatcttttagttgctttgtacatcttcaaattttggttttgagagatcttcgaattactcggttcaagatgtccttaccaaagtgaaaaccaaagttttgattttggtttggatttaattttggttagatttccttaccaatgtttgattgtaaaagatctaccaatcggtttacaattttggttcaagttcggtttaaatcaccttatcattgtctatttcacaacattccaaagtcgctggttccatcagaagttataatatcaaggcaaacaatatggctaacaaataaaccaataataaatccccacgtgtcagtatttgattgattacaaataaaccgaacttgatctattgatatttcccatcacataagaaaaaaaaagagccaaaaaaaaaaacttttaggcttagctttaaagggcacacacacacagtcgcgagtttctctctggtgcgctctttgtggcggctcgtcttcttcttcttcttccacgggactctctctgaatcggtgattttcgatcttcctagggtttcgatctgaaaccttgcgatctacttgaaagagagattcagaaatttccaagtaataataatg

SEQ ID NO: 12866 - DNA, 3000 bp, Unknown; identical to SEQ ID NO: 12860
  misc_feature (1)..( 3000): cDNA_ID_1807045_gDNA_ID_2214576_Annot_ID_135185 3000 nt of promoter + ATG

SEQ ID NO: 12867 - DNA, 3000 bp, Unknown
  misc_feature (1)..( 3000): cDNA_ID_2712716_gDNA_ID_2214577_Annot_ID_135195 3000 nt of promoter + ATG
gacgaaacaatggccacggtcaaaagactaagtgacgttgaaaacgattccatagtcgaggttctcgccggcacgagagcgagctgggtttgctcatcgacaaggagagaggttaaagtgttgttgggcgggtttgaaggtaaggagttaaggaagctttggtaagcaccgctccatggagcaggactcataattccatagttcctcaaacctttgatttcatgaatatcaaccttaaaatcgttgggtaacacatgctcagattcagtattcagcggaaatggagaaaaatgattgaagaaatttcggtaatcatctccacgtagagagaaaatcataatgcctctatgatccaaaatggagaatacttgtactaagcataagcatttgtttattctctacttgcattttttaaatgacctctaaaaaaagcaccaacgattgacattgagtttggcttttggttgtctcttcccttttcacaacctcttacaaaactgacaaaaaaacatatagtggagctagcacaaactttaggcttctctacttgcttctttttaaatgatcctctaatatgttaccaacgattgatcttgataaaagcgacgattgttccctgaataacaaaaccaaaagtaaagattggcagttatttatatatacaaacacagaacacataatgatgatacacgaagaaccatttttcactaaatttgaatcaaagtataccaaacaacattaggaaaccaaacacggttaagatataaagtaagaaaacagcagacctggtcaattgcacaaggaatcaagcaacgaagcttgtccattccagagaacaaattaaatgtgaaaatgagctaggaaaagatggagcttcctgcaaatatatggaatccaatttagaattcaggtacctgctccgcatggagaatgatttttccaatatgatcttcactggaaaagccaaatattgccttagcctagcaagataaaagatataaaaatgaaaacacatgcattagcgacattgtgcaattgaaggagatatatatagagagagcaaagtcaccttattatatcgaatattgtttgaaacctcgctcatattttcttatagaaaccactacacacaaagttaacgttggttgtatatcttccctcttcaaaactttttacataaataatacactcaaaattttataaattatgtggaacttgatgaaatatgatgtttagcgaagagtatattttactattttctagaaaattatattatttactaagagattatatattaattatgttgttgttaagtaataatagaatatttacgttttactggtcttaatgccatttatgaatttgaatgtaagctaatatgatcataattatcggttacattgtaaagaattcattgttataatgacatgcaatttaatgtggttttttttggctaaaaagttcttattggtcttgattctggtcaaacaatatgaactttgtaaatgtaccaattttcttttagagatagttatgtatacttatatttagaaccaataaattaaagaaatttttttgatatgtagataacacatgtcgaatcaatagagcgccacttgtcagtttttttagagcataagtttgaggaaatcttattttattatataataaaatatttttattataactaaaatatattatcctccttgatgacttaacccatctggttttttttttgtagtggcgattgccagatggcttaccggtttccgtcctcgtggacatactgaagctgttattgctattgcatttagtcctagacctggatccccgtaccagcttctctcgtaagaattgttctttttggcatcttatacgctgttttgtgtcagttctattcattggttgatatcatgctatttatgtgtttggaaaagatggtttatttcaactggtaagctccatgagccctttataaaatctttgcagatcgtcagatgatgacacatgtctgatatgggatgctcggggtgtccagcttgctccgcggatataagtccctaagcctcatagtcctattggtgattggctgattgctttatattcctggttgatttatatatcgatttgatctattggaagctataggactgacttcggaatcatattccaggagaaaaccgtggcggttcttctagtaatggtaattttttttgttgtgcattcaatgctaatggatctatctttgtcaatagcagctctgataatcgtgctagagtttactcggtcttgataaatgtttcttgactagattatatatataatgatgattcagttaattagagtagatacttccttggttacaggtttggggtgctagtaagaccaataagaatgatttagaccagctaaatcatgagatggatgttctggctggacatgagaatgttgttaaattacatttcttatcatatatgttatatttggtacctgctcatatttttaaattacatttcttatgagatcctaattttcttaacttagtcattttctgtggttctttctagtgcttgtgctggaagatctggacgaaaatgttccaaattttaagaattcttggtgtgctttctgctgcaattattcgtaaaagtttccttataatgtttttgacactcaataacatatgtatttgtctaggttctcttatgataacatagttacatgctctagtgatggtagtgcaatcatttggatcccaagatcacggagttcgcctgtaacatccgatttcgataagataaccatgacattcaatatgttttcataggagtagaaaccatatctttatttatgtctttcaggtaaaatgctgccaagccttagaagaagatccgagaggttgaaagataaaacaaaagtgagtattttgtaatattgctttgatcttgtggctaaatatgctacttatctgtttttttacgtctttagcaggctaggatc

SEQ ID NO: 12868 - DNA, 3000 bp, Unknown
  misc_feature (1)..( 3000): cDNA_ID_2709806_gDNA_ID_2214577_Annot_ID_135196 3000 nt of promoter + ATG
tgttgggatatcaaatcctcacatcagtgattctctctcaagtggtagtgtgttcctatgtcatggaagcataagaagaaaccaaacagggttgctactgactcaagaactcagttcttgtagtcaggatcagagtagtggcgctaagtcccatgacgttggtccttttgaaatattgaagcctcaacagttaaaagaaaagttatcttggttgacattatcgatacatgaagaggattgtcgttatattctacaaaaggaggatgaagttgcgaatttgcgacaagtaagtgtttgtggtgatcttatttgttgtttcatttagttcaacctttggtatgagtattcttacatgtagctgttactctttatctttcagggacatcaagaatacttaaactttagctccttgaggggaagtagctccttggactttaataaagagtagaaatatgaaggctgtggaaatctgtaaagtgaaaagtctgaaatatgcaactcttcctagttctggagatagctgctgcaaaatgatacttaaagtcattgatccgaactccgaagtgtacagcaaactttcaagcttacattacctgatttagtgacctttccagattttcttgtgaaaagaagccggtatgaaggagcgatacagaggaaatggacttgcagggacaagtgtaaggtttggtggagaaacaaaggcgaagaagatggtcgttggtgggaaggaggaattctagctgtgaaacccaaatcaactcattttcttgatagtccatgggagaggtacaaagttaaatacaagactagcccgaccgagacacatcttcatagtccttgggagctttttgatgctgatactaagtgggagcagcctcatattgataatgagaaatgaaacagtatgctcttagccttaacaaacttacagacttcagaaaaaagaatccaggtatgtgtgtttaggcttatgtttaaatttgcttaggtggtttagaagtagaaaataacataacactatcacaagaacatgacaatatgatataaacttgacagattcgtttgaggattcttatggactccaaaaactgaaccagatcatgggaaactcaagctacaccaataggtaatattctacaagactagaagaggttttgatatggagccgaatttgacatggttttgttctatggattatctacaggttcccagttcctttgtctcttgaggtaataagatcaaggattgagaacaactattaccggagtatggaagcgttaaggcacgatgtatcagttatgctatccaatgcagagactttctttgatctaaacaaatgtgtaggtgtagcagtcaaaatttcagatctttctcaatggttcgaccgcacgttgtcttctttgtagcttatctgcctatgtatagagtacgtgaattagggtcgcttgcgttgttgtatctgaaaggcttcttcgatctaacgagtaagcacatttttcattgatctaatttttgtttgtctcttgtgatgtaatgtaccctaatgtcctaaagttggagctaatttttgtcattttatgtgcatcagtacaatgatgttattacagcattttagtgtatattcgggtatccaagttttaagctatacacgaaaatcaactcttacttgacccacaactacccaactttggcgtggtattagtcgtaataataattttatgggttttggaaagttaagcaccaactattatttttcttttttttttgtagagttttggtcgatgtgagacatcttatcaaagttagtttagggccattgttttcaggtccgatccgtaccgtccggtccgatcggttaacccatgacccggacatttttccggtttagattaagtgctaatatccgataatttagggctaagcgattgtcccacaacctcctgtaaacgctacgtatgccggttgctaacatttaacaacaaacacacaaatttctttatactgttacagattgctagatatcgcttgcaatcgttagattttaaaacttcatttccgccagtgtttgcgacagcaggcggttgcgggtggttcaaatgattttttttttcttttttatctacattagtattttgcatcttttgctatgtattttgagatagtgaagtaatataacttcatttttcaggacttgtagtttttatgaaagaaaaaacaaaaactagaggctgattttaatgatagatcctaaagaaatcaaaccaaatgaaatcaccagaaccttaagatactttaacctattgggtctataaaacggattttattgctttggatctataaagtcacgttgtagacccaaagcaataaaagatttgggatagttaaaccatatgatggttagtgtgtggttttaaaaccttaagatatttgtgtaggagactaggaattgtgtgttttgaaaagaagcagccactaaaatcatatgataagtcaataaaggaagcagctactgaaatttacttgaaaatgatttttcagtaccaaaatcaattaatctcttccatgtctcgtttaatgtatataaagaccgttgagaaaagtcgtatttggatcaccacaagttagtagaaagacttgttagtcagtcaacccatgtgatatatatgagaatgaaaccatgttatcacattacaatttccactttcttgctttttcattgttgatactcaaaaaggtaaaaaaacttaaaagaaagatgaaagactcttggaacacaatcagtcattcttattactcttttctttcccttctttctcacttctaattatggagacgtgttagcagctcctaatagaaacttgtgtcatccagaacaaagagacgcaattctcgagttcaagaacgagtttgagattcaaaagccttgtgtgttgatgggcctcttaagacggagtcgtgggcgaataacagcgattgttgttcttgggatggtatcaa

SEQ ID NO: 12869 - DNA, 3000 bp, Unknown
  misc_feature (1)..( 3000): cDNA_ID_3026834_gDNA_ID_2214577_Annot_ID_186366 3000 nt of promoter + ATG
ttcactaaaaatgtattatatattttttaaaatatgaaatcccgcacgtatgtgcaggtcagaatctagttctatttaaattccgtcgcctcgttaacaaataatcaattatttgatattgtttctttagttgaccttattggattaatgcagactttgattataggcaaccaaactgaaagaaacattaaaactgaatctgagggaagtttctgttatatttcgtttgcatgtgcaatatataaaaaaataattaaatgttttaagtacaacgtaaaagattattgaatgttcagaaaatatgaccaatgacgcgaaaagaattttgtacgaaggagtttccgtactcttctaagtttacgtacaaccaggcatcgtaatatttaagaaaaagaatactatatgattcaattaaatatttttacgaaattattgggttgattagttattacacctcccctaatcattcaaagctgttttatgttctttgaccaattgcaactagattggaattttttttatttgttttcgttacaatcaaaatatatgttccctccattattttttatttgatgttttatgataatgcacacatattaaaaaaaaaacatttaatttttgtttatttttaacctaaaacatcattttttatgtacttagatataattcaaccaataaaaaaataatatgcagaatataaaaatcatcgaaccgattaaaaaattaattaattttgattgaaagttgaaaatattatctaattttgacaaaatttcttcctaaaatatcaaatgaaaaagaacagaaagagttgtttcaaattcaaatatattaaacaaaatattttttttcatgtaagcaatactctaaaatttaaatgcaaaatatattagttttgataaaaaaaaatatagcagactgatgatataggtattttgtaacttttcttaatttgtgagtagtatgtctagatatcatttaaaatgaagagatgaagtataaattttgatttcctttagttatgtgaagaaaatattattgcttttatcttctcaatatattgtcggaaaaaacttgatacaataaaccatataactttacttgtattcaaaattataaatgctgattttcgttcttgatttgtttttgttttttttaacaagatgattataatagtacgagccacggtcatgcactcatgcttggagtaaaaaaaaaaaaaaaaaggaggaatattaagataatgatctagaaagataaaacatttcttaagagctaatgaaagtcatccaaatttgtaaagaagactagttattcaaaagacgatgatgccatctacagtttgtagattttcgatcatatcaaaactttcactcagagtctgggaataagccaatgtggcttcaaaaactcctttgtacagattcaagttcattaatataattcagtttgcagaaaaaaaaaaattcatcctctaaaatgaggaagaaaaagagtcttgtggagatttgtaagaccacctcgaacggcgggactatgagagttcctaaaaaaccaaaaaataatattcctaatgtttcttatattttagaaacacaaattctttcaaaaattcaaaaaacttaattttttaggttttttatacactatttattagttattattgatgaattttaaatttcaagaaaaataattgaatattattggtttagaattatagaaaaatctaaatcacaaaaactaatacatttatgataagttttaatatgtttttaatttgtgtatttttttctagaaaatcaattaaaaatgaacatatggagtaatagtttaatcttataattatattctaattttttttaatatagattgactactaaactttgctaaaaaaaaaaaacaaaaaaacaaaaaaaagatggactactaataaaagtttttgagaccgtctcttaaataagagtttttacacctggggcgagtttgatctccttcaagattaactgtcttatgatctcctgtgaattcatcttgtttccttcgcttggctggtccatttagagcattatagacgcaccacttctgatcaaacctaacctccctttaagcatgctcaagagtgaacttactcttgtaagtggtggttatatgttaagtcaaagcattgattacatagagcaatcaatgactagcattagactttaacctaatggtaaaccaaccaaacattcaataaaaagagacttaagtatgatgtagacatcatattttttttacataatctaaacaagttgaaatagttctacttaacatgcatttatcacacttcttgtttatagttagcattcaataaaaatactaactatttacctaatgtacttcaaaacttgtggtgtcttcttgtacaagtgatgtctcaaatcttctagattctataactcaaaactcatttcataaaaccaaacacaagttagaaaacttaaacacaagaacacaacataatacttaaagcataaaacacaacttaaacacttaaattatataaaacacaaactcattaattagcctaaaaacaactgaaacacaacttatcataaaaaccaaactcttttcataaagaccaaactcattagctcaacacacaaagtaataactaaagtacaaactcattagccaaaacacaaagaaataactaaagtctagactcatttcagaaaggccaaactcatgagccgaaacacaaagtaattactaaagtccaaacttatttcataaagaccaaactaattagccgatccacaaagtaataagtaaagtccaaactcatttcataaaaccatactcatttcattcaagaacacaactgaaatagttaaatccaagtattgcactaatcccagcctaagctaatcgaatgaatcatatctttagaagagattggagatgagtatcaataaattctccgatttcgaacttcaaactctccgatttggatcgatg

SEQ ID NO: 12870 - DNA, 3000 bp, Unknown
  misc_feature (1)..( 3000): cDNA_ID_3026800_gDNA_ID_2214577_Annot_ID_186379 3000 nt of promoter + ATG
aaatttaactcttcatcgttttcttctcttcctcttcatttcttccttttcttcttcatattcccagaaaattttagttttgttcttgagaaaatttattttgattacaaacactaaaacctaaggaatgatactaaaaacggaacccaaacaaaataattaaacgaaccgtttgagatataataaacggatgaaccaattacgaaataaaaatttgagatcttatcattgtcttcttcgagctcgtttatcatgagacgtgagtcatgaccatcacttctcaccgccacccataattgctgttatcggagcttatatattgttgttgttctgttgttgtaaatggagatcttgtccgatgtttttcatttcgttaaaaaaatgaattattcgattcaatcaaataaacaatttcagattgattaaaaaaaaaaaaatcaaagaaacaatctcatcaattggaagaacctcaaatcatatctaatcggttacagaaaaaactctaaactcaaatttaatttttaattaatttgaaaagggcaaaatcgtcaataaaggtagtagaagtacccattcacgtaagacatgtataaaatgcttaatcatacaatacccttcactttattgtactattttcataattgatcctagaatttatggctaactagtcaaaagtatcaactaaaactattggggtctcaaaaccgtcatattttgtgactataataacgtcttaatttcaaaccgtcacaaacgataaccaaaaggtagtctcatattcgtaaaaaaaatagcaattttttttttcttgatacccttgtgttttgttactaagacagacctataatgttgaaattgtcatagctaatgacaaagaaaacctcatctccatccgatttgacagctatgtagagagtacaaggccaagtatggtcaatgattataaagtaggatcaattacgagatcttgcctttttttctatgtgctttgtccaaataggtacttttcaatgtgctactacaattaggcatttctctcctagttgcattgacgtttttatcccaatctccagttctccaattcacccgaattacgagattggtgtctgcaattcaccaaccccagttctttcgtctctacaattcaccctaatcgtaaactaatcacaacatgacgtagacaccatccaacatttgtttttgaattacttttcgattattagacatcgatctatcaaatccccatttccgccgttaatgcctttcatcttccgtttctgctattcaaaaatcagtgacaccgccttcagctctttcctcgactcataaaccggtgacaagtctcagtccgaaatcaaaaaatccacctactaatatatgtcgatcaaatctaaaattgatttcatttgtgttttgaaatttttgcgttccctaaacatcatcttcttagggtataatttttttttatatatatacgtatttaattggatatgttgagtaaataggtcagaagaagatctatgaaccatctggaaaaaaaagaaaaaaaaaagaaacagatcgatgtagaagaagaagctgaatcaagggtaaaatcgtctagtgataaaaaagtgctcatttacataagtccacatgaaaatgtccattttcaaatatttgaggtaggtagtacctatttttataaaaaaacctcttataaagcagtatgaaataataatcttaatgaataatttggtcttcaaaattaaatcgaacgtttattaaaaaaaagaagccttttgtagttctctatttgtatattggtatcgtgttgtaagtttcaattggaaaagccgggaagtcatatacattactataaaggttattgacaatatatgtgattttttttttttgttaagcaaataaacgaagtagccatatgattctgatttaaaaacagggcatttcgaaattttaaaataaccggggtctgggtcaataaactaggggcttttatgaatataggtatattttggatcaaaaatttgaaaaaagcatattcacttgggcttataagtttgtccttggatttgttgttggctaatgaaatgataattttgtccttggatttgttgttgataatttcacttcattttttccgctgcgtcacagatttcacgatcatgaaacctcgcttctcaccatcaactcttgcctttttcaacgtcgactcaatattccatcaacatcatcattttcaacttcatcaataccgtttctctcgtctttttagacttaaaaaatgttgcttcccctaacctcttccgattaacccaattgctcaaatttaacgagacttttgatggaaggaatctaaaccctaaggggatagtatttagggaacccaaaacatctaattttagacatggatcgaatcaattaaactccaattaatcaatatttgtaaaccaaattcgatcagtgttgtcaaagatgaacgattatagcgtcgttctctggacgaatatgatcacaagtgttcttattcattgctttgtgtgtctttaaaattctacaaaagagggttttgggattgagcttatatccaaaatgggcattttaagaaagtttctttcaaaagaggtatcttctacagtagaattcaacagtagcaacttattgactcgattctgacaattttgactttggtgtcaaagcgtgaaatatatattatatctaaaacttctcaattatcagtatggaaatggtacacagtctaaacattagtaaaaactatatactagtttgggatttagaaacccaaacaattcaatttacagtatgtaaatgttagataggtgagatgagaaaatttgtgaacaaagagaattgcagtttcagtggagaagaggacgccagtaaatcacgaaattctgattgtggattccgacatccacaatttggcgctagaaggaggggaattaagtcttttacttcagaacaacgatcaaaatcacc

SEQ ID NO: 12871 - DNA, 3000 bp, Unknown; identical to SEQ ID NO: 12868
  misc_feature (1)..( 3000): cDNA_ID_3026821_gDNA_ID_2214577_Annot_ID_186372 3000 nt of promoter + ATG

SEQ ID NO: 12872 - DNA, 3000 bp, Unknown; identical to SEQ ID NO: 12870
  misc_feature (1)..( 3000): cDNA_ID_2709817_gDNA_ID_2214577_Annot_ID_135202 3000 nt of promoter + ATG

SEQ ID NO: 12873 - DNA, 3000 bp, Unknown
  misc_feature (1)..( 3000): cDNA_ID_2712700_gDNA_ID_2214577_Annot_ID_135203 3000 nt of promoter + ATG
aaatatcaatctcaccggataacaatctcaaccatactttttgtagctatataagtgttacatctatcgattataatccgtgactgcttagcaaccaatttggccacatattagtaatatgatattaccattgacaaaatttgtggccacccatgactaaacattctgttctcttgaaatgactcgtatgtaaagaaaatcagtatcacccatcacttcttacttaaacaagtaccaaaacaaagctaccaaacagacaataacaaatattcaatgcaaaactctttaaaacaaacataggataaaatgtcaacaaaaataaataagataagatagattggactctttaaccataaaattaaatatcaatctcaaccggatatctatccatacagtcttcccatggactgttagctgaaggcttaacgtctcgcagagccacccacactgaactgttacacttaaaacctgaccccaaagcaatctgccatatcctatctccttccttcatccttcctttagcttctgtatacacccgcgagatatcccacgttgaaatgtatctcgtttccagagttgtacgctactccgtcaccgttctccatgaacagtgtgatctttgtaactgactttctgtctgaagggttggtttgttggaacaaacgccacacaaagtctgtcgcagatcttagtgtctgtgtgccgtagcttatgccaccgatctctccccggaatctccttcctccggtagagtcaccggaattgtcgacgaccgagtagtcaacagcattaactaatgagacaacgagcatcagagagattacaaaaaagattttgtgaaacgtcatctttgtattttgcatgtattttcataacatgcatcggtgttctgttcttctaaagacatattgacgttaatttggcttaccttacacctcacatattaattacatataaaatatttgtggatgtcggaatccacaatcagaatttcgtggtcgtgtttcgaagatcttaagacttgttaaacgaacaaagatcaatcggaaaagtgtttgtttatttctgtatagtttcagtgtcaattcattcgtctctctacaattgcaatcggactacatttatacaaatatttcgaatcaaatgaattaatcactacgctgattctacgccgggaatctcgcttcgtttacttcaaacgttacgaactctccagctcgagcaattaatgagcgtctttaattcgagatccttccgttactcgaattaaagcataatctgacttttgaaccgatgggcttctttaaacaggcccacttctctcgatgggccctccgctgggctcagaccgcgtattgggccggatacgaaatccaacatccacaatttgccccccaagtcctcgaagtgaacacttcggggacttaagttcaactcgtggcgccattctcggagatctcagaacgccatttcgggataacaagaatctcccgaggtaaaaaaggaaactgaatcgcgtgattttcgaggatttcctttgaaagagtgtgacgcttcgtaatcctagggttttggatttcccgcccattcaatcctctatataaaccgacgaacccttcaccttctgactgacctcttataagctaccagactcattcctcgcctcaggtaacaaccccgactcctcctttccataattcgttttcgttcagtctttgttccgaatttcacctgaatcaatagatagccggaatcttagacctagaatcgcagtaggtttaggccggtagtatttggagtagattctttatcgatttcttagattttaagtttagaaattcgaagaaaactcaacgtcaccgccgttctacacctctttccggtcaaattccgtcgtcaaattcttagattcaccgtctcaccggttcgccgatcgattaaatacagcgcggacctttctctgctcctgggttcttgaagaagatcttcaagtgttcttcagctgcttaagagagcttttcagaaaataaacgaaaaacggccctcagatatgacttttttcttgcaaattacttcgcggtgtttgtcatgcctccgaggaaagtagttcgcgaagtgtttctaatagatggtaagttcgaaaaatacaagacttcgctctcgacttcgagcagactcttgctgctgagaggagcccaccaaattcctcaccagattccacttatttctcccgaaccgacggtctgtcctgagaatcctcccccagggcatccgtgtgcgttcgaaattttattttcgctatgcgttggaatcgcacttccctagttgtgcccgaatgttattcgaactgtcttatgcctcattactctagctgaagaagacagattttctctatcactgaacgatctccttcagctatacgcagttaagaaagggcgaacaaagggaacatttttcttgtcacctcggaaaggtttccgagttttcgatgacttcccagataaagatgaacaatggagaaaatcatacttcttctttccagtgaatgatcttacttatggaaacaagactggcttatttgtatctgaatgggcagctcgcaccggtagatagtgaattcgctttaggaaaacacaacttaatttagttgtaatttctgaatgcaaacacttcgtggcacctgaactgaccatcttcttttatgtttttgttttcatttaaagtcagcatgcctcccgtttcacatactttcgctgctcacttctcgaatttctgttgccaagatctaggttgggagtccttgaccatagatagaattcgagcttcaggtcggagaatcagatcccgaactgaccttgccgtatcttcgcctcctttctgtccacgaataatcgacaaagccgacatgtctctcccttcgtaccgcgcagaaaagaaacttgagagagagagagagccgagcaggaaaaggcgcggattaaatccgacaaaactgtgatg

SEQ ID NO: 12874 - DNA, 3000 bp, Unknown
  misc_feature (1)..( 3000): cDNA_ID_2712752_gDNA_ID_2214578_Annot_ID_135206 3000 nt of promoter + ATG
taatttgggtacttaagcactgaggtttagggatcatataagataaattaatcaacctagcccaccacacaatacaaccacaccttctttgtttatatctaagtgttaattaccatatggatttaaataagttgatgcaacttgtagctccaatatcgaacttttgtctttcgtggtgttgttaatcatcacaatctggtccgtatcgtacgcggacaccgtcataatttatctcatttttgttgagagtgttcctcctattcgtcaacttttatagcaaaaaattgtttttatcatttatgttagccgttgaagtttggctaatgtcttaataatctaatatacatttttgaagtaaaaattaggaaacagatcttagtttatagagtatttacaatggaatgtcattgctttaattttttagatttgtaaaaattagttaaggattttaagatgagaaatacttgatttcaaagatctctagttattctcgattatttattactgtaaaatcttgcttaaatcctatgtttctttacctaaaaatatatttctggttacgttgcagattttggtttgtttggttacacaagaaacaacttacagtcatagcccatcttctctttgcaatagtatcattggaatggtgcagaacttcgtcggcaagaacaatgtcaattttcttgtagtagcaagcggtatatttggcacaagatattcggtaagtgggtttatctaaacttatagttcatctaaacattttgttttgtttttctaagttcgagatcgttagccggaagtagtgtaagatccaatctcgagatttggtggaaatgtgataagagataattctttctaactgagagctgagggagctctttatcgtttgatgcatagtgccatatagttaaaagatttatgagcttacctatcctagataggagcgactcaatctcatagaataagtcgatcttattttggggtgccagatgatatatgtggatcaagagttcaagaccttttttagaaccaatcatatgaccttgccaattcttactgtatgtccataaagtgggtcttttgatagtgtttgtctctagagtatgcttttgaccatttcaacccgtgggtttgacctattaaggtcttgtcccgttacaactctcgtgtaacaatataattcgaattattcctcttggcgctggtggtttacgtagttggtgatggcatattggcatgttgcagttaatcctcgagtgctaaaaggttagccgtcatggtcaacatgtagaaacgagctctcgagcaactagtcatgtactaaattcgtctatagtgttttcatcgccatcattaacaagtatatgttcgcttgcaaatttcatccgaacattatatctacttgtttacggtttacatctctaaaccgagtctaattaacttaacgcttttttttgttttacaacgagccataattcaaatcatatatatgaaagttagccaactcttctctccatatgattgacacatcatcactttagcatttgacatgtgtctattaaataattaatgtaagctcttcaacttctaatttataggttaatgatatatttattatttaatttacatatttaattgtagtattactaaatttattttaatattacataatttttcaataaaaccattttaatagttttctcatactggaagattttttttggtaatccaaactcaaagtatgagtatataatagtcgtggattacttaatgatttgagtaagttgttatcttaaattgatatttatacaataaatcattaagaaggaaagatacgtaaggagctccatcatcaaattcttaggtttctagaatccaacactaccctttgttaaattggtttaagacaaacgttgtttatgaattatctgtatgatgcattgttgagaatgttattagaaaaaatatttttaatactaaaaataattgtttattgcatggggaaatttgcaaaactaccctttttttactaccttttgcaacaatacccttttgtgttgtccatttttaaaaatatctcttctcttgaacagaatgatcaaattaccttcatctaataggaacatgtaattggaaactgaaatttttacgcaaaaaaaaaatttccgccaaacttttttcccgcaaaaaaacctatagcagatgtgttgttttttgaaaatttttggcgggaatttttttccgaaatttttttggcgagaaatttattttggaataatttaggcgaaaaatattaatatttcattttgttaacctaatacaattttcaaataggggtaaaatggtcattaaaaatttaaagagagtagaaataaaaatgactaaaaaaaaggtagagttgaaaaagggcatcatgaaaagggcattagaaataaattttctattgcatgaataagtaattagataaataaaaattatatttaaattaaacaatacgaaaaaattcgaaaaaaccgcagcgtagcgcggatgatcatctaatggctaataataattacccaaacaaaataatattccttctgtatttttagttagtgtttaagagttttacacacaaattaaagaatcatttagggagcttattggttcttgcattttttctactgatgataaaacaatcaacatattatatttcgtcaacactaattaatttttacatggtctaaaacatcaactaaaaaatacaaggggatatttaatgttcatattccctatattttgttttttaattaaatgtatttgtttttctgaatattttataaatcattctagaaatacaatggattttctttttttgatatatttggggaaaaaaacaaaagagtagaggttttagagaggtttgttggattgttttgctctcaaaatttctttctcttcttcaaatgttcattggaagaccaataccttatcttctactatcttcaccttccttccatg

SEQ ID NO: 12875 - DNA, 3000 bp, Unknown
  misc_feature (1)..( 3000): cDNA_ID_2712728_gDNA_ID_2214578_Annot_ID_186403 3000 nt of promoter + ATG
gttctgctttcttaattgccgtagagaatgtgcacattctatcgaaagaaccgtgaaagtttgaggcttctaatgtaacattctattgattaaattaaagaccattaattgaccaaattgtgacttgtgagttgtgagtgacacaaaactgtaacattctatcgattaaccgaaaataaaattttatcattttgaaacctataactcggagagtggaaagtgaacacgccaacacaagacgtgtccatttagattgttggatataacttgtaaagctcgatatgcatgtatacgtatttatatgcgtaatatgcaatacacacatgcacatacgtagacatacatgaacgtagatgagcctatatatgtttgtttaatcgttaaatttttgaaagaattctgacttgggaatattatttcaatgaacttattccatggtacgaaccactacatacatatatgcatgaatgtgcattataacatgagaagatacatgcacacagtcacacatatatgatttttataagtatgctttcacgaattttgttgtctataactataattaagaaaatagctatgaattgagataacttttcaaaaagaatattttaacaagaaatcaaaaaatattttatgataatgagacgtaactcccgtaagcatttattatgatttattttattattagaaaactttattgtgaaaaaatgcaattatataaaaaaaatataatgaatagagagattttgtttcattaaaatgtgttcatgttagcaattaatggaaaagaggaaaacaatatttctgactacaaaatacagacctcgaaaccttaaatgtattagttaatgaatccaaatgaagaagtgtcaaacatccggacacaaaaattaagtttgcaaatattttaatgttattatttatcccaaaaagagtatatggtgaatgtggcacaatctaaagaaataccaaattttcagctacatataaaaataaaaaaaaagaagaataataactatctatttataaagaaaaagctccacgtcgtacgtgattagctcaaaagataagttatcatattgatagggaatttcattttaaaaagttattatcatattttgtaattattaatttacgagtatcgtctttgggataggatgtttgtgatcttgggggcatagaaaaaaacagtagaatttcgagagctctagcatcattgatgaatgtacctgctcgagtttataattttagaccattgtcaattatcatcgtgaaaagattattaaaacatgaatgtaatatttcattctcggattgtattaataaatatataatatgtttcattttatgagtaattttgtactatacataattcagttaatgatcaattgcggaaaattctaaatttttatataatgagaaacttatttacaattttaaaacttatttaacattcgtatatatgagttgaacaaatgcaccatgtgtgtgtgaacaaatttgcagtaccatgtaaaactaattagcttaccaagatggactacaagtgtttttggtcgggctagaagtaaatgggttggaaactggtcatagatatgggtaaacgaccagcggctgtgctcttttaaccatctcctaaattactttaatccaaagccaatattttttgatcattctcattaaaatggttggttttccagtgaattttgaagttaaggtatatctgtagatagtcaagtagctagattaatcattgggtaacacttaggtggtccgagaccattttgggtagctccaatgtacatctcttgaattccatcgatccaaagggtcgtttggtttcatcattctccttaaaatgatgtactctctgaaaagaaaaaaaataggttaacgtcgttaggtcgaatggatttttcaatgggtaagtaagtatttttgattttggtatggttcggataaattcacgtttatccggctaaatggctcgaacattttgaattccacccaaatggttaatcaacttcttaggaaaaccttttgagtgaatatccaagcctctatttaatcgatcagatctaggattggacaaggatatcctccttgtatttggtttttggtgggactaattaggtaactccttggtccatgtaaaatttttagaagccacaattgaaacgtaagaaaggcactaataatcacgggcatgccatcatcacccatatacagtataatatttatataagattttttacacatattaacaaaacacaaaaatctcatttaaattatttcctttctataaaaacattattaattacacctaatttaattaataaaaaatatgtaacaaaatataattgatcaaaaatattaaatatatttaatttttgtatagaaaaatgaaaacaacatttattttacaacaacaaaacaaatcattaaactacatgaaaacacaaaaataataaaattgctaaacaataaatgttatctaagaaaactataattgtatacaaaagctagctattacacttagcaccatataaataaacttcttatccatcaatgtttaatatatatttgtatagtaaaataaaactagtttgcatctgaaaaagtataatcaaataaaactctttagatagcaatatgtacattaaaaaaagacttattttcatacgtattaagctgtaaaaaataatgattaagatttggggtaaagagaaaccaaagtttaagacggaaacgaaacaaaagatgataatcatcgattcatcatcacgatataatatgggttgctaaccacaatagaaaaacaaaagttcttttaaggttttaataatatatcaccaaaaatgataattaaaacctaaaattaaaataatatatctacaagactacaacaattctgctttataataaagctataaacctcaacatttttcaacctcttcccaaaaaaaagtgtagaagcagaagaaacccatcatcatcatg

SEQ ID NO: 12876 - DNA, 3000 bp, Unknown
  misc_feature (1)..( 3000): cDNA_ID_2709845_gDNA_ID_2214578_Annot_ID_186398 3000 nt of promoter + ATG
gcgaaccatcatttccttttccaatctcaaactcaagcattttggtttcttcatcatcacactttaaacatcgatttcggttatgattactttgtgtttccatgattgatacgtgtagttactattcttacaaggtctacctcaaattagctagcattgcatcccatgttcttttgtacgtccaatatgtggctaatataatatactaatatggtcatcaggtcatgtataagtataactatgatatatactagacattgattaatttgaggctaaggagaaattaaggtatgtgttttagaatccattctattaattttagaatcttaaatacatagatgggattcacgaacataccaacacacttcgtcagctcaaaaacaaaacaaccacatgccgcatcgcacaaaccaacaacgaggcttttttttttattggcgtctacttctcatatgttttttttcgtctttttacaatgaagtaaacaccaaatccctgaatgcatgtgatcttcaagtcttgatcaattgggtttctaatttatgcaaattttcctttttgatttagacttctctcttctttttttttttttttttgttgtctaaaattttagatttagacttctttttgtcttctaattttcttactctatcaaagggaactgctagttcgaatacacgggtgaagcggcaagacgagaaccaaatgaggtacatgtttgaacgcgattgaggaaccggatgtgcaatacacatgacaaagagcaagccggtaagaaaacacaaacaagtggcaaaccaaatatatatgtctataaccaagttgagtacatgaccactgatataacatggactataagaccgtttaaaatatttccaaatctactaaaatgtaagataaaattctaagtaattcaattataaagtatatttttaattgaattttccaatcaattaaaatctacaactaacatagaaattccttctttaatttaaaatgtatatagtatttgatatatataaatatatagagaattaatggacagtaaataatttttgaaagaaataaatatatgccggtaactcgttgttattcattaaaagcaaaatctatacgtcaatgttttttcttttttctctacgagtaaatgttctttcatttctcatgcaataattcttttcctcggtttgagtgatgtttgagacgaaactaatattacatgctgtggttttggatctagtaaattacgggcttcgcctcagaacctcttaaatttaaagaataaagaaaaaaaaattttttgcctctcacaacgtgagtgatgtaacacgtcacttatacacgccaactcttctcatcgaaaaattactcgtattacgttagtgattcactacaaaataaggattcctcttattgcgagtcaatctcatataataattatcaagttagttttatagcaaaagtattgaatttcatggcaactatgagtctatgactaaccaagcatgacatttgttataataaggaaaagaaacattttatatttgaacaacttgtgttgctatcataccagcggttaccgagatcaaatccatgattacattggattcacaagacatgatcatttagtaaccgagatttttcttttttctttctgttgataatacaatatactaaccgagattaattcatgattacgttggattcacacgacatgaatatgactctagtattttttgtttttttaaaaaacacttacatcattcttttgtagtgagctcatttctaatatagaaaactttttggttgttttctaaacataatattgattataacaaaaaaaaaaactttttttagataaattgttttcaaaaatttataaattagccaaatatctttataaattaatagaatctcacggttctgatatattataaatatatagaagttttactgtatatattttctcaattttgataatggttaaacttttaaaatatttttcataaacgaataatgtagcattactgatgataatggtgtaatattattgatcctatacgtaagaaatcagtgcttgcttactgatgaccaaaaaaaaaaatcagtgcttgcttagaaacatgtagaaaaattctaccgacaatctagaaaaagtaaagttcatactttgcacactctcctttaatggcatgacacatcaatggagatagatttctcagtaaagtacaagatgatatcttttgagaataaaaagaagaataaagaactcttacaaaaaactttcatagacacccgaactttaataatttatttccgaaagtgaaaaagtttaaacctttttctctacagaataagagaaaaaaaaatgtcaaacaggttttatccacacaaaagaaaagaaaaaagaaacgggttttcagtgagaagaatgaatgatttaaatttgttcaactagaaaaagaaaccaatgatactgtttctgaaaaatctgagtgaatgaattctctcatttatgaaaaagcttcaacttctttctgctaccaactgtctacattacctcttctctctctctctttctctttggtatttcagaattcccaattaaaaaaagatactcttgtcataatcagaggtaggggaagcttaatattatatattaatctatgacaaaaatcctcctttttcttgtttttatgtcctttggtctctcgtgttcttgagaagcaccacagagttaaacaaacactttttctatcttcagatctctccttaatatttgtcttcaactgtttcttgcatgagtaccctaaagtagcttcagtgagattttcttttttctggaggcagattttgttgtttagctccaagctttcttcaatgggtcttggtcttggtttttggggttatgcattgtttctttctctgttcttgaagcaatctcattgccaagaaccaaacacagatggtttctttgtctctgaattctataagcaaatg

SEQ ID NO: 12877 - DNA, 3000 bp, Unknown
  misc_feature (1)..( 3000): cDNA_ID_3026877_gDNA_ID_2214578_Annot_ID_186397 3000 nt of promoter + ATG
acatgagtgaaactggagcatcagaggataaggcgcgttcgcatgttcgacagatgatcaatgacttgtgggatgaaatgaattatgagaaaatggcacatagctcttcgatactccatcatgattttatggaaacagtgataaatttggcacgcatgtctcaatgcatgtatcaatatggcgatggccatggctctcccgaaaaagccaaaatcgttgatcgtgtcatgtccttactcttcaatccgattcctttagattgaacttcatattgattacattaaatatcatatggttttttgaattctaggacatagggttccatgaaactatatatatttggtgtaattttataacaaaataatatatattatatgtttatgaaacatcaacattacaactttaacaagagctggtatatatgcatgaacaaataatttcaggtaataacttttaatagatcttacgagattggggacccaaagccatagttccactatatatgttgttatacatgtgtcgaccacagataaacatgttaatcacttgaccatcgtaaatcggttggccttgtaaacctctaaaataattaaaacatgttaaccactttacacttcaaagaaaaaaaactggaatgacacctaaacaatttttgtttcaaataatatgtaagatggttataacctatgatatctttttgtctttttctatttttggtgacgcatgacttcacggatcattggcgtcttcttcgacaacatgtgatatctttcactatcgttcatcatgtccacatgaagtacgtcattagtagattctttttatctagagacaaattaattgtaaccaattataataatacaattaagaaacgttttttgcggacaacgtaagaagcttgtacaatattatatatagagacaattacatctagggtaagtggtgtaatacttttgttcaatggccactttactgcagataggttcagctctaatttacaataatgcacttgcgaagactcttccaggtcctcaacctttcacatgcaccataatggccaaaatgacacctggtgagtctcccgttgttcctcgtcgttccacaaactatcagccttctctttgggaccaccgcccatctcctttttatagaaaataaatatgtggtatatatatgtaagtaattaatacctgtataatattaatctataatgaggtcatatatatattgagtactatattgttgatagctatatatgttcaatacacagcgttcaaaaagatgaaagtgtgtgagatcagagagagagagatttgttgaaggaaagggtgagaaagatgctataagaagaagaattatctcgaccaattggagctaattgacgatctacgtacataaacttggggttcccaaaaataagacaatactaataatacgatgtggccattggttttaacttttaatagaaaagtatctttattcgaatgcacatctcaaagcttggaacgtttcatatttttcattcgacttgtgggagccatatattgctggccacatgacagcatgatacgacatgtgataacactaagatcacacaaacatttgagacttaacctttacacagataaacacatgcataaccaaatcattggcctaaggtggggtcaaaactcaaaaggtttcacaagccatcgatcgtagtatctgagaaatcttccccattaaattttttgaactgagggatctgcaacgtaaaaaaaaaccagcttaaaattatgttcttattttataactctaaattatattgtgtctaaacgttgttaggagtgggtttctttaatgttttcacatgtaatacgtctaaagtcatttggatgcaaacatgaaagttgaagatcaaataatatggagaaatatcctagcatggtacgtattcaatgagaagatgccaaccgttggatcaaattaaaagttggaaaattatagggaaacaagtgaggtttaatttagctctggtttgagttctgtcagaccaatgaactaaatgctaatgctatagtgttattgaagaagttgatgcgaaattgagatttgttttgcaaaagctcgagttcaattgttgaatgagcatataaataactcctgagaaggcagcatcgatcagtccacctattggattgatcgtttcacctattggctttaacattccaactattggatatatcatccagcaagagcatcatcaatcgatcccttgtagaattgattgatcatttttcctaagggtcgattaattgatatgattgttgtgtttataagtattcgtaaatttcaattcagatttatcaacaacatgaaatgagatgacaagaaaagtaaaataataatcaacgattttactcctttaattcacctattatacaaaaagtgatttttagataacatgcttttattttatgtgactttctaatttatcaaatgaaagtaacaagtggtgtcacttgtgtcacataattttcacgaaatgtatggttttcctctctaccatatttatttacgtgaagtcgtgaacatctaatttgtcaaaatagattaaaattttcgtcatatgaactgattacatgttattaattagtacgtactctaaacattagtacatctcttcagaaaaaataccatattttatgtttttaagtacattaaataaaatagaatataccgtcacatttcatttaaagggtaaagtaaaaattagtgtcagacattattaacaatatggcaaatagaccaaaaacgtgccaaaaaaacaggtaagtgggtcattgtcaatttgtcatggcaataagtaacgaatgaaagatctcagccgttaatagccagttagcgaatccgacggctatggatccgtacattcctaaagctcatgaggcctaatcgcatgctctgtttcttcaccggaaaaattgcaacttaaagaaaaaaagaaaagggatttaaaaa

SEQ ID NO: 12878 - DNA, 3000 bp, Unknown
  misc_feature (1)..( 3000): cDNA_ID_2709849_gDNA_ID_2214578_Annot_ID_186396 3000 nt of promoter + ATG
attttcatcacccagttacaaacttgaaaaagaatcacacatcagaatattttaatttttcttttgttttgccataagaatatatatcatgacgataaagaatgtactttttgttctagtaaccatttgtgtagcagtttctgtaaatgctcaactacagcaatatccgattattttctcaaacccgcttccatttctgcgctcgactggtatactaaacctaccagacgtaaaaaaatgtttctcgtccgtgaggaatgttccaggatgcttattagagatctctcaagcttttggagagaaattcggtcacatgatgcccgcttgttgtaaggctttcatggatagcataaaatgcatgccaaatattctatacagtgtacttttccctcctaatttgaaagaacaatgtaatcaggcagggatccactaatttgaaagaacaatgttctgagggatccacgcctagtaaagaggtggtagttgccaccacttaaaaaacagtttttaatataactttactaaatataaataattgccaccgtaacaatttaactctttccatgatcccatttttttaaaaataaaaatatttaagatggccaaaagctcactttactagtattttataaataaaagcgtaatttgtaaactaaatctaacttaactaattaaaactaggcttgggcgtttaatctgaaaccgataatccaaaccggaaaatcggattaaaatccgaatcgcattcaatatccataggtaccagattatacttgatccgatgcaatattcgatatgtatccgaatttgtgtcttttgttgtaccagggacatgtccaagtttgaaaatgtagctaataagaagcttgaggctggcttgttttcactatcttccaaaatttttttactactttcgattgaattctgctacttttttaatttttaggatgttatggtttaccttcgctttaaaactttgatatattggcatcgttttatgtctcactttggtttcccaactctatggtttgctaaggtttcatgttagttcaactagtcatttcagttttgttttgcggttttcggattgtttggattatgtttagattttttgtttaaatcagatattgaatatcacatgcataccgattcaaaatccgaaatatccaaaccgaagtcgaaccacattctataattatttttatagatattaattagaatctatttccaaaaactcgaaatccgaaaacaccaaaccgaattcgattcgataatcaaacgcccagacctaagtaaaaccctacaacttttgaatccaattttttttgtcgttctttctttttcctcctagtttttctccagacgagaactccctggtaagtttttgttctttgttcaattataactgtttatttcaaattttaatcattgttttttcattaatcattctaactgtagaaatctaaggacaagtttgtttcttcttattgtagaggtttagttctcgtgtgatttgatgatactttacacatgtgctaataatgattttgtgtttagttttccaaaataacgttgttgcttcatttcgtttgaatttgtgttggatccgacccaagctcgactcttttactatttaagagatgttatgccacattttaacctaagatttaagataggtttatttcgctgaattgtctaagagtttagaaaggcaatatagacctaagtttttactatttaagcaacgtttgctacattgtcggtgaagatatccccccctctagcaagtagcaacattagtgaaattgttttatgaatccatgtatctttacgcagtcactacgtatgttgtctcatatcgatcgaagtgcatgctttcaatatattcattagtaagtagtcccgatgggaacagtgaatttggtagattagggagattgtgatctatgatgcttagggtagaaatatatgtttctaatttgaatgcacttaaaactagatttgaatttgctaaagatattaaaaattgttatttttgtgtgtcgaaggtgtttgatgcacagtttaggccaatcctaatagtgttcatgatacttggtcaatgagaattgatgattaaggtgagattagtggactaaaatggacctgttgttttcattgccaattgatttcctaatttgcaaatggaagttcagataaattgggtgtttaatagagcaattaaaaccatggaagtaatctaccttatttaattgtttcacccatgatccatagcttatcttatttgctaatctggtttcattattttgtttaatcttattgtttagtagtttcccacttttcctttcgaattgaatgtctctttatttacttgtttacgccatctatccacctagtttaattagtataacatacacttaagtgtgttatagtctaattctttgtggattcgatcacaatattgtgctacaagtgacttaactgtactcttcccgttttacaattcatatttaaaatttgacggacctatagtccactcaatttagctggtattgtaaatgtctacaaaatgaaagtcatgaatacattttcacttcaaagtacgttttttatttgtttgagatgtcaagcacatgtttatttcgttgttttccaaataatatctaggagaggaaggttatcaactatgatctctatctttctagtttgtggtcacgcatgagtgacttcaccggtcatttcataccttcgactttaacatatgacactgtacacgtaccatgttaaaaatgtgtggatagtaaccttttctagaaacccccttatttgatttttgtatatcgaatgacaaatccatgtgatgtgacctaaccataataatacaatgcaaaactaaaacgtgattcggccaaaactatgacaacctaaaaagctagagagtaatatatatagacatacacctgaagagttacgtatagcataataatacatttattcaat

SEQ ID NO: 12879 - DNA, 3000 bp, Unknown
  misc_feature (1)..( 3000): cDNA_ID_1807330_gDNA_ID_2214578_Annot_ID_186395 3000 nt of promoter + ATG
taaacaaaaaatctaaacataatccaaacaatccgaaaaccgcaaaacaaaactgaaatgactagttgaactaacatgaaaccttagcaaaccatagagttgggaaaccaaagtgagacataaaacgatgccaatatatcaaagttttaaagcgaaggtaaaccataacatcctaaaaattaaaaaagtagcagaattcaatcgaaagtagtaaaaaaattttggaagatagtgaaaacaagccagcctcaagcttcttattagctacattttcaaacttggacatgtccctggtacaacaaaagacacaaattcggatacatatcgaatattgcatcggatcaagtataatctggtacctatggatattgaatgcgattcggattttaatccgattttccggtttggattatcggtttcagattaaacgcccaagcctagttttaattagttaagttagatttagtttacaaattacgcttttatttataaaatactagtaaagtgagcttttggccatcttaaatatttttatttttaaaaaaatgggatcatggaaagagttaaattgttacggtggcaattatttatatttagtaaagttatattaaaaactgttttttaagtggtggcaactaccacctctttactaggcgtggatccctcagaacattgttctttcaaattagtggatccctgcctgattacattgttctttcaaattaggagggaaaagtacactgtatagaatatttggcatgcattttatgctatccatgaaagccttacaacaagcgggcatcatgtgaccgaatttctctccaaaagcttgagagatctctaataagcatcctggaacattcctcacggacgagaaacatttttttacgtctggtaggtttagtataccagtcgagcgcagaaatggaagcgggtttgagaaaataatcggatattgctgtagttgagcatttacagaaactgctacacaaatggttactagaacaaaaagtacattctttatcgtcatgatatatattcttatggcaaaacaaaagaaaaattaaaatattctgatgtgtgattctttttcaagtttgtaactgggtgatgaaaataacatgggattattgtctgatttatatgaaagaaatgaagaactggctttaattatctttaatgaaactcgttcgagtatttatttgcctatttggtaattaatttgcggtttccaacattgaaaaagagttgaaaatgtaacgattgtctttcaaaaaacgcattatgaaaatggaaccatgtccatgttaatatcactctcaccattcttagtgttattaactaatatatattatggaagagttttctgttctcttaatgtgtacatatcatcatggtaaacatccaatcaaacaaagccatgtcaccattttttttttttaacactaaattataattacaatgttcatttaataaatatttatttctattaatattaattattaacaaaaaactaataaaataaaaaatgattttaaaatagtaaaagtcataatgtgaaattttattagtaacaataatattattaaaattttaacataaacacaattaaaaatgatcatacttcaaaatacaaaagaaaaaaagaagacaaaattcagaaaaagaatcaaaagatacatatgacatgtgaacaaatgggtagattagtatatattacatgttatacacataatcatgtagtcaactttttttaagttagttattgaattattaaatttttatggtcatacagcctaatttctcatgtatcaattagaccattgtcgacaaaacaaaatagaaaaaatagttgaattgattaggctccatgtttgactggtacgccgtgtacttgtcaatgttccggacggcgaatagtatttttgatattaggaaatggggtttaccttcaaaatattggtgtggacggatttgtggatacttgatcagatatcaaaggcggcacaaaatgaccaacgatcgacgaaacagtgcccaaaatcagagtcagaagtgactagctcgatagcatgatcgatgccctttcacccatttaaaccattccacctagaacacttcaacacgactgaagctaaaacttttgcatatctcatagagatatgtttgataaggttgctgaaaataacaacttctactataattttgtcttttattatttcgaccttctcttaagaaattcgcccaaaaaaatttccaaatcaaaaagttgttattatcctaacagatcttaaattatatgtttcgattttcggttatatactggtaaaatctgaaatccgaacattaaaaaaaaattgaaacccaaacggatactcaaaaacacctacaacccaaccattataccaaaaaataaaatccaaacgtaaacccaaaaaacacaaaacaatatatacacatatttttggattttaaggatcatttggagcgtttttctatatacatcgtttaggtttttggagtttttcgattcaaaaatcgaatcagaacatatttcgattctatggtcgcattttttttttttcgagaaccattccgaacccgtataaatccaaaacgaaccgatcgaaacatattcagtaccttccgaaatctccctatctaaaaaatccaaaaccatgtcttaccctacaaatccaaaacccgaattaccctaataaaatccgattcaaagtccgaatgtctaaaaaatccaaaaccctattttaccctacaaatccaaaacccgaattatcgtaataaaatccaatccgaagtccgaatgttcaagcctaattgagctactcactaacacacatcacacatgtgtaaatcacacctaacttctccttctatatatacgcctttgaaagaccaatcctaacttttcattgtttactctttcgtcttccttttcagagttcaatcacacaacacctctcttcaatagcaataaccatg

SEQ ID NO: 12880 - DNA, 3000 bp, Unknown
  misc_feature (1)..( 3000): cDNA_ID_3026889_gDNA_ID_2214578_Annot_ID_186389 3000 nt of promoter + ATG
ggtcaagttccatcttcaattggaaacttgaccaaactaatgtaccttcgcctttccataaaccacttaagtggcaaatcttctgtttcatttgccaatttaacgaaattgatccaactcgacatcagagaaaatgactttgaacccgagcttataccggacatgagccgattccacaacttggagggatttgggggtgggaactttttcgggccttttcctacatccttgttcacgattccttcgttacgatgggttaatttgagggacagtaacaacaacttcacgggacatatagattttgggaattcgtctttatcttctaggctttcttatcttagtcttgctgataacaatttcgatggcccaatccctgaatccatatctaaatttctcaatctcgtattattagatcttcgtaacaactcattttccgggcctttcccaacatccttgttcaagattccttcgttacaatgggttactttggcgcgaaacaatttcaagggacctatagattttgggaatacatggccatcatcgtctagtcttagtagtctataccttgctgataacaatttcgatggccaaatcccagaatccatatctcaatttctcaaactcgaaaggttagatatttccaacaataagttgcaaggcaatgtcccaggttgcttattgagattgtcatcgctagaactttctcacaactctttgagtggttttggaaaatcatcacaagttctagatcaagcacaaatgcgagtttgcgtcttgattctaattcattccaaggaccatttccacattggatctgccagtttagattgctggagattttagatttgtccaacaatagcttcagtggctcaattcctctatgtttaaggaatatcacttattctttggaagtgcttaatctacgaaacaacaatttcagtgggattcttccagatgtgtttctcaatgctactcgtttatacacacttgatgttacccgcaaccggttggaaggtaaactcccaaaaaccttgatcaattgcacatccatgcgacttttgaatgtggaaggaaacaaattcaaggagacgtttccatcttggttgggttctatgccatatttagatatcctcatcctccgagccaaccaattctatgggccgttatatcacctccacgaatctacttggtttcaacatttaaaggttattgatgtctcacataatgacttcactggatccttcccagctttctatttttccaactggcttcaaatgactacattacacctagaaattgatgttgtatacttcgaatatcctaccatccaagatgattatgatgacccttattttggtacttacactagttcaatggaaatagtgaacaaaggtgtggatagagagtttgataagatcaggcaagacttcacatccattgatttttcaagcaacaagttttatggaaagatccctgaatccattggcttgttgaagggattacgttttctcaacttgtcgggtaatgctttcacaagcgatatacctcaatcattggcaaatttgacgaatctcgaggcattagatttgtctcataatcagctgtcaggtcagattccccgagatcttggtgagctctcctttctgtcaaccatgaacttcgcccacaacaatctcgaaggtccaataccacgcggaacacaatttcaacgccaaaactgttcttcattcatggacaaccccaagctttatggtctcgatgatatctgcagaaaaactcatgtcccaaatcctagaccacaagaattagagaaagtatcagagccggaagaagagcaagtgattaactggacatcagcagcaatagcgtatggacctggtgtgttttgcggattagtgattggacatatcttcatttcgcataagcaggagtggttaatggaaaagtgtcgtagaaacaagcccagagttgtcatcagaagcgctcgttgaacacgtgtcctctctctaagcattgtcaagcatatgtatgtgtttgtaataacgttctccaaaaactctttcgtgcgttgtaatgttctaatatatggttttgtaataaacgtctttggtggcggtacgtatttgatacatattggtttgaaaatgcattcaaatactcttttagttcctaaatttcaacatgtgatagctatgtatgtgtaaatgagcttgttgtattatgtatcagttttattccgctttaatttgtataaaacagtaattttttctttgtgttatcaaggattcaagacaaaaagaatgactgtaactatctcaggaactgaaacgtttcttgacttattttccagttgtaagaaattcttggatgtaatttggccatgcaaccaatcacacaaagacacatgaaatgaatgacttggggacttaatctagattaatctaaattttatgagttttgtccaggtgttgtagtttggttggtgactatagttgagattaagttatgcatatgtaatctcaaatctaaagtagattagtgtaggccatttttacgcaccacactttatgcattttctcatcttcccacttgtcgctatgattcaaaaaacctggcacatcgggaaaaaacaattaatcacgtgtactcaacctcacaccaagcaaaatctcttcatccactaataaaaatccacgtcagagatatcttacacgtggacggtcacgatccctcaatgacattcaaagaggattcgtctccatatataaacacagagagatagcgagggacacagattcgccgcagctagagagaaaacgaaactaaccggagcatgaagagacgaagatcggcgaagaaatctccggcgatggtgacggttaccgattggaaagggttagattgcggcgaagagacgagaatcgtaaggagattgatgaagttcgaagacttgcctgagtatttgaaggacaacgagtttatacacaaccattatcgatg

SEQ ID NO: 12881 - DNA, 3000 bp, Unknown
  misc_feature (1)..( 3000): cDNA_ID_2712748_gDNA_ID_2214578_Annot_ID_186387 3000 nt of promoter + ATG
catttttatttctactctctttaaatttttaatgaccattttacccctatttgaaaattgtattaggttaacaaaatgaaatattaatatttttcgcctaaattattccaaaataaatttctcgccaaaaaaatttcggaaaaaaattcccgccaaaaattttcaaaaaacaacacatctgctataggtttttttgcgggaaaaaagtttggcggaaattttttttttgcgtaaaaatttcagtttccaattacatgttcctattagatgaaggtaatttgatcattctgttcaagagaagagatatttttaaaaatggacaacacaaaagggtattgttgcaaaaggtagtaaaaaaagggtagttttgcaaatttccccatgcaataaacaattatttttagtattaaaaatattttttctaataacattctcaacaatgcatcatacagataattcataaacaacgtttgtcttaaaccaatttaacaaagggtagtgttggattctagaaacctaagaatttgatgatggagctccttacgtatctttccttcttaatgatttattgtataaatatcaatttaagataacaacttactcaaatcattaagtaatccacgactattatatactcatactttgagtttggattaccaaaaaaaatcttccagtatgagaaaactattaaaatggttttattgaaaaattatgtaatattaaaataaatttagtaatactacaattaaatatgtaaattaaataataaatatatcattaacctataaattagaagttgaagagcttacattaattatttaatagacacatgtcaaatgctaaagtgatgatgtgtcaatcatatggagagaagagttggctaactttcatatatatgatttgaattatggctcgttgtaaaacaaaaaaaagcgttaagttaattagactcggtttagagatgtaaaccgtaaacaagtagatataatgttcggatgaaatttgcaagcgaacatatacttgttaatgatggcgatgaaaacactatagacgaatttagtacatgactagttgctcgagagctcgtttctacatgttgaccatgacggctaaccttttagcactcgaggattaactgcaacatgccaatatgccatcaccaactacgtaaaccaccagcgccaagaggaataattcgaattatattgttacacgagagttgtaacgggacaagaccttaataggtcaaacccacgggttgaaatggtcaaaagcatactctagagacaaacactatcaaaagacccactttatggacatacagtaagaattggcaaggtcatatgattggttctaaaaaaggtcttgaactcttgatccacatatatcatctggcaccccaaaataagatcgacttattctatgagattgagtcgctcctatctaggataggtaagctcataaatcttttaactatatggcactatgcatcaaacgataaagagctccctcagctctcagttagaaagaattatctcttatcacatttccaccaaatctcgagattggatcttacactacttccggctaacgatctcgaacttagaaaaacaaaacaaaatgtttagatgaactataagtttagataaacccacttaccgaatatcttgtgccaaatataccgcttgctactacaagaaaattgacattgttcttgccgacgaagttctgcaccattccaatgatactattgcaaagagaagatgggctatgactgtaagttgtttcttgtgtaaccaaacaaaccaaaatctgcaacgtaaccagaaatatatttttaggtaaagaaacataggatttaagcaagattttacagtaataaataatcgagaataactagagatctttgaaatcaagtatttctcatcttaaaatccttaactaatttttacaaatctaaaaaattaaagcaatgacattccattgtaaatactctataaactaagatctgtttcctaatttttacttcaaaaatgtatattagattattaagacattagccaaacttcaacggctaacataaatgataaaaacaattttttgctataaaagttgacgaataggaggaacactctcaacaaaaatgagataaattatgacggtgtccgcgtacgatacggaccagattgtgatgattaacaacaccacgaaagacaaaagttcgatattggagctacaagttgcatcaacttatttaaatccatatggtaattaacacttagatataaacaaagaaggtgtggttgtattgtgtggtgggctaggttgattaatttatcttatatgatccctaaacctcagtgcttaagtacccaaattatcgaaccaaccaagtcatcttcgtatttcttaatcttaatttattctaataatcatcatgtatataccaatttgatgtatatattatcgtcgacatggatgccacatcggacattgttgaggatacaccacccctgtagattgttatgatatttcctcattattttaacgtatcgttccactaatctcactctcaaaatccaattacaaacgtgactatttagtctaatctactctagtaaacatataatattaattaaaacccaaaacacatgatggagttaggccttaagctagttattttagatgacatgtaaaccaccatacaaaaattaacacaccttcacgaaaaaaagttaaccacacggcaattataaacgaataaatgacgtggcggagtcaagttacacacgcgttcacacaacattggttgactttataagtcaaacatcataggcgctaaacgtttcattttcttcaaacgttagttaggcacaaactataaaagagatactgtctctcttcgattgtataatatatgatttatatatatgtgtatagtcaaacaccatttctgattctttgttgtctcaaataaacacacacacaaaaaaaaaaaaa

SEQ ID NO: 12882 - DNA, 3000 bp, Unknown; identical to SEQ ID NO: 12881
  misc_feature (1)..( 3000): cDNA_ID_2712748_gDNA_ID_2214578_Annot_ID_135207 3000 nt of promoter + ATG

SEQ ID NO: 12883 - DNA, 3000 bp, Unknown
  misc_feature (1)..( 3000): cDNA_ID_2712740_gDNA_ID_2214578_Annot_ID_135209 3000 nt of promoter + ATG
gtcttttcaaactccaatatctccaaaacctaacccttcgttattgcaatctctatggagagattcctttttcattaggaaccctttctcatctcacctttctcgacctttcggaaaataaattagttggtcaagttccatcttcaattggaaacttgaccaaactaatgtaccttcgcctttccataaaccacttaagtggcaaatcttctgtttcatttgccaatttaacgaaattgatccaactcgacatcagagaaaatgactttgaacccgagcttataccggacatgagccgattccacaacttggagggatttgggggtgggaactttttcgggccttttcctacatccttgttcacgattccttcgttacgatgggttaatttgagggacagtaacaacaacttcacgggacatatagattttgggaattcgtctttatcttctaggctttcttatcttagtcttgctgataacaatttcgatggcccaatccctgaatccatatctaaatttctcaatctcgtattattagatcttcgtaacaactcattttccgggcctttcccaacatccttgttcaagattccttcgttacaatgggttactttggcgcgaaacaatttcaagggacctatagattttgggaatacatggccatcatcgtctagtcttagtagtctataccttgctgataacaatttcgatggccaaatcccagaatccatatctcaatttctcaaactcgaaaggttagatatttccaacaataagttgcaaggcaatgtcccaggttgcttattgagattgtcatcgctagaactttctcacaactctttgagtggttttggaaaatcatcacaagttctagatcaagcacaaatgcgagtttgcgtcttgattctaattcattccaaggaccatttccacattggatctgccagtttagattgctggagattttagatttgtccaacaatagcttcagtggctcaattcctctatgtttaaggaatatcacttattctttggaagtgcttaatctacgaaacaacaatttcagtgggattcttccagatgtgtttctcaatgctactcgtttatacacacttgatgttacccgcaaccggttggaaggtaaactcccaaaaaccttgatcaattgcacatccatgcgacttttgaatgtggaaggaaacaaattcaaggagacgtttccatcttggttgggttctatgccatatttagatatcctcatcctccgagccaaccaattctatgggccgttatatcacctccacgaatctacttggtttcaacatttaaaggttattgatgtctcacataatgacttcactggatccttcccagctttctatttttccaactggcttcaaatgactacattacacctagaaattgatgttgtatacttcgaatatcctaccatccaagatgattatgatgacccttattttggtacttacactagttcaatggaaatagtgaacaaaggtgtggatagagagtttgataagatcaggcaagacttcacatccattgatttttcaagcaacaagttttatggaaagatccctgaatccattggcttgttgaagggattacgttttctcaacttgtcgggtaatgctttcacaagcgatatacctcaatcattggcaaatttgacgaatctcgaggcattagatttgtctcataatcagctgtcaggtcagattccccgagatcttggtgagctctcctttctgtcaaccatgaacttcgcccacaacaatctcgaaggtccaataccacgcggaacacaatttcaacgccaaaactgttcttcattcatggacaaccccaagctttatggtctcgatgatatctgcagaaaaactcatgtcccaaatcctagaccacaagaattagagaaagtatcagagccggaagaagagcaagtgattaactggacatcagcagcaatagcgtatggacctggtgtgttttgcggattagtgattggacatatcttcatttcgcataagcaggagtggttaatggaaaagtgtcgtagaaacaagcccagagttgtcatcagaagcgctcgttgaacacgtgtcctctctctaagcattgtcaagcatatgtatgtgtttgtaataacgttctccaaaaactctttcgtgcgttgtaatgttctaatatatggttttgtaataaacgtctttggtggcggtacgtatttgatacatattggtttgaaaatgcattcaaatactcttttagttcctaaatttcaacatgtgatagctatgtatgtgtaaatgagcttgttgtattatgtatcagttttattccgctttaatttgtataaaacagtaattttttctttgtgttatcaaggattcaagacaaaaagaatgactgtaactatctcaggaactgaaacgtttcttgacttattttccagttgtaagaaattcttggatgtaatttggccatgcaaccaatcacacaaagacacatgaaatgaatgacttggggacttaatctagattaatctaaattttatgagttttgtccaggtgttgtagtttggttggtgactatagttgagattaagttatgcatatgtaatctcaaatctaaagtagattagtgtaggccatttttacgcaccacactttatgcattttctcatcttcccacttgtcgctatgattcaaaaaacctggcacatcgggaaaaaacaattaatcacgtgtactcaacctcacaccaagcaaaatctcttcatccactaataaaaatccacgtcagagatatcttacacgtggacggtcacgatccctcaatgacattcaaagaggattcgtctccatatataaacacagagagatagcgagggacacagattcgccgcagctagagagaaaacgaaactaaccggagcatgaagagacgaagatcggcgaagaaatctccggcgatg

SEQ ID NO: 12884 - DNA, 3000 bp, Unknown
  misc_feature (1)..( 3000): cDNA_ID_2709833_gDNA_ID_2214578_Annot_ID_135211 3000 nt of promoter + ATG
tacaatgttttatatatagtagataatacgagatatgattgaaccctatcaacttgcttcgctacgattttcaacaatttatctcacaaaaccaataaaatgtccacccgttatcaacgtgacacaaacacatcaaagaagggaacagttctactggccacctcatgagtcatgactcaaccattattgtgtcctggacttctttctagaatgtaaattgatgaacgaaaatttcagctctgcccttggctaaagcggctgaagtccatgctttaggcacacaaatttatagatagttgtaaaaggtaacaaatttcgaaaatgtttcgtaatctagtggttatttcatagattaatgtcttattagtgaacggttagaattttagctttgttttttgtgacttttaattagaaatagatttaaaaatgcttaacaattttaaataaacttaaatatgttttaggcattaaaatctgttgggttagttctgtcgaggcggattggacgttggtttttttgtatataaattagtgggcttcatggatagatccatcgtagatcacaaattcatgtggataaactcgtcgcagattgtgggttgcccgtaaaagaaaaatcaactcttttaaaacataatgttttttcatagaggatttcaatccttttgtctctgttagaattttttgtgcagttcaaaaaccctaatcaaagtatttcacgatcacttaacaagaaatctgaagaatcattctctatttcttcaagtttctttttatgaccacatcaaaaaaaattaaatcgtcgaaacttttgattttaagtcaaaacagagcatttgtaaactacacacttgtaatggtaagttatttgtgaatacacatccatgattagatgttttatttttgtttgattgattcgcaagtagtgactagttttgtattttgttactgatatgattcgtttgactccgagtattttagatctaataatctggaatatcagaaagtcattaagttgaaaaatgctaaatctaaacgacaacaagctaacaatgaaccaaaaggacctaaaaaactggaaagaaaactaagagatgaaataggagcacctaagccacatagaaaaaaggtgaatgaaccagaaacatttaaaacccaaagaaaaaagggtgatgaagcagaagcatataaaacagaaagaaaaaaaaagtttgatgaaattgaagaaaaaaagtctgtcttcatgttcgttgcactcgtcgtgaaccccgaacctcaaatgatttaaagattaaaaaagtattagactgctttcgataattccttcttagttctatgaaacactataatctatttagactacctcagcgtatcaatatttttttcttgtatagaatatccaatcacgaccaatcgaatttcatcaatctataagaatgccattctcatgcaatttttctcttatagccaacatgctcatgcaattttgattatttacttaaataaataaataaatagaagtttatataagtgtcaataataagcttaaccttgagattctttgagaaacgttgcatttatagaagaatttgtcagtaattctagtaagatacgagcaatcaattggtatttttgattgttacttctctcatctcacaagtttgaatggttacggcagttaagatggataaatccgtcaatggtttaatccgaactatttttaaagtagacaacaaaccgtcgcaaccaactctatttatatgtaaaaacggtatgtggttgatccgcatcagttttcttttttaaatccacacagaagtaatttgtgaaatggtaaataaaacgtggtcaaatacacaaacgaatttgtccaccttaaccacaacaatcatttagaccctaaaattgataataaatggacaagtgaacatagaaaatatggcaatttatgttattttagacaatcgaagcgattatttaggcgttacctgagagtctagtgcctagatagagtgtaaacgaccgcctagaccattttttataatactgaacttttgtaatcatttatttcggaggtggtgcacacgacaatgcctacattactcgtgaaaactatattatacctcagaataccaaagtccatgttcccgatcccaatatcatcaaagagttggcccatatcaaatgctatgttaatttttcttatcttttcaaattattctaatgttgtgttgccaacgactgcttttactttataatagaatagaaataatagaagttagtttccgcgattactattatatgcttacatttataccggactagttatctccagaagaaaaccgtccgttttcaatttgaaaacagtctgtaaaagaaagacttacatttatctaatgcggatttgtattgtgtgtgtgtgtgcttttttcttacatgtatttattggtaatgtacatttaattatatgtcaaggtggttgctggtgtgtgtaaggtttcataatctgctagaatagttaagaggtcaccttcatttaccaaatggattttgtcttctaattgatttaaatccatttttttcttttattctttgaatactttttcataattatttcgtatcctccacactaactcatttctactttgctacatttacaagtttcatctaatctacttaaattaacaaaaaaaaaaaaaaattgtttccttatttaaaaattagatttctcgtaaattggactttgattttaattattgtctattcaaagttttatttttttaccttaaaaagtgttgactttgatatttcattaccttaagaagaagaatcaccgacagctccaacttaggaaatctcaaccgttgattaaatcaaacgagatactaaaatatccaacggccataaatcgtccaattgccatgtttcttcccactctcttctccttcatttaagaaatttcactctccgaagaagaagacgaaatcgagcaaatccatg

SEQ ID NO: 12885 - DNA, 3000 bp, Unknown
  misc_feature (1)..( 3000): cDNA_ID_2709853_gDNA_ID_2214578_Annot_ID_135212 3000 nt of promoter + ATG
tgatattccagattattagatctaaaatactcggagtcaaacgaatcatatcagtaacaaaatacaaaactagtcactacttgcgaatcaatcaaacaaaaataaaacatctaatcatggatgtgtattcacaaataacttaccattacaagtgtgtagtttacaaatgctctgttttgacttaaaatcaaaagtttcgacgatttaattttttttgatgtggtcataaaaagaaacttgaagaaatagagaatgattcttcagatttcttgttaagtgatcgtgaaatactttgattagggtttttgaactgcacaaaaaattctaacagagacaaaaggattgaaatcctctatgaaaaaacattatgttttaaaagagttgatttttcttttacgggcaacccacaatctgcgacgagtttatccacatgaatttgtgatctacgatggatctatccatgaagcccactaatttatatacaaaaaaaccaacgtccaatccgcctcgacagaactaacccaacagattttaatgcctaaaacatatttaagtttatttaaaattgttaagcatttttaaatctatttctaattaaaagtcacaaaaaacaaagctaaaattctaaccgttcactaataagacattaatctatgaaataaccactagattacgaaacattttcgaaatttgttaccttttacaactatctataaatttgtgtgcctaaagcatggacttcagccgctttagccaagggcagagctgaaattttcgttcatcaatttacattctagaaagaagtccaggacacaataatggttgagtcatgactcatgaggtggccagtagaactgttcccttctttgatgtgtttgtgtcacgttgataacgggtggacattttattggttttgtgagataaattgttgaaaatcgtagcgaagcaagttgatagggttcaatcatatctcgtattatctactatatataaaacattgtagaaaagtaaaatattttcatttaaaatattataaaacagagaagaaaacttatactatttgaccaaggaaaaaaactacctactcacgacacgaccatcacgtttataatgttaatacacagttacaccatacattttttcattgtagttctatacaataatatatcatcgtttgatctaacaagtattcgatagatagtgggaacttttttttcccttttggccttatatttaagaacatggagcctgtgtttctaaaattctatctaaaaaagtatattttgtattgatcatatctgaaattgcatatattgtaaaatattgtgtacaaaaggatccggtccaagattaaacacacaatacttactgagactaaaaggggctaaaccacaagaacaaatccttgaaattgcaatggttaaacttacaaaaaatatgtctcttattaccagatcttaatattgtttaccgaatttctgaactaaactacattttttgcccaaacaaacaaagaactaaactatatttattcaagtcaagtcaaataattgcatgcaggagacaacgcaaaaagatgaaaaaactaaaaattcagagatgaacatcgagaacacaaataacattatccaaatctcattaggatcctattaaccaaccacaaaaacgtccacttcataatggtctaatagtacaatttgtttttatgtagaagtaaaagtgaagttcgaatattcttacattgatttcaatcatattttgctactatagattaacatgtatacatcagcatacacatggtccaacgattgagtctatactgcacaaaactctggagatgaatctaaactttggttcgaaattccggcaatgtatggaaaagaatattcaaaaaaataagaagaagcatattgaccgtttcttgttcaatatactagaaggtaaacgtcaaaaatgtcagcatgttttctttcaaaaacaaaaaaaaaaatgtcagcatgtggtcagaactcagaagttcttaccaagaaaacttaactaacagttaccatttagaccctaaattacttatgttgtatttttgtccgaaaactttgattaaaaaaataaaggtgtaagacgatgaaaaagaacaaaaaattatattgtcactgtatctttcaaaatcattctaaaatgatagacatgtatcttagcgcctccaaacttttccactctatgaaaagttgttcttcgttttttttttttttttttttttttttgtcaattgttcttcgtttttgaacttctattttgcttcgttttgatatttttatgttttcgtttatatttttgaatttttctttctttcgtttgagttgaagaaaaaacagttgttattatgtaagaatttaaataacaatttcaaaaaggaatattttttttggtcttactaaacgtctgaccggcatgtttgaaatatttcagtttcttgttgcttcttgatttaaccatccgaatctatctaaaccaactaaccaagtgattgaacaagaactaaaccgatttttctttgatttgatctgaatccttaagtagtaaagtccaaaacagcaaatactaaaactgaacacaaactggagccgaactgaatcccgaaggaacaggtgttacctattccgacaacgataaatctcctatttttgggatgttttatctattgaaaagttgttgaatgaggatggtctaatgatttttccggtctctccttacaaattacacttttatggttcaatccactcttaaaaaataattgaagtcaagattttcagcctgtggtcggaaagtccttacacgaaactgaagtatgatataaatttatctttagcatatggtcgaaaagtctttacaataaacttagttaaatagtagtaaacatatacactagctacacgtatttcatctttattatggtcacacatactacacaaccaacaaaaactacaagacgataacaacaaa

SEQ ID NO: 12886 - DNA, 3000 bp, Unknown; identical to SEQ ID NO: 12879
  misc_feature (1)..( 3000): cDNA_ID_1807330_gDNA_ID_2214578_Annot_ID_135214 3000 nt of promoter + ATG

SEQ ID NO: 12887 - DNA, 3000 bp, Unknown; identical to SEQ ID NO: 12878
  misc_feature (1)..( 3000): cDNA_ID_2709849_gDNA_ID_2214578_Annot_ID_135215 3000 nt of promoter + ATG

SEQ ID NO: 12888 - DNA, 3000 bp, Unknown
  misc_feature (1)..( 3000): cDNA_ID_2709845_gDNA_ID_2214578_Annot_ID_135217 3000 nt of promoter + ATG
aatacgaggaagtgaccatgcgtgtgactgtagaaatgattttgccggaaacatgaacaagtgttatgattcatgtagaaaaggcaaacaacatttttgagtcaatcttgttgtcaagcgaaccatcatttccttttccaatctcaaactcaagcattttggtttcttcatcatcacactttaaacatcgatttcggttatgattactttgtgtttccatgattgatacgtgtagttactattcttacaaggtctacctcaaattagctagcattgcatcccatgttcttttgtacgtccaatatgtggctaatataatatactaatatggtcatcaggtcatgtataagtataactatgatatatactagacattgattaatttgaggctaaggagaaattaaggtatgtgttttagaatccattctattaattttagaatcttaaatacatagatgggattcacgaacataccaacacacttcgtcagctcaaaaacaaaacaaccacatgccgcatcgcacaaaccaacaacgaggcttttttttttattggcgtctacttctcatatgttttttttcgtctttttacaatgaagtaaacaccaaatccctgaatgcatgtgatcttcaagtcttgatcaattgggtttctaatttatgcaaattttcctttttgatttagacttctctcttctttttttttttttttttgttgtctaaaattttagatttagacttctttttgtcttctaattttcttactctatcaaagggaactgctagttcgaatacacgggtgaagcggcaagacgagaaccaaatgaggtacatgtttgaacgcgattgaggaaccggatgtgcaatacacatgacaaagagcaagccggtaagaaaacacaaacaagtggcaaaccaaatatatatgtctataaccaagttgagtacatgaccactgatataacatggactataagaccgtttaaaatatttccaaatctactaaaatgtaagataaaattctaagtaattcaattataaagtatatttttaattgaattttccaatcaattaaaatctacaactaacatagaaattccttctttaatttaaaatgtatatagtatttgatatatataaatatatagagaattaatggacagtaaataatttttgaaagaaataaatatatgccggtaactcgttgttattcattaaaagcaaaatctatacgtcaatgttttttcttttttctctacgagtaaatgttctttcatttctcatgcaataattcttttcctcggtttgagtgatgtttgagacgaaactaatattacatgctgtggttttggatctagtaaattacgggcttcgcctcagaacctcttaaatttaaagaataaagaaaaaaaaattttttgcctctcacaacgtgagtgatgtaacacgtcacttatacacgccaactcttctcatcgaaaaattactcgtattacgttagtgattcactacaaaataaggattcctcttattgcgagtcaatctcatataataattatcaagttagttttatagcaaaagtattgaatttcatggcaactatgagtctatgactaaccaagcatgacatttgttataataaggaaaagaaacattttatatttgaacaacttgtgttgctatcataccagcggttaccgagatcaaatccatgattacattggattcacaagacatgatcatttagtaaccgagatttttcttttttctttctgttgataatacaatatactaaccgagattaattcatgattacgttggattcacacgacatgaatatgactctagtattttttgtttttttaaaaaacacttacatcattcttttgtagtgagctcatttctaatatagaaaactttttggttgttttctaaacataatattgattataacaaaaaaaaaaactttttttagataaattgttttcaaaaatttataaattagccaaatatctttataaattaatagaatctcacggttctgatatattataaatatatagaagttttactgtatatattttctcaattttgataatggttaaacttttaaaatatttttcataaacgaataatgtagcattactgatgataatggtgtaatattattgatcctatacgtaagaaatcagtgcttgcttactgatgaccaaaaaaaaaaatcagtgcttgcttagaaacatgtagaaaaattctaccgacaatctagaaaaagtaaagttcatactttgcacactctcctttaatggcatgacacatcaatggagatagatttctcagtaaagtacaagatgatatcttttgagaataaaaagaagaataaagaactcttacaaaaaactttcatagacacccgaactttaataatttatttccgaaagtgaaaaagtttaaacctttttctctacagaataagagaaaaaaaaatgtcaaacaggttttatccacacaaaagaaaagaaaaaagaaacgggttttcagtgagaagaatgaatgatttaaatttgttcaactagaaaaagaaaccaatgatactgtttctgaaaaatctgagtgaatgaattctctcatttatgaaaaagcttcaacttctttctgctaccaactgtctacattacctcttctctctctctctttctctttggtatttcagaattcccaattaaaaaaagatactcttgtcataatcagaggtaggggaagcttaatattatatattaatctatgacaaaaatcctcctttttcttgtttttatgtcctttggtctctcgtgttcttgagaagcaccacagagttaaacaaacactttttctatcttcagatctctccttaatatttgtcttcaactgtttcttgcatgagtaccctaaagtagcttcagtgagattttcttttttctggaggcagattttgttgtttagctccaagctttcttcaatg

SEQ ID NO: 12889 - DNA, 3000 bp, Unknown; identical to SEQ ID NO: 12875
  misc_feature (1)..( 3000): cDNA_ID_2712728_gDNA_ID_2214578_Annot_ID_135220 3000 nt of promoter + ATG

SEQ ID NO: 12890 - DNA, 3000 bp, Unknown; identical to SEQ ID NO: 12874
  misc_feature (1)..( 3000): cDNA_ID_3026897_gDNA_ID_2214578_Annot_ID_186386 3000 nt of promoter + ATG

SEQ ID NO: 12891 - DNA, 2610 bp, Unknown
  misc_feature (1)..( 2610): cDNA_ID_2709841_gDNA_ID_2214578_Annot_ID_135221 3000 nt of promoter + ATG
aactagtgaacttatggtctaatactctaatattactaacatgatttggtttagtttttaacttactatttattttacgagttggaaaaagctttacatgatatgtttttacgacaatgcatcaattctaattcacctaacaacttgtaagccaaacgatatatattttacaatagtcactctcaaaatgaactaaagatttccaaggctatggtttgttcgcaagattaatggaagagtgattgattgataccccaattggtggggatattgatgttatggtatggtttttgtggtcctaaaaattgatcactttgcaagttttttttttcgtcctttatccgaactcttgtggttcctcgatcttcttaactaccaagaattattatgtgatgagatttcgcatctacttttcttcccatctcttcacctactcaattacccatgacttagcttttttggcgaaaattttagttatgatcagtggatgtatttgttgtagatccattacaaattttgtgtagccgttagtttctcaactgaattgaaatgtatttgacaaatattatcacatcttcgaatatcttagtaggatctatatgatgaatactaaatgtctcaaaccatcacagtttataacatgaaattctattatgacactctgaatttgaaatatattttctatgccacctaaataactctttgttgaatataatttttattttcttaataggatatgcaaaaattaatattttatcactttgtaagatctaatcaagagtaattaagagttaatcagcagttaacttatgaattaaatcaagtgttaacatgcatttcaaaagattaaaatcacaaaagagaaaaatgttttcttaaaaaaaaataaaaaaatcttatcgtcttttattgtcccaaagaagataacgaactctgtacaaaagcttctaaccgtcgtttaaattttccataactttgtaaggaacaaatgaggtaaaattttagtttacttaaaatttagttatgttacacgacatcagaataaacttacagagacaaacaaaacgtgtaaggccttgaaccaagataactacgtctagttccaaaaccgcttttggctttattcaatttccttgtttatcatagtatcgtagcatctttgttattcagtttgaatgataatagtattgtggttaagagtatagtaaaacatctacaacaatactccgtaattagtattttgatagattaatatattttggtcttaaattactatttttgaatcaattagtaactttataaattaatcaaatcttatatattttcgacattactaacatagtatattgtttttattgttatatatgtcatcaatcacaaaaagaagaactatttgtattgaaggccaccacttatctcttattgtgtttatatctcaactagttattatgttaaaggtaaaactcttatcatatagagcccaaactgttctaataacaacaattaaagataaatctaaattttgataatttgactaacatctatgttgtatctcatatgcaaaaatatatgtttgtgatttcactatgcaaaattaacatctatgttaaaactttctatatgaaaatattatagttttttaataatacttacacatccaacattcaaacaatgtgatttcactccatagcgttttttgttattttgagatgttaattttgtaatgcaacctaaacatcttcatcttctcaaaaaatcttggtatactttaaatatgttgtttctgcttactttttttttggtttataaacatttgattattcttgtttcagttgatgaaatctctaacttgtttttctttttgatcatgttatagagttgtagttccacttgagaatatgtctgctatgcaaattacatatcatctttttcaatggcttacatataattgttgtaaaattcatgaataatatcacttgattatttaatgttatagaagatggattaaaatgtttaaaacttttcaagattttttttgaaatttcaataatatgaccaaattgtttttttttttgaatttgtttggaatattccataacaaccggaccttggaaaataaatacatgcatgtttgtttgtgtatgatgaatacatagacatgtttgtggttgtggctatcatgagtcccttcgttaataaacaatgatgtaggaccaatagctattcaataaccaacaaaacgatcacacaccaagaaactcttcttcactctctctaattctcattctcatttctcaccatacaatttttcatctccctctctttatccttttctagattttctttttacccttcaatcacttatctctatctatctacctttcatgctctttcaccactccttccataaaaatctatcaataatcacttcctctctctctctctctctcttatacaacactcaagaagcgagacacagaggagagagttagtcttcttctctgtttttgtctctttggctatatatattcaaacattgtgtgaacagaacacaaatcaacacaacacacacaactttgtgttctttaagttttgtttcagagatcaatg

SEQ ID NO: 12892 - DNA, 3000 bp, Unknown
  misc_feature (1)..( 3000): cDNA_ID_2712786_gDNA_ID_2214579_Annot_ID_135224 3000 nt of promoter + ATG
atttgcatctgaagcacggtggacggaacatgagtatgtaagtacactaaatatttttattcaccaacctatgtttaaatttttttattataaaaaaatctaattaattttaaaattatactgatgcaaattaacaaaattaaatttatattttgatcaatttttgtattagtggtttataaatatctgttattgtttatttattaacacaaaaatttaattaactattaatatatatatatatatatatatatataatctgtaatccgccacaagaagtttttttaccaatcaaaccttattctgtaccgcttattttgtactaaccgcacttgtcccacaaatatgtattctccctgcatatacctcagttgaaccgtacatcattgtaataacgctttccccgcacaataaaaaccgcgattaccattcagacctttaatgaaaatatttaaagttgtcacattaccaaattatgcacatgcaattagctagaagattaaaagataattctattaacatattttaatcattaacagtaaaattgataaaaattccggaatagagcggaatgatgctgaaataccgtgacacaggatatacacaccaagaagatcaagggttttgctggatattcacaccaacaagatgatctaatcttaaagagttttagaacagaagatagatgagttctcaaagagaatacaaaagggtttataaagagaaaagagaagagaagagaccaaaacatgatcaaaacacaagcccttctcgaaactaacagaaaattaattataagtttgaattagaaaatccgttttaaatacaattgactgccatttaaaataagatggcatagcaaaaaaaaatctccaacaatttcgataattttaccttgtgttctgtttttttttactttttgacagaggagtttcatcatacattcttcttcatctacaatagaaaaagagattattgttaattaacttgatttgatgtttgttttgtgtctcgagaagagttaatggaacaatgagtcaaaaaaggcagaagagagagagatggctatgcgaaatgaaagaggcctagcgaagaaacaaagccctaataaaagcagagaaatgaagcgaaaatgcgatcacatccatgattcatttatttttaaatttatttatgttattaaaaataaattataattaaaaacatatacaaaatatttttagttattgtacctaaacccgcaccagtcccgcttaagtttttcaggtaacagaataaatttaggtgtgtttggttactggttaaatagaataatgaatttctattatgtttggcaattgaaataatgtaattcagaagaaaaaaaggaaaatttgacaacattgtgagtttgtttgttcagaaaaaacctttttctactatagatgattactttctgagctaaaagaaatgcttatttttagtttgacatctaacttctcacttgtcaaattactcttttcattactcataaaaatgcattaaactttttttattggttaccgtgaattaaaaatatataatcacaaggatatgtagttgaaaagacttcgttggcccttttcgaatgattttaaaaccatctcatacgtgtgctaaaagttttgtctaccaactgtttgtcgaaatgcttccgaaacgttttttgtttgttgataaactaataataattctgattttctggtattttttatttgttgtgccgactattttgcagacacgagagattaaaggtatcccaaaaatttctgggaatatagttcttattcaccaatcatttgtagcaaacaagatagaaaaaacatgcctaattctccaaagtttgttttcataagtaattttgaataattttcatttctctttatttacttccattattttgatatatagttcatatccatatctcttatgattaattttttaatcataacatgagaaacgataggaatgaaacctatttgtaggcgtttacgatatttcttatgatacattttttttgtaaattagaatttagaagtagtcactttcgttttcattactggttcaattagaatgagatatgataaaactaataatttttttcaattgtctgctctacaatctacacaggattccaaggaaaaaaatactttaggacttcacatcaccacatcagatattgtcaaagacaattttgttttgtgaaatcgaatactctgaatccggctttgatatcgaggaaaaaacgcttgacaaagcattgaaagaaaaaaaaaatattagttaaaggaaccttatacattttatgaagtttttttttttgtaagcacccgaaataaaattgatgaagtttgagtatatcactatgccttatggtttttgccgaccaaaatatgtcgaaattatgaatacatatattttatttatttatttatattctattaaaattattttgggtgtaataataaaattaaacttctatcaattttaaagggaggattattaatttaaataacattaaatcatatatgatatataatcaaataatattttagtaatcttaaaattaaattaaaatttaaaaactgatatttagataatcataaagtattaacccacaacaataagtgattacaatttaaagaactactattagtttcttaaaatattttaaaagcacatgtgttctaaaaaggttacaggtagataagcagtctgctcctaaagaactataaacaataatcacttttaatttgtttaaaaccagcttgtttcacgccctaaattaactaaaatatatctaccattattccagacaaaacgacgtcggttggtgtgtttcacgccggcttggtgctctaggcatctatctgattctcactatcactactgacacaaatccttttccttttgttcctctttctctaaaccaatctttaaaacaacttattcgtcttcaagatttctccaacaagtcctacc

SEQ ID NO: 12893 - DNA, 3000 bp, Unknown
  misc_feature (1)..( 3000): cDNA_ID_1027604_gDNA_ID_2214579_Annot_ID_135225 3000 nt of promoter + ATG
tctcattgcagactcagctgcagctgcactgatgaaagatggtcgtgttgatggtgtcatcgttggagctgatcgtgtggcttcaaatggtacactcaaacaccttagataaatccgttttctctcacaaatctgattccttatgactgaatcacttcttaaccaattcattgatatactccaggcgatactgctaacaagattgggacttacagtctcgccttgtgcgcaaaacatcacgggatcccattttatgttgctgcacctcttacctcagttgatctgtcactttcatccgggaaagaaatcgtgatagaggaaagatctccaaaggagttgatgcacacacacggaggacttggtgaacgcattgcagcaccagggatctcagtttggaacccagcttttgatatgactccagcagagctgattgcaggaatcataaccgagaaagttcgtttttccagccttgcttgttctggaagatatttatgctcatttatttgaatctctcaacgtgtttgtatatgcagggggtcataacaaagaatggcaatgatacatttgacataagcagctttgccaagaagataacaggaaactcatctcgttgaagttagagtcagcattgcgacttgcggatgttcccctctctctatatacttgcaacaaagcaaattactttgtaatgtttgagctactaagtacactgtggtaaaaattgtcaaaaataagaaataatcgatacgttttagccaattgtaggtagccaaaatgctggtcttgggtttaatgctaatgaagattgggaaacaacttgttttagtgtaaaacaacttgtccatgggcttgcccggtccatcttgacttggttcttatttctctatttttttaagtttaagaaaagaataccgtttctcctacccgtcaatattgaaataatttcagaggttttccttgttctgtgtcaacaaacaattcgaaatgcctcgactttatcaattttttgataattctgaactttagaccaaatgcatatggacgagctatattctggaccaaaaaacaaatggtctaattgggcatatgaccagttttgtccacggataatatgggcttgaccatatggacaacgggctgcccatgggcatgaattgagtcaatagacatgtcttcatttaattgtatttttataattttaattacaattacaactaaataatttttaaataatatattttacatttataagtttttacttttctgaaaattttaaattttaatgaattatttcttattaaattatttacgattttaaaggaaagatagtattccacaattttctggaatacgcaatttttaaattttacggttttgacgggaaaaatacaattctccgattttacgattttgacggaaaaacgtaattctgcaaattttccaccaaaatcgtgattttattatattggcgagaacacaattttacggttttgacgggaaaacgcaattctctgattttacggttttggcgggaaaacacaattttccagccaaaatcgtgattttattatattggcgaaaaacacaattttacagttttagtgagaaaacacaattctccgattttacggttttagcggttaaatcgttatttttttgtatcggtgaaaaaaataattttacgattttaccgttttggcgaaaaaagcaattccataattttttcgtcaaaatcgtgattttattgtattggtaagaaaaacacaattttaccattttgtcgaaaaaagacaagtcttcgatttctacaatttttacggaaaaatgcaatttctcaatttttctttaaatttatgatttttgatttatcaataataacaataataaaataggctaaccatgggcttgccatatggacatggtctttattgggcatggacatttttcggaccaaaccgtccaacttggcccataaaaaaactgtccgtacggacacgcccaatggtctttggacggaccatttgacacatctagaaacaaccgtcagcagtagccattcgttaagagtttcagaattccgatatatacattttgatacaacctacacaaaaacaaagacaaagagagaaaatccaactatgaggaggattatcttgttgatagtgccatcaaaaacaagagttagttattcacctgaaggtttggctaaacaaagtatattatctcttttcatatacctgtcaattacatcttgacgctgcattgtcaacaatagagacctcctatgtcctttgtattcactcttggctttcttaagtactctagtagattcatctacaaatgtaaacatggttgtcttcgccgcgaggtcgtttgcatgttcttcttttacttgtttcgtttcagttcgttcttgatcctgcaagatcgggcgtcttctcattgcggcgttagttaattaaagtattttgtgcaaaaaaaatttccgtccaattttgcaactttatactctatgtccaaaaaaaacaaaataattatatgaaatttaaaataatacgtaatatagtcaatttttacaattttacatattgtaaacgtaaaaacatttgtttttgaaattttttaaaaaataaatagttaaactactcatatcaagaattttgatttgatatattatttatcaaaatttaaaagtttaataatatcaaaaaaaattatattgtgtatttttttaattttatataattattctgcattcttttaacgtgaaatgtaaagttgcagccccagggagtattttagagttttttcgaagataattgtaatcttaacttattatttcaagggtattttgggagattgactatttttttttgggttctgtcttgaagacaaagaaagctttcttctataatacatctttctctacagatcacacagaagcaaaaattccatctccgatttcggaagagagttgttctcttctctgagaagaagaag

SEQ ID NO: 12894 - DNA, 3000 bp, Unknown
  misc_feature (1)..( 3000): cDNA_ID_2712782_gDNA_ID_2214579_Annot_ID_135226 3000 nt of promoter + ATG
attaacacaagacctaagcaaaacaacgtcgatgatttgacgctaacattcaaaataagtgacaatgagtaagtttccttctttgatagtttaattcgaattacctaaattatactattctaataatatttttgattttatgtttagaaaccgtgttttgaaatgtctagctactaagaaggaagctcataattatcgtcgatatggtggtggagttattgtcgttgttcttggttggtggaagattgaccgttattttgatggtccaaagaacgtacgtgtttgcaccgcaggcccgatatcaaccgtctttccggatcctgatattcccgagtctaacgagatccatgagatgtaagttttgatctatcatcaaatattcttacatttcgttattagtaattatataaacggaatatctatactattatttataattgcataccacatttgtttgttttgtaggctccgtgatgaaggtgcaaggaatggcggttgaacatctacttaaaaaatgttcttacatgtaccctattgaactcggtctattattattttaatttctgtatgaacaagtttccatttttatttatgtatgaacaagtttacatatttctaatttagaatacgttctaaatcttgatatcttacaatatcgcatcgctattattgacaaaatttaatatgcttcatcctaaaataaatcttagaaggtatgacaaaatttaatatcaaagattattgctttttttttaaaacatcttaatattgctttatatatctaattctaatatttatttattcgtctgtctctatcagaattgcaaaatttagaaaaatatatttattattgctttggcttatgtctcatataacataattattttatcaacaaatgttagtttcacattctgtaaatataaacatatataaaattagaaattttctgattatgagatactgttaaacttctataacacttacatacacgaaaatgtacaaagctactatgtgtaaacttacatatacaaaatataaaattacgttcccaaacgtacatatcaacttagacattgtttgcatgctacaacccgaggaaactatatatacttaccaaaatattgtttgacgagactaaatatatttattttattccaatgatacatgatatacaactatatgtttacatataatgaaaataaagtagagtttatgtggaatacacagaacttaatatttgatgattgatttaaccaaagataccgtgcgtagcacgaatactgacctagttgtaaattataaatatgtacacacaaaaaatttaatggagggtataattgtaattttgcaatcgtcttcaacctttgtaaccctaattttgcagccgctttttaacagttatctcactaattataactgtcaagctaacagatactaaaagtctaaaatcatcaaactacagtaccaacttccaagtgatttcataaaccttataatagacaataattagtacattcatgagtttattagagtcctaaaacatgatttaaatgatcaatataccgaaagagtgaagcaagatgcatgttcagaaaccaatttagataaaattctaaatctattccaaacttagaaaacgactctaattaaccaccaaagaaaagtacttaattagacttacttcttgattgacttagatattggtgagactaaggtaaacactaagtacaatcatttatacgactttgtaaagtttgcggatgtttcagctacattggagaaaaatgtacattacacggacaagagcattaatcgaccaatttggaagaataaactaaagagtaattaatatgatattcatgttatgattcctcaaattttacaacatttaattttaaagtgattttttttgtttccaaatttcacacacgtgtttccctcttcatttctcataagaagttataaaacaaaaatatccttcattaacaataaaattatatccgagattgattatattttgaaaaattcctaaaaataacactaaaacaatatttttggataataataacacacactcaatcaagttctaaaaatagcactacttgatttactataaagtttttgttctaaagaattatcactaatttattttttcaataataccataattttatataaaatctattcaaccaaaataaattagaaataaatttaattaagggtatatatttcaaccatttaaaagaaattttaattcaatttaatattagtttatggtattatatttgggttctctatttccaatttaggatatatattttcaccatttaaagagagatttttcattttaaaattagtgtttagtattatatttggattctctatttccaatttatgatatatattttcactatttaaaaaaaaattgatttaatttaatattagattagtgtttgctttcatttttattttgggaattgacacaaatagtaccaaaaaactttattatttagttaatttctagaggattaaaaactttgtctgctatatttggaagtttcaaaagaagtgcaatttttataatattaaagttttttagtgtcatttctgtcaatcctccttatatttaaccacaaagataatttgtctttatctaaattaacaagacacaacccagcctttgcgaagaaggatgcagagacatcagaatttacattgcaagttgtttcttgttgccagacgtgaatggccgtgtcttgattttgtttgtttgttttcctacttttggaaaaaccccaaaacccaaaatatagggtttttaaatttaatctcaagagttactgtaaaaggtatattgttttgctaaatataaaaaaagaacacatcgtttaaaaacactatatagtaaaaatagttgtcaacaccaaaaatatatctataaaatgctgccattcatttcttaaacctttcatctctctcgtactcagaaataatagaatg

SEQ ID NO: 12895 - DNA, 3000 bp, Unknown
  misc_feature (1)..( 3000): cDNA_ID_1808374_gDNA_ID_2214579_Annot_ID_135232 3000 nt of promoter + ATG
aaataaatcgtggagttgggacttatttataatggctgccactcacatttattatttagttttacaaaatttaaaaagatattaaccaaacgatatcttgcctaatttgtttctaaaaatctctacacaatcttttcatatatcttcaaaaacaaaattccgtgaatcttactccacaaatatgcataaattcgatttatagcaaatatttatattaacattttgtatagcaaaaaaatactaatttataataataaaaatattcacataaaaaatcatatacacatacagaaaaagaattatatatatcatcatttaagccgttgctttatttaaataaaaaaaaatacaaaaaattgaaatcatatactttctatgataaatttaaaatctatattagtagtagaaatttaaaatcattcaagaaacggtataacacaggtgagatcctaaaattattgtatttataacaaaaataatttattttcttggattttataatactaatatttagctaacgagataatatagacgagtttatatgggatgacgggttttaatcgatatcaataaagaacagtatatcacggatgaattcttaaaatttacaattaaaatacatttctacaaccgtaaacacaaaaaccatataatattaacaaaacgaatataacttgaaacttaaaaaatttagctataaaaaatcgacccacggtatactgcagataaaatattcaaaattttaaaatccaccatacatcattacttaaaaaaatatgtgttttcatatcaataaacctaaacaatagtaatcataaactaaataatacagagattgataactacattgaaaaatacaaattaatatgatatattttcagttaatctttaaaaaaataacattatacttttgtaaacaatatagccccgcggtataccgcgggttaaattctatttagtttacattttaatgattaaatttgttatctttttgcttttgtatttttaaatgattaaatttgttctctcctctaataaatttcaaattttcctgttattgaagtctatgaaaagtcaaattaacaactaacgtagtaaacgtatctttgaacttttatgtttatggtataaaagcgttgacttttatgtgaaccactttttttttttagtgtagaaactgtttacaacccaagaaggaggcttaatattatcagaataaaaactagacttccatattgagcaagattatgtgaaccaattagacataataatagggttttgattcaagtcatattggcatctacattaataaagaaaatattattaagaagtacatacacatacactgtggaagcccccttggcccaatagttgaccaaatgttcattaatgtttctacaccaagaggtctggggttcgagttctagctactacagtttattagcaaatttgcagattaatggaggcaagtgtacatgaggtctacaacgaagtacaattatagccgttcgccaagattttacgcagagaaaatgttgaagatatccatcaaacgcatggagaatgagaagaatgtgtcgtctgtcgtggatctaataaaggtcggaaggaattgtgtgtagtagaatcgtctatgtaacagttttcataatttgtaataaataataaatttagacggcaaaaaaaaagtacatacactcatatataatagcagaatatataaaactttttaagcaattacatttatggataattattttgtggccgaaaaaactgagggatttatattactactataaaagtaatataattatatagaaatgggtaagagagaatcaaaaacgaaaaaaagcaaaagaggattttgacttgcacacaattgtcctccggcttcacaagtaatcaatctcccacacgaatttgcatgttactactaaacttttcacatttgccaaatggatttttttttgtctttttctgctatataccaatgaacttcaaatttttagatttggaagttttgtgtcactctatgatttctgattctcccagacgatttgtttttttactggataataattagaatattaacagatttgcatcatactttgcaaaatattatgatgtgcatattaaccgaaccaaaccaaactgacccgatctaatcaaattcaaaccaacccaaatcaaacctaagcttagactcaaaccatttggttgcattttgtctcaacccaaatgggtcggttcggttcggtttacaatcgaaccgaaccaataatccaatgtatttattaatttaattaattaattatattaataatattctaaataattctaaatatttataggttgaattttctatgtttttctttctagttttgtttgaattatgcatttgtctcaacccaaatgtttgaattttcatactgtatatttaaattgcataattcaatttttttatttatttattaataatattgtaaaccacaaacacatgtcttgggttttttaggtttttcttttcatggttttgtttgaattatgcaatttaaacatagaatttaatacgttaattaattttttgaatcaaactaaaaccgaaccaaattaaaaccaaaccaaatcaaaccgaaccaaattaaaactgacccaaacactaaccaaaacaaactagttacggttgaatatggttagaattttacaaaatccaaataaactgaactgaaccgaacccaaaccgaacctgaagttaaaccgaaatgtccgcccctataataaacaatgttgagacgtggtgcttaaacagttaaaagtcaaaacgtacgtcgccaaacatttgaaaaaagtgaccaactagtggaccaattctcttcttttgctttctttagagtcaagaaacaaaacaaaacaaaaaaagtaacccataccgccataagaatatctatctatatatacaagactaatacaagagtttagtttgttagttgcaagaacatg

SEQ ID NO: 12896 - DNA, 3000 bp, Unknown
  misc_feature (1)..( 3000): cDNA_ID_2709885_gDNA_ID_2214579_Annot_ID_135233 3000 nt of promoter + ATG
gctaacatgtcgattctggatcttttgacactacttgtcccttcatatgctttagcaagtttatcccatgcttctttagctgattcacagttttgaatttgcttgaattgattttgattcacggagttgaatatcaaagacagtgcccttgaattagctgtggcctttgcctcttctgcatcattccattgatcttcagtttttagcacatcttctccatcttctcccttgatgaccggagccttccatccaatgctcgtagcaatccaggcttcttttcctagaccacgtatgagagctctcatcttcactttccagtgtccataatttcctttttccaatatgattgctttaccgacttcaacgaactctttggggtagtccatcctctccgcaggatctgcatctgttgttaagtacatcttggttcagatgcccgctctgataccaaatgaaattccggatgaacctaagaatcgtattccccaaactcagaaccaccgagtatcattttattagaaatctgattaagaagtttacaactaccttaattggttttacacaagatataaactactttaccttgtcacctgagatttccctaaacacacaagagcagatcacaagaacacactctttgatctctctagaattccaatcagactaaaccttagtctctaacaatgaaaagcgttgcactagctttttcactcacaatcacggccaagtctaacaagaactttagcacctctatttataccatcgaggtcttcggtcttctaggttagccttcaagatcttggatcactccaaatcttcgcgtgaatatcttctttccaaactgaactcctcctgttgtggtctccacgtcattcgttcatttggcggcatatccacgtcagcatcaattacttgatcttcactttagtcttctgaaacagcttccagcttgttccagcaatcaacactccttctgattgttctgacagagggtgcactaacatttttatctcccaaaattgtctacttctttgtaggctattattgatggtagaaatcagattttggtcagcgtctgggcttgccattgcctcctctagcttttgcctattctcttcagtggctttttgactattttgatgcttagtcctagttcaggtaatgatttcttgtataaatctactgacattttcctcaacatcctccatggcgtcaaagttccaagctgcttaaattaaaatagagacttcctcattgtctttcaatcttttatcgtacttaaaaactccttttttcttttcctcgaatacattaaagtgagtaagaagtggttgacggtctgagctttcaaaccttaaatactcccaacgactggatgggtaagccttagcccttgttccatttgacatagccctatatagtgtgcaatgaacaatgagctcatgtctctttcctctccaagagaagaagttgctcaagtgtctgagatcgtataagtcacattctgacatgaatgacctaatgttcacaaaagtaccttcatgtatgatttgtcctccttgtttttctgatgcatcaatgatgtcattaaaatctcttgttaagtgccaaggttcttctctattcccatgaataattaagatctcatgttttcaacaagtattactaaaactattatttttattcttcaaactcaaaaagtagagctatatagtgacaaaaaaactgttgcacgtaaatttatcgtcataaaaatgacttttaacataacacgtgaattacacattgtttaatgatacgttactaaaaaagataacgttattttttgaccaccgatttttaagtaataaatacatgaattgttacaagcaaaaaaatgttgagagcttattcaatttcatcatactagtgtgacatcattgctacatatattgaatatattgcacgtttttagttacacatataaacactcgtatgcataactacgtcaggtatcccgacaacaaaattcacctaatttgttttagttagcaaacctgatctaaaaactcaacattatgggtctttcaacttgagttaagtacacaaactctcccataccaagctgtgaagagatccaaaaaacaatatccaatgtctacatttatttttatttctattttaaagaaaatataatcgatttagcttcaataactctaaaatagaaaaaaaaagaaattactatatatagattactcttaaattttcaatcaaaatccaaaaaaaatatttctcaacataacacatcttactactttaaaaacctcacaaaatagttattatattattcttagtcaaattcataacctatattccctattttccggtcagtcatatgcttttgctaataaacttaaatatagatagatctgataaattcttttcggaaccaattattttcttcccttaatttattagttgttaccctttaaatgatcttaattctaaaaaacagaccaacaactttattagctacccttaaatgatctttagttttcaacaaactcatcaacaattttataaattcttaaacccaacatcatccacccaaacacaattattaaaaaaacaatctatatgtttataaacatataataaaataaaataaaaagacacaaaaagaacgttgaaaaaagaaagaaaaagacacaaaagaacgtttgaggaaaccaataaaaagaaaaatgggcctgagagactgaagaacaacccttttatcacgtatcgtgtctccagctgtatatatatttcccacacacactctttttcaaaaccccaccgacgatggcatttccgttattattctaacggtcacacgtcccttacgtgtccaccacttttttttattattattttaatcccatcactctttctctctctctccctatcttcttcttcttcttcttcttattccccacactctcttcttctctacttcaccatcattcacacacactcatg

SEQ ID NO: 12897 - DNA, 3000 bp, Unknown
  misc_feature (1)..( 3000): cDNA_ID_2709857_gDNA_ID_2214579_Annot_ID_135235 3000 nt of promoter + ATG
aaacatttcaacagtcggcggtatcaaaatcatatagaagaaaagtttaatgtattatcttaccaaaggccaaagagacgatagaaatctacgacaacggaaaacggtttagattacattactgaagaagagttttaaaaaaactacaccttcatagaagtactagacgaaagtatattgatcgagatatcaaaaacatcatccctctaaaaaaatcagacgcaattatcgaaaattaatggtattttagctgcgataacatctaccaagatttctcccataacttttttgatctctttgtttttaacttttttttgccaaaggatcatatgaatatgtttaacatatgttgtaaaacctaattttcatataaatgatatttacatgagtagaaaaagtaaagctaggccaaaggctaagtgtgactaacacaattatagattatgatagatcattggatgaaaaaaaaaaatagagtaaagccttgatggaaaaaatgagaagtgggaccgagtaaatgtcaactcaaactgaaacaaagagaatctctcaaaatattaattatagttgagagatgaataagtcgccgtcttcagacaacgcggagagatctttcttcacctttgttctcattatattattttctcttctaattattgatatctaaaaacgatgtgtttctagaagatcgacaaatttgtctatctatctataataatatatatattgcatttctaccaaactctctttctcatctttgttttttgaggtgtttgttgaaatgtaaatttctatgatttttcatttgttttcttagttttgaccaaactattttgttgactatgttgttgcttggagaagaagggaaagagaggagtgttaatcttctagaatcgtaatattttaagttgactctttctaaataatattatcgtttatcaaattatttgtagataggcatgatgacattagaattttagttgttgatctattgttatatatgtttagcttgttagtagttcatccccataaactaaagattgcaaaccttaaaccaaaaaagttcacaaaactcctgataatctcccaaagtctctatttggaagatagtcattgcatagttcgaaaaagtgaggaggactacaacaaaagatagtctctgcattcataggtttgaactatttctttattaaaaaaaaaaaaaaatagttagaagacaaaaagtaaaatataatgggaaaaacaaatcttataattcatggggtttccagaactttagttcataatatttcttagtatccaaagtttgattttaggtactccaatttaaagaataagtgaataatttcgtagatagtatatgtaatccaaaagatactatcactagaccattgttcctttggtaaaattggaaatagtttaaaacaagaagaatttcatagacaatatgtaattttaataacagtttgataggaaacaataattttcaattactatccatctatcctttttagaatcgagatacagtaaaccctcgataaactaataatattggaaccgtgaaattttattaatttatcgatgtattaatttatcaataaattaattatagatattttaggctaattttgtaattttaaatactttatgttttaaaaaaatacttatgtataattattatttttttagaactaattacaactaataaaaaaatattatgtatagaaaacaacaaaaaagattttgaatatagtaaaaatattaaaaatgaactttagaaataatgtaaactaaaaatatatagcagagtcgtatttcaccaaaattttcatttataatatattaaaaaatttatacaattattagtttatcgagtattaatttatagaggttttatgtatgctgtatatttaacgaatacatcttttaaatcatatatatgaaagcacgggattatgcggtttcatcaacacactcaaaacttttacctatgagtaaaaattaacaaacaatatacagtgcttaataagaaatatatagttttcatccttcataatacaaactctcctataaaataatatttgtagaaaagaataataatttttaaatatattaaaaaaaaaaaaaaaataacaaaatccggcgggtagcgcggacactcacctagtaaagcttaaaacttaaaggatattccatgggaattaatatgtgatggttatttaatttgattccatcaaatagttaacagaatttaagctgtatatttaatttcgtaaatgaaaatatgttattatttttttactgaaatcgtgtgattattaccaaaactagtagtcaattttgactggtacaaaccaccaccctatccagcttgtaactactaaaaatgatgaaaacaaaatagaagcacacatacaaaatagctttattattgtttcttttaaattcatactcaaactctcaaattcgaagaaaatactaaacaaaattattattttatcagaaacttctttttggcgtcattgcatcagaatcacatgtttatggtccattgacgtaaaaagataacacgttagagaaagagggcaaaagctgtcatcgtctacaattttggaagcaccccaccactgactaaaaaatcaactcgttaataattttcttagaaactactatcaacaaagaataaaataagcatgtgttataaaattagggtgatttatttcaatgtcaatataaagccaccccaatagaatgagtttttctttgtgttaaaggagtagcaatagtagtagtagtaggtgaatttgaattgaaattagtaatctataaagtcttcttcttcttctatctctcctcgtgaccattaaaaaccgagttattatatttataacataaaactttatattataaagtcttcttctcattttctttaaaaaccattccatctctcattgcaaaccaaacaagaagaagaaaagaaacacaaaatcaacaacaatg

SEQ ID NO: 12898 - DNA, 3000 bp, Unknown
  misc_feature (1)..( 3000): cDNA_ID_2712760_gDNA_ID_2214579_Annot_ID_186437 3000 nt of promoter + ATG
agaaacgaagggtgtactgtacaaaacttttttttcattttttttcgaagagtgccacttgttattgagatgctgacacttgctatattttcttggagatttttatttcatcttatctttttacaatcaattattacatacaaaagtttttttttaaaaatatatacttatataaaaatttatgacttctatatatacatttttgcagccattttaacaaataaatcctataactggacttatttacaacccaatgccattagcattaattttttttccaaaataattaattttactttaaattcttaatttaaattgtcaattacattatcaatcaaatttaatccaaacaaacttcacattaatcccttaaaattagcataaacgtatttgttagcaatattttaaaacaaagttttttgtttaaataaatattattcttactaaacgtttttttgtctaaataaataaaccctgtatttgaacttatttacaatgtcatgctattggcattaattatttagaaattaaaatatttaattaacgatttaaatcttctaaatctttgcttttagagttattatgtcattacctaaaaggcaaaaaatatatatatttttaaatattattatttatatatttaaactttataaaacattattaatatttaaacaaaaagtttaatatatcaaaaaatttaacatcattatataatatatagtttaaaaaatctcaaaaaaaaatccgtcatattttgtgattcaaaattttaaaaatgaacatatattaaccaattagcgaaaaatgtgtgggttcaacatcccgcatcgactaaaatatttagacaatgattcataaataagatcaacattaataaaataaatgttttttttgcaggatgggttttgcgggacgggtttggcaggacgttacttaataacagttgtaaactataaaataaaaatattttatagatagatacaatttacaaatttttatatatatactatctttaaaaaataaattgtccccgcggtgtaccgcgggttaaaatctagtttaaactctataaatggaggcttggttcaatttatttggacacataaaaaaatgtcatttctaccataattttcttattcttctgccataaattctatatattattctaccataatgtcatttttaattaatttaatttagttttaatagatattttaacttaatttgtttaacaactattattatgcatcacgaaatataagatataagaaaataagaataaaagaaatagtggggttgggtgttgaattttattaataaaaaacattggagtgataaaaaattaaagtaaggaagaaagaggaaatgatgtgaaatgttcaaaattgaggtggaggtgctgaatatgtttttgcattgtacatagttttaagcatttaactattgaattaatattttcaataagtcattgtagatagtcatagagaaaacaattaatcaatactatttttgaatgcccaccagcactctaaacttgcacattatcacaaataccaacggtcccaggaattttccaatcttcatcggtctatgtaaacatagatcatttattttggagaacacatttatattattttatttttagcttttcttggattatgtgatacatatggaaagcacaaaatgaaaaacttcacgaaaatatggatcgagatccaagggatattctcaaactagcgaaaaacaaagacaatgcttggacgttagcctgattggaggttgcaaatgaaattcaagcctcagtggcagttaagtcggttaatataaatctttcaggatatcattgtttcattgatgactcttggaaagatagtgacaagtttttgggcatgggatggttctgtattttaccaaatgaaggacatccaaccatgtgtgctggaagcactcgtctgggcaatgaaatgtatgattggccaagaaaagcgaaaagtaacgctttttataaactgtagatctgatgaagatgatgtattttccaacaaaatggccaacattcgctacatacttaaagacgattcaggaagatagtgatgagtttgatttttttgatttatctctaatgcttcgaaatgtaaatgttaaaacagaccactagatacggaatgttcggatataaccacatatgattatctttgtaaacaatactttttagcattgatttattatttgagttaatctaataaagttgtcggaaaaaacggaaaagtgagaagagaaaaagtcgaaaattcagaaacggtttaaagttaaccaggattccggtttttataacagaaccgatcggttttgtaattgagacgaaaacttctgatatcacttaaaaacttcacagaaacaacacctcgatctcatcgaagctcctctctcttacatatcatcacttcacatcaaccaaacctacttctgtctctctctctcgctctctatctctcacgctctcacaggtttttttctctctctgtctctctcttgttctccatttgcgtctctgtttgtttgatgagtttctgaatgttaaatgcagatgtgttttggttttctgtggaagtttttatatctctgttgattgagtttttctctgatgttgttgggctccaaaaaattcgaaacttgtattatctctcgtttaggtttcgtgttctctgcattgatctgcttctttaatttgttaactatactcacgtatgtgaaaaatctgaactttgtttgttaactctaatccaaatcattagaaaaatgcagattgagatttctctaatgcagtgcttgaaattttggaaactagggttcttgttataatgtttcaagtagtgaacttatgtcaacttgtgctttaggtttgatctgattcttaaattttgtttcatatgtggtctttcttacaatgtttctggatttgttgttttagtagaagaaaaaattagaaaggttgtgaga

SEQ ID NO: 12899 - DNA, 3000 bp, Unknown; identical to SEQ ID NO: 12897
  misc_feature (1)..( 3000): cDNA_ID_2709857_gDNA_ID_2214579_Annot_ID_186431 3000 nt of promoter + ATG

SEQ ID NO: 12900 - DNA, 3000 bp, Unknown; identical to SEQ ID NO: 12896
  misc_feature (1)..( 3000): cDNA_ID_2709885_gDNA_ID_2214579_Annot_ID_186429 3000 nt of promoter + ATG

SEQ ID NO: 12901 - DNA, 3000 bp, Unknown; identical to SEQ ID NO: 12895
  misc_feature (1)..( 3000): cDNA_ID_1808374_gDNA_ID_2214579_Annot_ID_186426 3000 nt of promoter + ATG

SEQ ID NO: 12902 - DNA, 3000 bp, Unknown; identical to SEQ ID NO: 12894
  misc_feature (1)..( 3000): cDNA_ID_2712782_gDNA_ID_2214579_Annot_ID_186420 3000 nt of promoter + ATG

SEQ ID NO: 12903 - DNA, 3000 bp, Unknown; identical to SEQ ID NO: 12893
  misc_feature (1)..( 3000): cDNA_ID_1027604_gDNA_ID_2214579_Annot_ID_186417 3000 nt of promoter + ATG

SEQ ID NO: 12904 - DNA, 3000 bp, Unknown
  misc_feature (1)..( 3000): cDNA_ID_2709865_gDNA_ID_2214579_Annot_ID_135239 3000 nt of promoter + ATG
cctccacctcaattttgaacatttcacatcatttcctctttcttccttactttaattttttatcactccaatgttttttattaataaaattcaacacccaaccccactatttcttttattcttattttcttatatcttatatttcgtgatgcataataatagttgttaaacaaattaagttaaaatatctattaaaactaaattaaattaattaaaaatgacattatggtagaataatatatagaatttatggcagaagaataagaaaattatggtagaaatgacatttttttatgtgtccaaataaattgaaccaagcctccatttatagagtttaaactagattttaacccgcggtacaccgcggggacaatttattttttaaagatagtatatatataaaaatttgtaaattgtatctatctataaaatatttttattttatagtttacaactgttattaagtaacgtcctgccaaacccgtcccgcaaaacccatcctgcaaaaaaaacatttattttattaatgttgatcttatttatgaatcattgtctaaatattttagtcgatgcgggatgttgaacccacacatttttcgctaattggttaatatatgttcatttttaaaattttgaatcacaaaatatgacggatttttttttgagattttttaaactatatattatataatgatgttaaattttttgatatattaaactttttgtttaaatattaataatgttttataaagtttaaatatataaataataatatttaaaaatatatatattttttgccttttaggtaatgacataataactctaaaagcaaagatttagaagatttaaatcgttaattaaatattttaatttctaaataattaatgccaatagcatgacattgtaaataagttcaaatacagggtttatttatttagacaaaaaaacgtttagtaagaataatatttatttaaacaaaaaactttgttttaaaatattgctaacaaatacgtttatgctaattttaagggattaatgtgaagtttgtttggattaaatttgattgataatgtaattgacaatttaaattaagaatttaaagtaaaattaattattttggaaaaaaaattaatgctaatggcattgggttgtaaataagtccagttataggatttatttgttaaaatggctgcaaaaatgtatatatagaagtcataaatttttatataagtatatatttttaaaaaaaaacttttgtatgtaataattgattgtaaaaagataagatgaaataaaaatctccaagaaaatatagcaagtgtcagcatctcaataacaagtggcactcttcgaaaaaaaatgaaaaaaaagttttgtacagtacacccttcgtttctgagtttgaagcacacctcccactcacttactaacaagtggcacatgtgggtccaaaatttataaacatgttgaattcacgtaagtttttttaattattcaacaggtgcaatgtggagattcaacagttgaataaataattcaacacgtgcactgtagatagtattatagaagaattaacaggcacacaaccagtaataacatgccaaataaaatgtctcaattttagcgggcattggactttccaagagtgggcttggagaggccgtaaaatttgggccaaaataacaaacttggttttcacctatcgtcatttgctccgtataatatcctgattcgatcgtatatttttcagacttcgtgaagtgccaatccaaaaaatcaggtttgttattttttcttatgggtagtgcaaatacaaaagggatatccttgggatcaagaatattctgaattaaatctatatttcaagtgtttgtctgatcatcaatcaaattcttgacaagaagatatgctaatgaatataaccattgtttatagctggcctcggggattaagctggtatccagggatcattccatactgaatttgatcatccagagcttattcgtttaataagccctttgttaaccagaggttgagcagatccattggatctggtttttgataatagctcccttcaaaaacctttgcaaataaggaatcatgaaccttaataaaccgccatatttatttcgctaataacccagtattatatcatccacatcctgaaaaccaatcccactattagattttctctcgcataacttcttccatgccatccattgcatttcttttgtttctccagttgagctcaaccaaagttttgctactacattcgtaagttttgacgttaccaactttggtaatctaaaataatacattacataagtaggcaacgcagcagctaccgatttaatcattacttctttaccccctctagataagaattttgccgaacgattaattctttcttgttagcgctctctcacaaaagaagatatcttagttttggagcctcctaggcttttcagtaatcctaaataagagcccatgccccctaaattagtgatctctagagttctcataagttcgtctttcagtgaatcttctttcttgtgtccgaattgaaccgatgattttgtaaaatttattcgttggccaaaacctcttcatacctttttaatattcctaaaacgacagcgcactgctcttttttgtcattctgtaaaagaaaaagctatcatccgagaataattagtgagagatctagagacttgcttgtgttactttcattcctgtaaaagttttttttctttttgctttccgaatattggcaacaaaaacttctgtacattataaataaataaggtgataacgatctctttgccttaagcctctttcagagactatcaaactttcgaggctgtccattagttagaatcttatatcgaaccgatgtgacactttacattatccaaaaaaaactatttatcgcaaaaaccaattttctttagtaaatgttcaataaaaagccactctattcgaccataagctttactcatg

SEQ ID NO: 12905 - DNA, 3000 bp, Unknown; identical to SEQ ID NO: 12898
  misc_feature (1)..( 3000): cDNA_ID_2712760_gDNA_ID_2214579_Annot_ID_135240 3000 nt of promoter + ATG

SEQ ID NO: 12906 - DNA, 3000 bp, Unknown
  misc_feature (1)..( 3000): cDNA_ID_2709925_gDNA_ID_2214580_Annot_ID_135245 3000 nt of promoter + ATG
gctctggggaagttagtgaaagtattcacacacaaagtcagagtctgggttcgaatcagggaagaaatgagcagtcatggaagcagagtcctagtttgtctaattctcaagtccaatctcaatatcaaggcaattggtacgggacaaactctgattatcagaatggtgtaggatcgtcttggcattcaggtaagactattgatcgcgaggtatatgacatgattatggaatttgatgaatattgcatacaagagaatgtaagagtggccttaacgactatggaaaaactggagaagaagggttatgttatggattttgttagactcttaaagttaacacagctatgtagggaaggaaatgtttattacgaagtcagtgttttagaagaagccaaggtttctgttctagcgaagatcagagctttagttaacaatttagaagcgaattatttgaagtattatactgacatcatgattgaggaatatgatgcattttgcaaacacggtaaagtgaaaaaagcgttgtatactatagatatattggcaagtatgaattatgttgtggatttgagtagacttttacggttagcgaagatttgtggggaagcagagggtttacaagaggccaagactgttcatgggaagattagtgcttccgttagccatttagatttgagttctaaccatgtattgttagaaatgtactcaaactgtgggttggcgaatgaagcagcgagtgtttttgagaaaatgtctgagaagaatttagagacttggtgcattataataagatgttttgcaaagaatggttttggggaagacgctattgatatgtttagtcgctttaaagaagaaggaaatatacctgatggtcaattatttagaggaatattctatgcttgtggtatgctaggtgatgttgatgagggactattacactttgagtcaatgtccagagactacggcattgccccttccattgaagactatgtaagcctcgttgagatgtatgcgttacccggatttttagatgaggctttggaatttgtggagagaatgccgatggagccaaatgttgatgtttgggaaacattgatgaatctttctcgagttcatgggaatttagaacttggagactactgtgctgaggttgttgaatttttagatcctacacggttgaacaaacaatctcgggaaggatttataccggttaaggcatcagatgttgagaaagagagtctaaagaaaaggtcaggaattcttcacggagtcaaaagtagtatgcaggaatttagggcaggggataccaatcttcctgagaatgatgaactgttccagctattgaggaatttaaagatgcatatggtggaagtgggctatgtcgctgaaacaagaatggctttgcatgatatagaccaagagagtaaagagacattacttcttggtcatagcgagagaatagcttttgctcgtgctgttctcaacagcgccccccgtaaacctttcactgtgatcaaaaaccttcgtgtgtgtgttgattgtcataacgcattgaagatcatgtcagatatagttggtagagaagtgatcacgcgagatataaagagattccaccaaatgaaaaacggggcttgcacctgtaaagattattggtgattaacgacaaaccttgaggtgtgttctatagtagtgtctacgttgagaatgttttggctcttcttttctcataaatcatcatattagttttatgaaactgatttatcttgtctctctaaatctgattctcagtctccgaaacacgttctcataatgtctgtgttgggaactttggcaggatggaaaaacataaagcaaagagtcacaaagacaaatttgtatcataagcagcaacttttcgaccacgtctctttttttccaggcatttataccgtggagctgccatattgttgtcatagatctatctcatttctcttgtccatttgatccagtttttgtttgtgtccaggttatgataaactataccctaaatgctattgtttttctgagtaatattatcaaatgtttgttggtttggatttgtgaggaagataggaataggatgatgtttggaacagtccaactaaggtcttactttgttcttctgatgcatcgtgtaaagtgttctaggcctgtgcatagaaacacttaaaaaaaagtagtgggtcaacttcaaaaagtcttttgagttatataaaccttcaaaaagtaggcatgaatgtgttgtcacacatgattgatgtactcaaacccaagttatttaattaatcgttattccaaattttttttttgtctagttttgaaatgtttaaaaataatgtatgtttaatatttttatgtaattattaaatttcaaaaagtaaaataattttaaaataatttattttttcttgagaatctctctagtctctatgcaaattttttttcaaaaaacataaactatcatctaacaattaaaaaaaaattagtgaaagcccatggactttctggagatgatcttaagactttttgatcacgcactgttaacttaagcctggtgtcaaatatttaatgtaatccaaataaatgaatttgctagcctcttgttacgccaagtttcatattacaaccctaattcccaaattctcttccgataaattgttcacaaatccctagaaaatccagagggaatcttcaaatcttacggtgatcaaacctgcttcaggcctgtacagtgtactaggtaaattcttatccaattgttcttcttttacacccttgatcgccacgaaagtatcttccatcgatattcgttgtgggtttattgatttaacgtttcctcagaactaattttggactagtcttgctcaaattttgactacagttttgtatttgctaattttgagtttattatgtatattgagattgtttctatctctcagattctaaaggtgtgatcttttttgcaggaataaagtaaactatc

SEQ ID NO: 12907 - DNA, 3000 bp, Unknown
  misc_feature (1)..( 3000): cDNA_ID_2709889_gDNA_ID_2214580_Annot_ID_135246 3000 nt of promoter + ATG
gttacttggtgctaaagcagaactcacggttcacaaagtttacctcagggctagacaatcttggcaagatgaaagatgggttatgattggaaaggtaagtttttttacttatttatttaatggtactgtgttttaaagtgatgtttgaacaatgatgctaatgtctaactgtcttataatcatctttcaggtatcttgttctgtgaagtcctccacgctgactggatcagatgaacaccagaatgtgaacccccttctgaactgtgtggccacaggagactagtgttgcttctttaagagtgttgaagagaccttcaccatgtgattgggcggagtctgctgaatcatgcactagaagtcctaagaagatacgatcattggaggaagaaggacaccagcaccggtttgcttcttcttcagcacagaaggtatataatgatagttctgaacgtaggggtgttgaattgtacgtgaaagcttcgtgtaacgagaataaaagtggtttccgtcaaatggtcagggtaagatcaaaaaggtttagtgaatgtgttggtacaggaaactcagtctctaatagttgttatgatactgatgcatcctcagttggtagttgtagccctattagttatgatgagagtgacaaaccaacttcttttctagatggtgccgactcttgtagtagtgatgctgaatcttcaaaagaagcatctggatgcagagatgaagctaggcgaaaacattcattatcaggtaatggatcagtggtgagatcatgtaggcctgaactttacacttaccgtagtacactgacgaagttatttgcttctggctccctaagttgggatcaggaagcatcactaactgatctccgactttctcttaatatatcaaatgatgaacatttgatggagctaagaaatctcaagtctgccggtacccacagttaattttgttagtatctattatatctttttgatccttgacagtcttatcttcaggtgttggccatacttccctgcaatgtggaatcaactgttgtatattgttctgttaccggaggattgttaaaatgattgtatagacagcagaagggaaataactctgactgaaaatttcaaatcctcattgtgatgttttcttcttatagtctaattttctttgttgtactttccggatgattaaacttaaacaaaagttacagtatctgtgttctaagatgagtcatgtcttttcttcatatatatactttagtttattgtgtttaagcttctggataagtcgagtcatttgtcttctcctcatcagtgatggattattgaacttaccttacatttttcaggaaaactgtagccatgttgggtgactgcagatcttgcttgcttctagagatcttactctgatgcatgaggttaactgaatggtgcaaaacacaatgccccttcttcctcaaaattcataatttaaattgtgctgtgttttctttttggctgtacataactgatctgtttcaggtgttcttggatatatataccctctttacacaggctgtgaactgttcctagccgaaggataatcatttacagtctgcaggttggataagtttgccgacgattggtaagtattaggttgaaagttctttatgaactgtgtctatctgagacagtattgaggttgtgtggaatacttttactctttcagcaaatgtgaccagtagattgtggaactgtccatgcttgtttgttggtggtatatgtacagttggcctggtcatcaaaatctacagaaaagtactcaatttttatgaaatcaaggctatgacatttcaagctgaattaccgaggtgcggggattcaaacgttagcataaatattatgatcggtgtgtatagacctctgcataaatcaaacgtgtctagctgctcgcttgtcaaatccaactttttccctatgtctcaagcttaaagaaattgaaaagactcagagaggaagaagaagccttgcgaattgcgatgttcttatgccatcactatcggttttatattcgcttatactctacactaagaaaaataatcgaattgaatatttctgattctttagaactcatgttaattcaaaattttatggttgttacaaaacttatgaacaacattatgatctgcattaacttataatgttttcaatgtgttctatgtaagattgacattatttggaaccacctgttttacttatattattttattcttgacttgaagttgatttgtggcttctacatgtcactagcttgagtttcaccagaacttcataaaatcaaattcctttgcaacttaaaagcatcagagaaaccaaacagaaaagcagtagcagaaaaagttacttgggttgcgttattgattttattcaaagccaacagacgcaaacatgtaactaacacagttaccaaaactgtcacaattaagctttccaagtaccagagtagattgattccaggaaatgattatctaaataccaatttgcgcataaaccaacctcctccttctttctcgatttaccaagcgtttttggattgtagtcctcctatttgaattttgccaattattgaacaacagaaacttgtatgatgtttttaagtattggtaatattagtatgtttgggggacaaacaaaagcctaattaaccaaaaaactatagttaatattcagttcccagagcaaaacggaaaaaaacatgccaatttgttaattttgaaagtttctatgagcactaaaagaccaatgaaccgaaatatacttgctatttttgtggctacaaaagcagaaaaaggagggaaaatagttacctgttggggcccacaacaaaaaagaaagaaacaaacgtaacagaaaaaaggatataaaaggaaattcgaaaccggcgaattcggagaaaaaaaaaaaaaaaccttgcgtgtttatccgcaagggattttgattttggaaaaagaaagagagagggatctgaagc

SEQ ID NO: 12908 - DNA, 3000 bp, Unknown
  misc_feature (1)..( 3000): cDNA_ID_1034119_gDNA_ID_2214580_Annot_ID_135247 3000 nt of promoter + ATG
aaatttcagatttcctttcttgctatttttcaaaatactatgtttacttctcatataaactgtaaatatatcccttttttaataagaaaaaaaatctctcacttcaaaaacaaaaaggaaaaaaaaaagcaaagagaaaaagtaaataatacgccgacgtttcgtgtttatgttaagcttcctttttcctttttcctttttctttttgccttttaaataaccgtcggactcatatttctcgcctccgccggcgaacagttttattatctctctctttctgcgtgttccaatttcttccacaaaaccctaattttctcttaaaccctgaaattcgtgtaacctttcaacaatctcttcaattttgttttcgattctgaatccattgtttacgaatctctcatctaaagctacattcttcgttaaatcgtttttaatcgactcgctcactcgtgagttgactcgtcagctgtttccataattgcttattgaatttttatacgatgatgtttcaatatggaagaaactagaggaatttctgatccagagaatgggagttcgagttacggcggtaaaccgccgaatccactctccttctcttcttcctccgccgctgctgccgtttacaggcaaaccttcgacggcgagcgatcgttggcgccgtgtaataagaggtcactggttcgacactcatctctcgtaagattcgtttctcttcaacttgatttgtggatcagttaggtttattttgtgtattgaatgatcaatttaagttgaggttttgtaattattgctctgcttttggatttgatcattattggtttcctaatgtgtataattaaggtagaaagtttctgtttttaatgtgtcattatgagatgtttgaggttttctgattgattttcattttggtaggtgaagacaatggtgtcagatatatctgttgagaatgagtttactatagagaagaacaagtctgagtttgttcctgctacgcgttctggagcttggtctgatattggctccaggtcaagcatggaagatgcttatctatgcgttgataatttcatggatagctttggccttctgaattctgaggctggtccaagtgccttctatggggtatgttctttcttcagttttcctgattttttgtagatttgtagcataagcaaacaactgtgaatgtagtgaaaatatggggatctcttattgaattttgtttgttattaggtatttgatggacatggtgggaagcatgccgctgagtttgcatgtcaccatataccgaggtacattgttgaagatcaagagtttcctagtgaaatcaataaggtgttatcttcagcatttcttcaaacagacactgccttcttagaggcgtgttcattggatgggagccttgcttcaggaactactgctttggcagctattctttttggaaggtttgttgattcaactcttattatcttttagttttgtctaacctaaactcttacatcttggttatgttaaagaaaaacgtgtttgggaatagatgcttatcctcaactgcgtagtgtgcataatcttgacctttaacacaatcatgtacaactaattcgcctgtagatgtattctctgcccatatgtgctgctgctataatgtagttattgtctcatatggtctttgagtcacgtatatacttgctcatttcatactctattagtattctggtatgaaaccgtttggtaccgtgttaacatatagttttgtggtaacaggtcgttggtggtagcaaacgctggagattgcagagcagtcttatcccgtcagggaaaagccattgaaatgtcaagagaccacaaacccatgagcagtaaggaaaggagacgcattgaagcatcgggtggacatgtattcgatggctatctaaatggacaacttaatgtggctcgagcgctaggtgactttcatatggaaggcatgaagaagaagaaagatggttctgattgtggacctctaattgcagagcctgagctcatgacaacaaaactaacagaagaggatgagttccttataattgggtgtgacggggtttgggatgtgttcatgagccagaatgctgtagattttgccagaaggagactacaggagcacaatgacccggtcatgtgtagtaaggagctggttgaggaagctttgaagaggaagagtgctgataatgtgacggcagtggttgtgtgtcttcagccacagccaccaccgaacttggtagcgccgaggttgagagttcacagaagcttctcggcggagggtttaaaagatttacagagctacttggatggcttgggaaactaattgggggacatgaggatggtgacgaatgattgatttctctgtttttgttttgtcttttcttacaattttatagtttggggtttggaggttttgttctgttaaattctcgcaatttgagtaagttataacatgaggcggcatacaataatttattgtttggtaggatatatttttttgtcacttttgcataataataattctgcttcagtctcatttgttttgtaactagaaagttattccaattcctgcgtttaccgaatatgttgtgttcttgcagaatgacgtatgttagatatgcagtaaactcgagggtcggctttgaccacatcgccacttatcggtttgcggatgctggaaaagtcagtctagtgatgaggctgagtgagccatcgtcagttactattttatcgtgaaactctgaacaacgagattgtcccggatattcaaatgaggaacaaggcccaatagtccgatcaaagtgggctattcgtatcgcttacgaggcctatacgatggtaattgaattcacgcgcattcatcagcgcgtgatttggagttgctcaatttcagatcgcacaggctctgttaatcatctcctcctccgaaagacagagaaagagacaaatcaaattcattcatatcaaagagatagagagaaaatg

SEQ ID NO: 12909 - DNA, 3000 bp, Unknown
  misc_feature (1)..( 3000): cDNA_ID_2709921_gDNA_ID_2214580_Annot_ID_135248 3000 nt of promoter + ATG
atcttaactagttatcgtctttatgatttatgtctcgagagagttatttgaaatatctaagaaatttacaaaaaaaaatgttttctgtaagtttcaaactagttttagaaaatcgtgagtgtggatttgcataagatgatcaagctgtgtccattttcttgttaacgtaggtctcttattgcaaaaccaattttttcttcttcttctcttcatgctacgagtcttttctctctcgctaaggctaatctccctttattctctcaccattcttgtaaaagcaaagaacatgagcatcaagaaattaaattattgaaggtccgacatggaagtgaaatttgtagagttgtagttaaactttgaaatacgaggccgaaatcaaactaatcgttggagtgacatagagttgggcttcactttggatcgataataggccaactcatttcagtaggaagtacttggagtgtttttcttttgtactacacgcatgtactacttttctttcatttcacatccaatagagtactactttaacacacaaagctgaaaactcccaaaatttggtaggatacaagattacaaaacaaagaaaaaaaggacggaccaaaactaatcgtgcacataaagatctcaatgaatttaatgagttaattatttttatacggttcgatttaaaccaaaaatcaaaaatggcatcctcaaagaaaattttgcatgaattaaagaccagtttggttcaatgttttgtcatcagtaactacacaaacaaatacttaaaatttaatatatctacaatagtttttgtgtgtattatttgtttctaattgactttttttacacctgcctaacaatctcccttacacgtaatgaacttccaatttacacggagaaacaaccacccctgttgacacgtgtcatcaccacaccgaccggcggtgcatcacccttagctaatccggctaactccaaacgtcgatgagcagacggacgaggaagattctccggtacgatggtctctagcgagttctcaagccaaggcggacacgtcctcttgtcactccacctccgcggcggcaccacacccgcagccatctcttctaccggcgatttcacaaccgcagcttccactgatgcaacatcattgatctgaatcccgccgattacgacagttgccgccacccccaagacaaaagaacacttgtttttccgtggctctgtctcattttctgttctcctactaaacaataaaagaacaaagatcattgatatgaaaaattatcaggtaaataataacttttcatgaatagaagagataccaagagatctttgacgttgtcttgagcagtgaagctaatgattgtgcagaatttgaatctaggggaggaagatttagacagcagcttattctccctgccattgttattcctctgttttcgtttccttctttttcttaagaatccacctagaacaaattttattttattcctttcacctccaacatatatataactactaacccattcttacttgggtcactcattttttcttactatatatgtatcctcaaattattacatttcatatgcgcatgcaatacaaaccacatctaaatttttcttccaatatgttctttctctatacttaactaaagcccaaagaatgaacttaacctagaaaagatggacttgacccaatagcattggtccgttggagatgttaggtccatactccatacaaagacaaattgaacaaaagtcgtgaatctgtttgctacgtctgaataacaacgtacacgtatcacgccttgcgaacaaattatttgacaatgatggccaattagcatgtgtcatcacttgttaccacgtcaacaaggttcttgtcggtccgtttaattaatagtaaccatcgttttcaggaaaaaaatccacataaaaagtttctaatggcgaaacaatattcaaatatttcctaacaactaccatgagactgattctttttctcttccgaaaaattaatgagactgagtcctaatttttcttatagttaatttggtgaccatcaaagaatgtaaaagtatttaggaaacagcacaaataatctggcaattacggtctacaacatgtttatttacttatttttaaattatagaaaaatttaatattttaatatcttatatttaatgccctaaataacactaaatcacacatataaatagcagagatataaatatagaaaaacattccaagcatttttcagtacttaacatttatacagaaaaacaattaaacatttttcagcacttaataattaacatatgtgagaaattcataaactctattaaatattcatgaaaataatgtatttttaattttataagtaatatctcatgtgtcgactttttttatataaaaaagatgtaaaaaaggtcccaagttactaaaattcaattttgtcaacttaactcaaaatctttttgctattagtctaaaatttcagatttcctttcttgctatttttcaaaatactatgtttacttctcatataaactgtaaatatatcccttttttaataagaaaaaaaatctctcacttcaaaaacaaaaaggaaaaaaaaaagcaaagagaaaaagtaaataatacgccgacgtttcgtgtttatgttaagcttcctttttcctttttcctttttctttttgccttttaaataaccgtcggactcatatttctcgcctccgccggcgaacagttttattatctctctctttctgcgtgttccaatttcttccacaaaaccctaattttctcttaaaccctgaaattcgtgtaacctttcaacaatctcttcaattttgttttcgattctgaatccattgtttacgaatctctcatctaaagctacattcttcgttaaatcgtttttaatcgactcgctcactcgtgagttgactcgtcagctgtttccataattgcttattgaatttttatacgatgatgtttcaatatg

SEQ ID NO: 12910 - DNA, 3000 bp, Unknown
  misc_feature (1)..( 3000): cDNA_ID_2709917_gDNA_ID_2214580_Annot_ID_135250 3000 nt of promoter + ATG
ttataatggatttaacaaaaaaaagaatagtttataatggagtcttgagagagttatttgaattattttgggaatttacaaaattgttggataaaaaaagtagttacaagaaaaaggaaaatatttacaagtgtgtttctaattttttcctactagaaagacaactagataagatcatttcaatagtcttctattcactaattatggacaagtaaaaattaaaagatttgttacaccatctctatcttacatttctctatttatagattcacatacccaatgtaaaaacaaatctcttgcctatataactctagacataattcattatattacaacaaacaaagattcaataatcaaaagaaaaatttagaatgacaagtaaatatttctccgtactagtgttcatcatcttggcttccaatgaagttgttgccaagagacactcttcaacacctaaattaagaaaaactgatttcccagaagatttcattttcggagctgcaacctctgcgtaccaagttgaaggagctgctcaggaagatggtagaggacctagtatatgggatacgttttctgaaaaatacccagaaaagataaaagatggtagcaacggatctattgcagatgactcttaccatctttacaaggaggatgtgggtttattgcatcaaattgggttcaatgcctatagattctccatctcgtggtcgcgtattttgcctcgtgggaatcttaaaggaggaatcaaccaagctggtattgactattacaacaacttgatcaatgagcttttgtctaaaggaattaagcctttcgcaaccattttccattgggacacaccacaagaccttgaagatgcttacggaggattccgtggggcagaaattgttaatgattttcgcgactatgccgatatttgtttcaagagctttggagatcgagtgaaacattggattacattgaacgagccattaacagtggtgcaacaaggatatgttgcaggtgttatggctccaggaaggtgttcaaaatttacaaaccctaactgcaccgccgggaatggagccaccgagccttatatcgttggtcacaaccttatcctagctcacggagaagcaatcaaagtctatagaaaaaagtataaggcttctcaaaaaggtcaagtcggtatagctttgaatgcaggttggaacttaccttatacagaatcagctgaggataggttagccgcggcacgagccatggctttcacattcgactatttcatggagccgctcgtgaccggtaaatacccggttgacatggttaacaacgtaaaaggcggtcgcttgcctacatttacttcaaaacaatctaacatgcttaagggatcatatgatttcattggcatcaattattactcgtcttcttatgcaaaagatgttccttgctcaagcgaaaacgttacaatgttctctgatccttgtgctagcgtcacaggcgaaagagatggagttcccattggtccaaaagctgcatcagattgacttttgatatatccaaagggaattcgtgatcttatcctctatgcaaaatacaagttcaaagaccctgtcatgtacataacagaaaatgggagagatgaagctagcactggtaaaatcttacttaaagatggcgatagaatcgattactacgctcgacatctcaagatggttcaagacgctatcttgattggagcaaacgttaagggcttttttgcatggtcgttgctagataactttgaatgggcatcggggtacacggtcaggtttggacttgtttacgtggatttcaacgatagacgtaagagatatcttaagaaatcggctcactggttcagacatttattgaatggaaaaaaggagaattgatgagatatgcaacattccaatatattaactaactagattaatacatgcacaatggtttgtttggaaaacaactattgttaatatacaaataaggtttgattttactgtattatatcaaacttaaatctcaaaaatagtggtttcaatgtaaaacttgtgcacactaaattaaatggaatagtatgcatttaaataaaaaaatcaagaattttcattcttatttcggccttctaaaattaattaattagttaaattagtttgtgattttattttgttgtggttgtcactagtggtaaattattaataatttaaaaatctaatattttcaataaaaattaatgatctatttttaatattaaataaaaatagttaaaattatagaaatttagttcatattgatatctctctaattcatttggaaaaatatttttagcacagacaacagtttatgcctgcatcattacaacaattttttttactattttctcataattttttaatactatttgagttataattgaaaagctaattacggttaaggagcagctatagataacgaattaatagattagagaggttaattatagagtcgtcacatctctctcacatgcctctctaagttccctttagggttttcttcttcactatagagactcatgctcttctcttcccaatcgccgcctctgatctctcttcctcgcttctcagattaggtattagacattcactctttcttacattgttataacattgatgaagtagaagcttagattcatatcattgccattggtcacgattaatcatctctttcactaaatcatcaattgtttcaatgagaaccaataacagctgaatcaatgtcgatacatttgttgttacgaaatcttttgaatcttcactgaatccgctttgtcatttttcttttgcagcctttgttttgttagattgatttgttatgtccaacaatctattgcctcagccttgtatgcaaatgggtcaattcattaatgtccctactcccactcctgagctgatttctaatccggaaatgagattgtcacaaccaatctgtagtcatatctctggtgggagacaagattttcatgta

SEQ ID NO: 12911 - DNA, 3000 bp, Unknown
  misc_feature (1)..( 3000): cDNA_ID_2709909_gDNA_ID_2214580_Annot_ID_135252 3000 nt of promoter + ATG
atgactattatgcaaccactgctcctcctcagtctggttggagtacttctctgccttcccatactgattccaaagacgttcatgttgaggtcagaagtctaaacattttatgattttgttgcgattcctaaattggttgagaatggatatgatggttctgtgtctattggttaacgattctctttgtgactgggaattctgagagctggtttctgttctaatgttaatttatcttatgcttatggctctagttagttattacaaaaattgtttgtgtgtggtgtctattgtctgagagaagaggatttgttattgttgctcatgttgctttatccttcctgaatatttttcatttgtgtgttacctatgttgtggtagcacatggttgtgtaggttgacttgtgtaagcgttagttcttgtccagattgcgtgtgattatcttggttgctgatgggattatcttggtgtgattgtcaggaaagtgaaagtgaggaagatattcttgatgaaggtgatgatgatgtggaggaagagcaggaacaggaaacagaggtacaggttcatccagagcctgaggtgaagaaagctcctgaagttcctgcacctcctaaagaggcagagaggcaactttccaagaaagagaggaaaaagaaggaacttgctgagcttgaagctttgttggctgattttggagttgcccccaaggagaacaatggcctagaggaatctcaaggtacacttgtcttcaatcaattttgacatctgtaataatacttatcacgtattggcacagccattgcaactgatattgcttagttccagacagttgtgctctttaatagtattaatgttttgtgtagtgtcactatcttgctgagaaaatcagcatgtttgatatgtctagcagttttgctaattccgatacattgcatgttctttttacagaggctggacaagaaaagaaagaagatgtcaatggagagggagagaagaaggagaatgcagcaggtggggagtcaaaggcatcaaaaaagaagaaaaagaaggataagcagaaggaggtaaaagaatctcaagagcaacaagcaaacaacaatgccgatgctgtagatgaagctgctgggtctgaaccaactgaggaagaatctccaattgacgtcaaggaaaggataaagaagcttgcatccatgaagaagaagaagtcaggcaaagaggtggatgctgcagctaaagctgctgcggaggaggcagctgcaagacgtaagaagctggccgcggcaaagaagaaggagaagaatcactataaccaacagcctgtgcggtaaaatcctgaatcaccaccattttgatcttgatggaaatgcaaatatgaacatgtatttcgccgtatattgttcatatgagtctctgtcctaataaatcttttgaagggtctggttcttagagttaaagacattgaatcctttttctagtcttattacaatgaacaggctaaagacaaaactactctctggagattttcatttctttttgaaacacctttgttttcttaatatcagaccttttttaggttcattatgtcttcaatcagcttcttatgtatggttcgatggtgttattttcttctttttttcgttcagttgcctgtgttttgattcatgccttgtcacaaaatcttttttggttatatgttccaaagtgattccccacttgagggtaatgtatttttatttttgcaatcacgaataataacattaacctgtatttagtctactatgcctagttcatcaatcaatatttagactccacctgaaccacaaccgcacttgattgtgcttcgttaaccacacttaaacgtgcttgactcgacctaaaagtctcgatttgaacccctaaattaagttcctttgctaattcagtcggcccaagtgctttctttaactatcataactctgaaccattctcaatgttagttcatgaatgcatgcatgatcatatccattattgtgccattattaccatcccatttcccttgatcagaaaatctctttatcattgatcacagttgagttgtgtaatccacgcacatggtgatatggatcaagttattgaatttcctttctcatgcggttaagaagcatgttaatcagttgttactcttttttgatgtttatattttcttcttgttcagaagcataccgttttgcccaaaaatatgtgtttgtcaactatgaacacaaaaatatatcttgtctagattggtcaaatatgttcgtctgtaatctttaatttgttatcaacatgcaaatcaaatcagctgtatgtattaatatcgtcttgaatatgtactatacactgaataatttacttaactatgtataaaatatgacacatttttgatatgtacatatctagtcgaatttttgtaatgatatttactataggataaataaagtattacctaaataaggatttgatgttcatattgtgaatttttgaaattgataaaaatttggaaaggtcaatgtcctcatggttggaccggattaatctggtaatcggaaagatatttcggttctctttgagaatcgggtttagagttattggtacggcgttatcaaattcgtgagtggtttattgcggttgaaccgaaccacattaataagttgtaacaattcacaagttttagacgcagcttgcttctttcttcttcttcctttccctatcctctgcatacacgaactcgtaagcttcttcgattctcttcttaaaccactgataatctctttctgatcccattctagaaaaacttgacctagattaatcagaattgattcgagttggttgctgtaatatagaagaaacttttgtttccccacacattcagaaccaattcaatctatgttaagattctcagaagtgggttgtcttaaagtctgaagctttagggggctaagagtcagacttcttggtccccagcagatgagcacgtgataatg

SEQ ID NO: 12912 - DNA, 1440 bp, Unknown
  misc_feature (1)..( 1440): cDNA_ID_3026995_gDNA_ID_2214580_Annot_ID_186471 3000 nt of promoter + ATG
tgatggaatttgagctttgatgattcaccaatcatcaaagtaccgtgggacttaccgaagtgatatcatcttcagtacttggacttacattagagcctattgatgcacgtcttctccatgaagatgactgtggaaatgagcctccaaagtttaggttcgtattgataacatcacataataacgtaagtagaagaattcgcataaaaaaaagtagaagaataaaaaaattcgcatactgaaattcgtaaaataaaaaatcgcattataaattcagcaattatatactcatttattttgtgttttgatgtttcggtaaacattatgcatattttcttaattggtaaaacttttgcatattcgcataatctatcaacaatggtttttcgattcaacatcctccacatcatcttctctttcttccacatcatttcctctctcttccacataataattcaatacccactcaaattttatactctacaatggtttgtttaataaaattcaacaccctaccccacaaatttttttttcattatttttcttttcttttatgttttaaatggataattaatagaattttgggtgttaaatgagttattgttgggatgttttcttttatgttttatcggctaatggattttttttagtgaaaatagatgtaattttttctgtgtccaaataaaatgaaacaagtctctatttataaagtttggaaaatgatgaattttagtataaaaataatttaaaacaaataaatattttataagataattgatctccaataattcagaggaaaataaaatataagaaatttcagtagcaaataaaagaacaacacatgtcctatctttatttaactctcccccacaatttctgtctccaattatttaatgacaagtggcaatgaaggatccatttttaaagattcaacattgttgaatagattcaacactatttaatccacataggattcatttctttattcaataccccattgtaatcattcaactattgaataaattttttcaataagccattgtagatagtctaagaaaacattattccgccattatacatgtaaacctactggaaccttaattgcttttgttttttttttttgtctaaaatcttaattgtttttcacactttttttgtcagcaaagacaaaaaataaaataaaaagcaaaaccattggttaacaagtcagaaccgaaacgaatttaatcaatcgggttaacccatttgcttccctgtcccagccttaatggtctgctctgctcgtctcagctaagttgacgattccagaccaaaaattcttcacaaaaaatatctgaaaaatccagccaagatatttcagattgtacggaaaatttcagagcaaataattttcagattaatcggtatgtattagctcagtgatcggaatttgtgacggcgatg

SEQ ID NO: 12913 - DNA, 3000 bp, Unknown
  misc_feature (1)..( 3000): cDNA_ID_2990777_gDNA_ID_2214580_Annot_ID_186462 3000 nt of promoter + ATG
ggaaaaagttatgtatggagaaattgcagcagagcgattgtgttccatgtcagcagaggaacttgcttcaaaggaactagctgagtggcgacaagcaaaagcagaagagatggctcagatggttgttctgcaggacactgaggtggatatcagaagcctagtaaggaaaacacacaaaggagagttccaagtggaagttgaaccaatggatagtggttctgtagaggtctctgttggaatgagttcgattaactggtctcgaacaaagaattttaagaagaaaaccccttccatcacgaaaactcttggagtcaagaatgaattgaacagctctaatgagagcactgggccaataaacggagtcacaatagatgatgagatgcaggctgccactggatctcttcctccaattgtctctcttgatgaattcatgtcatccatagattctgaatctccgtctggctttttgtcttcagatactgagaaaaaaccttctgtttcagataataatgatgtagaggaggttttagtttcatcacccaaagaaagtgctaatattgatctttgtacatcaccagttaaggctgaggcattgtcaccacttacggctaaggcatcatcacctgttaacgctgaggatgctgacatagtatcgtcaaagcctagttctgatttgaaatccaaaactacatctgttttcatacctgatggtgaacgtttatgggaaggtgtgctccagctgagtccttctactgtgagctctgtcatcggcattctaagaaggtttgtaataaattgtttcatgagtggtagcaaacctatctcagtattttttttttattccacatttccaaatttaggtttgcatatatgaatagctttctttatttagtctacatgttactacttatctatactattctagtgcttatcagctctataaaatgtttttttaatgaatatggcttcgctgttattgataccatgtttaccaacctgatttttacgcttcacagtggcgaaaagactactacaaaagagtggcctattttgctcgagattaagggtagagtcagattagatgcatttgagaagtttgttcgagagctcccaaattccaggagtcgtgctgtaatggtatttgtctacacgtttacctctatcattaatgtacatgttttatatacgcattctgtgtttgagcccctgcaaaagctattaactgtgacgtttaaccaagcttaagtagaagcatttaggaaagaagaggagagattaacggccaatactgatttgtgaatgattgagaaaaatacattacatctgtgaatcacaatggagatagatggacttacaaaaatattttcaccagaacaattgcatagcttatgtttcttgaataggcctccatattccaataaaactaagacctgtttgttctcgattctatatgtatgtgatgaactcgtttatccatcatggtacttctgaaaccttgctttcgtgttacaggttatgtgtttcgtctgcaaagaagagtgctcaaagacagaacaagagaacatttccgaggtatgagcgttggtagttaaccaagattctgtgtatccaaataaacgaaaagatgattaaaaaaacttgagatttatttgaatattaatgatttatttgatcaaaactgaacgcgaatctgtacaaactgaaaacccaaaccgaatttaaattgaaacactcctaaatatctgtagaatgtctaacttggtaacgaaatttgggcatttggttttgttactatacaggtggtggattcatacgctaaagatgggagggtgggttatgcagaaccagcttcaggagttgagctatacctatgcccaacccgtgggagaactgtcgagattctaaacaagattgttccgagaaaccaactcgatttcttgaaatctataaatgatgatggtcttataggtgttgttgtatggagaagacacacaatttaaaaaatcaccactatctaacaactctcacaagaaccaccgtgaaaagggttcttcgttaaccacatataatacttctcgttacagtaacatgctacaggtcaacaatgacgatggtgatgatgtgccaccggggtttggcccaatgaccatggctcgggatgaagatgatgacttgcctgaatttaactatttttccagtggggatgttgtcgtgaaccggacaagccggtctgtatctgtaagagagcttattcaaaaatatggaaaatctgaacctttgaggaaccaaagttataatgataatgacaatgatatactaccagagtggcagcctcaatctaactggactcttggggttactcatgtaaatggtggctcgatggttagaccatgtagtgagtggtggtctcatcaggatggcagaggaggatattaattgttttttgtttcaccttagcaattttgtgtttgttatgcattttctgttgcaggcaacactgctttccaaattttgtgattttctctcaacagtcaccgatatttggcactttattagtaagatgggcttgcgcagcccgctaatatattgctcctttctgtaacaaaaagtacaaaagtaacaaaatccactcctatcgattatactataaaacagaagtgcagagaaaatttcagtcatgatattttttgaccagctcgattcagaaatttggaaagactagcttttttttctctcgggtttcactttttaaaggtcgtgaaaatttgggaatcactgatcaattttgttaatatgatttcctgatttagggtttctctgcatgcctctagaatcagcaagtgtaaagcaattaccatggtgactccgaagcagatcgatttctcttcctgtggtggtggtgataactccgacgataccctctcccatcgagaatctccacggaatccttcctcaaagcgtgctgctgcttccttcgcagcagaagcaggcgaagagact

SEQ ID NO: 12914 - DNA, 3000 bp, Unknown; identical to SEQ ID NO: 12909
  misc_feature (1)..( 3000): cDNA_ID_2709921_gDNA_ID_2214580_Annot_ID_186458 3000 nt of promoter + ATG

SEQ ID NO: 12915 - DNA, 3000 bp, Unknown; identical to SEQ ID NO: 12908
  misc_feature (1)..( 3000): cDNA_ID_1034119_gDNA_ID_2214580_Annot_ID_186457 3000 nt of promoter + ATG

SEQ ID NO: 12916 - DNA, 3000 bp, Unknown
  misc_feature (1)..( 3000): cDNA_ID_3027021_gDNA_ID_2214580_Annot_ID_186456 3000 nt of promoter + ATG
ttgttgcaattggagaaccaaaacatatttgataatgtttttgtgtatgtgtttctttacaggtagttagtgaagcacagagaggacatgtttttggtgaagttggggtactatgttacagaccgcagctgtttactgttcgtaccaagcgattgagtcagttgcttcgtctgaaccgtacagtactcttaaatcttgttcaggcaaatgtaggagatggagcaataatcatgaataatcttcttcaggtttgtaataactctgaatagtacagtttgtttcaacctgttgacacacaggaccagttccataacagatatgttgtggttcatgcagcatttaaaagactcagaagatccagtgatgaaaggcgttttggctgatacagaacacatgttggctcaagggaaaatggatttacctctcagcttgtgctttgctgcagccagaggagatgatttattgctgcatcagttactaagacgaggctcaagccctaatgaaatggataaggacgggcgaactgcgctggtaagcccggatttcctttgtatataccatcatcctccttttaatgcctaaaccaaatttgctcactctctatgtttcttctttgaatatctcagcatatagcagcatcaaagggaagccattattgcgtcgttttacttctcgaacatggagcagatcctaacattagaggtaagtagtaaaaaataatgtttcactaggtcaattagcttaggatgataggatcatgtagtactaaattatcggtggctcgtacattgtttacagattccgaaggcaatgtacccttgtgggaagcaatcataggaagacatagagaaattgctaaactccttgcagagaatggagcaaagctaagcttagactcagtgagctatttctctggcttagccgtggagaaaaactgcttagacgcactcaaagacatcatcaaatatggcggcgacgtcacactccctgatggaaacggaaccacagctttacacagagcagtgtcagaaggacacttggagattgtgaagttcttactagaccaaggtgctgacttggactggccggattcttacggatggactcctcgtggtcttgccgatcatcaagggaatgaagaaatcaaaaccttgtttcataatcacaggcctgtggagaaaaaaccgaaacctatccctggaatacctcagagtcctgtgacagggaagccattaatgaagtatagcagtgagcctacaatgcattcaggagaactcgtcttagacgggggtcaggttgttgtttctcagaaacggaaactcaataacttcagaaactcgctcttcggaatcatttcagctgcaaatagcggtaaaaccacctcacctctccatctgctctctagatactcgttgctttcttgtcacgtaaccataattttcagaacttttcacatcacaatagtcattcttatatacaattcacaacgttcattacattgttctgttccttacaaatttacaaatttggttttcatttctggtttttttccagctgatgatggaggagaagttccaagaagtccagcggttcctggaggaggaggtagtatgatttatccggagagagtgacgataagttcgccggaaaacggtgaaactggtggaaaagttgttttgttaccaaattctatggaagagctattgaaaattggtgaaaataagatgggattcgtcccaactaaagtacttacgagagaaggagctgaaattgacgacatcactcttatcagagatggcgattttctccttctatcaagggatccttgattcacacgcaactctctttcgattttgagtaatgaaaactatttgtcttaacgcaaactcgcaaaccaccacagtcaagctttatggtggtgatatgatgctaatattaggggaaaccgtaagccccaatcaactccgggattgaaatatcttttaggttttttttttttgcttttgtgtatatattcactgcttactatttttcacatgtatatatatatatatcctgttgactattttctgttaaaagaactctctaacaacctcatgatattaacatcgaaatctacaagaagtatggaaacaatcttgtttttttcagaaagcatacaaggataaaggtcctttcttaaacgtctagacaatcttcttctctaagtctctaagaagaagcaagtgttaaaatttataacttttgtgcgaggtcgagatttgagagtaactcctcactcatcttttccaatcaagcttaaatcctctctaggtgacttatcctatttctgagatgaattatcatctcatctttcatttttgtttagatccatgatggtaaagtgatattgatgggacttgggagccaaagcattaccgaaaatgagcacaatgattgagatagagttagagacaacacacactataatattattattatttcatgcttcaaatgcaagaaggtaatatttgaatcagactctagagagcttaatctgctcccatctctctgaccaatacgaaacatccgcaatctgctcaatcaacctaaagaggtgaagttgtattttatgtctagttgaattaaaacccttgtcaaattagacaatggtttaaggttgatgagaatttgatgttggaaaaaaaaagtgatataaaagataaaagcggttcaaaacggttttgcgattgatgttaaaagagtgcgaccggttgtgggagaaccggtcaactcctagtcctagaggctagagagtgttgtgttgtgtgatttgtggtgcagataatatcttaaccggcttcaaattttaaaatctagctcggttagcattttaaaactgttttctggtttgattccgtgtctatctctcggctccgttgtatcggaaggtagatattaaaactgaaagaccactgccgtcgagagcaactcaaaagatcatcagaaccgattcgaacg

SEQ ID NO: 12917 - DNA, 3000 bp, Unknown; identical to SEQ ID NO: 12907
  misc_feature (1)..( 3000): cDNA_ID_2709889_gDNA_ID_2214580_Annot_ID_186455 3000 nt of promoter + ATG

SEQ ID NO: 12918 - DNA, 3000 bp, Unknown; identical to SEQ ID NO: 12906
  misc_feature (1)..( 3000): cDNA_ID_3027024_gDNA_ID_2214580_Annot_ID_186454 3000 nt of promoter + ATG

SEQ ID NO: 12919 - DNA, 1440 bp, Unknown; identical to SEQ ID NO: 12912
  misc_feature (1)..( 1440): cDNA_ID_2709897_gDNA_ID_2214580_Annot_ID_135259 3000 nt of promoter + ATG

SEQ ID NO: 12920 - DNA, 1690 bp, Unknown
  misc_feature (1)..( 1690): cDNA_ID_2712823_gDNA_ID_2214581_Annot_ID_135260 3000 nt of promoter + ATG
aagctttggagatcgaagagatgatctgcaccactcacgaaaatggtatgcgatgcacctttcgaaacttggtaagagtcatccgacttgacacctctttcgacgaagcatgggagaaatttccaattaaaagactcttcatggaaagctacatctctaaagaacgagtgcgagaaacgtttgaaaggacgagaagatcaatcttcaagaagaagagagacaacctgaagaaacctccggacgaatctgtatccaagagagctcgcctagggcgaagaaactcgtgttactacacctagtaagacccaaacgtcgagccaacgacgttaaataagcgcactaagtgggaggcaacccactagatagctacattttcccttagaattttattttgcttttgcttttgaccttttaagtatttgtttcagatttttataaaaaaacatataaaaaaaatagaaaaatagaagtagaaaacccaaaaaagaagagaaggttgtgacaaccggcccagctacttgcccgagtaactggcaccgccaggagaagttgtcccggccgcaacaaaccttggctggagcccgccaatgcgcgccaacctttggctgaagtccgccagaccgtgccaaccattgaccaaagtctgcctgaccatttcaaacattggccggagccagccaatccgcgccgaccattggccgtagtccgccggactttgccacaccttcgccggacttgccccaccttgcggcctaggcaacaccttgcttgccggtccggacgaacgcaaactcagccggccaagtggaagatgagccaattacagaagagagccccctcggaaaaaactaagtctggggaaccgaaagtaagaaagaagtaaaggagaagaaggtgtttaaaagaagaagtggttggaaattgtggacctcaaccgatctgttctctcttgcggttttgcaacatatcctgcattcgagactatacggtaaccctaaacactttaactccaccacttaaacacgaaaaatccctttcataccaggcgccgtctgttggtgtcggatcccgcaccacgggctcagatccggacaaagattgctacgtggataaaagaggcccataacagagaaggcccataagcgttctcgaggtgaaaatatggatggggtgttgacctgcgaagtgaatgcggcgtcgaggtcaagactactcggattgaagaggccaaatgggccaaaaggtgaagtcaagaaggcccggagtggattcaaattcaaacgttcggataattaatttgaagactagaaacggatacgtttaagatagaatgattgtgattaaataagaattaaatgtattctttggatatatattgagagtcaaaggtcatgtaaggacacacgcatattttggtgcaaattagctatacattttcttttacaatactcataattttctctataatcatctacttattttttagtatatttgacctcaagaataatccttctcactaaacaaataaatacttgagtgtgaatccgacatccacattttggcgccgtctgtggggatggaggattcttgagtcatcagattctttctgtgcattatatacccgaagtgatccgcaatgtctagagaggatgctaccaacgtttagatagccgaaaccctcaaggccatg

SEQ ID NO: 12921 - DNA, 3000 bp, Unknown
  misc_feature (1)..( 3000): cDNA_ID_2712819_gDNA_ID_2214581_Annot_ID_135261 3000 nt of promoter + ATG
ttcttgtcgagcgcttgttcgttcttttgatgattgtgctggaaaaaggaatatcccacccatacctaagccctaccctggtgatgttcctcatttgcttggaagacctcacgagttgactgcttatacgccaccatggatgatgagacgtttttctaggaagcatttactgctcccatctgatccacctaatacctgaaacccgacataattgatgcgtgttttatttcgcctcaggcttttacctgaaagaccacacgactactgcaagtgcacaatatatcggagtagtattttaggatcgaatccacaaggagagaagtagttctgagaaatccttaagaagagagtgaagctagaaccaaaataaagagagggggttgttgtatgatatgagtaaccaaataaagacaagttactaaactaaacggtaagcaataagagagaagcgttaggtcatcgagggtttctccggatgtcatggttgaataaataaggtatagatctcaatctaggtgaaaacatggctaggtttgtttacttccaatttcccagacatacgaaactctatcaagaccagctaaccctaacggttagtaggtgaaagccggctatcatcactaatatcttgcgtactcagttgccctatcggctagtaggtgccaacatggtttcaaaatacaagattaaagcattaagttcaaattcgattctagtccataagtccctatcactcggcgggtgtgcaacggttatagttctttattcagttgagttaggtcaagcattcaaacgagattttgccaaagaatgaaatacctaaggtcaagtactaggtggcgttctggatatacaagcattaagattaaactcaactagaaggaatagtgtaaacggtcaaacaaagccatagaaaccaccaacctagatcttcgatctattggtccccatgaattcccctttgaaaaccccctcaaacccaactagagatctactcgctcatggcaaagaagctaatcaaaagttgggttgagtaaaccataactaaaagatgaataaaactagaaaacgggttagggattacttctttgaatgtagaatacaagaggcaaagctccaccttaaagagtcttacacgaaaacgagaaagagaaagagagagatggtgttcttcaagcttaaagaggtgtggcggcaagtgggcagctcttggcgacagctagggtttgatggtgatgaaggcacgcctagggttagggcttagaacaagtatttatacttgagggccaagaattaggtttaggggtaagaacgtcattccgccggataagtaagtgatcgggccgagtagtgggcttcaaggcaagagactaatgacggcagtgcaaagaggaaaggacttgggcgtgacctaatggtcggtggtgagctactaggagctgcccgtgttcaagtctcatcggccggatgtgttttggacttattatttccaaacagccagttcttgacatgtctttactctttgggtcatatcttctaaacggcttcatggattgctatgatttgacttcgacgtgaatcttgactcttctagctgtccaatgacaccgagatatcctcatgccgggatagggaagaccttggccggatgctaaacttccgaagcactagaatgatcgtcttttgatacttttagcatcaaaactcttaaaaccttcttggcatctagaatgtgtgtttctcctcttattggctctagaatggcaccaaatgctctttgaaacataagaaaacaatagctaaaacgggctaaaaagtcgtgttatcaactcccccagacttagactttgcttgtcctcaagcaaacaaaagaacaaatctggtggagagttctaaaaatcgcgggaactctcctgttatcattgaccgtgtctcgaatatatcctacagaccacattaaacaaaagttgcgttagaacggtcgctcaatagtcctacgcctttctcgtccttgtccatccgctttgatcctacagaactctgaattcacgtcagtcaactcattacattctttaaatgtgttggcgtggactttcttattagaaggtgtcattcaggatagacggtgtggatgtcggattcacactcaagtatttatttgtttagtgagaaggattattcttgaggtcaaatatactaaaaaataagtaaatgattatagagaaaactatgagtattgtaaaagaaaatgtatagctaatttgcaccaaaatatgagtgtgtccttacatgacctttgactctcaatatatatccaaagaatacatttaattcttatttaatcacaatcattctatcttaaacatatccgtttctagtcttcgaattaattattttaacgtttgaatttgaatccactccgggccttcttgacttcacctttcggcccatttggcctcttcaatccgagtagtcttgacctcgacgccgcattcacttcgcaggtcaacaccccatccatattttcacctcgagaacgcttatgagccctctctcttatgggcctcttttatccacgtagcaatctttggccggatccgagcccgtggtgcgggatccgacaccaacaattagccccccaagtctttcgaagtgttactccagtttggaaggctttaatgctataagggcaaagattgcgccaaatgattcttttgatttcccgcccaaattacgcgattgcattgatctcggaattttccataattactgatgcgacacctgtcgcaattatgaccgtatattgtttatttactattaacgcggggaaactcttccacttcccccacgactcccaagacggttccgttatcatcactggctcgcgtgtaggtaaatttactttactctttccttgtcattttatttttgacgcttctctctcaaagcaaagttctcttctttccctgaaccttcaatctttctactctctacacaatg

SEQ ID NO: 12922 - DNA, 3000 bp, Unknown
  misc_feature (1)..( 3000): cDNA_ID_2712807_gDNA_ID_2214581_Annot_ID_135264 3000 nt of promoter + ATG
gaatcactaattaatggaactcgttgcttagttcatgttctgtaaatttgattcatgattatatttgggttgtatcttttccgaaagtctggttatcttatgtgttcatcataaaaggtttttaagttttttgatggttgattcacttatggaagaaccttgttgctagtgaaattgatggaggtattagcttagatctgagactaattttcattcacaaatgttagattgatttcaacgtttgtgtttaagatataaatgttaaaaaatttggtgcaaaatcgagaagatcatcttaactgagttaaatgaacagacctttgtagacaacgatttctggacacgttcttctttaccttttttatctcaaaatccaatcgagaagatcatcttaagagagttaaatgaatatacctatgtggacaacgacttctggacacgtttttcccttgaatttttaatcatttatgctatattttgagatgttttgtatataaaatcaaacttggacttgtattttaaattttcaaaatccaattaagaagatcatcttaacagagttaaatgaacagacttctgtggacaacggcttctggacacgtttttcccttgaatttttgatcatttatgttatattttgagatgttttgtatacaaaatcaaacttggacttgtattttaaaactttaaaatccaattgagaagatcatcttaacagagttaaatgaacagacctctgtggacaacgatttctggacacgttattctttacctttttatctcaaaattcaatcgagaagatcatcttaacagagttaaatgaacatacctatgtggacaacgatttctggacacgttcttcccttgaatttatgatcatttatattatattttgagatgttttgtatataaaatcaaacttggacttgtattttaaaattttaaaatccaatcgagaagatcgtcttaacaaagttaaatgaacaaacctctctggacagcgatttctagacacgttcttctttacatttttatctcagtttacttgaacttgtctctaatttttttgctgtcaaattctatggcttttgaaaaggaatggccctgttttttttgtaatcactgcgtcagccatcggcaactgaaattttttaacttacttgcatgtaatgtatgtggagactaacatcatcattctcgtgaaaagagtcgcagggactataaaagtggtcgccgtttagtctagtgatgccgacgacaacaacatctcttgtaaaagtggtacaccattactatttcttctccgtttcttttgctgtaaaagtggattgatgatgtgggctttgtttgtatctactatttctaatcgaaagagagggaactacctaattgatgattttgaaagagggaatgaaaatgatgaaaaacaaaagaacatggaagagagacgataaactaagaatagtttctcaatcacacgttcttatccggagtaagcggccataactaaaaatggagcgtttcattataaattattttaaaataattaagataataaatgtttttgatcgttcagttatgggttaaaaaagtctatttttttttttgaatagaagaaaaagtgcctcatctctgaaaagtgcctcaaaaaaaataaaattctttaaaagtgtgtaaacatgtcatattccctatttttaaatacaactcaagataaagtttattaaatcaaacttgtggatatatagaaaacagataaatactgtaatagaagactaaatttaaatccagtgttggacaaatcgtctgagccaagtcgaataaatttggtggtcttaagactttttcgaagtggaagtataaaatcttattagtgtcacgtctaaattatataaaaatgttggttgtaatatgtaaatgttttttcgttgagattttagaaattttttgatttaatgtgaaatttcatcttactctcaacaaaatattttggacataaaaaattgttttttttaataacaaaaaaaataataaaattgtttttaaagcagcaaacatacatacagggttggagcacgaaactaataaaatcatgcatgtatgtttactgcttaaaaaattatttaaaaataaaagcagcaaatatacttttcattttaagaaagaatttgaaaagttataaaatctagtttttagtagaaaatatagttttacattttcttaaaataaaactgaaaagctgtaaattattattataaatatatattgaaatttgataagtaattcattaacataaactatcttattttctaaaccgtgtaattggacaaaatattttgtttatcgattatgaatttatttgtatatattgaacctaaacaaaattaaatctcctaatggctcgcatattatcaaatatcaaagcacttctaatttctttatattaaactttcaaaactaaatttaatttattacactcgcactatatattattttaaatataagctttttagtttttttttttttttttaaatatgtttaaaaaagcatctttagtagtttaattatttaattataaaaacttacattagtattcttaatagaaaaaaattaacattattaatcataattttaaaattatattataacaaaccggaatctaaaaactatatttgatcaccttattaattcatcatgtgctttgaaaatttctggtccaactttataggaatatagttttaaaatttctatgttgatttggagtggtagactggtatatatatatatatatttgttgatagcttcctagaaaatactcattccattttagactgttattaatttagctcattttctattaggatgtgacgtttccatttgttgacattgccaacattttacttttagttctcataacaggggttgctaatataatgtattaagactttttggtgtcgttatgtttttgtttggttgagaactgagagtccagcataaaaa

SEQ ID NO: 12923 - DNA, 3000 bp, Unknown
  misc_feature (1)..( 3000): cDNA_ID_2709939_gDNA_ID_2214581_Annot_ID_135270 3000 nt of promoter + ATG
tgtcaagattaagttagcaggatatgattgaaataataagaaaacaaagtaagaagacagcaggttgattgtatgtaaacgattaaataaagaggtaggaacaagatattctcaggaaactattggttagtagatctaatgaaaggtaggttgttatcgaaccattcttaaactcaaactctaattatggaataactggtggtgttccgcgaaactccctatgtctataactaagaatagccagagaagccgagagatttttaacctaaacatgcattctaaacgagttcgattgttcaccttagtagataggccgattcttattacacacctataaaccaggctcatcaaataatagatccaactacagatacctatggtgggcatatctattgtctggattcaagatctagttaattactctagatctagcattaagattaatcaaagatgaagaattctacagataagctaacaggggagcgatctactaaaccatatgaatccctaatgagaaaccctattcctaacaagcagactactcagacatattgaatgaagcaaacaacatatttgatatagaaagcataaacacaacaataaagataagagttagaaaggatctcttcactgtattgaaaactgaatgaatctctgaagaacaatggatgaatagcttatgtctctgaaaatagggtttgcaaagaacttgatcaaagaaaacttaggtctaaaaacaatataaaaaccctataaaatgttcagggactaataatgcaaatagggaagtcttctggggcaaatttcctcttctgtaaacttgaaagcgtcatggactttgctgggccgaaactggtgtcgatcgacaccaggagtgtgtcgatcaacactcctctgaaactggaactcaaaatcgtctttaacttcctttttcttatcttttgctccaaaatgtctccttatctccattatcgtcccactgcatagaatacctgaaaagacactaaaaagactcgagaaataacataaagactcaaaatcctatacctaaaacatagatgaaatcagtgaaaatagggatatatcaagtcccactttaaaaacacctctctctctctcttctctctctcttctctctctcttctctctctaaacttttcagagagagagagattttgatcgagatttagccgtccggtacgctttaccggcttatgaatccggatgtgatccggttttgtcgatccatctcgctgtcctatctcgccatcaggtgtatccggcggttctcatggctattctgttgccgttgtgtttgtttcaccgaattgatttgcgaaacaatttgatatcagttttttcttcttttctaactagaaagtttcatggtctattctcgatctgtcccaccaccatccacaatcaggtaagtgttttggtgtttcgattgggcgactgttttagtctcatccacatgaatcaaaattcagatctgggcgaattatgggttgcttggctccttccaaccgttatagttgaaacggtccggcgtttttgacggtttcaatcacctcatttgaggtccgtcttgccattccaagaagtcaaggtatcaatttccaaagtctattcttattagcaagtgatgacaagagatcagaagcttcacctcgtcgttgattgtttgtcgacgacttctttcatgcttttgttttcggaaaagatccagtgatgagaagagaaagaatttgaagattaaattgaatcctttatctttttcggtttaatagctgtctgttttcataatccggagatgtttccggttgttcactcgctggaaattgtgtcagcttctgtttgcatatttcgctgaaggggttgtgggtaccggtttactaggttatccggttcacccggtttgtaagattggtttatgaataaatatccctttgagaaaaaatcaaataataatcaaacttatggatatatagaaaacagataaataatagaagactaaattttaattatatagttgtattgttggagatggatcctaatcggaaatatcaacatgcatgtaccaataaaaataaggcacgtccaatgttgaactaatcgtctcagccaagtagaataaatttgatgggatcttatggtaagactttttcgaagtgggagtataaaatcttataagtgtgtcacgtcaaaattatataaaagtgttggttgtagtatgtaaatgttttttcgttgagattttaaaaagttttgatgtaatgtgtaatttcattatactcccaacaaaatattttgtacatgaaaatttgttatttgtttaacaacaaagaaagaaaaattgtttttgaaagcagcaaacatacatacagggttggaccacgaacctaatataatcatgcatgtatgtttactgcttaaaaaagtatttgaaaacataagcagcaaatatactttttcattttaagaaagaatttgaaagctataaaatctattattttaatagaaaatatatttttacgttttaaaaaaaactgaaaatatataaagtctaattatacaatatatagtgaactttgataagtaattaattaacataaatatcttattttctaaccgtctaatgggacaaaatattgtgtttatcaattatgaatgtttttttttttttgtatatattgaacctaaaccaaattatcaaatatcaaagcacttctaatttcttcgtattaaactttccaaactaatattaatttattacacttccatgacaacaactaggttttaaacatattattttagactgttattattttcagccactgatattaatttagctcattttctatttggaagtgacgtgtccatatgttgacattgtcaactttgtactttaagttctcataatataatgtgttaagactttttggtgtgtttgagtttttgtttggttgagaaatgagaagtagaacagaatcaagaatg

SEQ ID NO: 12924 - DNA, 3000 bp, Unknown
  misc_feature (1)..( 3000): cDNA_ID_2709943_gDNA_ID_2214581_Annot_ID_135271 3000 nt of promoter + ATG
ggaaccgtcgggttttggagggaagacggtggcggagcggtgagttttgggagaggagagggaagcgcgtttggatagagagaggaggaggaaaatggagatgaaacagagaagggagagtagagggaagagtgagggtttgttgtgtgaagttgtagccatggctgtgtctctctcagaagctctcagccatggcggagattttggattttggctacttgagttatttgattaactgatttaattttattatatatttccggaaaatgtcaaaaagaagtcctcaatttttaaaaatgttttgaataaaaaaaacactagctttccaatagaccagtgttttcatgctcgatccagatcgttcggtctgaccggttaacccgtgatccatttttagtttgagtttagtattaatatccgacaaatttaaaactaatgtttttaaatccgatccggacggtgaatcagactaccgatctaacacgtggcgtgaagctcctaatgtgtgggtaaagcaatattacccatctgccaatattagtcatggagaaatatttgtagcaagatgtttcagactcttcaattccaccaattaggctaacgtttcggatccaaaactccaaacttgggagcatatgttgtacccttttgaagagaaatacaaaactctgatctcgaagaggatagtgattaaaggacaaaagtatgtggttgtgcaaaatcgcgtggcttacaaggcaaaagaagatagatggaaagctataggaatgctgcattatttggaaacatgatggaacttactttcttgctatggtatacaaaatgtgttatatcgttgtattgatttaccaaaaatccaatgcttcaactctaaaacaagatactgggaatctttgaagggttaggaaggtctgccagtgtttgacgatgatggttgtgttagattggtagattatagtggaaagatgactcttttgtgggataagtgcgttccttcatgtagaaacaaaatgatttagtgtgttgtgattgcgcttgaaagacgaagtactcaagagatttggggaaagattgagtgggctgatgatgttcttagtacagtccttcttttttatgattttgtttgtgcgctcaggcccgattattgggctgtgcaattggaactttgaatagggtccaatataattttgacatttttcttcagtatttaggctaatttgtattgaaacaaattagaaaaaacccaaaaaatttaaattctgtttatatatattttttttcaaactattgagaaatatgtccaataattaactgaatcgggcctctatgctcttactattactactactttgatgaattgacttgtgagaaggcttaatgtggtgaatctctagtgattgtgggttatttggttttgttgtatgattcagtgtgttttgacattaatacaataggcatcatttcacttataacactctgatggttagcttattttgtgctctgctaagaggcctatgaaagtctgttctgcctacgattgaagagtgtgtttagtgtccaagtgatttgctttttattccttagttgcagaaaataggttcttgaatgtgtcttacaaagttacaatctcattatcacagatgcaaatggtttcgcttttcatttgtgtttaagaaaaaaaaccggtacggagtgaatcatgttgaacctgcaagtccggccgtattggattagtccaattaattgacatgcgtgtaccaaccaacaaagaaattgccacagaaacattaagggcttgactcgtttaaacgcagcggttgtgggagtttgcggaaatgggcaattgcggtttcaagcgttatttagcgttttgaccgattggtttagcggttgaaaacatgtgcgtttgcagaagatttacgactggttgatcagcgggtacgatagcggttaaaccaaaatttaccaaaaaaaattaatatatgatttaaaaaaaaaatttaaacaccaaaaactagaattatgaaaaagtataaatttttaaacataattaatgatttaaaactataaataattattcaaataaattttacgttgaaaacaaaaataattattaatattgaaaatttaaagttagataattattttttttagaattaatgtgaatatatataagacttgataatatatataatttaatttgattatttttcttttttagtttctttccttttttaaattaaccgtaaccgcccacaaccgcaaacgcttgcgggaaagagcttttgaaatccagcgatttcgaacggttcgaaacgatatggaacagtttctatgattagtaccaaccgttaacaaccacaactgaccgctaacaaccacaaccgaccgctaacaactactagacagttgttagcggataaaccaatcaagcccttaaaattctcagttttataatttctaaacatcatataggtctcgtacctttttggtaacaattattcccataaaatcacatcataacctttccacattataccattaatactcgaacccaaatatcaaaactctaactaccaaaaagtcgaataatcattgctaataataatcaaactgataaatcaactaaatgacgaaaacacccttcaccgaaaacacgtttgcaataacatcccgtggacattacagtctttcgccacgtaaaccatctcctccagcttcatcaagcaaaatttgttttaatgtcttcttcttcatcaccttttcgtctctccactcacactaaaaatcactctccattttgattttcgtatctctcgtgtcacactcacacaaaacacaatcttcctcaaaaaaaattttgtgcaatctgatttgattttcactgtctttctaagtttcgaaacggtggattttgtccgtacgtggttttgattctcgtagatgtcgaagctctgacgtaagattagagtttcgatttctaggtttcttataactatg

SEQ ID NO: 12925 - DNA, 3000 bp, Unknown
  misc_feature (1)..( 3000): cDNA_ID_2709947_gDNA_ID_2214581_Annot_ID_135272 3000 nt of promoter + ATG
atctctgggagtaccggatttagcaagaacctcaagatcaacgagactcatagacataagacccaaagtaagaccagacattagtccagcgaacaagactagtaacactatcacagcgatgtgtatgaagaagctggtcccgcagcattcatattccaccgccatagttataagaaacctagaaatcgaaactctaatcttacgtcagagcttcgacatctacgagaatcaaaaccacgtacggacaaaatccaccgtttcgaaacttagaaagacagtgaaaatcaaatcagattgcacaaaattttttttgaggaagattgtgttttgtgtgagtgtgacacgagagatacgaaaatcaaaatggagagtgatttttagtgtgagtggagagacgaaaaggtgatgaagaagaagacattaaaacaaattttgcttgatgaagctggaggagatggtttacgtggcgaaagactgtaatgtccacgggatgttattgcaaacgtgttttcggtgaagggtgttttcgtcatttagttgatttatcagtttgattattattagcaatgattattcgactttttggtagttagagttttgatatttgggttcgagtattaatggtataatgtggaaaggttatgatgtgattttatgggaataattgttaccaaaaaggtacgagacctatatgatgtttagaaattataaaactgagaattttaagggcttgattggtttatccgctaacaactgtctagtagttgttagcggtcggttgtggttgttagcggtcagttgtggttgttaacggttggtactaatcatagaaactgttccatatcgtttcgaaccgttcgaaatcgctggatttcaaaagctctttcccgcaagcgtttgcggttgtgggcggttacggttaatttaaaaaaggaaagaaactaaaaaagaaaaataatcaaattaaattatatatattatcaagtcttatatatattcacattaattctaaaaaaaataattatctaactttaaattttcaatattaataattatttttgttttcaacgtaaaatttatttgaataattatttatagttttaaatcattaattatgtttaaaaatttatactttttcataattctagtttttggtgtttaaattttttttttaaatcatatattaattttttttggtaaattttggtttaaccgctatcgtacccgctgatcaaccagtcgtaaatcttctgcaaacgcacatgttttcaaccgctaaaccaatcggtcaaaacgctaaataacgcttgaaaccgcaattgcccatttccgcaaactcccacaaccgctgcgtttaaacgagtcaagcccttaatgtttctgtggcaatttctttgttggttggtacacgcatgtcaattaattggactaatccaatacggccggacttgcaggttcaacatgattcactccgtaccggttttttttcttaaacacaaatgaaaagcgaaaccatttgcatctgtgataatgagattgtaactttgtaagacacattcaagaacctattttctgcaactaaggaataaaaagcaaatcacttggacactaaacacactcttcaatcgtaggcagaacagactttcataggcctcttagcagagcacaaaataagctaaccatcagagtgttataagtgaaatgatgcctattgtattaatgtcaaaacacactgaatcatacaacaaaaccaaataacccacaatcactagagattcaccacattaagccttctcacaagtcaattcatcaaagtagtagtaatagtaagagcatagaggcccgattcagttaattattggacatatttctcaatagtttgaaaaaaaatatatataaacagaatttaaattttttgggttttttctaatttgtttcaatacaaattagcctaaatactgaagaaaaatgtcaaaattatattggaccctattcaaagttccaattgcacagcccaataatcgggcctgagcgcacaaacaaaatcataaaaaagaaggactgtactaagaacatcatcagcccactcaatctttccccaaatctcttgagtacttcgtctttcaagcgcaatcacaacacactaaatcattttgtttctacatgaaggaacgcacttatcccacaaaagagtcatctttccactataatctaccaatctaacacaaccatcatcgtcaaacactggcagaccttcctaacccttcaaagattcccagtatcttgttttagagttgaagcattggatttttggtaaatcaatacaacgatataacacattttgtataccatagcaagaaagtaagttccatcatgtttccaaataatgcagcattcctatagctttccatctatcttcttttgccttgtaagccacgcgattttgcacaaccacatacttttgtcctttaatcactatcctcttcgagatcagagttttgtatttctcttcaaaagggtacaacatatgctcccaagtttggagttttggatccgaaacgttagcctaattggtggaattgaagagtctgaaacatcttgctacaaatatttctccatgactaatattggcagatgggtaatattgctttacccacacattaggagcttcacgccacgtgttagatcggtagtctgattcaccgtccggatcggatttaaaaacattagttttaaatttgtcggatattaatactaaactcaaactaaaaatggatcacgggttaaccggtcagaccgaacgatctggatcgagcatgaaaacactggtctattggaaagctagtgttttttttattcaaaacatttttaaaaattgaggacttctttttgacattttccggaaatatataataaaattaaatcagttaatcaaataactcaagtagccaaaatccaaaatctccgccatggctgagagcttctgagagagacacagcc

SEQ ID NO: 12926 - DNA, 3000 bp, Unknown
  misc_feature (1)..( 3000): cDNA_ID_3027045_gDNA_ID_2214581_Annot_ID_186507 3000 nt of promoter + ATG
cagaataagataatagggagtagactttagcgttgagccttaaatatttgaatatgacatagaattctaaacatattagtgacttgcaaacaactttttgaaaacccaaatagtatttcatttgaaaatttctacacctagcactcaaaactttaattaaatattaaataggttcttaaaagtgggggcttactttctttactcattttacactctccattatgtgttactcattttacactctccattatgtgttatacaggcgattttaggaaggaaaaagagagagtttaaaatgtaatgaaaatagtgtttcatgcgtgtatgtattttctaccgtcttgtttatgtttgatttgtgaacatatatatgccgtcacgtttgtaagaaaacttgtaacatgaaaaaatatcagacatatttatctacaagatagcaacatgaagagtggaacaaaaaaaatgatagcaacagccttctttaataatctacggtaaatccatgaaggaagaaaacaaagatatcttgacttgttaactaaaaaagtctttgggaccaaccaataatttcatgtttatctttcttgctacttggaggtgttatggaataatcaaagctgcttccttattgatataggttaaattaggcaaatatgacatatttattagttttaaaaaattacttagatgtaattatactaaaataattagatgctattttttggaaatttttacaaaatcaagattacacagtcaattattaaaaaatatatagtcatgaagaatgttatatagtcttttaatgattttgcatgtatctctcccacttgctttacatatgacgtcatgtttaaaacgtaggccgaaccagtaacatcggatactatcagacacacattcatatctatggccagagatgacctgaccattatccatgatgcaatataataaaacaaagctatcttgacttgtttactaaaacaattcttaagacttatatataattccatggttatctttactggcttcatgcaaggattatggaataatcaaaacagctgcttattgaatgaggttggttaaattaaattacgaaaatatgacacatcattataaaagtctaagagctcatttgtttcaaatttggaaaaccatatacatcatctatattcaacatcctatatattgtttaaaactttaaactcgttcttttttttcaattttttattttttataattcggatgatttggttcaacagattttatgatctctgaaccagagcacgaagatttctttttctagctggttcttgggtcaatggaccatgagaactgactaatcccaggacgaggggaagccatgtgaaaacctctaacactcacacatttgtggagtagtttttagggtagatcaaactttggatagctcattacaactttttttagtctgatcactaccactagaccaagcttgtgtgggcaaaaagacttcgttctcaagggcggacctagtaaagaagaagggggtcacttgacccaagttgaatagtcaaattttattttttgcatagaattttgtttagaattagcagaacaattggtaaattccaaggtgttgacacccccaaaacatgagttcaaatctctataatgacacttttactcttttctcctcaatttagttttaaataaatgttttttttgtcttatatatttctttactttttccaaaataacagcaattaatatactatttttatttccttatgaaattgattttatttttgtgagtttgtataaatattataagaaagttagttataaaatactgtttataaattttttttgaccccggtaaaatttatttatgggtccgctactgctcgttcttgcctataaatgtaaattttgtttctatttgagtatgcagaaaaatacaagtactatatatataaaacactcgttttttaagtcatgtaaattatcattaatgaatgaaggaatttgtaagttaccaaaaaattgcttaaccagcgaaggggataaaccttgccaaaaaagaataaagaacaaggatatattttgcatgtcagagattaggtattaccgtattagcaagccaaagctgcattagggaaatcccaataaggtttttacgttcatgatttcttgcacgactatgatctcgtcaatatggaattatacaacgtctgctatttgaatatggctgccttaggctctctcaaatcttatctatactgcatattcgattggacgaaatggaactatgattatttgccaattttgtccatacatcaatattttcaaagtattccctggaattgtttcttattggtgttaagattttgtcattgttgaagtacttttgatgttatttttatacgtaattaatttaaatgaagtgaaaaacaagaaatgaaacttttttgtttttattcaattgtttcttttgttagtttttctatttctaaaatcttatttttcatactttggaatattttttagtttttttgttcatcaaatatcctataatttatttaaactttttaacctaatgtaataatacaaaataaattagacggtatgctgttgtaaatgttacagaattcagatcaaatttaatcaactatttttaaaaaattaacaagtaagtcatgaagaacatatagtctttttatgtttaatgcatgtatctactatctctcccacctgctttatatatgacgccacgtctatgacgtaggtcaaaacagtaacattagatactatactatcagacacacattcatatggccagagatgaccaaccactggagatgctctaagaaatttatcctcgtaggcttttctcttttaaaagtcaacatattggagccagatgtttattttataaatactaagaaccacaccaaagaaaaaacatttcaaagcaaaacaaaagagagagagtgtatccatttttggaggggaaaacaaagt

SEQ ID NO: 12927 - DNA, 3000 bp, Unknown; identical to SEQ ID NO: 12925
  misc_feature (1)..( 3000): cDNA_ID_2709947_gDNA_ID_2214581_Annot_ID_186503 3000 nt of promoter + ATG

SEQ ID NO: 12928 - DNA, 3000 bp, Unknown; identical to SEQ ID NO: 12924
  misc_feature (1)..( 3000): cDNA_ID_3027053_gDNA_ID_2214581_Annot_ID_186501 3000 nt of promoter + ATG

SEQ ID NO: 12929 - DNA, 3000 bp, Unknown; identical to SEQ ID NO: 12923
  misc_feature (1)..( 3000): cDNA_ID_2709939_gDNA_ID_2214581_Annot_ID_186499 3000 nt of promoter + ATG

SEQ ID NO: 12930 - DNA, 3000 bp, Unknown
  misc_feature (1)..( 3000): cDNA_ID_3027062_gDNA_ID_2214581_Annot_ID_186495 3000 nt of promoter + ATG
aacaattactagaggattctactgaacatgtgaaccatgcatccattgtgtctggtgataaggtatttcacacaacatctcaaattacattcttcattacaatcataaagttcataagagttttggcaatttctaactctatatattgcaggttccacttatgctggagaatggtaatggatcgccagactctacgactccatcttcaaagcgtgtttacgctagagaaacgagtggctctgaaggttcttcaagttcaaagaaggtgtgtgttgtaccattagacttggaaaagtctttatctgagaatgctgaacatggagttgccttgaatccgcaggtggctgattcaaaagaagttactgttccaactgaagtcaaaacatcaaaggttcctgttgaaacagagaatgaccaagcacttgtcccagctactgtcgtggtgaaacaagaaatcaagaaagagatggctaggaacatggctactgtaagggtcaaagtggagaagaacaagtgatctacttatctatttcttttaataagtgatgcttcttgaactatgtttggtcactgaagctatgttttgaattttgtttttctttaatggattatgttcgtgtttttgttttcgaatttataggatttcatgttttggattatgtttcatctttaattttggagttaatcttaaaattattttattaagcttatatgttcgatcattactaattttgtagccatctatatgaaaacatgaaatctcagttataatgttactgttagagggtccaaagaaacttaccatttcatgttgtatatatgtattcaactggcttaagacttttaatgaatgactttagtgtatacctgtatcaataagttaaagtttcattaacaatttgctattccaatcttttagatataatatagatttcataatatatgataaaatgaaactatacaaaagatcaagtcaatattatgtcaatattatgtcaatcttttgacaatcttctatatagattcactatgattaacatctataactgtctagatattaggaaattgtcttattcgtaatcattatacatctatgtctatgatatcttattagattttctcaatatgtcatattgacgtcatcatcgagaacccgcggaacgattcgtattttcttattttaaaaaacatctgccattcattgtatcttttcaacttatatatatattgagtaactgttccttttcgatctcaaccctaaaagataaaacaacagaataagcataaacattaaatccttagagagacatccgtggcttatattcacaaactcgaaaatttgaacttgatgaacaatcagaattgggttatatgcgtgatagttctctgtatttgggatcatcctccaaacgtgaatggtgatgttacaaccatgattttggttgatgcaaaggttagtctttcaaattcatctgctcttttagatcgtttttttttgtggcttggtctattgcatgtcatcaaaatatcttgcgggttctacttagtctttttcttttgtcaacttaacagcatcacagaatcgttgcaaccatacctagattgaatttgagggacaaattcaggcgagttctccaggagggtttctggtttaacatctctcagtttcgtgtgattccctctacacacagagtagaaacgtatgtgttgaaccgtctccatatcatgttcagatgggatactgtagtgttcagaatgtcagagttagtgaaatctgatttcacagactatcttttctccaatgaacttgaggactctgctacagacaatgttcctgatgttactggtatgtttataacgatcataattctttagatcatttcatgagtttatatttgagtactctgctgcagacaataactagcttttgattttttgttttcatagatgctattggtgtggttgcaagtgtttcttctatcaagaggtttccttatgtctgcaataagggtgagaccgactatgaggccaaatatgtttctttcgagcttatagataattggtaagtttataagttatagatttaggattagttgatctagcttgcagactttacatttagattattgcgtgtgattatttaccacagtctaccaatggtacagggaacaaaaactcaagtgtgttgctgttggttcatgctgtgaagagtttgttaccaagtggtctaggcgtatcactagaccaacatacaactatgaaccagttgtatgtgttgtgcgcttctggagaattgcttcaattgatggttagtattctaaatctgctagataattgtattgagttgtgacccatgaaacctgtgtttaaatttaaattatgttctgttttgacaaatgaaacctgtgttttttctgtgtgtaaggtgaaaacgttttaacgagtgagtttggatgttcccgtctacatatagacccaagcttcccttactttgatcttgcaagttatctgtaagtctagcaattggttttaaatttctgtagtttacaattaagaatagttacttagttttataatctattgtctctgtaccaggcggagtttcaaagatgctgatgatcaagaagtgacaatggaaccagttactgaagcttgaagctatttgggtcggtttgttcggttttgggagaaattcggttttaattttttttaccgaatagacccaaattaaaattcggttcgggtcggttcggaagtcggttcattcgggtcggttctagaaattgtgttccgaacttaaaaccaaacaaaaatttattcggtttctacggtttttaattcggtttagatatttaaaaaaaaaattacactaccaaaaatcctaatccaaacaaattacccactacaaattaataaaaagcccaaaatacaattcaaaaaagcccaaaacaaaaactaatagcccaaccctagaaaatattagggttttgaccaaaagat

SEQ ID NO: 12931 - DNA, 3000 bp, Unknown; identical to SEQ ID NO: 12921
  misc_feature (1)..( 3000): cDNA_ID_2712819_gDNA_ID_2214581_Annot_ID_186485 3000 nt of promoter + ATG

SEQ ID NO: 12932 - DNA, 3000 bp, Unknown; identical to SEQ ID NO: 12926
  misc_feature (1)..( 3000): cDNA_ID_2709959_gDNA_ID_2214581_Annot_ID_135275 3000 nt of promoter + ATG

SEQ ID NO: 12933 - DNA, 3000 bp, Unknown
  misc_feature (1)..( 3000): cDNA_ID_2712856_gDNA_ID_2214582_Annot_ID_135277 3000 nt of promoter + ATG
tctaattctacccaaagcaagaaagcagcctgcgccttgtccacagtattcttccgacccgtaaggcatttgagcgcaatagcatcgcaaacttcctttgcataccttcaaaagcagaaacaaactaattattcacatgcaaacgaacactccactctgcccatttctaaagcaataaaaataaacaacaccataccttccagcatctgaatcggctgctcgcaaaaacgcaatcaatgcatcaagcgctttctcttgcaccggcgcattagaatctgccaccgtcttcctaaacaagtgacctgcgaataaaaaataataatcagaaattcaatcaaaagtaaagcaaaatggaaccctagaccaatcacattcccactcaacaatccaaattcaaaacagatccacaccgatataaaccaccctaatcagatctgagcttcaaaaacaaaaaccctaacataataataataaaaaaacgaggtagagaaactcaccaaaatcgcgaagacgagggtccttaggatcagtaatcgaatcaaaaacagaagctaaatcgacgttagcttcgttcctaactttccaattcttatgcccaagccgatcctcccaaggaagttttttcgcctccttcaataacttctcatcctccgtcgacattactccacgaaattatctctccgacggtatcgatcttatcgatctataccaagttttttttttcttcgtacggtctcttggaaactttctctctcttttcaaaaaaatttcttcgtgttgttagtgccggcaagagagagagagagaaggacaaaaaagaagagtagggtggagcgtaatgagagagagagagtgggggaattttggtttctacgtttaaatcggtggtgtaatttttttgttaaaaacccttcacgcgcgttttgattggaaatgtttacacgcgcgattatttcaaatcttaaaacgagcgtttttcttttgctttctccacgtggagagatcggcattttcaaactattttaggaaatgattaacagtactgaattttcctattgttggttctgtaaatattttcaaaatatatttacattaacaatctattaatttctaagaaaataaagtaatattttgaaatgaataactcatttttagttataaaaatatttattttaaaaaatcaacaaaatcatgagttattattacttacttattggattatcttttcttctataaaatacaaataaatagtcattttctataaaactagacacgtaaaccaaaatggatttattagtttgattatggaagttcaaaaacattgtgtattttatgatttaaaaactagttaaaatttattattttaatatcctaaatatttatgctaggatctgatttcgctttggattttaatatatttgaaatatctaattcaaattcagaatacaaatactcaaatttcaaacaaactttgattgataattagtacaagaatatttaagccacaccacaccttacaccttttccatctccatcctcatgtcttaggtgatgtaactctctatctccagatatcttttcttgtctactgctaacacatgaaacaacaactcaaatttaagccatatttttacaatggtaccaaatttataagaatcatagatgaaattaccaaaacaagaagttacgtggaaagattgaatccaatattaatattttgatttctattataaaagcaaatgaaataatgattatcagtccattgtttgttccatttttaagtacacttgtttgtttgatttaggtgaataagatccgctaaagctgaaaatacaagaattgtccctaaagatagtaaagtacagtacgcttccaaataaataacaatgggctttagtaggcccacgcaataacgatgttttaactgacccaacaagcccttgtccagttctggcattatacaatgcgtcggtcgacacgtgtaataagtcatgatcggcacgtgtggtctccacttctcctctctcattggtcgtaaactcgtaactagccgattccttctccaaagtatctcacatttccactgcacactctactttctctctcttcactctctcataaatcacaacaacaacaaaaaaaaaaaagttgttagttaagacattgctttacagctcaattgcgtcttcttcctctgtcttattcttcatcttcatcttcctcctcgcggatccattttgaggttcgtgtaaattcccattctctttcgccatttttttgggggaagtgagattttggtctgagttatcggcgaatcgatttcgtttttttagattattgaatggttttgttgactcttcagttcttcttgtgctgtgattgcaatgatgtcctccgaatttcgtgatttaagttcgattttagctatccgagctcctctttaaataatgagttggggttttattctgaaggttcgatttctgattttgcaaatttgggaggtggatttgatccgattagataatctcactgttctgggtgctgtaattgttaatgagaccatgcaaatgttgtgcatcgatgttgtggaacgcttgatttgtaattgaggatttggttgtctgattattggaagatcgaggcttgatagagtttcaaatgagggtcagctgttattgttgtacggtctaatgacattattttatttaacttcaggagtctctttttgtttcttgaagatagactgggcgtcacggagcagctgagtatatgctacgagtgttgcattccggaggctgttctttcagatgattggcagtagctatattatgcttgaacggtgccataatgggcatctgtctaatgaagcgctgctgctcatggtttcttttgatctcgtttctctctgcactaacgaatgaaaatgaagcaattagtcctgatggtatacagcgatatgtgtctttaatctcttctatattttgtctttgacaagtcatg

SEQ ID NO: 12934 - DNA, 3000 bp, Unknown
  misc_feature (1)..( 3000): cDNA_ID_2712852_gDNA_ID_2214582_Annot_ID_135278 3000 nt of promoter + ATG
ttatgcaccaactatatagaagcaaataaagaaaaacactagtaattgttaggaaataatataaaatttggaaaaacaaaacgagaattcgatcagcaatgaagtgtaatcacactaatcagcataagtatttgggaaagcccttacattccctctaatgccgtgcaatttcccaatgaggcaggtattgattgatataacgcattgttgtgaagcattctgcaatgacatgggaatacacatacaatgagtagtagagcatatgctagacatcaataatattaattaaaaggttaggagcacatacaaaagccttaactgatccagctttccaagctcagggggtaaaggtccccttaatttgtgataagtaagactcctgcacacaagaaacttcaggaaccgacaaaagatgcaccacatactgaagaaaaaaaaagaatttaaactaaagaaattttaaacttacaaggctataactctttttgtttttgcatcacaggtcactcctttccagttacatggatcaggatcctctggtctccacagaccaataacaccatcagaagccaaaactccatttctaaaactcaaaagcgcctcacctggagaaaaaaaggatttaatcccttcagcaatctgggcggagtaaatggtgatcatgacttgtcaaagacaaaatatagaagagattaaagacacatatcgctgtataccatcaggactaattgcttcattttcattcgttagtgcagagagaaacgagatcaaaagaaaccatgagcagcagcgcttcattagacagatgcccattatggcaccgttcaagcataatatagctactgccaatcatctgaaagaacagcctccggaatgcaacactcgtagcatatactcagctgctccgtgacgcccagtctatcttcaagaaacaaaaagagactcctgaagttaaataaaataatgtcattagaccgtacaacaataacagctgaccctcatttgaaactctatcaagcctcgatcttccaataatcagacaaccaaatcctcaattacaaatcaagcgttccacaacatcgatgcacaacatttgcatggtctcattaacaattacagcacccagaacagtgagattatctaatcggatcaaatccacctcccaaatttgcaaaatcagaaatcgaaccttcagaataaaaccccaactcattatttaaagaggagctcggatagctaaaatcgaacttaaatcacgaaattcggaggacatcattgcaatcacagcacaagaagaactgaagagtcaacaaaaccattcaataatctaaaaaaacgaaatcgattcgccgataactcagaccaaaatctcacttcccccaaaaaaatggcgaaagagaatgggaatttacacgaacctcaaaatggatccgcgaggaggaagatgaagatgaagaataagacagaggaagaagacgcaattgagctgtaaagcaatgtcttaactaacaacttttttttttttgttgttgttgtgatttatgagagagtgaagagagagaaagtagagtgtgcagtggaaatgtgagatactttggagaaggaatcggctagttacgagtttacgaccaatgagagaggagaagtggagaccacacgtgccgatcatgacttattacacgtgtcgaccgacgcattgtataatgccagaactggacaagggcttgttgggtcagttaaaacatcgttattgcgtgggcctactaaagcccattgttatttatttggaagcgtactgtactttactatctttagggacaattcttgtattttcagctttagcggatcttattcacctaaatcaaacaaacaagtgtacttaaaaatggaacaaacaatggactgataatcattatttcatttgcttttataatagaaatcaaaatattaatattggattcaatctttccacgtaacttcttgttttggtaatttcatctatgattcttataaatttggtaccattgtaaaaatatggcttaaatttgagttgttgtttcatgtgttagcagtagacaagaaaagatatctggagatagagagttacatcacctaagacatgaggatggagatggaaaaggtgtaaggtgtggtgtggcttaaatattcttgtactaattatcaatcaaagtttgtttgaaatttgagtatttgtattctgaatttgaattagatatttcaaatatattaaaatccaaagcgaaatcagatcctagcataaatatttaggatattaaaataataaattttaactagtttttaaatcataaaatacacaatgtttttgaacttccataatcaaactaataaatccattttggtttacgtgtctagttttatagaaaatgactatttatttgtattttatagaagaaaagataatccaataagtaagtaataataactcatgattttgttgattttttaaaataaatatttttataactaaaaatgagttattcatttcaaaatattactttattttcttagaaattaatagattgttaatgtaaatatattttgaaaatatttacagaaccaacaataggaaaattcagtactgttaatcatttcctaaaatagtttgaaaatgccgatctctccacgtggagaaagcaaaagaaaaacgctcgttttaagatttgaaataatcgcgcgtgtaaacatttccaatcaaaacgcgcgtgaagggtttttaacaaaaaaattacaccaccgatttaaacgtagaaaccaaaattcccccactctctctctctcattacgctccaccctactcttcttttttgtccttctctctctctctcttgccggcactaacaacacgaagaaatttttttgaaaagagagagaaagtttccaagagaccgtacgaagaaaaaaaaaacttggtatagatcgataagatcgataccgtcggagagataatttcgtggagta

SEQ ID NO: 12935 - DNA, 3000 bp, Unknown
  misc_feature (1)..( 3000): cDNA_ID_2709971_gDNA_ID_2214582_Annot_ID_135279 3000 nt of promoter + ATG
tgtaggttgagaagaatgcagctgcgggaagaacaccttcaagcctaccgttgtcaactcctcccccttcgtccttagctcttccatctcctgatattccttccttgtcctctttagatgtgaagcctttgatgaaccctagatctgatttatacacagacgacatccgagccagtaacatgaatcctggaggtagtttcctagatccttatccttctttgtccttccttgcggtgtttatatatatctgttaaaaacaaacatctttggcagtgatgacagggacgctagatgcaatcagagaaaggatgaagaacatgcaactggcttcatcagagccagtaagcaaaccgctgatgccaacaaacgataacttatcaatgaaccaacagagcgttcccccgagccaaatgggacaagagacagtccacacacacccagtggttctcccaatggatgagaaagcattgtccggtcttcaagcccgaatggagaggctcaaaggtggatcactggaacatatgtagaactagagaccccaagctttggagtctgaagttacataagcaaattcgccatttttgttacttctctccaattaatgtagtagtaaaatacttttcttttaatatacaaacatataagagagagcaatattttatggtgaagcggctagatttcaatggagttagtgtgtatagtggtgggagagtctgggagctgatggtgagtgtgccagattctttttaatatgagacaaaatattattctttctatgcttgtttacatctttttttcaaccactagtagaaacctgaatattctctcgactctgtttagatatgattctgatgtagttggcatatcttgtgtaatccctccactctcaaatttctaacaattcttaatttttgggttgaaacggaagtaatattttgttcttccatctaaccaaaggtcgtatatttgcaaaccaattgaagtagaaattaacttaaaccgggaactggtttaagagatattaatatatgaccgaagacattgggtttaaaaagtcagaataataaaaagttggcgtagtctaaacgccgacccagaggccctctcatacctttaccagtgcctatatatatatatatatataaacagactaattactattccccatcgcacagacccccctaagaatccgagagagaagaagagataatgcagatcttcgtcaaaaccctcaccggcaaaactataaccctagaagttgagagcagcgacaccatcgacaatgttaaagccaaaatccaggtttaatttagggtttcttctcttctttatcccctcaaacgattccttagttcctctgaatctctacttgttcttaccttgaattgtataattaagaattgtttcgagtaggaatctctagtaatcttgaagaacatggatttgatttacttgagaatagctaaaaagtgtttgtgaggattgatagtttgtttaacgatctttatctgagctcgcttttgttcgaatctttggtaaatcattttggggtttcaggacaaagagggcataccacctgatcaacagaggctgatttttgctggtaagcaattggaagatggccggaccttagctgattacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggtaaaaacaaaacttacgtttttctcttatgacttgacgagtttgtgtttgtcttggtgcatttaagcctcaattgagtcccatcctgaacattgtttgcagtatttttattgcatgtgttagtcccatcctgaacattgtttgcagtatataactctgtggtacgctctgaattctcaggctcatatatgccggaaaacagcttgctgatgacaaaacggccaaagattatgcgatagagggaggctctgttcttcatttggttcttgctcttaggggtggtcttctctgatcttaataaataagcttttcaacaaacatcttttccctcactattgtcctccttatgtggaattcatgacacaccaaaattgctatgggaaattggaatattatgctctgcttgtgtgtttggatcatattacttgtatttttcagtctctctgatatgatactttgtgagttaattatcgagtgccgtatcaggtaggaatcgttatctgactaacgagttttccactggcacataccaattcatatttcgtttaagtagagaagtccagattgcatgtgagatctagatccgagactccctcgttcgtctatccagagaccttgaatatggcgtcaactgccttcccactaaatataacgaccatgtcaagtactaagagtctaagaccactgctgagcatggccttctgtgataatctcggggttatacgttgctaaaagttgactcctagtcaccaaatggcatagttttataataacactgttagatccttgtaccagttactcagtgagatccttagattcacatagagttgtcccatataaagtaaaaaaaactagagacatgaaacatagatttttttttttcatcacgtgaaacatagataagaaaagaaaaaggataggtgttcaattatttaatttagtaggaaacatagaataaaaaaacttgctttgtttttcatattttctcattattggaatcactgtcttttcgaacttggtgacaatcttagtactagaaaacaaaagactttgaccggtctttggctcatctctttcttctcccctttctccaacacttatttctttctctctctagttcatgaattcaagattcaaagacacacgtatggctacctcttggtaaatccaaagagacacatat

SEQ ID NO: 12936 - DNA, 3000 bp, Unknown
  misc_feature (1)..( 3000): cDNA_ID_2709982_gDNA_ID_2214582_Annot_ID_135282 3000 nt of promoter + ATG
tccttctttcattttcctatatcataaatcttgagacatgcagggcccaaaattacggatccagcgatcctaaaaaaacaagccaaagaactggttagtacatggccagaagatctgcaaaacctcatcgatttaacacctgatgaaactatcagcagaactcctctagtagaccggtggctatggcctggcattgctcctccagcatcaaaaggacgagtggttcttgttggagatgcttggcacccaatgactccaaatcttggacaaggtgcttgttgtgccttggaagattcagtagttctggcaaataaacttgccaatgcaataaatggaggaaccgaatcaattgaagtagcaatggaatcatacgggagtgagagatggtctcgagcattcccgttgacagtacgtgcaaacctagttggcgcacttctgcaatgggagaatcctctagtgtgttccattagaaacaatattgtcataccaaagttactgaggcttggaccaatgcttgaacacacaaactttgagtgtgaacctctctttgtttctaaaagctgaatttcgtatatatagtgagatccattgaatagagagacttgaacaatgtataatcataggaacaatataaactctgtgattgaatgtaaaagaatcatacaatgtaattctagaagctaacatttgtgagaaaattgtctcaacaagaacagagtaaagcttgacctaatcaaagtctgtcttccaccatgtcaatttgtcactgtttgatctttgctactgtgaacaaatcagacaatagaaatacaagtcacaaccaaaaccttaaaaattacagagattctcgaacatgaacagaggatttgtctccgaggaattgaatttggttacctggattcgaaaacatccaaagtatgactgcgcagagaatgagtacgatcggaatgaaatggatagcgttctcggcggatctgaatcgcgatttgttcttcttcccgggatgagagttgggatcgtacctaggcaaaagaaggtggctatcatccgaatctgcggaggttttaattcgcggcggagatggtgatggcgaaggagaattcgctgagagttggtcggaaactatggaggcgctcgccgatcgacgcatctttttttcttctttctacttttacgcgcttcacaaggagaaacttctatatatagaatgaatatggtttttgaattgactgttttacccttttgaaagtcaaacttcacgcgcccttcccggcaaattagtgtcgagtgtcctaagttctcataccaagaacactcggaagaaattggaaaaaaaaaattggatttttttttatcaattttaaatttttaattggataaagaaaaacaaataaaaatgtaaaattaaacctttgtgtagaatgagtgagactgttttgagatcttggaagtaattgataacattttcaatgactggattagtttcactatgttacattaccttctttagaacaacacctccaagtgacgtttatcaaacctacagaaatctcaagtatgtgtttgagagattgttgactctcctcattgtgctatttggcattttggctcttttataattctcttcgattagtgattcttttgcattcttatcttatgtagacttattctttggttttactttagtattcaaatttgagatatccttcttcttttttaatctgattttattaaatcattcttaaacttaaaataaaataaatttctagttgattaccaaacccgaagaagaaaaatttacaataaaacgattttattggacttaaaatgggccatattaacttttaaaattatgaaattcaacaataattaaggtccaatcgcatatttatttagggtttcgggtatttcatctctataaatatgttatataggtttctcggaaactcagaaatacgccgcaccaacaccaaaaatgaagtttctagctaataagatataatctctctgatactagttttgtgttaaagtggtgaaggcgcaacataaattgttcttcgtttgatcattcatttgcgaaatcaaaaacgatcattccgctgcgaaatcataaagtaaatcgaaatctctatagattaaatatgcatgcttagattcagtaatattttattaaaatgtaggaatttcaacaatatatatcttgttgtttccatgatttctttttctttttctaattttctattttcttttcttataatctctactgccatcaaaaaattttttaacaaaatttagtctgtttatcaaaattttaatatagatgattcaatattttcatttttaagagcattttgtctgcaaattttaaatgatatacataatagatttttattaatctcaaaatttggttgtgaagttgtatctacttctgtgatgaagcacacctaatcaaagaagagtcaatctcaaaatataagactctttcttacttgtgtcttttcgtagtcatatttttaaaaatgtaaatatattcagcttttatatattcttcaacaaaaaaaaaaatataacaataagaagatttcttatttgtagtcttgtagataacgttctcttctattttttcttttaaaaaaaattatgaagttatgtgtagagattctattatgtttcatattgggaaacatgcacattttccagtccactattctttactctttataatgggtcaaaggtctgccgttacagttttaccttccttactagtttatatatcgcaattgggcagctaacattaaatggctatttcatgcacagtgaaagatggttagacgatcattcggagtttcgccaatgatctatacatgtttcattgatttcttgatatttctgctaattaaaattgcgtggatcacagtctaattcaatgtttatggcgtgacagcttatagattaatcaagcagatggctaggaagtccatacgggggaaggaagtggta

SEQ ID NO: 12937 - DNA, 3000 bp, Unknown
  misc_feature (1)..( 3000): cDNA_ID_2709990_gDNA_ID_2214582_Annot_ID_135284 3000 nt of promoter + ATG
ctcgccagcagactcacctgcattcattcttcgccatcatcatcagtagacagaaatgtcgacgcttatgcctcccatggaaagatttttcccagaaagcttttggtcctcacgcaagcccagccacagacacgatatcctcgccatcgcagcctgccccaccactttcaccctgtacaccatgctcagatctgcagctgccgcccatagctcattcccattaactttcactgacctccgtgaccgtgagtcatcatcattatagccctctagatccgagtgggtgactacaaccattgacccatcatcaaacaccactacattcccagaacaaacctgcttcacatttctcgggatcaaagctgaagttgcatcagttaagcaactctgagtattcagcaccttgacatggtagtactcaacaacggcctgcaaatacatcaacaatcagaagaagaagaataaatgactaaactctggttcatcggtgatgaagaatgggacccctgtcagataccttccattgggctgctgctaaaagaaccctgggcctgattgatctcacgtaggaatatgctgcttcaggtgtcatgtttttgtgttgaacctgtgttgaaaaggtatgatcagagaaaaggagaaaaagtgtctctgctcaaaatgtttttctgggatttattgcaatacaaaccaagtagcatatgacaatagttgtgctgcgaccccgacccgctttgcagtgaacataagtcgtctttccaagcgaagcatttccttcaaggagacaaaatagaatttgagatcaaatgaacgcgggttcggacaacagtaagctttttaataatggtcagtggcaaaaaacgtaaaagaataaaatgagaaggtacacttactatggataaattctacagcttggcatattgcttccatggaaggagcaaaacaataatctcttgtagcaatcaccaggtggtcaatgcagtaagacttccataagagtaagaaaattaaatgggccgggtcagtacatagaagaaaccaaaagacagaacggccacattaaataactcactttgtagagagacgatggaaccaaagtttcatatggctcattcagagtgatcactccacaaacaccgagctctttcagctgtggaacatcagatggaaatggaacagctcccagtaatataaactgcagaaaccaaagagagagagaagcataagcaaaagacccagaaccaaatccagaaaacatacttagaggagtatctacaagagatacaacaacaaatgaagacgattttacacaaaccatcaaaagcagcacaatctacatgatcaatgtatcaatttccactaaaacagctcaaaggacaatcaagattttacctcagccacgcgatcccaccagcgaaactcagattcgagcttattcctaacaacgttgtaaaccagagtaggataaaacaaagcacgagcaccaacaccaacgagtgccctctttgtagtcaacacaatcacgtttcctctgctcaccaataccgccttatctccatcatcaacgttatcctcaaccgatctctccctcttctcctcatccgtttccgtcagttctttgatatacatattcctcagtcaaagatctaaagatccaacacacaccaaaaaaaaaaacaatctattctcctgccaaccgatgccctaataatcaatcaccagtcttatatacacagacacgattattcacaatcctaattgattcgaagacaaagccaagaagaaagtctacacgtaatcgaaatcgcgataaagtcaagaggaagcaaccgaagaaattttgaattcaaaatcttcagggagatcaccaccatatttcgcctgaaacaaaacgatgatccgatcaaacgccggtaacgacgagacggagaagactgaaaaaaatccgatcaccgatggatataaatcaaattcgccaaatgaccaaagagaagaatcgccctaagaacaagttttcgaaatttggggatcgagaattttgtttttgcctaatctctactcaacctttaggttttctctttaagagaggagaaccaaaaaaagaaggatctcagtgttttcaatgagagggtttttgctaaactgacaagcgtttcacctcttattgtagcttttatgtgaaagtcaatgctctgttgacacgtgttttgccgatttatggagaaagagtcatgcgtcgcacaaggcccggataatattaggattatcctttctttaactcttttttttgttttggataagatcctttctttaatttttaagtatcaaattaatttaagttttttaaaagaacaattaatttacccatatttgaaatgaaaagaaaattatgtttttaattgttaaaattcaagacttcttgagccaaaaataaagttctctttgagcttaagaaaaagtatctaagtcctctaaaatattaaattcaaaacaaacaaaactagtcctgggtaatactttcgagtaaaaagaatttacaactaggctacaaaatagaaattactgcaaataggctttattatattggagtgatttactaaagtcaacaaaaaaaaatcaaaagtagctgagcaaattatctacagcccacgagagtgtagtaatgggctaatgggctaatggcaactatgatgtgtagatgattagagagagcttgattagttttaaaccaaatcttatcacgtctttcattagaatccgatataaatgataaatacttggaactttctattaccaatttttttgttacctttattacattagtctctctttctgttcaaacttgtaatcctaaaaatagaacaaaatcctctgttttttctgtaacgaattctttcttattgaatcacccaaaggtaagagcttttttagtggcttctctttctttgatttatccaatttttcacacacactcgagaatctgagacaatagagagaaca

SEQ ID NO: 12938 - DNA, 3000 bp, Unknown
  misc_feature (1)..( 3000): cDNA_ID_2712844_gDNA_ID_2214582_Annot_ID_135286 3000 nt of promoter + ATG
attgaaaacaaagaagattgattcgggcaaacctgaggagattggatcttgtcagggtgataaacttgagcccattgacgataagcttttctgatttcttcgtcggaggcctccggtgataaattcaggagcgcgtagagttctctgttgggtggtcccgtcggagctgcttcttggcccatcattgcttaagattcaatcgattcagtgattgaaatctcgatagagacagtcaaaggaaagtgatagaagaaagagaaagttccggtgccggagggttttaggggttttgcggcggatgaggttttttgacaccgctgctctcggctttagctcgcttgttgacgctttgacccttgcttgattcccaagtccattcttctttctttttcttcgtccccaattccctcgtaaattctacttttgacatcttattttataaattgttcaattttgacccatttccatatgttaatgggccttaaaatgtccataaggcttcggctaaagctacacattaatcttgacccacaaaacaatcgatttctaaagagattaagaagacaagattaaagaatgttggactaaacatatatccaacaatctcggagaaatagagtcataatcttctctttcaggcgttttgtcaaacttattgggctttctttggaatccatcttgaaaatagtttgcatgctaagatcttaacggttggaccaaactcgaatttgaatacctgaatattgtccgtttgataacaatgggttttgtttggaccgaattcagatgtgagattaagtaattctctagcctaatgtgttatgtggatacttgaaaaaaggtaatcaagtttgcatttaattgtaagagttaacttttgtcatatgaagatttcgattaagttgtgttttattgaagccttgaaatagtaggtactcctgtttttcatcatcgcaatcgcaaagattggctcatgaaactcattgtagcaactagcaacctttcgatacttaataaaaagaaataatgtcaacatggtctttaaacaataaaacaaaaatgtacataagtagaagtcaacagaaaaaggagacacttggttggatccgtaagcatctaaaagacaatttcagacaatttggaccgacgcggtttcaacacaagataagaggagtcgtgtcttgtttaatcagtcaacgtttactcgaccctttccttcctctttcccttttctctactttcttcccccaaatttctgttctaatatacgataaagatgttttttgttccatttattagttttgttcctagtttttatttataatttagtagtttataactatttaaaatgtgcagtattttaatttgttatattggttgattttttataaatgagaaaatacttgttgtttcttaatctttgtgattttagccaaaacgtttttaagaaaatgggatagaggaaatataatacagcctattgcatgatgaaatgatacaacacgtaatcttgatatgttgtacaatataaatatccatattgccatatacttaataaaaaaatacaagatgggttgttatgtattactccataaatgtgcatatttgggtacgtacagtcaacgttggatatctgcctaaaacatacaatgaattttattttcctgttaacctcaaaataagtggtacaaaaccaacgtgacaaggacgactattagaaaacgataacagttaatgtagttaggtataattctagtgtctgaaacgatctttccaataaaattatactattatgcatattgtactttgtattttgctaagtaattgtgaatcaaacgtaagaacattactttcctcctctctcctctgactaatatagggcttcttaccgtacagtcttgtggatgtgactcaaaacatctgtacaagaaatttgtgtattttctcactattcttggtccaatctgagtatttctatacagtatagtataattttttccttattttcggattttccattcacttttgttggaatttttttccagtttaagagatacaggaaaaaagttctcctcttaattactctaattattaaatttactaatcctatttcaattcctctcatttccagtatttcaatccactgatcgtccaatatgcaatatattttacctttttaacacacaatgttagtttcttgacagatttgactttgaattttggtggagattagtaaaagaattaaagaaatatgtagtggaaatataaaaaataatgaactgggatgagattacacaccagacaccacttgccaagagaacaacgggctcagtcacatggtcctaaattgaccatttccataatattagctgccaacaaaatacataaaataaaaatacggttactttcataactccccttttaatttattaatattttaaaaattaagcagaccttaattcatcatcttttagtgcgttacaaactaacagcgttacaaatctctcttagtccaaaaaatgtgactaaaagatttctcttttaaacccttaaaaatctggaatcaaaatcttttatattttcaaatttttttggaaacaaataagaatgtagaattcgatcaatatgaaagaaaaatgaacggtgttagatttgctttggaaatatgtaaactaacagtaattaacttgttttagtcattagcaactaatacagtaattaacttgtttaaagtaaaattagagcaacctaggaatatatgctcaactttttcgttttcttctaattgttaaaataatgttgtcattggccagtcgccattatacctttttaacccttcacagtctcccagaaacctccctttctctttgatacattctctgtatatatatatatacgcgtatgcgtttacacattctttaaaagtttcagattctagataaattcttttcatttgatttgttttagcaattcggacattgtacagagaaatcaagaatg

SEQ ID NO: 12939 - DNA, 3000 bp, Unknown
  misc_feature (1)..( 3000): cDNA_ID_3027141_gDNA_ID_2214582_Annot_ID_135287 3000 nt of promoter + ATG
ttatgctccggtcgccgcgtcttcaaacctcgatcttgaaccgtcaccaccgcgtttgcggtatctatcgccgtttcttgcggtggttgcagcagcagcagctgtctctctcgatacgccgtcgtttcgattatcataaaagatagaaccaaagacaagaacacaaagcctctctgcaaatccattcttgatttctctgtacaatgtccgaattgctaaaacaaatcaaatgaaaagaatttatctagaatctgaaacttttaaagaatgtgtaaacgcatacgcgtatatatatatatacagagaatgtatcaaagagaaagggaggtttctgggagactgtgaagggttaaaaaggtataatggcgactggccaatgacaacattattttaacaattagaagaaaacgaaaaagttgagcatatattcctaggttgctctaattttactttaaacaagttaattactgtattagttgctaatgactaaaacaagttaattactgttagtttacatatttccaaagcaaatctaacaccgttcatttttctttcatattgatcgaattctacattcttatttgtttccaaaaaaatttgaaaatataaaagattttgattccagatttttaagggtttaaaagagaaatcttttagtcacattttttggactaagagagatttgtaacgctgttagtttgtaacgcactaaaagatgatgaattaaggtctgcttaatttttaaaatattaataaattaaaaggggagttatgaaagtaaccgtatttttattttatgtattttgttggcagctaatattatggaaatggtcaatttaggaccatgtgactgagcccgttgttctcttggcaagtggtgtctggtgtgtaatctcatcccagttcattattttttatatttccactacatatttctttaattcttttactaatctccaccaaaattcaaagtcaaatctgtcaagaaactaacattgtgtgttaaaaaggtaaaatatattgcatattggacgatcagtggattgaaatactggaaatgagaggaattgaaataggattagtaaatttaataattagagtaattaagaggagaacttttttcctgtatctcttaaactggaaaaaaattccaacaaaagtgaatggaaaatccgaaaataaggaaaaaattatactatactgtatagaaatactcagattggaccaagaatagtgagaaaatacacaaatttcttgtacagatgttttgagtcacatccacaagactgtacggtaagaagccctatattagtcagaggagagaggaggaaagtaatgttcttacgtttgattcacaattacttagcaaaatacaaagtacaatatgcataatagtataattttattggaaagatcgtttcagacactagaattatacctaactacattaactgttatcgttttctaatagtcgtccttgtcacgttggttttgtaccacttattttgaggttaacaggaaaataaaattcattgtatgttttaggcagatatccaacgttgactgtacgtacccaaatatgcacatttatggagtaatacataacaacccatcttgtatttttttattaagtatatggcaatatggatatttatattgtacaacatatcaagattacgtgttgtatcatttcatcatgcaataggctgtattatatttcctctatcccattttcttaaaaacgttttggctaaaatcacaaagattaagaaacaacaagtattttctcatttataaaaaatcaaccaatataacaaattaaaatactgcacattttaaatagttataaactactaaattataaataaaaactaggaacaaaactaataaatggaacaaaaaacatctttatcgtatattagaacagaaatttgggggaagaaagtagagaaaagggaaagaggaaggaaagggtcgagtaaacgttgactgattaaacaagacacgactcctcttatcttgtgttgaaaccgcgtcggtccaaattgtctgaaattgtcttttagatgcttacggatccaaccaagtgtctcctttttctgttgacttctacttatgtacatttttgttttattgtttaaagaccatgttgacattatttctttttattaagtatcgaaaggttgctagttgctacaatgagtttcatgagccaatctttgcgattgcgatgatgaaaaacaggagtacctactatttcaaggcttcaataaaacacaacttaatcgaaatcttcatatgacaaaagttaactcttacaattaaatgcaaacttgattaccttttttcaagtatccacataacacattaggctagagaattacttaatctcacatctgaattcggtccaaacaaaacccattgttatcaaacggacaatattcaggtattcaaattcgagtttggtccaaccgttaagatcttagcatgcaaactattttcaagatggattccaaagaaagcccaataagtttgacaaaacgcctgaaagagaagattatgactctatttctccgagattgttggatatatgtttagtccaacattctttaatcttgtcttcttaatctctttagaaatcgattgttttgtgggtcaagattaatgtgtagctttagccgaagccttatggacattttaaggcccattaacatatggaaatgggtcaaaattgaacaatttataaaataagatgtcaaaagtagaatttacgagggaattggggacgaagaaaaagaaagaagaatggacttgggaatcaagcaagggtcaaagcgtcaacaagcgagctaaagccgagagcagcggtgtcaaaaaacctcatccgccgcaaaacccctaaaaccctccggcaccggaactttctctttcttctatcactttcctttgactgtctctatcgagatttcaatcactgaatcgattgaatcttaagcaatg

SEQ ID NO: 12940 - DNA, 3000 bp, Unknown
  misc_feature (1)..( 3000): cDNA_ID_3027141_gDNA_ID_2214582_Annot_ID_186531 3000 nt of promoter + ATG
ttcttatgctccggtcgccgcgtcttcaaacctcgatcttgaaccgtcaccaccgcgtttgcggtatctatcgccgtttcttgcggtggttgcagcagcagcagctgtctctctcgatacgccgtcgtttcgattatcataaaagatagaaccaaagacaagaacacaaagcctctctgcaaatccattcttgatttctctgtacaatgtccgaattgctaaaacaaatcaaatgaaaagaatttatctagaatctgaaacttttaaagaatgtgtaaacgcatacgcgtatatatatatatacagagaatgtatcaaagagaaagggaggtttctgggagactgtgaagggttaaaaaggtataatggcgactggccaatgacaacattattttaacaattagaagaaaacgaaaaagttgagcatatattcctaggttgctctaattttactttaaacaagttaattactgtattagttgctaatgactaaaacaagttaattactgttagtttacatatttccaaagcaaatctaacaccgttcatttttctttcatattgatcgaattctacattcttatttgtttccaaaaaaatttgaaaatataaaagattttgattccagatttttaagggtttaaaagagaaatcttttagtcacattttttggactaagagagatttgtaacgctgttagtttgtaacgcactaaaagatgatgaattaaggtctgcttaatttttaaaatattaataaattaaaaggggagttatgaaagtaaccgtatttttattttatgtattttgttggcagctaatattatggaaatggtcaatttaggaccatgtgactgagcccgttgttctcttggcaagtggtgtctggtgtgtaatctcatcccagttcattattttttatatttccactacatatttctttaattcttttactaatctccaccaaaattcaaagtcaaatctgtcaagaaactaacattgtgtgttaaaaaggtaaaatatattgcatattggacgatcagtggattgaaatactggaaatgagaggaattgaaataggattagtaaatttaataattagagtaattaagaggagaacttttttcctgtatctcttaaactggaaaaaaattccaacaaaagtgaatggaaaatccgaaaataaggaaaaaattatactatactgtatagaaatactcagattggaccaagaatagtgagaaaatacacaaatttcttgtacagatgttttgagtcacatccacaagactgtacggtaagaagccctatattagtcagaggagagaggaggaaagtaatgttcttacgtttgattcacaattacttagcaaaatacaaagtacaatatgcataatagtataattttattggaaagatcgtttcagacactagaattatacctaactacattaactgttatcgttttctaatagtcgtccttgtcacgttggttttgtaccacttattttgaggttaacaggaaaataaaattcattgtatgttttaggcagatatccaacgttgactgtacgtacccaaatatgcacatttatggagtaatacataacaacccatcttgtatttttttattaagtatatggcaatatggatatttatattgtacaacatatcaagattacgtgttgtatcatttcatcatgcaataggctgtattatatttcctctatcccattttcttaaaaacgttttggctaaaatcacaaagattaagaaacaacaagtattttctcatttataaaaaatcaaccaatataacaaattaaaatactgcacattttaaatagttataaactactaaattataaataaaaactaggaacaaaactaataaatggaacaaaaaacatctttatcgtatattagaacagaaatttgggggaagaaagtagagaaaagggaaagaggaaggaaagggtcgagtaaacgttgactgattaaacaagacacgactcctcttatcttgtgttgaaaccgcgtcggtccaaattgtctgaaattgtcttttagatgcttacggatccaaccaagtgtctcctttttctgttgacttctacttatgtacatttttgttttattgtttaaagaccatgttgacattatttctttttattaagtatcgaaaggttgctagttgctacaatgagtttcatgagccaatctttgcgattgcgatgatgaaaaacaggagtacctactatttcaaggcttcaataaaacacaacttaatcgaaatcttcatatgacaaaagttaactcttacaattaaatgcaaacttgattaccttttttcaagtatccacataacacattaggctagagaattacttaatctcacatctgaattcggtccaaacaaaacccattgttatcaaacggacaatattcaggtattcaaattcgagtttggtccaaccgttaagatcttagcatgcaaactattttcaagatggattccaaagaaagcccaataagtttgacaaaacgcctgaaagagaagattatgactctatttctccgagattgttggatatatgtttagtccaacattctttaatcttgtcttcttaatctctttagaaatcgattgttttgtgggtcaagattaatgtgtagctttagccgaagccttatggacattttaaggcccattaacatatggaaatgggtcaaaattgaacaatttataaaataagatgtcaaaagtagaatttacgagggaattggggacgaagaaaaagaaagaagaatggacttgggaatcaagcaagggtcaaagcgtcaacaagcgagctaaagccgagagcagcggtgtcaaaaaacctcatccgccgcaaaacccctaaaaccctccggcaccggaactttctctttcttctatcactttcctttgactgtctctatcgagatttcaatcactgaatcgattgaatcttaagca

SEQ ID NO: 12941 - DNA, 3000 bp, Unknown; identical to SEQ ID NO: 12937
  misc_feature (1)..( 3000): cDNA_ID_2709990_gDNA_ID_2214582_Annot_ID_186527 3000 nt of promoter + ATG

SEQ ID NO: 12942 - DNA, 3000 bp, Unknown; identical to SEQ ID NO: 12935
  misc_feature (1)..( 3000): cDNA_ID_2709971_gDNA_ID_2214582_Annot_ID_186521 3000 nt of promoter + ATG

SEQ ID NO: 12943 - DNA, 3000 bp, Unknown
  misc_feature (1)..( 3000): cDNA_ID_3027113_gDNA_ID_2214582_Annot_ID_186520 3000 nt of promoter + ATG
ataatagtttttgctgaccaccacttaattatttttgttttctgttaggttgccaaaacatttgatgttagcttgatgggagcttcatcgaggtcgtgtaaatatgttttgaacacacttatgcaggtaacttcgtgtgaattagtgatgctgctcttcttcattagctggctagcccacttagatttgtttgtgaagttcactactcataagtatgtatttttgcagacattccaaaataaaaagcttgcccatgcagtcaaagaagggactcttgaaagccttataacagagctcttgctttggcttctggatgaaagagttccacgcatggaagatgggagtcaacttcttaaagctctgaatgttttgatgcttaagatcctggtcagatattcgttccatgctaaaggttttcatcatatgtggctatgaagttctctgacttcattatttttatttcttgttttatttaattcaggataatgcagatcggacatcttcgtttgtggtgcttattagcttgctacgtcctctagatccatctagatggccttcacctgctacggctgaagtttatgctgtccggaatcagaaattctctgatttggtagttaaatgccttattaaacttacaaaggtattttaggacaatcattgttcacataactcaagtagttgttacgtacagccctactgtctattatgcaacacttgcctttcctacttgctacaatcacagtgtcaaattgtttagtattgtatatctgataattgcttgtccttgttaagctcctccaaagcaccatatatgaagttgatcttgatagacttcttcagagtatccatgtatatctgcaagatctgggaatggaagagatacgtaggaggtacatctctttaaatgcactcttagaaattttgcaaatctatgtctgtttattatgtggagatttttcgtacttggcaatactaatgcattctcggttggtattttttccaatgaaaagagctggggcagatgataaacctctgaggatggtgaaaactgttctacatgaacttgttaagctccgcggagccgcaattaagggccacttgtctcttgtccctattgacatgaggccacaacccatcattctcgcttacatcgatctaaaccttgaggtgagacctccttagtcgtctaacttcatgtccagaaattttgacaaatttgctgaagctgagggtttggtcaaagagcgcatccaaactatttgctgttttactatgttttgagaaatttagacgccattggtagtaactatttaaatacctgcagactttagctgcagcaagaatgttaactgcaacaggtcctgtgggccaaacccattggacagattcaacagccaacaatccttcacctcctgcaaattctgccgatgttcagttgaagcaagagcttggggctatttttaagaaaataggtgacaaacaaacttccacaattggtctttacgacctctaccacatcacaaagtcatatccaaaggtaatagatatgactatgtatttcaagtctcaatgtttcctgttcttcatgaacaaacgagccaaattgtatgtacttacaacctcatcttaatgcttgtaggttgatatattttcccaacttcaaaatgctagtgaagcgtttcgtacttacatcagagatggtctggcacaggtctgtaactagtctcctagctttttactatgatttcgataaaactcaagttttttgtcttgaagttttgcaatcggttctgtaggttgagaagaatgcagctgcgggaagaacaccttcaagcctaccgttgtcaactcctcccccttcgtccttagctcttccatctcctgatattccttccttgtcctctttagatgtgaagcctttgatgaaccctagatctgatttatacacagacgacatccgagccagtaacatgaatcctggaggtagtttcctagatccttatccttctttgtccttccttgcggtgtttatatatatctgttaaaaacaaacatctttggcagtgatgacagggacgctagatgcaatcagagaaaggatgaagaacatgcaactggcttcatcagagccagtaagcaaaccgctgatgccaacaaacgataacttatcaatgaaccaacagagcgttcccccgagccaaatgggacaagagacagtccacacacacccagtggttctcccaatggatgagaaagcattgtccggtcttcaagcccgaatggagaggctcaaaggtggatcactggaacatatgtagaactagagaccccaagctttggagtctgaagttacataagcaaattcgccatttttgttacttctctccaattaatgtagtagtaaaatacttttcttttaatatacaaacatataagagagagcaatattttatggtgaagcggctagatttcaatggagttagtgtgtatagtggtgggagagtctgggagctgatggtgagtgtgccagattctttttaatatgagacaaaatattattctttctatgcttgtttacatctttttttcaaccactagtagaaacctgaatattctctcgactctgtttagatatgattctgatgtagttggcatatcttgtgtaatccctccactctcaaatttctaacaattcttaatttttgggttgaaacggaagtaatattttgttcttccatctaaccaaaggtcgtatatttgcaaaccaattgaagtagaaattaacttaaaccgggaactggtttaagagatattaatatatgaccgaagacattgggtttaaaaagtcagaataataaaaagttggcgtagtctaaacgccgacccagaggccctctcatacctttaccagtgcctatatatatatatatatataaacagactaattactattccccatcgcacagacccccctaagaatccgagagagaagaagagata

SEQ ID NO: 12944 - DNA, 3000 bp, Unknown; identical to SEQ ID NO: 12934
  misc_feature (1)..( 3000): cDNA_ID_3027169_gDNA_ID_2214582_Annot_ID_186519 3000 nt of promoter + ATG

SEQ ID NO: 12945 - DNA, 3000 bp, Unknown
  misc_feature (1)..( 3000): cDNA_ID_3027186_gDNA_ID_2214582_Annot_ID_186514 3000 nt of promoter + ATG
atatttttttttttgaaatcggatttaggaaagggtattgtaatgatgatgtgacacaaatatgaaacttgtactaggttaacaagttggtaccaaactatatatataatattttaattagcagtaaaacaactacatgaatatcaaattattaagattccgacaaactttttaggttaaatattcgagttgtgaaaagattaatatcacttgtgcgctggttctttattatttgcagacatgtggggatgtgttttcggcttttcaatggaagagactaatattcaagaataaacggtttcgttaacaaagtttgtgtggttttaggtttcgaaggtggagactctcttgatctcttcagtcttcagcaaattaaagagtcaatgatatacttaaaagagttgttgaagattagcaaatatcaatctcagttttatgttgctcttggatttctaaatcggttaaagggtcttttccaagggaagagaaatgctatcggagtatatgtatatagttttcatgggtttttgttattaggctttatttcttgaggccctatttggtgtttttgggctcattttccatatctccagactccagtggtcaatataacttgcaaacacatactacttgtacgaagaagtttaattttcccataaccaatcattaaatatattttcaaatttcttaattgctgtatctttctttctaccattgtctcatgttaagaatatcttggtcgttgattcagtgtttagaggaatttgtcaacaagtttatatactttcaaagcttctcgttctgcaatgttttcattgccttttcaactaaagaacgttttccgggatattaagtaggagtcaaattagagttgaggaccggtttgattccatcatggtatgaccatctgcgaataaatattagtttgtggacttttgataaatgatctcatcatttataatcatcacaaactgcgtattcacttgctaattgatatcttaagattctaagttttcggcaaaaatgtatattttaatatttagtgtagattctgttctaattttgatttatgattcctaaactatatttgaaatctatactgtaaggagaaaaaaagaaaagaaaaagagaagataattctaccgaattctgtaataagtcgcctaactctactaaaatgtacattatctgtttgatggtgattaaacttcagtttggattaaatgtacaatgcaaatttttgggaaaaatgtcaattaatcccccaactttcaaaaaatggtcattttatacatcaacttcgtatgcggccgtttaaaacatgaactaaacgttgactaacttttaaaacataattattcgttgaccaggccaaaatagacatgccgttatcagtcattaacggaacttctaacgtccgttatcatccgttaacgactttattagtcaagttttaaattgtggccattttaaacatcgactttatatgtgaccattttaaacataaactaagcgttgactaccatttaaaacatgaaaaattcgttgaccaagccaaaataaacatgttgtcatcattcactaaaagaacttataacattcattatcacttgttaacgactctattagtatccctagttccccaaatttatttctacaaccgctcaaacaagacgaacaattttataatgagtcttcaatttgcttccatgattccttttaaaatttaaaacaaatatataaacgaaaacacctttatttgcttccaattactggcactgcgattatctctttatcaaactatgttcttgggttctgcttaaaactttttgatatgaagatttcatatgggaaaaatctttatgttctttcgattattctcaaacgacgttgttttggacagattaacagtcattaacggggttttaggttctattgataaagacatgtctattttggcctggtcaacgaatttttcatgttttaaatggtagttaacgtttagttcatgttttaaatggccacataagaagttgatgtttaaaatggccacaatttgaaacttgactaataaagttaacggatgataacggacgttagaagttccgttaatgactgataacgacatgtctattttggcctggtcaacgaaagatcatgttttaaaaattagtcaacgtttatttcatgttttaaacgaccacgtacgaagttgatgtataaaataaccattttttgaaagttaggagattaaatgacatttttcccgtaaatttttggacatattatatcaacaaaataatttcctcaaaagtatggagagttgacatgttcggacatcgtgggattggggaaaccggaaaacaaagtcaaagcaaccagagcattgcattaagatctctctgtctttttgtgtctttgcgtatttaatttttgtttttccaaattcattcaataaatatacatctaaatttacttaactagattaacaaacagatataaaaatattactacctttattcttaatatcttatccatttttttcttaagtgtaattataagtcttccaattgtgatttcaattcatgatctcctctttctacaaagtcttaaaagaaaaaaaaattgctatgaattgatatacacaacaacatgtccaaacttagctaaccatttgctaacaagaacattgttttataatgattttaaatgccactattttgcattacttgagagagttggggaatcaaacaaatgttgaataaagaaacaaattaataatgtaacccaaatacaatcgttaatgagcgaagctgctgaaagagaagacgccgaaaacgaagttgaccagaacctaccaaacgatcaaatcgatcggacaaagaggaagaagaagaagacaaaacccgaacaaaagagaaaaggcaccaaagaataaaacttttttgttaatggagatttgaggaagacgaagaagagattgaaacattgagaataatg

SEQ ID NO: 12946 - DNA, 901 bp, Unknown
  misc_feature (1)..( 901): cDNA_ID_2709998_gDNA_ID_2214583_Annot_ID_135292 3000 nt of promoter + ATG
ttgcttagtaaagtagagaagaaataatcgtcatctttatttaaaattgatgactgtagtataagcaattaagcatctcttgactacattattgaaatatactccctaatatacacatggctttgtgattttattatagaaaaaagtgctctataatagatgataatccagaggagcatattcgattctaattaggtccattactgtcagattttccagagatatatatcattaccgtttatgcttttgcgtgacctttaattatgaatcacattgagtaaaataaaacattattattatgaatccgatttctctttgatcaattattattcaaattctaccttgtctaaattattattattttcgttagtcaaataaaagtaattttataaacggacagatattaaagccatgaatgataatatagatcgcattcaaaaccgcaccgcaacagtactgtaacaatatcaaaaattatatatatatatatgtatttatgtatttttgttaatatttgaactgtaccgcatttctccaataccgcaaaacgcagtaaccattcgaattaaagcataaagacaattcaaatttggtattttcatatcatttttatttttgactcgttttatatacaattgttttttgtctgaacaaattgacttttaaatgaagaaaattaggagaaataaaatgaaacggaacgagtcatcatcataaacctcgcgtcccttttttttttttgcttccttcactttcttcttctctgtttctcgtgaattttcccgtgaattttcgcggagcttttctcgggaaaataatctaaagaagattcgagattaagacacgtcatctccggtttcgtagagagatctgaagaacgagtctcttctcttctccgatg

SEQ ID NO: 12947 - DNA, 3000 bp, Unknown
  misc_feature (1)..( 3000): cDNA_ID_2712882_gDNA_ID_2214583_Annot_ID_135297 3000 nt of
acgaagaggtgtgagtgttgtgtgatgcgcggggccatgagggaggaagcaatattttcatcagcccgagaatatgatcaccacacagcttctagggctttttcaagaaccgtcggtaccattgtcatctttgttggtgtctttggattcaagacttctatgtcttacatgtgaaacttgtacaaagagggtgtcacagcctcccattgaataacaagttgcggctcaaacgcaagccaaagagacgacatatgcaattaagacccagctgagtaacgtcaagaaaaactttctaaagactagttcatgatcctaatataaaatattacttcttctgtttcaaattagttgtgggttaaggtatttacacacatattaaaaaattatcaaaattttatttaatctacctcttttatataacagtatcattaattataaccaatagaaaaatatagggttaaatataattggtttaaaaaatattaaatacatttattatttgcatagaaagttgaaaacaatacttattttgaaaaaaaataaaaactcttaaaactacatttatatagaaacagaggaagtactaaatttatcacaaaatgcaaaaaaacaatctcactaagaggcaatgttaaatcatacaatccaaaacaaggcgtctttgttgttgagcatatatccacgactgtcacatatgccaaaagaccaatgtctttaaaatgtttgacaatttatgaatatattgcatacttggcaatattattatatccacgactgttacatatgccaaaagaccaatgtctttaaaatgtttgacaatttatgaatttattgcatatttggttcaactttatgctaatttttactaaactgtcccttgaccgacttcaaaatatatgagtacttctcttctattctttccaaaaagaacaacttatacattctatatatgtttgcccaaaaaagaaaaatacattctagatatgtatgtttatctacatagtctcgatttttatatagattattttctgatttttgctgatgttttatataaaacaacagagaggtaaggaacaaaactatattttccaaagttggacgagttcattcccatcatcatcaaccaaaaagagtgataaacttcggatacaattttattaatatcttatatatttattttttgaattagtttcgtaagaccacactccaaagattcatgtcttttcatataaccagttagaaattgagatctttgtacttacatttttatttgatcaatcaaatcttcttgataactctaaattgttgtgcaatggtctctcctttattgcaatgttacatattcctagtctctattatggattaggtttataccaaaagttaccaattgcaaacaaataataaatcaaagaaaatgtttgaaacataggaacaagtaatgcatcataaaacctaaggctaacttcaaatctctgtgatgatttcactctgtttcataatcttcctcgtatggtaatcgtcgacataaatgacaggacctctcacgcttaagccacttaaaggacggcggattcagttaggttttaggttttgattttgattgaagatcgaagaagaagaagagacatgcaaggaggaagggggaaataagagaagaaacaaatcactcaccaatggagaagagaaatcgccaaatcggaatgatattgctgtcgttgttgtggtcggagaagatgatttcgagatcggggttttgggttttggttttcgcttaatatcgaaaaagaagaagaacaaaagtgaccgcaaaaaaacctagtacttatttatagtctctttgtaacttcattttgagttttatttcacttaattcataattcttttttcttagttttttttaaggaaaatatgcttttaactttgattaaagataattagtctttttacttaaaaatagagtcattctagttaaccattggtaagaggagtcattctatttatttttgttaaaattatagtcaatttaagcaaatttcagttaaatatcataaaatgcaaacaaacaatctcgcgaagagctatgttaaatcatacaatctaaaacaaggcatctttgtttttgagcatatatccacgattgtcacatatgccaaaagaccaatgtctttaaaatgtttgacaattaatgaatttaatgcacatttagttcaagtttatgccaatttatactaacttcaaaattcatatatgaatacttctcttccattctttccaaaaagaacaacttatacattctagatatgtatgtctatctacatagtcttgatttttatatatattatttttctgatttttgctaatgttttagataaattaaagaagtaaggaacaaaactacattttccaaagttggacgagttcattcccatcatcatcaaccaaaaagagtgataaactttaaatacaatttcatttatatcttcttatttttttcctgcatacagaaaaatatatcagataaagaaaaacctttttttttgtggtcttagatactattattcttaaataaaactccaaaaaataaagtcaaattagatatgtagtgcaaaggcttgttgtttattaactttacttgggccaatatgagattacccaaagaaacatacttggtggtattaataattacaaggcttttagcaaagatgtatatctaagcgcattgaatatacaatgatttggcccaaaaggaccattaatcaaaattatggcgcactgaatatacaatgatttggcccaaaaggcccattaatcaaaattattgcgcaacgaggtcaattttttttttggcttaattgcgaagagaagcaaaacagaacaaacacaaaagtcttcgacgaccaaagaacaagatcatcctctgatttttcagacacatatttgtaatttataaagtttgtagctttttccttagcttgagattacacgaagaagaagaagatg

SEQ ID NO: 12948 - DNA, 3000 bp, Unknown
  misc_feature (1)..( 3000): cDNA_ID_3027190_gDNA_ID_2214583_Annot_ID_135300 3000 nt of promoter + ATG
attccaaatgaagttccataatattcttcggggtgtagaatagaggtgttttcttacaatttaggacgtctatactagtagctatgattgaaaccaagacaaatccaacaattgtggtccaaaacaatattgtacattgcttaaggaaagcgttgaagataataaatcagaattaaccaaaaagaaagaaaaataataaatcattgttatggtcgtcttatggatcctagttatatacgaattgagttttcattcatagttgagaacgaattcgtttgctcgcgtgtgagtttagatcgtggttgtttttgtttgatcgtctactagtgttaattaagatcattatttcttaaacccttgaatggttcttctaaaacctatgcaatgaccgtgaaaacgttgatgatattagttttaaccaaagaaatgttatgctaataatgatattgtgatgttaaattaataaagaaaaggttatgcttagcatgatcccaagcgataattcgtgtgtcctatcattaggtttggaaaaactctaccaatcatagacgattagaccagtatagttgattatagttttcagaattcagatttcagaccaaagatagagttgtggacgtaggtttcttgatttttgttttgtttctgtttatgtttttttgtcgttatacatggataaaaaaaattccaaccaatcgttaccttgagatgtgtagttggacttttattgcctcatcaatacacttatacaaaaggttcaattttctgtctaattatggacatgtttatttcaaatgtatggtaatcttccaacacttataataccataatgaaaaatacttctgtttatatatatattgaactgagattcaattagtgccacccatgtgacctgatggactctccgtagacaaatgtgggggcaattttgttggatcaaccaaacccaacatttattttatatctgatttgaagattacattagtaaataaacaatggttagagtcaagtttatacaaatatatgggacccaactaataagaaaaaaaaattattgacgtcagatatatactaataaagtatataacaaaggaccctcagtgcatgtaattaatatatattttccaataaatatcaaactatagattttctaatgtatttaatgttattatttctaactagtaattaattgataatttgacaaataaatttttgtttcacattattcttatataaaactgtaaatgatttgtagcaaaaatacaaaactgtgtatataatatactttataaatagtttctatgtattggatccaagtaggatttcgaagactttgaagggcacatctttttcaaagtttacttatacatatttaatgtaagataaagtcattgtttatatgtttttttctagaacacttaaatttccacaatatgataatttaaattaattgaattttgttttactttggttggtttgtggataaaatccaaatattacagtcactatctttcgacgtgtctcacttgcaacctaatccttttctggaatgtagctttttttttgtttgtcaattttatttctttctctcttaatccataaaaattttaggcatttttgtattactgtcaaagaactgattagctatgtcttctatatatctaaaataaaccataagaatcatagttcatactcattatggtattcttaattttctgaaactatcgataaaatgttaaaacgttatatacaaaaaaggactatcaacgtagcaataaaatgaatttagacttatatgaaagctaatggtgacgaagaagttgacggtgatgccggtcatttgggtcggtggtggttccgtcacggagactttgacggtgcattattgacgtcaacatgaagtagctctcacaaaacacaaaaaggaccgtttagtttgctagttattaaaaatataatgggcttcaagcccataataacatgtctttttacaaaacagaagccacgtattatataaacccattttttaatatataaataattgggctgtacttgggcttggacggtttcactcttttatttttatttttttaaagttttttctatattagtaatgatatatttacagtggaagcctttttggcggaaagttctattaatacttatacacaaagaaattgaggttcaagtcccaaatactgtgatttattagcagataatggagataagtgtgcaagagatctcgaacgatgtacaattataactgtttgccaggatttgaagatctttcaaggtgtccatcaaaagcatgaagacggagaagaaagtgtcgtctttcgtggatctaataaagatcgaaacaaattacccataatagaatcggctatataacggttctcataaatcataatttgcaataaataataaatctaaaacggtaaaagaaaaatatatttacatgaaaataacatgtcattttaaatatttccagaattaaaatataattccaactgtcaacggtccatatacgttatctatagactatatagtacataaattattttaaaaagacaaataatttgtttcgagaaataatgttgctgtctcgtcaaaattggaaaaaaaatacattttaaaatacagagaaacgaattattgagaggagaaatttagagaccattcaggttttgattgaagaaaaaaaagattcccattttatcatctttttagtttttagtgtcaactctccaacaaaagcaaaaaccttaaagaattttgttctttttttaaagcaaaagaaccaaacatggtttcacatgaatcccaatttcattgcaaagcataactaaaaataaagaagaagactttttggagatcgaatctgttcatgttgatgggttttggctgagctttctagagatagagctagagagtactgggtctgtgtaaagttgataactttttttggtttagagagagaaaggacagagctttacagag

SEQ ID NO: 12949 - DNA, 3000 bp, Unknown
  misc_feature (1)..( 3000): cDNA_ID_2710027_gDNA_ID_2214583_Annot_ID_135301 3000 nt of promoter + ATG
aaccccaacaacaataatactcatctttaccaggtatcaacggaggcaactgaggaatactcgcagcgtgaaacgctctttgacagttttgacatctaatacaatactcttgataaaccctaggatactcatgaagactgtaacagtacggacacgccgtccaaaacgtagacatcttctcattcgttgttgttttcttcttcgatttctgagtgttgagatttactttagtgaagatgagattcaaatctccatcgaattgagatttcttcgtaggtgttgatagaacttcccatgcatcaagcacgaatctgaaagcttgatcggcgaaagggaaacggtttttgtcagggtggagaagaagagcaagacgacggtattgtttcttgattagatcgttgtctgttgatgattcagttagatcttcgatctgaaggattttgtaccagtttggttggtttttgatacgattctctggtgctgatgagagtaagacatcgacgacggcgaggatttgatcggtgccttcgaggagtggctctgtctcttgagctaagattgcaaactcttttgaaccgtttagatctcgtgactcgagaagcttctccgcgattccgagaagacgttctgcttctgatcggttagggttgttgtctcccatctttcttcttccgtcggcgatggcggagaaatggtgagcagatctaaatattatcgcctcgacaagagacgatgaaacaaggctctgattggctgtgtgtaaaaatggtcgggggaaaaaaaatagtaacattggagtaaacggaaactaaaactttatttgttaccaaatttatttagtaataaaatcatttcttcatttttatgttattatttttcacaattttattttatgttattatttttcacccttttataatgttacctacttacaattcgtttcctatttcgccatatttataatattgcaaataaaatccagctttgtgtcaccagttacaaaaataatatgattatatactttattggttttattaacactacattaaaaaggtaaataaaaggaaaaattactatagtatattggaaataaagtcggtatttgactcactagagagttataatttataaatgagacataattattgtttattcatcttattcagacaacataactaaaaaatatatggtcaagataatattaaatgttttaagaatgaaaattttctagagctaagaatatcggaaataaagttagacgtattatgtttaacagaaaaagaggcagaattatggcagttagctcaatttgagctcaataccaaaaataacggttccatgggatcgaaaaaacaaattcgggttcagaatatatcacacgataatatttattctggtttgcgttgttttgtggacggatcttggaaaggaagcgataagttttctggattagggtggttttgcagatcatcaaatggagactcgccaaccatgggagctgctaatcttcgtagaagtctttatccactccatacagaagtcgaagcactactttggtcgatgaagtgtatgattggtgccgacaaccaagaagtagcattttttacagactattcagacttggtgaagatggtgtcttctccaaccgaatgaccagcgttttcaacttatttggaggaactaaagaccgatataaggaggaattcacaaagttttctttatctttaatttctcgaactgcaaatgtaaaggcggacaaattggcacgaaaaattcatattgaaccgcttcatgtcacttttataaataattttcctcacaattggctcttttgagctctaaataaaatctgttgacaaaaaaaaaaaaaaaatcagaaataaagttcatctatgactacctaccaaaacaaaagttcatctttgattcactcacaaaataatacaaataaaacatgaaaattataaaaacatttaatattatctcttaccataatttatttatttgttgtacatagtacaaataaaatggaaataataattattttttatttgtaacgtttgccggccgaataaaatattaaatttatttgcaatactactcacaacaaactttacaaataaaacatgattatcgttttttcttttcgttcattcaaactataaacaaaagcaatgaaagcatgataagaaatgatattaaatgtttaaaaaataaaatttgatataactatattattggaaacaaagtccatatttaagtcacctataaaaaagcatgatatgaaataataataaatgtttaaaataataatataatatctaatggtatttgaaataatgtatgtgtttgaagatgttataaaaatgttaaaaataaaaatataattatcaatattgataataatattcatattgatatgaagaaatgatattatttccaactacaatttatttacttttcaatgtgatgtgaataaataaagaataatcatgttttagctaatgtttcaaaatagaaaaattaatataaccaaatactgtaacctaaaattgtaaaaaataccactctagtaaataccaatattaccccggttagctgctactaacattaagggtgaagttgtcatttgatacagtgatcacgcacttttcacttgtcttctttattagttttttttccttgttttttaaagacatcacttgtgaccaaaaaacaaatccactaagaaagaaaaacaaattaataaaaaaaaaagatcagaaattagtttgtgcagaaatcgaattggagaaaccgagtaactatggtagccacagatgagttcatcgtttttgaccagatctgattgttttcgtctttgccgttgaaataatcctccgctccttcttctcatcgatttctccgatcgcgattttggtttctcgctctcctctctcgctgtggattttgactccgagagaaggtttgattttcggtggatttcatctgacagacatg

SEQ ID NO: 12950 - DNA, 3000 bp, Unknown
  misc_feature (1)..( 3000): cDNA_ID_2781846_gDNA_ID_2214583_Annot_ID_135304 3000 nt of promoter + ATG
ccttggtgccattgtagagatcaaccgtcgtgggtttaccagccatcagtttgtgcccaacggtcccagccacagagtatctgtaaaaaacggatccataaatggatgaaaagagatacaatttcgtgttagatgctatgctaggaaaaaactgaattgctaataaaggggaaacacaataggtatagtacccgggtaatgcaacaagattcaagggagaaggagcccagtgcttgaacacttcaagtgaaaagccagcacaaagcataccaggtgtggcaaagagaacacatggcccaggagcatgtataagagatcgatcgaaatctttaactgcagaatgtgaaggtagtagttagaaagcaagcagagttgtacagctaaggtagtggataagaacaaaaaatggacgcaaaggatgtattagaaccactagtttggttcttatttttcaagcacatcagagtttcggttccatatgatataaatttcatcttcaacgttctaaagttatttgcaaatggtagtacacataccattcttaaaatcaaatgggttatgcgtattgtgcttttctttaacgttctggcttgtccagctgatgagcattttgtaatacatatttgcttggatggtcaaacctgcaaaagtacaaatttatcttcagggacagcaattttcagaagatagagatcactattcatgaaatagagtcacgactttgttgagctgactaatctgcagaattgatttcatatgaggattggtggtgatttaacagacctgatgagaagtaaattggaacctttatattcatgcgttcccagtaatcatcaagcagcatgcagagttcctgaaaaaggaaacgcaattgtcaatgagacataagagaagcaaagacaagtttaagtaactgacttcaaagctctgtaagaagacagacctgagcccttccaagagcaaatgaaggaatcagcgccttccctccgccagcaacacatttatgaacctggaagagttttctgagatatcagacaattaccaaacgaaagcttaagcatttcctgaaggggtatattgatcagaaacaagccaaaggtgatgcgggtaattataatcaaaaaccatttaagaacaaatttagaaaccatgtgttaatagttacaagtagacatacagcttgaagaaactctctctcccggggatattttgagccgcgaatggtagttgcatatgtggacctaaaacggcatagttaaacctatatcaggtaaacttgttctttctaagtttgttgaaaaataccagcgaacaagtttgtatttgttttccatactctgaaatgagaagatccaactggagtctgtcaattttagcagctcctagatgtctatctgtcgtcatattgtaatctccagtgtacacaatcgctgcatctcccatctttgcataaaccatcactgctccaaggaccttatgatcaatacaaaataagctttaaaaaatacagaaactctgaatataaaaaacacagaaagaaattcactaaaaccagaacgaatgtcttacatgccctgcataataagcccggatttgaagatcttcatcaacctgaattgtttgcttcaaatctattgcaattactacatataaaaaaacaagaggaagtcaagttatagacactgcatctgaattcgtgcacaaagacctcaaatgaactaaatccaatattcaagtaccttttttcatgcagtttgcgatatgggtagtggtgaatagctcctcctcgcctcttctatccaccatcactcttcggtagtcctcaagcattaatggagacaaagcctttgtgggatactacaaaagagacaaatcaaagtaaacaacctttaccttcacaaaaaaaaaacagtcagtcaaacatttcatcgaacaccttgaggacaatataactcaccgacatataaatcggaccattgtacccacaaacttccgtgaagtaaggaagcgctccaacatgatccatatggctattaacactcacaattaaaacccacaaaaactaaaaaagtgaattttaaaaaagggacaaattctgggtttgaagaatcaatacaagtgtgtgatgatgatacaagagatcgcgttgtcaaaatcaccggatttagatatgagagaaaaatttgggtaacgattgtgatcatcacagcccatatgcatcccacaatcgaacattatctttttaccattaatcgtcactaccacacagctctttccaatctcttgtccagcacctggatacaacacaaaaaagatagaattatacagaaattgaaattgtgaaactttgaagaagcaaagagagaagaagaagaagaacaaaaactgttaccaagtacgagacaatcgatagccatagttactgaagaaataaacaacaatttgagtttcaaaactcgtcgatggtcaaaaatatcttactcgttgaatcagaacacaaattcaagtgaccggagaaaattttgaagggggcgagagaagaaacagagttaggtcgacaaacgaatttgaatggcggcaaagtgttcagtgacatcggaaccgttcggagttattacacgtgtctgatccaaccgtcgatatttttgtggtgtgaagcccaataatagttcttctcacggcccattaaatttaaaagtttgaaacgacaacgtctcatgtcgtttttaatctgaggaagaaaaaagctcgtaactaatccctaaatcaagagagaagtgagagacactgagactttgtagttgaccggatcattctcacttcgccggccgacgttcttccttccgccgtcggtatctatatttacgatccacgatctctcttgctgtttctgtcttcatcggtgagtaattttttactgatcttccaaatcctatcaattcaccatctctgagctctttcgttgatttgagttttgttcttactgcagtgacgaaaatg

SEQ ID NO: 12951 - DNA, 3000 bp, Unknown
  misc_feature (1)..( 3000): cDNA_ID_2710034_gDNA_ID_2214583_Annot_ID_135305 3000 nt of promoter + ATG
aggtatgagtatttgacctgagacaagaccattatagatacatgttgttttactaaccatagtttgaaaatgcaattcatgtatatgtgtggctgatgaagtacctgcaactcttgattgactgtaaagggcaaaacagcagaagggtcctttgatccttcaggaagcacgacctgaaaatgatatcttcctgtgttaagtgtaatctgctaacaatataaggaaattactattagtagaaaatgctaattaaacccactttgatagtcaacttgttaacaatagtttcgacgagcgggcacccaaaggtaaagttcaagtaacgtctgccatcagatgcttcaaagagatagtcttccaatggaactctatagccgatgataaaagttgcactccaccctccaaataatgggtagcggggttcaaattcaagttctgactgcaaataccaacaatttttttataagaacttagagaataagaaaccaattagagttatacaattagagcctaagcagagtttctcagggaggaaatatcactgcctaaatggctacagataaagagaagtgggcaatccaagcatacctttctaaagcctgtacgcaaatgtgaagtagagatgtttcctatctcatccctgtagtagacagagttcactctgggaggtaggactgcaaggagcgcattgaaagaggatgcaccactgaccgatcgtttagattgataatcaaccctgccaaaattgagaattcagagaaacattttcagcataacagcatacatatgaacacaacctcgccattgacctctttcacaagtaacagtaaaataggtaattaaatagacagttttccttcaataacagagaaaagttgcctgcagaaatggaaaatggcaccttaacagttagctcaaaacacataaatcgaaattctgcaacatctaactcctagagataaattttcagatgtcacctcatacattatagaagttattagtcccattacataccttgagaaaacacccttatgcctcgctcccccatgagtcaacctataattttctgtaatctgaaggctaccccagtgtgaaatctcaatttcacgcacaagctcctcaacaacagcaaatggactgttattctcgaagtgaatgatgacaggtgtgtaagagtatgaagcacgattttcatatggtccatatttgatctctttgccagcccggttagcaggttcaatgctagtgaacgactctactctagtactaggagtcttaataaaagttgtctgttgcttaacatgatacggtgacaatatcactgcactatcatgatagtaaaccaattgagattctgactgggttatctccactgggaaaggttccaaggaatgagtcaatatgtaaagcacctcaagtgaaacagtttcacccggacctaaggggctaataaacgtaacacggtagtatccagtgtcatttggtgcatcaggttgttcagttggttttacatctaatggcaaataagttttcttcttcttcttgccagtagttgccagggcttgtaccatagccaaattcttgatctgggtaggtgggaaagcaagaagcatttctgcagcaggatctttcccaatattttcaacctgaagaaagaaatccagacaagaaaatgtcacctcctaatagaaaaacttaaagatgatgaaggagaaaagcgataatatcaaattaactgtcacaacgaatcaaagccactaaagttccaacctttacaacaagtatcactacaataaactaaatttgactaaaagaaaaacagctgcagtttcatataacatatccaaaaaagctttaattttccaattctaagttccaaccttccagtgtatattcaataggaataactattataaacatttgcttataaataccttgagagtcaagaaggccttcacgatatgtgagcttaaatcaatctgtagacaaaaacaaacacaaaggagaagcatttcagtttcgggcaagaaaattttgcaaacaggttctatcattagactttctaattactcaaatcaaacgtataactgatgaaaagtcacactatctatcaatgtacatacatatgaagcctatcgatgatgatcaaccatgaagtgaccaatcacacagtaattctacaaaccgagtatagatcggagaaacagcaaagcccaacggcaacttcattaacttgaatttccataaatcggagaaacgggatccattaaggaagtttatgaattgtaagaagaagatagatcggagaatcttacccttcgctcggcatttacgatctggagatcctgagctgaggaaaatgcagaaatagataacaatacagctacgaagacggagaagatcccgatacgagcagccattttcgtcactgcagtaagaacaaaactcaaatcaacgaaagagctcagagatggtgaattgataggatttggaagatcagtaaaaaattactcaccgatgaagacagaaacagcaagagagatcgtggatcgtaaatatagataccgacggcggaaggaagaacgtcggccggcgaagtgagaatgatccggtcaactacaaagtctcagtgtctctcacttctctcttgatttagggattagttacgagcttttttcttcctcagattaaaaacgacatgagacgttgtcgtttcaaacttttaaatttaatgggccgtgagaagaactattattgggcttcacaccacaaaaatatcgacggttggatcagacacgtgtaataactccgaacggttccgatgtcactgaacactttgccgccattcaaattcgtttgtcgacctaactctgtttcttctctcgcccccttcaaaattttctccggtcacttgaatttgtgttctgattcaacgagtaagatatttttgaccatcgacgagttttgaaactcaaattgttgtttatttcttcagtaact

SEQ ID NO: 12952 - DNA, 3000 bp, Unknown
  misc_feature (1)..( 3000): cDNA_ID_2710015_gDNA_ID_2214583_Annot_ID_135307 3000 nt of promoter + ATG
gctgtcttccttgcataattgctcttctttatgccgttgctggaacggtatgaagccatctcatcgatctttgttgtctactactttaaagaacttagagacgccttttcttgcgggttttatacaggaaggtgtatcggaggcggagctcggtgttcttcccttgtacaaatttaaggctttccatagcaatgagaagaacattactggacctggtaaaatggttcctataccgatcaatggcttatgcttagcaactgaaagaacactgcttgctgaggatgcggtaaacacgaatctagtttgacaacgatttgttacttatgaactctgcttttgcttagtttcaaaggcttcttctacttgatttttcttaacaggattgttgcatatgtctgagttcatatgaggatggcgcagagcttcatgctcttccttgtaaccaccattttcattcgacttgtattgtgaaatggcttaagatgagagcaacatgccctctttgcaaatacaacattcttaaaggaaccactgatcaatcttgaagacaaaactcaaccaaccagagggaataagattctgcacatatagaaacagattccatttcctcaattaaaaagcttctgtatatatttatttacataactatcaaagtcatgtgtcttttgttaaaagcatccattttaaatgtaaaagatcacactttacaaatgcccttttctatatttgcccatatttgagaatacagctgatgctcatagtcatagctcaaatcataagaaagttcacgaacagttcacttcattgccacactgtttgctgcaatccgcatcacttactgctgttacaagcccccttctctgcatatcaagaagcaaatccgaagcagcggccatgtttccctccttttcataagctctaatcaagagatcaaaaacagccgaatcaggacttattccgctattcaacatttcatcgaaaacttgtcttgcctcaaccatcaaacccttgctagctagcccgtaaatcaatgtagtataggctaacaaatcaagcaaaagaccttcctgaaccattctggtttttaacttaaacgcatccaccaaattcccttgcttacacaaaccagctatccaagaagtgtacatgaacttatctggaacaagtccagcctctgagattttactaaacaatctctcaacttctataaagtctccttctttgcacaaagcatcaataagcacagtgtacataacatcattagctttctctatacagaaataaactatagcttcatgtagttgtccattcttcgcaatcccatcgatcatagtcgaaagagctacaacatcgggctcaaagcctctctcaattaatttgtggtacatgttaaccgcagccttcatgcgtccggatttaaaatatgcattcatcattgtagtaaaaatcaccatatcaggaactaaatcacttttctccatatcttctacaatctcagttgcctcctttagtttaccattaccacaaaggcctgatatgattacgccgtaagctgttatatcaagtctcatcccttgattgagcattttggccagaaacttcatggcattatccgaatctcctctctgaaaaaaaccatcgataatcgtagtgtatacaagagagtttggctcaactctatcctcgaccatccttgaatacatttcctcagctctctgcatttcccccttcttgcagaaaccatctatcaaagcagtataagtaacaacattcaaagacatccgaacgcgtctcatttctttgtataacgaaaccgcaacctccaagtcaccagctttacagtacccatcaatcaaacaagtgaaagtaaccacatttggagataaagcatctctcttcatagagtgaaaactcttcaacgccaactgcaactccccggatttgcagaacgtgtcgatccaagtactataagtaacaacattcggcgaacaacacttcaacataacacccatatacacaaaaacctcatctaacatcttcatcttgctaaacccattaaacagagaattaaaactaactatgtcaggcttgcagataaacccatgagaggctcttaaactctctaaaaccaaactagcacttctgatatctccatttctacaatgcccatcaatgagagagttataagatataacatctggttcacacccgaatctaggcatcgagtgaacgatatcttcagcgaatttaacttgccctagtttacaaacaaacgatacgaccgaattgaatgaagaacgatgaggagtgtaacctctggagactaagtaagctaagaatttgagagatagaatgccgcaattggaattgattagctgatgaatatgcttgttgcaggtgaatgggtctgggagattcgaggattttctcaggcgagaaagaaattgaagagcttctctgaccattcatggacatgggtttcttcagaagattcgaaaggttacaactttgaaaagatttttaaacatcaaagctaaatctaacggagaaggcttaaaccctagaaggttaaagaagaccgtcgttcggttctaaacgacagcgtttaattgtaagcttattattaaataaacatgaaaatgtaaaaaaaatctgaaaacggtaattatctctctctactcgctgtgacttagcataaacctcttttaaatccttctctaccaaaaaaaacttgctatttctcttttgtttttgtagaatctccggtgaagccgaattcaaaccctaacacttttggttcatcagttcttcttgacgattcagtgttgttgcgcgtcttatttctacattttgctttctcgatttgagaatgtgctgattttaggtatgtgttgattttttttttttgtttctggtggatggatttgagacttcaatagatatggaacttttgatgcctgtgtagattagagaagtaagggttttatagatcgggaataa

SEQ ID NO: 12953 - DNA, 3000 bp, Unknown
  misc_feature (1)..( 3000): cDNA_ID_2712864_gDNA_ID_2214583_Annot_ID_186572 3000 nt of promoter + ATG
ctctcctcctataagtagtaaagcaaacaactttttaagtaatcaatgtagctagagaacaaagagtggtacctagtgtggagagtagagcaaagacggtcccaaaagtccatgatttggtcaccagagaggtgattaggatcatcaagatcagtgttgatacaaagcaaatgaccaaaaccattgcaatgaatcaaaccatgcatcaaatgtgaagaaagcgtcaagctttctctcttcaatggctcattccattcatcacggtttgggattatcatatgatacttcctcttcgttacatagtgatgaccccaacctatatatatacacacacgtaaacgatccaaaatcgaaactttaccaagaacaacgaaaaaacaaaacctaagatttattatttaccaaagcatcgacagaaatcgcagagagggtttggagaagaatcagagatttgttgttcgatgatgtaaagagggaaaacgacgccatttgcttggcttccaaggaaaatagtagagacggtggctccgtcgatggtgtaatcttcaatctcggcatattcacggaggaacgatctgatgttgtcgcggaaagttgcggcgaggttgaagaaaggtggtgatgatgaagaagaagagatggcaaaatcgttaataaggaggactttgggggctttttgtctctccgtgagagcgtcgtatgcggttatcgccatgactgaaaaaggactacgggaaaagagagagagagagaggattggttttatcattgggatcacgtgacaggatctacttgtgaattgacggttttgcccttgtggcggcgatcgtgttttttggtttgttgttgttaaaagtaagagtggaatttccggtttacttggttttggtttgggataacgtgagattggcctgatttgattgtgacgggactcatcttcttccgtgtggtttgtttattaacgatttttgccctttcggcggcgattttggttcattggttttgttattttattgcaagagtgggagttccggttaaagagggtttggttcggtttaatttggtttgtgaccacgtgacattggctgattgttgcgacatgtctttcgtgtgggtttgcgtggattgacgattttgctcaatgtgatttctgaatatgtgttcgtgttggccatatggtgtattcatgaaaataactttatagaaggttaaatagtattagatttaggatatatgtcaatcttctgtttctctatatttactccgatacgttgttatctcctatgaggcaactgctgttgtataaatacctctcaaattctcaaattctactccgatactaaaaacttgaatagtaatcgttttcgtatatgggagtaacaaatcaagggaaaccaaagagaagctaatgttggataatggagaaaatcaaatcattatcttctgttctgtctgctcacataaagataaacaatgtgaaatctatttcgttgtccgcgcataatatcgggaaggtttagaatgttatatcattagtaaattcccaatgttcacacagttacaaaatagttacagtttgctaaatgtcatcttcatctccatcttccctttagtttaactaataagaatacaaaaaaaataaaaaaattataagaaacaaatgtgatgttttaaaatttgattaagcttttaagtacttccaaaatttatcaactaatttggtttttgatgttttcacctctggaacaagataactaggtaagtaaaacttttaaagattaaagtaaaatatatatatatatatatatatattatcacttttgatatgtaattaaattaaataaataaaaaaatctaagcaaaacataatcaaaatttaagcaaatgataatgaaatacgtgtaaaagtacaaattgtggattttgagtcattttaaccgcgggggtcactactttgtatgccaaatttgagctatatatagaatatgtccatatatatatatggtttatctacccttttttttgtgcaaatatggtctatctacaaaaagttcttgaacggactaacctctatagtaaaaagtcgacatcatactaagcattttattaaaaatcgtagctgtatgtttacctaactcaaaaggatcaacttgaaagggcttttgagcagtccgatgggtaatccactttggtaattaacttcatttctcactttacaagtttacagagtagtttgttcatcccacgcatgcaaaacatcactgatttgctatttttcggtatatatatatatataaaaaggcatttcgtgtgagtattgataatatgagtttagtagattagtctaataatcgtataaaagttattcttcaatccatcacaatgctaattattcaaaacatattcgtatcataaagaagttacacgaaaaggcttgttgagctgtattagaagacccttaacaggcctccatatcacactaagatgggctgaaattcactagtcttaaatggatccatatgagataccattaacatataagaatcatgaccaatttattagtcttaactgtaactaattgcctcatacactaattaaaagttgaaagtagtctattatatataaacctgaactaattggctcattaactactaactaaccaataaaatcagcaaaccggaacttaaagaggggtccgtaccgggacgtgtgagtcacgaagaagacggtgtaaaggagaacgaaagttccgatgatttcagcaccgtggaaaaggattgagacagagaaaaggcatgtatgtcgtggagaagatcaagagaatatttagttttcattattgcattttattagttttgtcatatttccatattcatatttatgcctagggttttgcttgtgtaatatcaaggtcctttcctatttacaggaggccttagaaataagtctcatatcctctaaacttatttttacttcaaaaccctacttcttcaagctatg

SEQ ID NO: 12954 - DNA, 3000 bp, Unknown
  misc_feature (1)..( 3000): cDNA_ID_2712875_gDNA_ID_2214583_Annot_ID_186570 3000 nt of promoter + ATG
ctgactgatactttactgccaggtatggcattgggttggaaatttcacaggggaatcaatcgatacttggtggcatagaggttagtcacttgtacgttcaagaactttttgtagatatagaccatatttgcacaaaaaaaactagatagaccatatatatattatgacatattctatatatagtgcaaatttggtatacaaagtagtgacttccgcggtgaaactgactaaacatctacaatttgtacttttacattgttcattatcatttgcttagattttttttttgttttgccatttaatttaattacatatcaaaagtaataatattttggtcgtgaacaagcctcaaagtaataattacacttgttcattatcatttgcttctattcatatccgttatcatctaattcctgatcaggggatgtgcagacctcagtgttctcatcagctctaagaatattaaatgaaacatgatctaaagacattgctacaaagcctacaagtgccattgcattctttttctgaatgggagcttttgatatgaaaccaagcatgaaccgaagcaaatcagagagagtttgggactacgtgacattggctgatttgttgcaacacgtctttcgtgtggtgtgtgctcatttaccggcgatcttgatttttttttttttcctttggttaaggggagagtgggaatttccgtattatgtggtttcggttcggttctatttggtttgatgcagttgttctattcattttctagttatttcaactcggtcgtttgatttgttgttctgtaatttgtgtaagtatgtaatgtactcatttaaaaaaaaaactgcttgctgacggaaacttcgctatcaagaacacaggggataacgacacagcgaggtttcttatggcaaagcttccatttcccgacggatacttacttccaaaaatggcattgggttggaattttcattggggcgtcaatcaatatttggtggcgtgggaaacccctgataatccgtccaaatcgagttacacgctaaacctcgaacctaaaagatgaggagaggaatatgttgcctcaagcttccctgagcttttcgtttctaactatgagggccgactgtacgggactggttcttctattaacctctttctgaataccaccaaaatgtatgaagatcttctagtaccaccaggccccttggatgaccaaaaagaacagagtctaatggataaaacttttctaagtgataaaatttacatagctgacatacaagaggtcagtttcacggcttacaacgacagcatcttcacaagattgaacctaagccctcccggaattttacagcgcttgacatggaaccagacagtagagagatggattggttcttggcaccagtaataatatttatccaaaactaactaatagaaacccaataatgtgttttcaaaaaaaaaaaaaaaccaattatgtatccaaaaagtgtccaacgcatttaatttaattacatatcaaaagtaataatattttttactttaatcttaaaaaattccttatcttattccaagaatgaaaacatcaacaaccaaattagttgatagtttttggaagtacttatatcaaattataaaacatcagattagtttcttaattatatttttggttttgtattttaattagctaaactaaagtttttaaatggatcaatctaatacttaattatatagaaaatgaagatgacatttacccaactgtaactattttgtaaccgtgtgaacattgggaatttgctgatgatataacattctcgttatatgttatgtgtcaaatgagactttgaatgtttctaataatctgataaatggtcacagaagttaaagatgaaaaacatgaaagtgtgtgaattggagcgttgcatatggcttcatgtaaattagcttttttctcatgcgttattcttttgcagactcatataagatttgttgctttctcatataactttcttttatattttcagaaaatttatcgtgtccacgtagaaaatgcatacatatggccagcttcatgccgtgggcaaagcatgtggcaaacacgctcaattttatctgaagttctgatcaaaaagttcaaaactcaaacctatttctccttgtcttatagaacttgtgtggaaagcatatataggatcttaatcggtgaataaagttttacagatgaggtcacaactcacaagacttctcgcggttaaaattaactcatatgagatggttccatgttggaaaaaaaaagacatggtttaattaaaagcgaaaaataacattagagtaggtataatgatattgttcatccgtaatttgattattggaaatttgcgcataacagcaccaatactctaaagatacttaatttgatgctcaattcaacatgaacacggaaaaaaaatgatacgtataaggtatgtggatgctcttagatttagcgtaattaaaaattgattaataaagcgtatttaaaaattgattaatatacaatttactttctcttcattatattagaaaataacttggaataatatttataagattaaatacttttacttacagtataaaggttttcctttaaaatatgtgtttgaattaatatgtaagggatttgacacactttaattgcaaactcatggaaactacttgtgggcatattgcttagtgttttcttttatggctttcttataaataatggtaacaaatcaataattaaataatatgatatatattatacttaaatgaaactcataggaaaattttttaagtaaatttgaaaccaaattacaaaataactaatatgatgtgatgatatgtttcccctcgttctttacgtatatatatatatatatatatatatatatatatatatatatatatatatcatgttcccacacacacacttcacaactttgagaaagaaaaaaaacgagagagaaagagaatcgatcatcaacaatg

SEQ ID NO: 12955 - DNA, 3000 bp, Unknown
  misc_feature (1)..( 3000): cDNA_ID_2710015_gDNA_ID_2214583_Annot_ID_186567 3000 nt of promoter + ATG
agagacgccttttcttgcgggttttatacaggaaggtgtatcggaggcggagctcggtgttcttcccttgtacaaatttaaggctttccatagcaatgagaagaacattactggacctggtaaaatggttcctataccgatcaatggcttatgcttagcaactgaaagaacactgcttgctgaggatgcggtaaacacgaatctagtttgacaacgatttgttacttatgaactctgcttttgcttagtttcaaaggcttcttctacttgatttttcttaacaggattgttgcatatgtctgagttcatatgaggatggcgcagagcttcatgctcttccttgtaaccaccattttcattcgacttgtattgtgaaatggcttaagatgagagcaacatgccctctttgcaaatacaacattcttaaaggaaccactgatcaatcttgaagacaaaactcaaccaaccagagggaataagattctgcacatatagaaacagattccatttcctcaattaaaaagcttctgtatatatttatttacataactatcaaagtcatgtgtcttttgttaaaagcatccattttaaatgtaaaagatcacactttacaaatgcccttttctatatttgcccatatttgagaatacagctgatgctcatagtcatagctcaaatcataagaaagttcacgaacagttcacttcattgccacactgtttgctgcaatccgcatcacttactgctgttacaagcccccttctctgcatatcaagaagcaaatccgaagcagcggccatgtttccctccttttcataagctctaatcaagagatcaaaaacagccgaatcaggacttattccgctattcaacatttcatcgaaaacttgtcttgcctcaaccatcaaacccttgctagctagcccgtaaatcaatgtagtataggctaacaaatcaagcaaaagaccttcctgaaccattctggtttttaacttaaacgcatccaccaaattcccttgcttacacaaaccagctatccaagaagtgtacatgaacttatctggaacaagtccagcctctgagattttactaaacaatctctcaacttctataaagtctccttctttgcacaaagcatcaataagcacagtgtacataacatcattagctttctctatacagaaataaactatagcttcatgtagttgtccattcttcgcaatcccatcgatcatagtcgaaagagctacaacatcgggctcaaagcctctctcaattaatttgtggtacatgttaaccgcagccttcatgcgtccggatttaaaatatgcattcatcattgtagtaaaaatcaccatatcaggaactaaatcacttttctccatatcttctacaatctcagttgcctcctttagtttaccattaccacaaaggcctgatatgattacgccgtaagctgttatatcaagtctcatcccttgattgagcattttggccagaaacttcatggcattatccgaatctcctctctgaaaaaaaccatcgataatcgtagtgtatacaagagagtttggctcaactctatcctcgaccatccttgaatacatttcctcagctctctgcatttcccccttcttgcagaaaccatctatcaaagcagtataagtaacaacattcaaagacatccgaacgcgtctcatttctttgtataacgaaaccgcaacctccaagtcaccagctttacagtacccatcaatcaaacaagtgaaagtaaccacatttggagataaagcatctctcttcatagagtgaaaactcttcaacgccaactgcaactccccggatttgcagaacgtgtcgatccaagtactataagtaacaacattcggcgaacaacacttcaacataacacccatatacacaaaaacctcatctaacatcttcatcttgctaaacccattaaacagagaattaaaactaactatgtcaggcttgcagataaacccatgagaggctcttaaactctctaaaaccaaactagcacttctgatatctccatttctacaatgcccatcaatgagagagttataagatataacatctggttcacacccgaatctaggcatcgagtgaacgatatcttcagcgaatttaacttgccctagtttacaaacaaacgatacgaccgaattgaatgaagaacgatgaggagtgtaacctctggagactaagtaagctaagaatttgagagatagaatgccgcaattggaattgattagctgatgaatatgcttgttgcaggtgaatgggtctgggagattcgaggattttctcaggcgagaaagaaattgaagagcttctctgaccattcatggacatgggtttcttcagaagattcgaaaggttacaactttgaaaagatttttaaacatcaaagctaaatctaacggagaaggcttaaaccctagaaggttaaagaagaccgtcgttcggttctaaacgacagcgtttaattgtaagcttattattaaataaacatgaaaatgtaaaaaaaatctgaaaacggtaattatctctctctactcgctgtgacttagcataaacctcttttaaatccttctctaccaaaaaaaacttgctatttctcttttgtttttgtagaatctccggtgaagccgaattcaaaccctaacacttttggttcatcagttcttcttgacgattcagtgttgttgcgcgtcttatttctacattttgctttctcgatttgagaatgtgctgattttaggtatgtgttgattttttttttttgtttctggtggatggatttgagacttcaatagatatggaacttttgatgcctgtgtagattagagaagtaagggttttatagatcgggaataaatggaggaaggtggatatgcgtttgaggttaacaatggaagaccaacggcgagtgagtttggtacgacggcgaggatttcgtcaccgtcattgact

SEQ ID NO: 12956 - DNA, 3000 bp, Unknown
  misc_feature (1)..( 3000): cDNA_ID_3027225_gDNA_ID_2214583_Annot_ID_186565 3000 nt of promoter + ATG
agtttctgtattttttaaagcttattttgtattgatcataaggtccttggagcagtgatggtttatgcaaagatgggagatgcagcgattgtgtacactggagattacaatatgacgacagatagacatctaggagctgctaaaattgacagactccagttggatcttctcatttcagagtatggaaaacaaatacaaacttgttcgctggtatttttcaacaaacttagaaagaacaagtttacctgatataggtttaactatgccgttttaggtccacatatgcaactaccattcgcggctcaaaatatccccgggagagagagtttcttcaagctgtatgtctacttgtaactattaacacatggtttctaaatttgttcttaaatggtttttgattataattacccgcatcacctttggcttgtttctgatcaatataccccttcaggaaatgcttaagctttcgtttggtaattgtctgatatctcagaaaactcttccaggttcataaatgtgttgctggcggagggaaggcgctgattccttcatttgctcttggaagggctcaggtctgtcttcttacagagctttgaagtcagttacttaaacttgtctttgcttctcttatgtctcattgacaattgcgtttcctttttcaggaactctgcatgctgcttgatgattactgggaacgcatgaatataaaggttccaatttacttctcatcaggtctgttaaatcaccaccaatcctcatatgaaatcaattctgcagattagtcagctcaacaaagtcgtgactctatttcatgaatagtgatctctatcttctgaaaattgctgtccctgaagataaatttgtacttttgcaggtttgaccatccaagcaaatatgtattacaaaatgctcatcagctggacaagccagaacgttaaagaaaagcacaatacgcataacccatttgattttaagaatggtatgtgtactaccatttgcaaataactttagaacgttgaagatgaaatttatatcatatggaaccgaaactctgatgtgcttgaaaaataagaaccaaactagtggttctaatacatcctttgcgtccattttttgttcttatccactaccttagctgtacaactctgcttgctttctaactactaccttcacattctgcagttaaagatttcgatcgatctcttatacatgctcctgggccatgtgttctctttgccacacctggtatgctttgtgctggcttttcacttgaagtgttcaagcactgggctccttctcccttgaatcttgttgcattacccgggtactatacctattgtgtttcccctttattagcaattcagttttttcctagcatagcatctaacacgaaattgtatctcttttcatccatttatggatccgttttttacagatactctgtggctgggaccgttgggcacaaactgatggctggtaaacccacgacggttgatctctacaatggcaccaaggtcgatgtccgttgcaaggtttgtttactctttcttctggttctcacaaaatttatgtaaccttaacacgaaaacagcaatgcgtccaattcacacgttgaacctaaactaaaatgtcttgttgattctgttgttatcaggtacatcaagtggctttcagtcctcacacagatgcaaaaggaataatggatctcacaaagttcctttccccaaagaacgttgtactcgtgcacggcgaaaaacccagcatgatgattcttaaggaaaagataacctcagagcttgacatcccctgtttcgtccctgccaatggcgaaacagtttcattcgcttcaaccacttatataaaagcaaacgcttctgatatgttcctaaaaagctgctccaacccgaatttcaaattctcaaactctactcagctccgtgttacagaccatagaaccgcagacggggttttggtaatagagaagagcaaaaaggcaaagatagttcaccaagatgaaatctctgaggtgttacatgagaaaaaccatgtggtctctttagctcattgttgtccagtgaaagttaaaggagaatcagaagatgatgatgttgatctaatcaaacaattgtctgcaaagatcttgaagacagtgtctggtgctcagatccatgaatctgaaaactgtttgcaggttgcatctttcaagggctctttgtgtctaaaagacaagtgtatgcatcgaagcagtagtagtagtagtgaagctgtgttcttgtgttgcaactggtctatcgcagatttagagcttggctgggaaatcatcaatgctatcaaactaaatcactgattcttgtaacactgagaagtgttttcagtttttgtcgtttttctgtcggcatatgtaaaagttttgatcctagtaaattaaattaacccagtagtaactaaacttaccaactttagcgccaatttctatctaacaaagtaacacccgtattaaaaaccggaaccaattacccgaaactgaatctgaatccgaaaatttacttgtgtcctaaattcttctaccctaaaaaccaaatctgaagtcgaacccaaaaatacatgaatattttaatcaaaaatttaaattttattcgaaatccgaaaaatttgcatatttacccgcaaaatcaagtatggttctaaaaaaggcctaaaatctatacacgaaccgatattttagatttaccctatagaatcctaaacttctctacccgaaaaaccgtattcgatcgaattttacccgaatccgacccgtttatccgaatggccactcctaaccggatcctttaaggttaaagacgtacgacttattgtgataatgataattaacttataagactgtgtctaatcttcaattaatgttaattaactaaaaccattttttaaaactgtccgccatggcttagcgttttctagagcagagagaaagaagaatctcaattctcttcgttacta

SEQ ID NO: 12957 - DNA, 3000 bp, Unknown; identical to SEQ ID NO: 12951
  misc_feature (1)..( 3000): cDNA_ID_3027229_gDNA_ID_2214583_Annot_ID_186564 3000 nt of promoter + ATG

SEQ ID NO: 12958 - DNA, 3000 bp, Unknown; identical to SEQ ID NO: 12950
  misc_feature (1)..( 3000): cDNA_ID_3027233_gDNA_ID_2214583_Annot_ID_186563 3000 nt of promoter + ATG

SEQ ID NO: 12959 - DNA, 3000 bp, Unknown; identical to SEQ ID NO: 12949
  misc_feature (1)..( 3000): cDNA_ID_3027237_gDNA_ID_2214583_Annot_ID_186560 3000 nt of promoter + ATG

SEQ ID NO: 12960 - DNA, 3000 bp, Unknown; identical to SEQ ID NO: 12948
  misc_feature (1)..( 3000): cDNA_ID_3027190_gDNA_ID_2214583_Annot_ID_186559 3000 nt of promoter + ATG

SEQ ID NO: 12961 - DNA, 3000 bp, Unknown
  misc_feature (1)..( 3000): cDNA_ID_2991081_gDNA_ID_2214583_Annot_ID_186554 3000 nt of promoter + ATG
aaggtatttacacacatattaaaaaattatcaaaattttatttaatctacctcttttatataacagtatcattaattataaccaatagaaaaatatagggttaaatataattggtttaaaaaatattaaatacatttattatttgcatagaaagttgaaaacaatacttattttgaaaaaaaataaaaactcttaaaactacatttatatagaaacagaggaagtactaaatttatcacaaaatgcaaaaaaacaatctcactaagaggcaatgttaaatcatacaatccaaaacaaggcgtctttgttgttgagcatatatccacgactgtcacatatgccaaaagaccaatgtctttaaaatgtttgacaatttatgaatatattgcatacttggcaatattattatatccacgactgttacatatgccaaaagaccaatgtctttaaaatgtttgacaatttatgaatttattgcatatttggttcaactttatgctaatttttactaaactgtcccttgaccgacttcaaaatatatgagtacttctcttctattctttccaaaaagaacaacttatacattctatatatgtttgcccaaaaaagaaaaatacattctagatatgtatgtttatctacatagtctcgatttttatatagattattttctgatttttgctgatgttttatataaaacaacagagaggtaaggaacaaaactatattttccaaagttggacgagttcattcccatcatcatcaaccaaaaagagtgataaacttcggatacaattttattaatatcttatatatttattttttgaattagtttcgtaagaccacactccaaagattcatgtcttttcatataaccagttagaaattgagatctttgtacttacatttttatttgatcaatcaaatcttcttgataactctaaattgttgtgcaatggtctctcctttattgcaatgttacatattcctagtctctattatggattaggtttataccaaaagttaccaattgcaaacaaataataaatcaaagaaaatgtttgaaacataggaacaagtaatgcatcataaaacctaaggctaacttcaaatctctgtgatgatttcactctgtttcataatcttcctcgtatggtaatcgtcgacataaatgacaggacctctcacgcttaagccacttaaaggacggcggattcagttaggttttaggttttgattttgattgaagatcgaagaagaagaagagacatgcaaggaggaagggggaaataagagaagaaacaaatcactcaccaatggagaagagaaatcgccaaatcggaatgatattgctgtcgttgttgtggtcggagaagatgatttcgagatcggggttttgggttttggttttcgcttaatatcgaaaaagaagaagaacaaaagtgaccgcaaaaaaacctagtacttatttatagtctctttgtaacttcattttgagttttatttcacttaattcataattcttttttcttagttttttttaaggaaaatatgcttttaactttgattaaagataattagtctttttacttaaaaatagagtcattctagttaaccattggtaagaggagtcattctatttatttttgttaaaattatagtcaatttaagcaaatttcagttaaatatcataaaatgcaaacaaacaatctcgcgaagagctatgttaaatcatacaatctaaaacaaggcatctttgtttttgagcatatatccacgattgtcacatatgccaaaagaccaatgtctttaaaatgtttgacaattaatgaatttaatgcacatttagttcaagtttatgccaatttatactaacttcaaaattcatatatgaatacttctcttccattctttccaaaaagaacaacttatacattctagatatgtatgtctatctacatagtcttgatttttatatatattatttttctgatttttgctaatgttttagataaattaaagaagtaaggaacaaaactacattttccaaagttggacgagttcattcccatcatcatcaaccaaaaagagtgataaactttaaatacaatttcatttatatcttcttatttttttcctgcatacagaaaaatatatcagataaagaaaaacctttttttttgtggtcttagatactattattcttaaataaaactccaaaaaataaagtcaaattagatatgtagtgcaaaggcttgttgtttattaactttacttgggccaatatgagattacccaaagaaacatacttggtggtattaataattacaaggcttttagcaaagatgtatatctaagcgcattgaatatacaatgatttggcccaaaaggaccattaatcaaaattatggcgcactgaatatacaatgatttggcccaaaaggcccattaatcaaaattattgcgcaacgaggtcaattttttttttggcttaattgcgaagagaagcaaaacagaacaaacacaaaagtcttcgacgaccaaagaacaagatcatcctctgatttttcagacacatatttgtaatttataaagtttgtagctttttccttagcttgagattacacgaagaagaagaagatggatgacgttaaagataagctaaagggattcatgaaaaaagtcaatctctcttcttcttccggcaaattcaaaggccaaggtcgggttctcggatcttcttcttcttcctctgcaccacccgttaacccgattcagaaccggtttaactcttcccaagctcccaatccgactcctagacccaaacccaatccaaatccgttgcctgagaaacccttatcctcctccgatcagaagattagtgggtcaacgagaaacccggatcatgacccggttcgtgctccacaagatgggtttgacccgtacggtgctttcataacgtcttcgaacagatctcagaacggatattctctgagcatg

SEQ ID NO: 12962 - DNA, 3000 bp, Unknown
  misc_feature (1)..( 3000): cDNA_ID_1534314_gDNA_ID_2214583_Annot_ID_186552 3000 nt of promoter + ATG
gttccgtcagcgctcatcaggttcagaccgatcgaaacagactctctcgtctttacaggactccgcaatgaactcctggagatcagtgaaccactctcgtgatcatttgtgttccactgatgatttagcttgagcccatgaaataagtttacaaatttaggtttctctcttatatggtgtgatttgatgatgatttgtgtttgtgattcgagcacattttataggtttataagaaatttgtgtcatttgcacaataagaagaatcataaatttgaaggtccttcatttgttaatactataacaaaacaacaaaatagatcattatgtctctatacgacaaaatagatcataaatttgaaggtccttcatttgttaggaacttatgtctctatacgacaaaatcaggaatccatggattgagccgttcacttgttccgatttcttttcttgcttccctttgtcttttcttcagatgaataatctttagagaaagaaaaaaaaaaacttacactctataatcgggagaagggtattttcataccgtactatattctgagtgtattttcatacccagacaaatttgtacctaaatttatttgtttgcgaacacctggtttataacgtgtctaaaacgacgtcgtttattactcatcgaagcaatgaatctagaacatcatcttttctagattactactcatcaatctcaagcatgagacctgtatcacataaatctgcatagagagatctcacaggcgagactgtgttcttaaaggaaagctgtaaacgagtttgttacagatcaaaacttgtgtaatttgaacaataataacaatcaaatttgaagattcttcatttccaaaatcatgttactataacaaaacaacaaaaacaaaacataagtaaacttataggacaagatcagaaatccatggaatcagtctttccttttttcttattccttttcttgcttccattagtgttagtcttcttcttcggtttctcttccaccggtggctgttgactcagcaagtgctgaaatatcgaaccaactggatcagcttgaaaagctggatggtctagaaccttattcaatctctccccttctgtcaatctaaacaacacacaaagacacaatcctttcagatgaaaatcgcaagaaacaacaacaaaggaaacggagacttacacgagcttttgtcgccttttacagttcattttcagctcgggtgcaggaagagctgatttctgcagagcattgaactcgggaagaaactccgacaggttggtgagatcatacgcctttagcttcttttgtcggctgcggattttcttcttctgattaaaccgtaattagagttaccctcattagcaaatcatatgtatatagaaaaagttcaaagctttcacaatagcaaccaactccattgtagaagtagcaaccaacaactacaagtcctgaacaaaacaatggactcaaattgcaacgttcttaacaagttctaacaaagattgatactttctctaatcatagagaagtgtttaccttgccaatctccttttggacagacaaagaagtaactgtatctttgacctctgcattcacaaacaaagtttcagacacattgcaatttgatagcttagcagaacaaattttcaaattcgagacaaatttgatagcttacttgtgtaaaattgaagcttcttctcaaacttcttatcagacttcgttgtcacttccgatctgagaaataacgtccgaaatcaaatctcaaacacaaaaccagtcaagaacaaaacaatctgaacttcagatgaataactgttcgaagaagataagagaagccttaccctttgcttggtttgcccattctgtgtcttcaaatcttcaacgatttcaaactcgggttaataatggcgaatgctctgatcgaacaagatttagggtttttgattgaacaaagagagtaaaagtttgaatgcctttgtaaattcggatcttatgacccgacccggaaaatgaaatttgtttatatcagtaatgtttgggcctagccagacttatatctttcaacccattatgagcccaaaggttgttaaataaatacgtcattgttaaataattacgtcattgttttcgcacatactactaaacacaaattaatgatcattgcattttgttgactaaagataaacaaacttatatgtatattttttaaaatatctgaaagttcaggctcaaaaactctatattttttaaaggcggcgaaacttacaccagattaaattcatctttcttaaagaaaaaaatttttccaatatgcttcgaacacaacaattccacctaaaaacattatcattagaccaacaataagttattatttttcttttttctttttgacgtagtttggctttgacaaacaaacagaaattgaatgattactcgtgtggtatataaatagttgagactcaaaattaaaaagaaacaacgagttcttttaattgttgtttttttagatgaccgttgaactgaatcaagtgtgattcactgccacacaattaaaacattgggcattggctataaaattcaccaagaaaatctatttaccataaatttgaagaaacaaaaaaaaaaaaaatcctagaacatttatttaaaggttagttttaaacgaaaataaaagaattgtttttccaccgaaaaataaattattaatatttagtggtacgatacatcttttcagcaaaaaaataaaaaaaaattagaaacccaacttttagcctttaggcttgaagttatatatattactcttttgaagcgaactgattcttaatttttcactttctatttctctatatctatttttttatagatatatattttgtcttggttggattttgttctcgtgggttacttacttgagagaacctcgagacctgtcttgtctttatgcttcagaagcaaatcaaagcatctctccaagatttgaagctccatctatg

SEQ ID NO: 12963 - DNA, 901 bp, Unknown; identical to SEQ ID NO: 12946
  misc_feature (1)..( 901): cDNA_ID_2709998_gDNA_ID_2214583_Annot_ID_186548 3000 nt of promoter + ATG

SEQ ID NO: 12964 - DNA, 3000 bp, Unknown; identical to SEQ ID NO: 12954
  misc_feature (1)..( 3000): cDNA_ID_2712875_gDNA_ID_2214583_Annot_ID_135309 3000 nt of promoter + ATG

SEQ ID NO: 12965 - DNA, 3000 bp, Unknown; identical to SEQ ID NO: 12953
  misc_feature (1)..( 3000): cDNA_ID_2712864_gDNA_ID_2214583_Annot_ID_135312 3000 nt of promoter + ATG

SEQ ID NO: 12966 - DNA, 3000 bp, Unknown
  misc_feature (1)..( 3000): cDNA_ID_2710065_gDNA_ID_2214584_Annot_ID_135314 3000 nt of promoter + ATG
gatggtcggacgatgtattgccggagttggtgtagggtttgctctcatgatagctccggtttactctgccgagatatcctctgcgtcacatagaggctttctcacttctctacctgagctttgtattagtcttgggattttactaggctatgtctcgaattactgttttgggaaactgacgttgaaacttggatggagattgatgcttggaatcgcagcgttcccgtctttgatattggcttttgggattacaagaatgcccgagtcgccgaggtggcttgtgatgcaaggtaggttagaagaagccaagaaaataatggttttggtatccaatacggaagaagaagctgaagaacggttcagagacatcttaaccgctgcggaagtagatgtgacagagataaaagaagttggtggcggcgttaagaagaagaatcacggtaaaagtgtttggagggagttggtgataaaaccgcgacctgcggtgcgtttgatcttgatagcggccgttgggatacactttttcgagcatgcgacggggattgaggccgtcgtgttgtacagcccgagaattttcaagaaagccggagttgtttcgaaagacaagctcttactagccacggtcggtgtaggtttaactaaggcctttttcataataatagccactttcttgctcgacaaggtaggtcgtagaaagctcctgttgaccagtacgggtgggatggtcttcgcattgaccagtttagcggttagtctcacgatggttcagcgatttgggcggttagcgtgggcattgagtttaagcatcgtctctacgtatgcatttgtagcttttttctccatagggcttggacctatcacatgggtgtacagctccgagatattcccgttgagacttagggctcagggagcgagtataggtgttgcggttaataggatcatgaacgcgacggtctcaatgagttttctgtcgatgacgaaggcgatcacgacagggggcgtgttcttcgtattcgccggaatagcggtggcggcatggtggttcttcttctttatgttgccggagacgaaaggattgccattggaggagatggagaagctttttggtggtgggggtcctcgtggtgatcgtgacggacttgagattcaaactaaaaccatctctattgggggtttctcataagagtttctcacaattaaaaaaataaaaataataaaaatgaaggagagagagtgtagaaagattctcagaaactttgagatactctctacaacccatcatgacaattcgcttctcactattggttcaactttttaacaaaaatatttttttaatcaaaaattcaaattataatataatattaatttttttttgtttgagaaactttgtgggtttctcatggatggagatgcccttagagagtcaataattaggttagattatcatggctatgtagaataatttttaaatccaacatgatttggcatatctattataaggtgtgattttttgtaaaggacaaagtatgatttttatattcatccctttttactgtagctaatgagaatctacaacctaataaaaaacaataacaattatttaattataaaatctaatagttcaccaaaacaaaatcatatatcggtttggatttataagagagggttaaagtttaaattttatgattaaacgaagttaaataccagtttaggtttataaacgattttagattttagaatcaaacgaggttaaatgtcggtttagagttataaacgggtttggattttacaattagatgaggttaaatgtcggtttgagttttagaaagaacgatttaagtttagattttacaattaatcgagtttaaatgtcggtttggatttacaaaatagaattagagtttaaattttgtaattaaacaaaattatatatcggtttgagtttatgaaatagtggttaagattatagattttataattaaatgagtttatttatttattaggtgacatattctaattggctgaaagaggtgaatgaaaaggtgaaccaagaattgttcgatttttaactacacatctaattctagactctagagtatgcatattaatgtttccagagatcagaaagtgcttaaacaaaacatattgatcacttcatggtttttaagtcttagtttaattgatggaaaggagaggattaccaatactgaagtagagtcatagttgatatttgaggggtgagaaccctgagattcgtaaagaaatcgatgaacttgtgcgtgaagaaattagtttgatcatgctcaaaggtctaaataataaaaaaccttgacatttgttcccaattgaagtcctttaattgtgagaaaaattatgttgctctagagcaatattgaagaaaaaggagacatatcacatatgggaagacctgaggagcaatgatttgatttgacggaccaaaataaaccagagattttcctgacaaattaaggtaataatgcatgaggttacgtggaaatgaatcaacaatcgttagctcctaatatcacggagccaaaaagagaaaaattagaccggagattattacaattagtaactaacacaaaactgttattaagacagaaagagagagaagaggcatgtttctcggaatgaagacagagcaaatctcaatcttcctttttcaccttattcctattatcattttctgatcaaatgttcaaaaactctctccccttaatctcttcctctaaggtacacactttcatgctaatctcttaactaattttgtattaatctcttatatttagcattacctgttttgttaacgatctaacgaacataataagacaagaacttgttccaacgttaacaccattttgattatgatctgttttttctacgtgttgttgttgttgttctcagaataattgagtggttaagggagagaggagacggagagtttttattttcgttaccggaaaattttgatctccgatg

SEQ ID NO: 12967 - DNA, 3000 bp, Unknown
  misc_feature (1)..( 3000): cDNA_ID_2710076_gDNA_ID_2214584_Annot_ID_135321 3000 nt of promoter + ATG
gttttccttgccgaaagttatagtgaacaacacagattgacaaaaatacttttaaactagtgatcaactgctataaaggtattctataaacatagtaatatgttgaatgttgaaaaaaaaaaatcgtagacaatatgggggattatttaagtggccatgactaaattattaattaggtaaatgataaagtggcaaaactgtaattaaggagtttcagatttttgtttttcacattttgggaaagtcattcggatttcgcatattaatgctattttatttaatagcaagttgttggataatattgcatgataattttctatagaagttttctatataacatactgatttttctaaattcgttacatgaacaaaatagcatgtcattttagttaagaacatgttattttctcaaaattagtgtgttatatactaaattggatagagtgtacttttcaaactaaaaagaaaaacattttaacttatatatctgatattaacagaagttcatggttatctagaatggttgtatgaatactctagaaaatattaattttattatttacttacaattttcatttgtggatatgcaacctaataaaaacggaacaccaaacatctataaattttttaattggttttggctaaaattaatgagaaggggatatgttgaggccatcaagtttatttgacagagaaaatgatttttaagagtttaatgtgtgtttagggaatggtattgggtgttaaaaccttgcagcggtggccggtggcaaagaagcaataactccaatctctttttaatttcaatatctaggaagctcacatgaaatatcagtttcacttcccaaccatcatttttcatggctcactttagttatttatcagaagaaatcggcctaactttatatccctagatagtaaatacactatagtttgtaagttaaaaacaaaactttcgatatactttgactgacccccacacctaatgtgctctcgttaagttcagattctgtcaaaccatgaactaactaagaaacattggtaacaacttactggaaacaaaaagcggaatcgataaaagataaaaaagagtgtgattggtgtaattttaagaaacatagattggatttgtacactttttatagttcaagcagattcaatcttagcattttagtatagaataatatgtgtcgagatatcatggttcatggattgatgctgttaaaaaggttggtcatatttttcttatgtataagagatagaaagtaatgtttaaccaaaagaacttgatttttagtagtgtttttacatttttttgggtttcttaatcattcgcaaacttagttgcacaagctgtggaatacaatttatgaattttatatggaaaaagaggaaaacttaatatatgtgaaaaaagaaagaaagagaaaaacgatcctatttgttgcgattatgtattatttaggcccatttatatcttagccaacggcccattgaaaaactgtctcatatattatttaataagagtatagagagccacattattttgggtcaaaattgagtaaatgactttgatgacctgataatattagaagctatttttccaaataacgactatgtattagagaaataacatagtgtataccgaataacgatcgaatttttatgcttaagtcatgctctacttgacttaaatcgaatttttatgcttaagtcatgattagtgttaattttaaagaaacatgattatctacatatacatttttgcagccattttgtgaaataaatcctggagttgtaacttatttacaatggctgccactagcttttaattattgattttcttttggcaataaattgattaacaaacaaaaaatatttcaaatatattctaatcccatatatcacgcaaatttctccaaaatttgaactagatttcggaaactatttaaaacaaaaaatatttgacaaaccaaaatacaattgcaatcccttaaaatgagcaaaacgcacctaaatacatttcttatcagttcactaaatcttatttctccaatatttgaattagatttcgacaactatttaaaacaaaaatttgtttgacaaactaaaatataattgcaatcccgtaaaatatttttttaaattagcggtgtactgcagatttttttaacgggacgggtttggtagaacgggtttggaaggatgttacttgtaaactataaaatataaatattttataaataaatataatttacagacttttatatatactaattttaaaaaaacaattatttctgcggtgtaccgcgggttataatctacttattattattctgttacattgaaagaacttaacaataaaaaaaattgttagagattgagcaaacattttggctagtaattattttcttctctttatttatagaagcaaaataaggaatgttctaaatccattaacaagcctcatgcaactactgaactacactttgttcacacgaggcctcggaagttcttgcttcggtatgtgggaaatggttcacaagtttaacataatgggctgggccctatattactttgaaatttgtctaatgattaccacacatcattagagatattgtcactaggatcaatagaaaatgcaaagcacaaacgattacgactatatccacttatttgacgatacgttagatgctttagttgatcatttaaacaaaaaaaaagaaagagatgcaatgtttttgttcccttcaaagattttaagattttttagttaccaatcaatcaaatacaattatctacttcgacgtaagttataatatttttcaacgattgacggcatttcacgaacattagattagtatcaagaaataattcaccacgtgtcaaagtaataatacacgtgttcacttatcacgacacgtgtctattcacggacccacctctcatcgttccattgatgttaataaaagagctaaagattctctcatttgagtaatg

SEQ ID NO: 12968 - DNA, 3000 bp, Unknown
  misc_feature (1)..( 3000): cDNA_ID_3027260_gDNA_ID_2214584_Annot_ID_186604 3000 nt of promoter + ATG
accatttgccatgtgtctattaaataattaatgtaagctcttcaacttttaatttataggttaatgatatatttattattttattttacatatttaattgtattattactaaatttattttaatattacatgatttttcaataaaccattttaatagttttctcatacccgaagattttttttcttgtaatccaaactcaaagtacgagtgtataatagttgtggattacttaatgatttgagtaagttactctcttaaattgatatttatattctcttaaattgatatttatattctcttaaattgatatttatataataaaccactgagggtgaagaatacgtaaaaagctccatcatcaaattcttaggtttttagaatccaacactaccatctgttaaattggtttaaaatcaacgttgtttctgaattatgtgtatgatgcattgttgagaatgttgttagaattttttttaattaaaattgaatcatcgaatacgttgttatattgcataaacgaatgcttttttcagttgatactttttttttttttttttttttgtcaaacaagccttgtatttcattcaatgcatctcctaaaggtaaagtttacaagatcttcaagcatacaaagggttaaaaaaactccaaataacgaaagctaacaacaaggaaaaaaagataggtttgataagccatagaggaacggagacagaagcaatcaagcaacaagccacatgcgacctcatggtgtgtcatagacacttccgcgaccacgtcggggagtttcggattactcatgatcgagaagacttgatcttttgactttaaaaaaatgtcctttgtcttatggctcgtcggcaagaaatgcattgtggacgttgggaccaatggtaagaactcatggaaggtaagagttttttcgggtatgagttggagctcaagctttagggttaacggatataaaatattgatgaagatttggtaaccaccactccatggagacgggatcataatgacattattcatcaaacttttactttcaagaatagtacccatgatgtagctaaatatatcaagtatgaaatcaataataaaatgaatcggagatgaaaacttgaagaaactacggtaatcactgctccttagagacgagatcatcatgccgatcttcttcaagcaattagcaacatgaatagtacacctatagattctaatggcaaggttctcaaaggatttttgtaccaacatagcagcaatgttcgattatgattcaattgatgtccattagcaattggtatcatgaatcgatgcaaatacaagctaagagaagacaaaaaggagtttgggtcaaacctatgattttgcggagaccgtttagaggggctgggccaatgcattagtggagatgggccattgttttgggggatgggcctaaatttggttaatgggctcgaagaacagtggcccattaagaggaaccctaacaaggcaacagtgtggcagaggatggtgatggtgcgacggatctgaggcggcagataagaactccgataaacgctaaatgatgctggtgggaataaggtcaacgtagatgagatacccacataaaacaggtcggaggtaaggatggtgttgcatgtagagatcatagcggttttagattggaaaaattggggctgttctgttggtggaaacttcaaaaagatggatgcggacaaaagctgaatagaaggaaagatcatcgagcatttcctctgccctctgtcgtcaatgaacggccgaggaagttaaacgattgaaggttgggttgggatgattgagataatagccagagaagaattaaaaatatgaagagataacgaaagaagtgaaacgaagaagagaaatcccgacgccggtgagcaaaagcatcaccggcgccggaaggcgaagctagggtagtctcctcgatgttagtgtctgggagagtccttaagtttatataatgtcgtcattctaagacttagattatctccaactccgctacaatattcatctccaaactccttcagttgatattttaatgttgcttattgcataagtgaatgattacataaataaaaattatatttaaattaaaaataaaaaaaatctgaaaaaaccgcggcataacgcgggatgatcacctaatgtttaataatttgattaaacaagaacaatttgctttcatttgtgattgtttatcttatcatatacacctcgtgagacatgacgacaccactaaaatattgaaaattcgttaataaatttgtttctctacggatctggatctttaggcacatggaaaaattaatagatttagagtagtcatggtgctttctcgaaaaagttttttttttttttgaactttgaagtggaatgtctagacccttgtgggtggtttagggatgatgatgttcaataatttgaaaaaacaaccttctaaatcgattatgagggttcaaaatctaatctaattttcgagaaagctaattaacgattttgaggtttttttttttgaaaatgatgtcttttagctaattatagaaactattaacggatacctaacattgtctgattagtccattaggtagttaataatatgttttagttggttttgtcaacgaaaattagtgatttaacttaaagttaacataaaatcaagtattttattcatcaaatttaaaattcatggtttaaatcaacgaaaatggataattgatgatttaaatggtatttttcccctcatcttcttctaccatgacttgaactcatgcggtggtgtttagccctcataccaaatgagctacaagaacaggctaaatggtatttttcttactgtaaatgatgtagagcgttgtattatgttttcaagtgagaatgaaaattgacagacaaaaaaagaaaaataccagaaaaaagatatgtgagtaaagcccaaaagtttagtttttctacaagttgcttttgaaacgatg

SEQ ID NO: 12969 - DNA, 3000 bp, Unknown
  misc_feature (1)..( 3000): cDNA_ID_2710041_gDNA_ID_2214584_Annot_ID_186600 3000 nt of promoter + ATG
atatatgctatatataaatggccacaaacgttaaagacctacataatgaaattgattgacgtattagtaaaaatctattactgtatcacgattaccaatataggctctaagcttgaactagtaaacatattacgtaataatttaggtgtcatatattactttatattttgatataaatatcattttggtatttaacacaagaattaattgtttttttttgtttttatgatcataagatcgatgaaaaatggtaagtataagatcgatcaatgttgtaataagtataaaattgaaatacaataaaaaagcttttttttttaagcaaaaaaaaaacaattaaaaactagtattacccaaaataacatgtatttcaaaaatttaactttacttatccacaataatatgcctttaagaattgtaattgtaagatcgattaaaagtctcatattctcaatttacatcaattcttcttatttttcgtttgtttgtcgtttgtcaatttttttcttaaacatgaactcacccaaattagcgaagcttaaatatttagttctttttatacaacaattaaagattccaaatttacttggttaaagacattaatcaccacaaacaaatacaatcttctcgagtaatcaataatcatgtacggtcaaaccttaatcacgtggcacttaagtcatatgctttccaaaaatatacatttacaaagattattctatactctctctcctttatctttgcctctttcgagctccaacctgtgtctgaattcgatatcaccattaggtgctttaaccacatggttagcaacatgttaatctatattatacatttccataaataggttgaggacacgtgtctccatacatgtgtttacaaatatcatgttgtaggtaatgattctaacaaggaccagctaaaaagaaggtggatttctagatagctcttaagttatggtcctagatctgtttagccagttaattaatcttgtttttttcaattgttaaatgttaatacttaatactattattaatatattctttctattttcgttcatgcagcttttaaggcgatcttgtataacttcgtggtggtccaaggtatacatggcacaacatagaagcattgtgtcaatataatattttcttaatcaaatcgaaataattgtttagctcaaaactttgattggttcacatattatattgtatataataacctttttccttcaagaaacaaccagtaagatctatatcagctgtaaaataaatacgcaagaacctattaactcgactcgccatttattactaaatgcggtagtgtcattaggaccaatctctcgaatttgacttctgaccatataaaatagggagtgtattttcattaacatttgagactttttcttgtaacaattgatttataatttttcatgtgcctacttgtatctttagagtctgtatggttagaggactgaaaacttttgtaatgttttaggcttatttgaataggctataatacattagacttctagttcaaatagttaatcatttttttaaaagatagttaatcacgttatggaataactcaataagtagaatatcatataattatataattgggtgaaaactttaatttaccataacatggaattaacaaaaaatgattgcgacgagggaaaagaaaaagagagaatcagagaacgaaagattggaacatgggaaatggcatttcttgttgtctttgttttcataatgactaaaagtctaaaactataagccgtcataaaaaatttatgtaaattatttacaatagcaaaaaattacgtgtttggtaaaacatactgcacaattattcccatccgactactacatttataattatgtttacgggctttataggctcaaataatttactaaacttaggatgcatataaatgaatacattaatgggccacatttcttatagcccgataaatagttgagttactatctttcatagtcttgagtcttcacattaaaacgggtttaaattagcttcaattcaaagtcaaattataccaaaccagtaattaggatttactaacaaagaattgaacagaaactgttgacaaaaaatatctcttggactttgagttattccattgatgcatttttggcggtggatctttaaatgatattgatgcaggaacttaatcgttgtaattttaggtaatttacatttataaactatttaatattttggcaatttttattggttttccttctttttttatggggttttctccataattgaacttaactcggtctcaaaccgaacacgtataaatttctaaaaaaaattataaaatcgaatcatactaattttttatttcccacgcacgtcatatatatgacatatttattttgatacacgatagtgcatataatgatatcagaatatcaaaatttcagtgttaattatatctttagtaaaaatgcaacaaatgaaattagtatcttatttgtaaataatttttagaatgacaaaaaaaattgcttttgttttctaaggtgaggaattaaaattttaaatttgtcatttttaagtttattcaaaaaaacatgctagtttaattggagaatcgagtccgatttttgaagaaacatgtctaaatccacatattgaagaaacatgactcatatattctctttctgttctttttctacaaattttggcgttacaaaagtaggcatggtagtttttgttaggtctcgctaacaaataattaatagcatgtcacttgtcaatgcctcatccgaaatccaatccaagattattttgttccacagaaaagaacaaagtttataaaaataataatatagcgactataacgtttactattcatccctttatgggtcagtgtatatgtaatctcttcttttatcccaaatcacacattggcattgccattgacaatcaataaaacatcttgtgagacaagaacgggtaagtgataagatc

SEQ ID NO: 12970 - DNA, 3000 bp, Unknown
  misc_feature (1)..( 3000): cDNA_ID_2710038_gDNA_ID_2214584_Annot_ID_135322 3000 nt of promoter + ATG
atgttgaaagttaaaacttacatgcttttatcgttcgtctcctttctcatttagggaatctctaaagacatacgttaaccatttctttaaaattttcccgattcataagccaaccaaattcaattaatttggtaaagattctcatcacagacgcaatgtttttgttatattagttatatatacatgtatcttaataataataaataaataaaagtaacggttatttgttgataagtatttgcctatttgggataagatgattatttttttctctaatggataaataaaagtattttatttttctaggtgtaatagataaaattagccattcatgtataactaactaacacgtcatcttgcgtttaaatatttaagtcatgtaatcttcatgtctttttaacatttttcttctaaaccatttaaacagctaattatcataaaaatcagctacttaactagctagtaagtagtaactacgctctgctatttaactacattccgctagttttaatcctcagaatatagaagaatcttaaattttgagaagataaatgcttaaagaaacattaaacgatcgattttctgttaacaaattggtcaaaatagtgtgtacgtggttgtggcttgtggctggcttgtggctgaaccagtaaaaacatttcgaataaaacacatttcatcacaaaaattaatattttggcggctattgcttaccaaagtctgattggtcgaaagaaagtttggaaactgaagatcagaagacgtgtatgaatgtgagaggtggcctacctgcgaattggtagaatgttgacacgtgattagactccatgtgcttaccttatcacccgaaaagaagctctttcatagtttcattggcgtgaagcgatgaaagaaagtaaaaaatatcgattgatgtatgtacttttttgtgtattaaggtgtacgtacactgattttcgtggttttaagcatttttttttcttcgttttaaagcttaactttaactcatttgaatatataaattggttatgtaaaccaggaatcaaacgttagattatccatgattaaccgaatactctaattatacaaatagagtgtatcattgtaacggaatctttaagaggaataacagaataatttcatcttcttcgtttttttttcaaattctcgttcactaatatggtatcatagagttaagttttaaaatctcaaccgatttgacctaaatttcatggatctttgagattcttcttctgtagatctcactgaagtctcgttcactaacaattagccattttttccacaatatatatattttctatattaaaattatatattttattttaatatatctatatatatatatatatatatatatataacattaagtcatatatatatctaaattattcagaatgtaaaacaggaaaaacaattattcaaaatgggtaaagatataatctgggtatgtcaacatttgtaaaaacgttttctaagaaaacaaaacaaaatagttgttcaaaatgggtagagtagtttgaattttaaggtatatgtattaaacccaaattttgaaggttactttgttctttgaatataacttaccacggttttacatggattctatatgcagaatattgttatttatttatgaaatgttatttttacagtatgtacatatgcatacgtatgttcaaaatatatgttgatcattgctaaaaagaaaaacgattacctcgtatttattattttaaactctgaataacctaaaatgtgtttccattttggctatacaacaaaataaacgttaacattaacgtagaccatatatgtttcgagtttaaaaaccgattaaagaaaacatttgaaagagtgagtaaaattattagtatacgagagatgagagtaaaagtaaactaccttttgaaagacaagtcagttatgttttctcttttaggttgttgcttagacttatccatatgatggtgataacgacatcctctaatcctctcatcacacgtaaattaagctttatcgcattacatatttataaatgataattacatgtatttcctttagtttttcaaaggcgacctatatattgattattgctttggttttaaagactacgtacgtgttaatatccataccttaagaagcattttaaaaatggaatatgtttcataagactttttttgttttgataagaatttacatgaactaattaacttgtttatgcttcttaagataatcaagggtttgtatgtcaaaacacacactatttaggagctctagtaattaagtgagttttggttccaaattgccaacaaagtgtaagatctacaacaaagatcgaataaattaaactacggcggtttagttgaaaagttattgaactataggctgcatattttagaaaattcctacgtaaacaatatatccgcattataaattttcaattctagttaagatttctattttatatataaaaacataaaatgatccatttatcaattgttaccaaattataaaaacataaaatgattttatagtccaaataatattgggaggttgtttattcttttttttttttttggtctcttacttattgtcacatgaatttgacaaagaaaatgatattgtcaagttaaagtcatgtattttcaatatgaaacaatattaactattaagatattaacgaaagtgatgtacatatgtcatttgagatctactactagtcttgatttgctaagtggcaataatgttatttgaaagaatcataagcccaaatccggaaaaaagaaatatgtattagaaaaaaaaaaactctaatcaaaccatcccttgacacctactcctcctttataaatgataagtcctctgcttctcctaacacatcttctcttattgcagaaaaggtgagacaaaaaacatcaccaatcttttgaatctaagagagagaagaagaagaaggtctagagaacgaaaagaagaaacatg

SEQ ID NO: 12971 - DNA, 3000 bp, Unknown; identical to SEQ ID NO: 12969
  misc_feature (1)..( 3000): cDNA_ID_2710041_gDNA_ID_2214584_Annot_ID_135323 3000 nt of promoter + ATG

SEQ ID NO: 12972 - DNA, 3000 bp, Unknown
  misc_feature (1)..( 3000): cDNA_ID_3027260_gDNA_ID_2214584_Annot_ID_135327 3000 nt of promoter + ATG
atgcatctcctaaaggtaaagtttacaagatcttcaagcatacaaagggttaaaaaaactccaaataacgaaagctaacaacaaggaaaaaaagataggtttgataagccatagaggaacggagacagaagcaatcaagcaacaagccacatgcgacctcatggtgtgtcatagacacttccgcgaccacgtcggggagtttcggattactcatgatcgagaagacttgatcttttgactttaaaaaaatgtcctttgtcttatggctcgtcggcaagaaatgcattgtggacgttgggaccaatggtaagaactcatggaaggtaagagttttttcgggtatgagttggagctcaagctttagggttaacggatataaaatattgatgaagatttggtaaccaccactccatggagacgggatcataatgacattattcatcaaacttttactttcaagaatagtacccatgatgtagctaaatatatcaagtatgaaatcaataataaaatgaatcggagatgaaaacttgaagaaactacggtaatcactgctccttagagacgagatcatcatgccgatcttcttcaagcaattagcaacatgaatagtacacctatagattctaatggcaaggttctcaaaggatttttgtaccaacatagcagcaatgttcgattatgattcaattgatgtccattagcaattggtatcatgaatcgatgcaaatacaagctaagagaagacaaaaaggagtttgggtcaaacctatgattttgcggagaccgtttagaggggctgggccaatgcattagtggagatgggccattgttttgggggatgggcctaaatttggttaatgggctcgaagaacagtggcccattaagaggaaccctaacaaggcaacagtgtggcagaggatggtgatggtgcgacggatctgaggcggcagataagaactccgataaacgctaaatgatgctggtgggaataaggtcaacgtagatgagatacccacataaaacaggtcggaggtaaggatggtgttgcatgtagagatcatagcggttttagattggaaaaattggggctgttctgttggtggaaacttcaaaaagatggatgcggacaaaagctgaatagaaggaaagatcatcgagcatttcctctgccctctgtcgtcaatgaacggccgaggaagttaaacgattgaaggttgggttgggatgattgagataatagccagagaagaattaaaaatatgaagagataacgaaagaagtgaaacgaagaagagaaatcccgacgccggtgagcaaaagcatcaccggcgccggaaggcgaagctagggtagtctcctcgatgttagtgtctgggagagtccttaagtttatataatgtcgtcattctaagacttagattatctccaactccgctacaatattcatctccaaactccttcagttgatattttaatgttgcttattgcataagtgaatgattacataaataaaaattatatttaaattaaaaataaaaaaaatctgaaaaaaccgcggcataacgcgggatgatcacctaatgtttaataatttgattaaacaagaacaatttgctttcatttgtgattgtttatcttatcatatacacctcgtgagacatgacgacaccactaaaatattgaaaattcgttaataaatttgtttctctacggatctggatctttaggcacatggaaaaattaatagatttagagtagtcatggtgctttctcgaaaaagttttttttttttttgaactttgaagtggaatgtctagacccttgtgggtggtttagggatgatgatgttcaataatttgaaaaaacaaccttctaaatcgattatgagggttcaaaatctaatctaattttcgagaaagctaattaacgattttgaggtttttttttttgaaaatgatgtcttttagctaattatagaaactattaacggatacctaacattgtctgattagtccattaggtagttaataatatgttttagttggttttgtcaacgaaaattagtgatttaacttaaagttaacataaaatcaagtattttattcatcaaatttaaaattcatggtttaaatcaacgaaaatggataattgatgatttaaatggtatttttcccctcatcttcttctaccatgacttgaactcatgcggtggtgtttagccctcataccaaatgagctacaagaacaggctaaatggtatttttcttactgtaaatgatgtagagcgttgtattatgttttcaagtgagaatgaaaattgacagacaaaaaaagaaaaataccagaaaaaagatatgtgagtaaagcccaaaagtttagtttttctacaagttgcttttgaaacgatggatgggtatgtcagtaggcccatttagtttcgttaggcctaataaaatgagtttttccttttttttttttttaatatttttttgaataacagaaggttctgaggcgaaacccgtaatctttccaggcccgaaaccacagcacgtaatattagtttcggattttcattatatatatagtttgaagaagggttgtaattttttcagaatcagcttacggagaaagctacgttcgttcgttcctcgtcgaaccaaatcaatagtgaagacgaaaggttcgctcatctttgtattgatctaaagaatttgcaactcgtaagctctctccgatctcttcgttttcacttttcgtatcttagttttttttttgtttcttccttccgatttgataaaatctccgatcgtttggttatccgaagaagattcatgatttgtttcatagtcaatttttaactagtttcgatctctctgaatgaaatttcgttagggttttgagtgattgttctgttgtaattcatgaattttccaaagaaacttgtgtgaataattgtatgatgttgttgattgatttgtgagggtagaagaacgatg

SEQ ID NO: 12973 - DNA, 3000 bp, Unknown
  misc_feature (1)..( 3000): cDNA_ID_2710134_gDNA_ID_2214585_Annot_ID_135330 3000 nt of promoter + ATG
cgagaaaaccgccctgaagaagtggtttcaggaaggcacagagtttcaccaccaaatccgctagactcttgaatcgtttaaaaatagaaccccttagaacttgaaccaaaaagagaaagaatgagaaaaagggtagagttacgacatctatgggactggatgtgtccgttggcttttacctttagcattctgctaaagctcaatcttttctctaagagtcccctgttactcgaccaaatcattagagggaccatttatgtctcttagcctaagctcgaaaccaagtgagtttataacctttgtattgcttgatctactgttcgtgcttaatgaatgttaaagggaattggttgatctgaatgcctgaatagattaaggcaggttgttaggttgcattatgacgagtatggctaaagtttttaagtaagggtctatcatcttgcaatctagaattagctacctggacattgagcttacccgttctatatgcatgcttcggtttttgaatccccaccttcaaacctctccttcaacttaagattttttgtttgcttgagggcaagcaagagataagtttgggggagttgataacactgtattttactcattttagacatgtatttatcttcatttagcttagtgatcactcaatatttcatatcattttgaatcatttttggcttattttgcacctttaggcatttaggatcatcttgcatacatattgcatgtttttgtgcgttttcaggtgtagaaggagcttaaaaggattctactcgaccctctactctatccaaccaggagggaagcagcggagcaatctactcgaccagttcactcgatccaggcatctatagaggaggcagcaattcactcgaccagtttactcgatccatgcagctacagaggaagcaggagatcggtctactcgcccctcttactcgatcctctactcgaccccttcactcgatcaaggacgaccaactttacaagacttgttgatctatcaaagcatcttcagatcctcctcattcctcactcaaccagacatcggagcatacagataggagaggaagaagcatctactcgaccaattgatcactcggagcatagacacaaaggcgcagagtttgcagcaccctctttacttgatccccaagatcgagcactcacccaaaccgcctcaagtctcttgtcttctagtgaatctagggttttcaacattttagtataaatcgatcactttgggatttgttcaaaggatctagcttttatcctttagtttttttttgtgttcttgaatctaaaaaacttaattactcttaatctattttgtttttgcatttagttctttgagtaaagttgtttagtttgtttagatctacattttggtatgatttcagtaatttcttggtttgtgttcttagttatgttgtttgagtagtgattagggttcttgaggatggattagtgatatggttcaaacactacaagaaaacagtcaatttgcgaggaagggttgcgagggaaggcattcctcgcagtttttgcgagggtattgcgagaaaggtgttacgtaccgcacgcgcgtagcaattccgtcgcaaaactagcgagggaagacttcctcgcaaatttgcgagggaagtacgatggtttcgcaagaaagatattatccgtcgcaaatcccaagcagatacgtcgcaaatctttatcctaaaccctaaaatacataaaagtgttttgcaatctttgattctcatttataaatatgaatctaagtgaccatataatcattcaagttgattatatggtttgaacaaaaaaatattgtattggtttcaatattaacatttcattttgaaaatgttaaacattcatgattcatacttaaagaaaaccataagatcatcattgatgtatttggggaaaacacacattcgaattatatgatgataaaataggttcaaatgtagataattaacgttctaatgattcaaaaaaatgaatccaaatgattttgagtagtgattgttgtatttttcgaaattgattatacattgcgaggatattgcgaggtgtttgctagtacgcgtagcacttccctcgcaatatttacactaaaccctaaaatatttagaatttttagtcatgttcttattttgctgagggtcttactagaaataggagagactgaatcaaatataattattgaatcagatatgatttaattggttaaaacactgcgagggatttgctaggcgctctcgcagttccctcgcaatgtaagttgcattttgattggtttaaaagacggttcctcgcaattttctagcaaggtttgcgagtgatttgcgaggaaatatattcttatatatactcgataacctattttgagcggagctcaaacctgccgcattaaaccctaaacctaagttttttctttgattctcttcttctccgatctgttttcctcgtcgccggcttctcttcttctccgatctattttcttcggtgccgcctctcttcttcttcgatttgattacgtcgccgcctctcttctttttctccgccgcgtctcttattctccagcagccgccgcaactcttcttctccaacttcagccgcgagtcgatctgtttcttctccaaggtaacgtcttcttctccgatataacttcttctttccattccaacttccaccgttcgatctaacttcttcttcttctccgttgcgtctcgtcttctccagcaaccgtcatgactcttcttctccagcagccgtcgcaactcttcttctccagcagccgtcgcgactcttcttctccagtagcagcagcgactcgatctcttttacctccaaggtagcgtcttcttctccgatctaactgcttctctccgatctaactttttcttcatctccgatctggcattgttttccagatctaatatgttctagtttacggatctaaactcagggttttgtttgttttgcaagatg

SEQ ID NO: 12974 - DNA, 112 bp, Unknown
  misc_feature (1)..( 112): cDNA_ID_3027288_gDNA_ID_2214585_Annot_ID_186628 3000 nt of promoter + ATG
ccaggcactttctccaatgcagtctattagcagttggaaacttttgaaaaaccagatctcagctacctctttttactaaaacagaattatccaacagttccttccaaaaatg

SEQ ID NO: 12975 - DNA, 3000 bp, Unknown
  misc_feature (1)..( 3000): cDNA_ID_3027292_gDNA_ID_2214585_Annot_ID_186627 3000 nt of promoter + ATG
tgaagaagacatgcaaaaagtactagacaataagccttaccactatgatcaatggatggtcatccttcagaagtgggaacctacaatctctgacacctttacctctaagatccccttttggattgatatccaaggactcccaaaacattactggcaccaggatatgctcaaagctattggcgtagacttgggagaaattctggattttgaaataaccaattcttcagcaaagctaaaggtctttgttgatggcctgaaatcgctagtccttgacaccatggtagactttcctgatggcagcgaagctctgatctcgttagtctacaagaatctcaaaaattactgctcacattgcctaagacttactcatgaaaagaaattctgtccagatctggtttcagaaaatgaggacactacaaagttcagatcttccagaagtgaagaggcatccaaggatctggctagaaattattacactcctagagacaatttcatagcccctagatctctaagagaatcatctccctcaagagcgccttcaagaaacccttctattaatcaaagtcgttctcaagatcttggaaaagtaagaggagtagacctcaacttctagagaacatctatctcgccgagctggaccctatgaggagagaagacacagaaatccttttaaccctaacagaaggaatttaggtcgccatgagacaggagacaaaaggggtacctcaagatatcaggatcctattagagaggggccaagaagagattcttctcagactcctcaatggagggttagagccacacatagactcagtcctagaaatgatagctctgaaacttcgagaacaagacgtcccccgttggagagaaacctggattcttatgaggttactccaccacctcctcctcccatccctactaatgaccaaatcatgggagagcttagagacgtcactctgcaatatgttagttgtgcacacccaactgaaagcgctgcaagaaaacgaagagtttttcaaggagaagaaaaaggactcatggcagaaacagcttctataatgctggaagctgcactcatctcaaaccaaaattaccttgcctctgaagatcttccaacacaagataatctctctcagtaccaagacctacaaagtcatccggctgatcagactacaagctgtgttgctcctgcaaaaaagaaaagaggacgtccacctttagctaaaccccaaaacaaagctgctttaccattgctgggagcaaaatcaagcaaaagaaagggacttatccagaactcccctaaaaggaaatccacacctgagaagaatgaagctcacatacaagaatctgctggccctagcagaaccacgaaaacaaagcaaaagcttctcctccaacctggagcctccaacccttcctcaagtcaacctactccacgagtaactattatacctgcaagagtgaaagataaggtggattttcaccatctaccaaatcagattccttaaaagttctgagctggaactgttgtggattggggagccccacaacagtacaacggctgcgtgagatgcattcttcaatctcaccagaaattctgttccttatggaaaccaagaaccccaatgagacaaccctcacctctttaaactggatgaatttttctgcacatcaccttgttcccccgcatagcccaggaggtggtggtctggcccttctctggaaacatgaagtagaagtgacaatcctttattcctgcaacaactttattgacacaaagattaaggcggcgggtaaacacttctttgctactttcatctatggggaaccagacagatcaaagcggaaagctatatgggatcagcttaccagtttagggaaagatagaagtgaaccctggtatcttactgagaattcaattatatcatagattcttctgaaaaacaaggaggacctgcaagatatgaaggaacttttgtggacattagatcatttatggcggaatgtgatttgtatgatttaagacattcagggaatttcttatcttggcgtggaaagagacatgatcatgttgtgcattgcaggcttgatcgtgcattgtccaatggagcgtgggctgaagattatcctgctagtagatgcatttacctttgctttgaagggtcagaccacagaccacttcttacccactttgacctgtcaaagaaaaagaaaaaaggagtgtttcgttacgataggcgtctaaaaaacaacgatgaagtcacagcccttgttcaagaggcctggaatctttatgatacagacattgtggaggaaaaaattagcagatgtcgtttggaaattgttaagtggtctagggctaagcagcaaagtagtcaaaaacttattgaggaaaatcgtcaaaaacttgaagaggcaatgtctagtcaagatcacaatcaagagctgttatcgactatcaatactaatttgctcttagcatacaaggcagaggaagagtattggaagcagagaagcagacagttatggcttgccttaggagataaaaattcgggttacttccatgccatcactagaggtagaacggtgataaataagttctcagtgatagaaaaggaggatggagtacctgagtatgaagaggcagggatcctcaatgttatctccgagtattttcagaagctattctctgcaaatgaaggagctcgagctgcaaccattaaagaggccattaaaccattcatctctcctgaacagaatcgttctctgatttaattgccttcagcagaggaaataaaatctgcttgtttttctatccatgctgacaaagcacccggtccggatgggttttcggcgagttttttccaatcaaattggatgactgtgggtcctaacattgttttggagatccaatccttcttttcttcatctacccttcagccaacaatcaacaaaacacatatcacactgattcctaaaatccaaagcctgaaaaggatg

SEQ ID NO: 12976 - DNA, 3000 bp, Unknown
  misc_feature (1)..( 3000): cDNA_ID_3027296_gDNA_ID_2214585_Annot_ID_186626 3000 nt of promoter + ATG
ttatctttttatcgtaacttttggttaacattgacggttactctttatatttgtcattcttcagattattgtttcatgatgaatccaaaaaaaaaaccttaaaatgactagaaattcttgactctctaatctaatctgtttctaaatatacatcaatttaatatcaaagaaattcttctaattcttgatctaaccaaagatttttggaatgattataacaatggtgaagttttaatcaactctaaatataaaattctaatgaagatgccaacaattttcttctcagaattgggcggattatacagtgaatttttttatttaactattgtatatggtaatagtgatactttctgtcttaaggcaatatatatgggttgtatacaacgaaatattgatgctgcgttaacactattacaaagtccgaatatgagaagacatcctcaagcaatatggctatatttttcatatgtgttgggcgctttaaatgtggtaaacgtcaaatgaaccattttaaatggtatagtaatccagaaatcatctccgttattaggaaaaaagcaatgattccaatacgtcacatgaatattcaaggaagaagtttttttagtcagttaatttatcaatataagtataaattcatgaaatcttgtaaatgcttatttgttttttttttttttttaacactcactatgctttattgattaacagagtcaacgtacagagcagttgcaatacatggtgggattaaatggtgataaaagaaatcgatggttgataaacgttgattccgtgcaagctgatctgctgctttgttagctgttcttgggacccagttatattcgacaccttcaaatcttcgttcccataacttgatctctgttacccagttgaataagtcaaagcgctgtgcaggagattgaagaagagacactaagaccatgtttatttgtttgttatagatgtaatttacgtcatcaaatattgtattttctcaaatctatataatataatctgaaaattatccagattgacttaaaactgggcaataataattaaaatgactctcattagtgatagataactagactaacacaaattttatgtaaaaagacaatttgaccttagatgtccacatttaatgttttagtggtaaatatggtaactgttctaataagtctgtcattacatggaaaaaaaactgtcaccattgtaaatattattatagcaaacaaatatgcaaaaaaaaaccataattgatttttgaagttatagaatttttatatatttgggttgactatgtatatttacggtataatttttaggtgtcaggtttagtatttaggatatagaaattagttttgaatattaaatttagttttagatttgtggtatttttgaaaaataaaattcattatagtattttttggaaaaactcattttagtagtatttaaaagaatttcaaaaaaaattgacaaaaaaaaatcaaatctgtcataatatgattttccaaataaaacaaatgttacaatagttagtattattctatgaaaaaaatcatggaaaaaagaaaactataaatcggtcaccataaggatttcaaattacaaatctgttgtaacataaaatatttttaaggtcatgccatcaaacgacagatttatggtaatataagtttatctgtcacaacataaaacaactctgtcataacacaaaatattatattttagaaaataaatctgccatcaaacgaccgatgttgtgtaaaattgcaagaatcttttataacataaaacaagtctatcttaacattaaaaaaattggttatcgttagacgtcattctagtaattaactttttgacaacaaatgtgttacaatgtgacagaattttttaacaaaattataaatctgccatcacttaacgtaaaaaaaacatccaaaaaaataagtctgtcaaattatatgaaagtctgtgattgaacagtgggtaaaccatatataaaaaaaattatatcctgaatttatttgtatttccaattactcaaaaaagcaatgtatctagatcatctttgaatcatcccataaatctaaaactggtgttgtcattattcactaaatcgacttccactctttcttacagaaatatgtttgataatcaatagaaagagatacataaatgagaaaactacgaactctattatgattttaaacgatattgaatatacaagaaacttaatttcgagagaaacaaaagagacaaattaaaataaaaacctccaaagaactaataaaatcgtgtaaaaaaaaatcaaagcttttgaaacgtaaattagtaaatttgtctgtaacgaaaaatattccgatgaccaccagcacggtcaccaacttttctccctcttccttcgcctccaccgccattaatagcaggttcatactgtcgaaccgactctgttttttcttcttctcctcctccgttgaaaatttataagttatattcttattgtgaaagtacagaagtacccacgaatctgacttgacttttgatccttggcttttcttcttcgtcctcgaagaatttctgaaaatctcgtttcatacaaaactttgattcacgaaatctcgagtattcatcgtatcttgtgtaggagtaagcttgactgcttgagtgttacttgagatttaagttgtttagttttgagaaagattaagtttaattccttaggagttatcttaggatattattaaaagttatctaatattaatccttgtgtgtttaggtttagattattgatctctatataagagttaccaaagttgtggtgaaccttaagagaatttgagattgtgaagagatcaatagctttacgttttgagtgagttttctaaagaaattaaagagagttattctttattttgagttcttaaacatttctctaaaacaagaattggtattagagctttaaaggttcaatcaaaccaaccaatccattaagagagaaat

SEQ ID NO: 12977 - DNA, 3000 bp, Unknown
  misc_feature (1)..( 3000): cDNA_ID_3027300_gDNA_ID_2214585_Annot_ID_186625 3000 nt of promoter + ATG
catgtctcaccatagatagtttggaatattcattaacggttattttttccgttagtgtcttttatcgcaacttctcatacaactgtattttttatctaaacagttgtgtctattaaaatattgacagttactcttttacattcgtgtcttttaatcgtaaacattagattactaattaaatatcggaaattttgcttaaatcaaaaaatatcacatttaatatcaaattttttatagattactaatttactactcgaaattcaaatactatcgattaatatttaaatgtatatatattacatccgtctatttaggtgggctttatctagataagatgaaagtacagttttacaagttacaaactcatatgattgtgccacgtgtcaaatataacgatcagatgttttactgtatcactaaaaatttaatttttttatttttttttttaaaataaaaaaactaaaaaagtaaacaaatttacatatactaattttattatatatatatatatatatagacaaatattttgatcaacctaaaggaaaatttacaaatttgttactacatgtgttattggtcgattaaataagtctaaaatgtattaattcaaaatagaatcattagtatgaataatctatactatataaaagttgaagctatttgcttataaagacgtccacataggatatagaacgactaatcggggttggacatgtcattaattaacatttttttaccattttattgattaacttttataaattttacgaattttctataataagattattatatggaaaacaatatatatggaaagaagagatatgacaacttttgaaaatatagcatatggaaataagaaaagtgtaaaattgtttaggctatttgctctttacggcgtccacatagaattttaaacaactaattgcagttgaagatgtcattaattagcatttttagccattatgttaatttacatttttaaattttaacaaatttctatgttaaaatatttatgaaaagaaaaaaagatatggagataagaaaatgtattatttgattagtatattatagaaatattaatgtcattgttagtgtcactatgttagcttccaaataaattaaaaaaaaatcttaattctaaaataatatatataataagaattggaaaaaaaatcaaatataaaaataaattttctaaaactctatactatagaaaagtcgaagcttatgagcctctaaagacatccacataggattttaaacaacgaattgcggttggacattgtcattaattagcatttttagtcattctgttagtttacaattttaactttttaacaaacttcaatattaagatatttatgaaaaagaaaacaagatatggaaataaaaaaacgtataattcaattatataatgttgaaatattaatgtcattgttagtctcactatgttagcttccaaataaattaagaaaaaatcctaattctaagataatatagataattagaattggaaaaaaatcaaatataagaagaagttttctaaatattaacaaaaagatagtaataaacaaccgtgcagaaattttccggaagtttgagaaaattaaagtttaaacaaaaagaaaaagcttaatgacttaaagaaaaacttcttcttaacaaccatggaaattaataaagtcttaaataataaagcagtggtgtctatataaataaacatctatggaccattgatgatagtcgatcaaagattttactttgaaaagtttaaacaactaatttattgacttaactaagcgacctctcgacaaacttgaaaaaagcttttactaataagaaaaggaagaaacttttaaagaatcatatatatgaaagttgaacaactctctccatatgagtgacacatcatcacacaagaaaatgacatgtgtgattctacattaattaaataaaaagattaaaaactatttgaggaaaaattcttttgttgtattaaatccaccattaatctcactcttaaataaatattctaactatacaaatataattacataaaatgaatataactttattaactacataataacatacacgaaaataacataaattaataataaaaatagttaaacataattatttttaaacaaatttcaaacaacaaccaacaaaatgacaatcacaatgtgaatccaaactttaatcatgagcctatcacaatgttactgaagtacataaaacaaggaaatgattatttataatcgagttaggcaaatattaaaccacaaaaataacatagttacacagaattgtattaaaatatcattattgttgttatatgtattcataaagtgaaaaatattaaaattttataaataatcaactttatacacaaaaatatataaattgatatttcgagtcacaaatgaatctaaccataaaaattgtaactacatattatggatctaattttactaataatacaagaataaacaaatagtaaatataaattagcaaaaagaacaatcaatgtaatttttttttaacaattttcaaaacagatccacgcgtagcatgggtactcatctagtatatatgaaggtaggctatgtgaaaattttggaaggtaggctatgtattgtttaaacaaaatcataagaggatggaaagatacacccgttaaaaaaaagtgtgtgaaattttttttaaaaaacaaattatttctaactcttttttctcgatagataatcaagcctatggcgtcaatgtttttttgctgttgatgtcgatggaagtccatcacgagattaataatattttatactaacatatcttggcccacattaagaagcccaccaagattctcaagcccactataggcccatcagctttttatttcttcaattgagtttgacgtgttaactatatagccggaaggtaccaaaatacttttcgaagctttgacctaacttggagatgagagatttaacaacagcg

SEQ ID NO: 12978 - DNA, 3000 bp, Unknown
  misc_feature (1)..( 3000): cDNA_ID_2710119_gDNA_ID_2214585_Annot_ID_135334 3000 nt of promoter + ATG
ggatttcaatttccatctgaagaaatctgtaacctgataatagaggaagatatcaagtgcataatcgctcttttgtgtattaaaggaatttgttgggtcgtcatgctaatccacttggaacagaaggcagtttgtgtgtgggattgtgcatcagcttttttaacaaaagaagttaacaaaaaacatgttggtgcctactctattgttgtgccatacattgttcagaacatcctcagaaaagaggacatggatgtctctccattcagtattagagtcttgacctcttttcctcaacaaatttctaaatttctttaatatatcagagtcttgacctctattcctcaagtaatttccaaattaaatgcttaaaattcttttggtttttggtggtaggctcctaagattgaagattttggtatctacgttgtgaagataatggagtgctatacaatgtatactagtcattcaaaccttgagggaaatattattggaaacgcaaggaagaaattcgcggctaacatctacacagaattagcaaatatataggttagtatatgcttaaaccaatataatttcaataaccaatccgtttgaagaattaagaagttttgggttatattatcatttttcttttgaatagggtcagtcactatgcagaagtagcagattgctaataaaaaagagtggagtataagaaagatttagcagcttttgtttcttatttcataaaactttgtcgtttgaatattttatgaacatctgtatgatataaattttatgaaatttatttagtacaattactattgaacacaattactgtatgataaatatgctttttagcagatttttaaatgatgtacaagcttttttttaaaggatttaaaagcgttgaaaaaattgcagtaactgttattataaaaagatttacaactgtttttaaaaaaatttacaaccatttttaaaagaatttacaatcgtttttaaaagaattttaaagtgtttaaatttttttgaaaaaggtgcactaaaagtaattcgaactcaagacctataaaactaaaatggaaaaaaatattgatgaagtttatttagtacaattcctatatatggttgtctgggttagaaagtgcttaaagttgaattgaaaaggattcaaaaatgatttacaaaagcaattttaaaaggtttttgaaaggatctacaatcctttttaaaaggttttaaaagaattttaaagcgttgaaaaagttacaataatgttaacacttgtactgttagtaatttggcctaggccacttatttttgaaaagcaagccgttttagtaaaaattcactgaagcccaaaattcactaaaaacaaaaagaaaaggaaatcgtgaaagtaacaaaaaaaaaaagatgcaaagaaactgtcccttcaacaatttgaagaaattccgtttttccagcaaagaaatgaattgaaggtcacaatttatgacactaaagtttgatatttggatttgttcgattttgtttctttttgccgaatctcttctttgttatagcaatttctagggtttttggttacaaactacacaagtaaaatagattgatatttgggattatgaaagaattttagaaatggttttacaattttgatagattaatatttaaagtttgatatttgggtttcgaaaaacttttaaaaagatttctaatgccaattctcttatatgccaatcctcacttaatttatgggttaccagttgattagagctggtttgaaaatgttttttttttgtttctatttatggttgtgtgcttttaaaaaattttaaaatttttttgtacaagggttataaaaaagtctttaaaaggattatgaaggatttttaaaaatgattttacaagggtttttaaagtcctttaaaatgacttgtaatgactgtgttgtttcgaaactacacaagtaacatagatttacaatgatctacgtatacatttttggtagggtttttggccaaaaatccctcacctatttactattttcaatattagtctttacaaatttaatttcaatcaaatactttataactaaaaacttacaattagttgaattgcagtaattagttgaattaactccaataacacttgaattgaataactccaacgacacaaaaattttataaacagtttccatactcaacaatgtgcattcatgtcaattaaaattctcaattcaaatatatggtaaatatcaattggcatatacaacttgccctatataaacgaattctcaccacaatatcacattcataatagtcaatatatttaagcaataaagtttgcgtgattagctcacggactttctctgttcgtttcttcttaatagccaatatatttaagcaataatgttgcttacgacttgccttatacaaccgaattctaatcaagcaaaatcactaacataatagccaatatatttaaggaataacgttgactttccctatgtgtttttttcgtgtgtagctcacaactttccttatacaaacgaattctaatcacgcaatatcactaacataatggccaagaatatttaagcaataactttttcgagaaatgaaaagaaatttccttatgcgtttttttttctctgtgtagagcaaaaggatttttaacctattgttatctctataaatactcttttaacgaccggcacttctcatcatcacaaactccaatctcttactaattcattagcaaaaagcttacttcagaaaaatggtttccactttcgcatatcttaaagttgtgagaccctacaagacaagtggaaacagttcaccgcgagtaccggtgaaacattggagttggtcatttatgatgagcaagtaaaaaacagaccctccaagtatattctttacaaacgtaaataatgtatatgtcttgctaatgcatcgtatcatttttcaaaacatttgtaggggaagacacacatctgtgaaaaaggagttgatg

SEQ ID NO: 12979 - DNA, 3000 bp, Unknown
  misc_feature (1)..( 3000): cDNA_ID_2710111_gDNA_ID_2214585_Annot_ID_135336 3000 nt of promoter + ATG
gaagagttttttctttcttaatttggctcttcaaactttatgagtatttatttcctttcaacgagcattcaatattcttcttcatctgctaatacattacatacatatatttttatacgaaagacatagttcaaacatttctttattgacatagtaaattgtcttaatattttgggatgtactttgaagagcattttcatattctgttcatgcaccattatgaaaaaatagttcaaacttctttcatttttaaattctctaattgagttacctaaacaccatattgaggtgttattgtctgcttgcccgttcatttaccattttaaatttatcaacaattctctacttttttgccttcaatatataagacctttaaatttttgaccaaaatatctagttccagcactaatatttaatccgtggtatatattggcattgcacgggtcttttgaaaaatactgcgaattaaaaataaataaaaatcagaaatactattaaccattaaatattccaaagatactacaaacttgtgtttggactataatttggaggatggaggttcctaagaatataggaagaatttgcctcttgttgcttctttggttagcttttcactgggactcctatgttgttacaccttgttatgttatggcttgttgatccacaatgtccacaatgaagagtcactccttgtcttgtcaatttttgcattttctgaggaggttgatttgctcatatctctttcatcttcttcttctgtggtgactcatttttcaacttgattcttttctgcttctttttacgacccttatcccttgatggtggttgaactgtagattccctagattttccccaaaaatccattccatatactcccataagtgtctcactgtattgatttacccaacttgtagtcaaataccaatctgagacaacgaaatcttcaagcttcagctttttaccaatattatttgtagtacatgtcgacaaggtaatcatatcatactccacctcctacacacacatttctttgcattcatatcaactctaaaaccttttccatgctcagttacctcatataataaaatatatgttacatttaaaaaaaaaacaaatccttttttgttaaactatttttcgattgttattttaatatttacttcagaattattgaaaagtgataatctataatatatgttttgtaggcagaattttaaatttctatttaaatattataagtatttttcttgtatattccataaatattggatctttcatcatttaattaattttttgtttttgaccaaatttagattgatatcttaatgaattatttttatattcaagtcaagattaaaacaaaatctaaggtcaaaagtttttataaaaaaaagtcaatgagcggttgagtaaaagtggtgatggttgagaaatttttttgcataccttataaatttgtttttcattggaagatagttgtgatgatctatagtcgaatttttccaaatatcagagagctataatctgaatatgaaaaatttagttaataatgaaacataaaataaaacaaataaattaaattaaacaaaatcataattaaataatttatataaaactgggaagaaaacaatggatgtcttgttgaaagatatggatgatcttatataatgaagagaggatgtcgatttagggttaaaattttgaatcttctagtgaaatcttcttttaagctttgagagcaatgctaaaaaaataaatgaaaattttcattttcatatttgaatactcaatcaatgatcattcatattaaatatacataattataaatttgtggaatatgcttgttttaaacgattataatatcagatttagggagtataatcataatttttatatcatattcgaatactcaatcaatcatattaaatacacgtaaatagatcaaattaaataagattcgaaaataattttgtatatttaagttatgaattattttcaaagcggaaattaataaatgttatgaaaattaatatttaaatatcaaaccaaaaatgtattattttttaatgtttaaaaatatttttatattttaattatgaaacataaaagatggtttaattaaatgttattacagttatttatataaatttagaatatttaagccaattttgaattcaaacatattaattcgatatttataattatatatatatatatatatataaataaatcatatttgctaaattacattagaaaataatattttccgccaaaaaaacgtaaacccgtgattttcccgccaaaaacgtaaacctgtaatttttccgccaaaaacataaacccgtaattttcccgaaaaaaatgtaaacccatgattcttccgccaaaaaagtaaacccgtaatttttccgccgaaaacgtaaacccgtaaaagtagaatccgtaatgaaataataattattaataacgataattatttatttttgttttacaataataattaattaaattcttatttaaatgggttaacccatttaacaactcaacccatcacatattctcagtggggattcaaaacttcctaatggactcttcgccagcgatcaatattcgaagggaaggctgaatgtatactctagactagatattctatcctttgtccggaaggtttttgatgagacagagaaattcgattttattcttcagtcatgctttggatctctattccatttgtcggttagtagggttgcgacttcgggtaaagtcattcatgccttactatgtaggaagttggttactaagaaaaagtatgagttttggacacacccaatgtgattttcactacttgaatttgcttccctggctggcttgccttgtggggagtttccggtggagtacgaccctgaaaatactccggtttatgatgatggcaagaagagttaccggaacgagttaattggtccagacaagacggttacgttaggggatatatcagccatg

SEQ ID NO: 12980 - DNA, 3000 bp, Unknown
  misc_feature (1)..( 3000): cDNA_ID_2710107_gDNA_ID_2214585_Annot_ID_135337 3000 nt of promoter + ATG
aaacatatattatagattatcacttttcaataattctgaagtaaatattaaaataacaatcgaaaaatagtttaacaaaaaaggatttgttttttttttaaatgtaacatatattttattatatgaggtaactgagcatggaaaaggttttagagttgatatgaatgcaaagaaatgtgtgtgtaggaggtggagtatgatatgattaccttgtcgacatgtactacaaataatattggtaaaaagctgaagcttgaagatttcgttgtctcagattggtatttgactacaagttgggtaaatcaatacagtgagacacttatgggagtatatggaatggatttttggggaaaatctagggaatctacagttcaaccaccatcaagggataagggtcgtaaaaagaagcagaaaagaatcaagttgaaaaatgagtcaccacagaagaagaagatgaaagagatatgagcaaatcaacctcctcagaaaatgcaaaaattgacaagacaaggagtgactcttcattgtggacattgtggatcaacaagccataacataacaaggtgtaacaacataggagtcccagtgaaaagctaaccaaagaagcaacaagaggcaaattcttcctatattcttaggaacctccatcctccaaattatagtccaaacacaagtttgtagtatctttggaatatttaatggttaatagtatttctgatttttatttatttttaattcgcagtatttttcaaaagacccgtgcaatgccaatatataccacggattaaatattagtgctggaactagatattttggtcaaaaatttaaaggtcttatatattgaaggcaaaaaagtagagaattgttgataaatttaaaatggtaaatgaacgggcaagcagacaataacacctcaatatggtgtttaggtaactcaattagagaatttaaaaatgaaagaagtttgaactattttttcataatggtgcatgaacagaatatgaaaatgctcttcaaagtacatcccaaaatattaagacaatttactatgtcaataaagaaatgtttgaactatgtctttcgtataaaaatatatgtatgtaatgtattagcagatgaagaagaatattgaatgctcgttgaaaggaaataaatactcataaagtttgaagagccaaattaagaaagaaaaaactcttctgatccatggattcatgtccgtttatatatatatatatatatatatatatatgcatgtgaaagcagcaaatgcatgtagacgtgatggaggtttcacacagtttacactgtagccattacaataataaacaacaaatacttctggtaggagaaggatatttctcttttttttgtatcttgcaagagcctttggttcgggtactagcataactgtaaattctttcgatactcgaggtagaaacagatatcattgtagtatagacatttccttataatctaaagtataaaaaaattgtttgaccatcattgttactttgtctgtgttattatttgccattatatgatgattacaatatcagaacacgtaaatttgcggttatagcaatcatacttgttgagtgttgtagaggagttaaaggtgaagtgcaagaatgcgaagacaaatgtagaagagttggagagacttggatgcattgtggtccatggtgttaatgtgcactccatgagcatagattgcagggttgttggaacgattctatatgatagaatcatcttcaatttttctcatgtatggttttcttttggtcgtgagcatgagagctacatcatctcatatgattttttgttgtacatatatatatggtcgctgttattgtttatggtgttttaaacaaatatttccgtacttgtgagagaagacacaggaaacaccaaaaaccggtggaaggttttttcaggagtgctagagtgatgcttaaagaccaatatggagagattcatgtgactcataagatggttcactcatttaaggagtggaggatactggttctgggttttacatttggttttcgttgtcacagagaagtggaaattaacgcatgcaatatctaggttacactaataagagaggaggtggaagtgactatgactctagtttccctgttggacaagcttctactttcatgtttaggaaattctaaaggagagttgatatgaaaccactcattttgtagaattcttttaaattatatgatttgtttgtccaccagaactaatcaatcttatgagtatcataggtatctggatcatgtctgaataccagtaccacaagattttgtgtcataatgtatttcgagttttagaaaattaatttctatgtacttttaaaatttgttataaggcatgtccatggtttttttccttcttatgtatataactccaacactttatataactacaaatttaataatagatggagagacaaacaaacatagatggacatttttgggattatgaaaattattaagcaatcagttatttgggcaataaataaaaattaatggaggttatcctagctaatcataataataaaaaaaaagtgggtaatcttaggtaaattttagtatatgagtccatttacacataaatgattagattaattaggataacctcctttaattttaaattgggagataaatggaaaaacattgagataaaatgaaaactgttacaaataattgatggatgcccattataaggcctatcttctagaattctctagaattatttgtatctagaattttattttgtcaccaagtaaaattcttcacttgtactcctatataaaggaccctttattcattggaataatacactcattttgtacaatctctttctctagttacaacacgttatcagcgcgctttaaaagaaacaatgaatggtggagaaatatgcttggcagacaatgcaactaatcatactattttaaaaaataagagatatttctcttttttgaca

SEQ ID NO: 12981 - DNA, 3000 bp, Unknown; identical to SEQ ID NO: 12976
  misc_feature (1)..( 3000): cDNA_ID_2710095_gDNA_ID_2214585_Annot_ID_135341 3000 nt of promoter + ATG

SEQ ID NO: 12982 - DNA, 2637 bp, Unknown
  misc_feature (1)..( 2637): cDNA_ID_2712894_gDNA_ID_2214585_Annot_ID_135343 3000 nt of promoter + ATG
ccaggcactttctccaatgcagtctattagcagttggaaacttttgaaaaaccagatctcagctacctctttttactaaaacagaattatccaacagttccttccaaaaatggctttacacaacgggcaaagatggagttccagtgacctttttccggcgttttcaactgttttcacctcaccgagaagtggaggtatcttctctatgcatcccggtagtgtctctgcttttactctctaattctgttttgtaacccttttcaaacttttaatcatgtgtatccctgttatcctgtttgaaaccctgaaactgtttgaatctctactttatccctgatgcctctccgcttcaaaccttacgccctctgtaatcatgagttcaagaatcccctaccatctcaaaggtaaatgaatagagagagaactatccccaccaattcgaagaagaattcgtgcaccagaactggacacttcagacctcatcgaagctaattccctaactctaatggatcgcctcacaaacccatctatccaacgattatggtctctctttcctttcctctcaaaccggtggaatctgaaaggaaaagctacgggttcagatctgggaagaggctgcttccagttttgttttgactttgaagaagacatgcaaaaagtactagacaataagccttaccactatgatcaatggatggtcatccttcagaagtgggaacctacaatctctgacacctttacctctaagatccccttttggattgatatccaaggactcccaaaacattactggcaccaggatatgctcaaagctattggcgtagacttgggagaaattctggattttgaaataaccaattcttcagcaaagctaaaggtctttgttgatggcctgaaatcgctagtccttgacaccatggtagactttcctgatggcagcgaagctctgatctcgttagtctacaagaatctcaaaaattactgctcacattgcctaagacttactcatgaaaagaaattctgtccagatctggtttcagaaaatgaggacactacaaagttcagatcttccagaagtgaagaggcatccaaggatctggctagaaattattacactcctagagacaatttcatagcccctagatctctaagagaatcatctccctcaagagcgccttcaagaaacccttctattaatcaaagtcgttctcaagatcttggaaaagtaagaggagtagacctcaacttctagagaacatctatctcgccgagctggaccctatgaggagagaagacacagaaatccttttaaccctaacagaaggaatttaggtcgccatgagacaggagacaaaaggggtacctcaagatatcaggatcctattagagaggggccaagaagagattcttctcagactcctcaatggagggttagagccacacatagactcagtcctagaaatgatagctctgaaacttcgagaacaagacgtcccccgttggagagaaacctggattcttatgaggttactccaccacctcctcctcccatccctactaatgaccaaatcatgggagagcttagagacgtcactctgcaatatgttagttgtgcacacccaactgaaagcgctgcaagaaaacgaagagtttttcaaggagaagaaaaaggactcatggcagaaacagcttctataatgctggaagctgcactcatctcaaaccaaaattaccttgcctctgaagatcttccaacacaagataatctctctcagtaccaagacctacaaagtcatccggctgatcagactacaagctgtgttgctcctgcaaaaaagaaaagaggacgtccacctttagctaaaccccaaaacaaagctgctttaccattgctgggagcaaaatcaagcaaaagaaagggacttatccagaactcccctaaaaggaaatccacacctgagaagaatgaagctcacatacaagaatctgctggccctagcagaaccacgaaaacaaagcaaaagcttctcctccaacctggagcctccaacccttcctcaagtcaacctactccacgagtaactattatacctgcaagagtgaaagataaggtggattttcaccatctaccaaatcagattccttaaaagttctgagctggaactgttgtggattggggagccccacaacagtacaacggctgcgtgagatgcattcttcaatctcaccagaaattctgttccttatggaaaccaagaaccccaatgagacaaccctcacctctttaaactggatgaatttttctgcacatcaccttgttcccccgcatagcccaggaggtggtggtctggcccttctctggaaacatgaagtagaagtgacaatcctttattcctgcaacaactttattgacacaaagattaaggcggcgggtaaacacttctttgctactttcatctatggggaaccagacagatcaaagcggaaagctatatgggatcagcttaccagtttagggaaagatagaagtgaaccctggtatcttactgagaattcaattatatcatagattcttctgaaaaacaaggaggacctgcaagatatgaaggaacttttgtggacattagatcatttatg

SEQ ID NO: 12983 - DNA, 3000 bp, Unknown
  misc_feature (1)..( 3000): cDNA_ID_3027367_gDNA_ID_2214586_Annot_ID_186647 3000 nt of promoter + ATG
catgttagcacctactagccgttagggcaactgagtacgcaagatattagtgagtatagccagttttcacctattaaccgttatggttagctggtcttgatagagtttcgtatgtctgagaatttggaagtaaacaaacctagccatgttatcacctagattgagatctatcccttattattgaaccatgaaatccggagaaacccccgaagacctaacacttctctcttattgcttaccgtttactttagttacttgtcttttattttggttacttactgcatacaacaaccccgtctctttattttggtcctagcttcactctcttcttaaggatttctctgaactacttctctccttgtgaattcgatcctaaaatactactccgatatactgtgcacttgcagtagtcgtgtggtcattaaggtaaaagcctaaggtgagataaaacatgaatcaagctttttggcgcttttgccggggagagattgttagttccacaagtccaagaactagagtgaactctaggacactttgcttttaatttttgtttttgtttttctttgtttcaggacttaaacaatgaatccaagaaattatcccgatagctactaccctaatgtgaatcacggctcaaaccacttatcccatttctctaccggccactacaagcccgatgcatcccaaatgcatggcgtgacttggcaatcttggtcgtctaatggaggagcttacaggaccgatcattactctaatgatcaatctgccaccttcgttcagaaccggccgcaagctaaccgctcgattaacccgttccaccattgcgtctcatcacctagagatcaacgcgtgggaggacctcactcttctcatccttatggagttgcccgccatgaagatttcagctatgaccaatgatacttgcaagaggtgatgagtatagatgttcatccgaacaactatgcttaccaaactaatgagccctacaaaaatttcgaggcggaagataaactcattggtcatctccaagacttcgttgatggccaccaagaagacgtgaagaggatcggctcaaaaatgtcggagatgaaggccaaatttgaggagaagtttgatgacctcactaatcgactcgaaaatatggagggggcacttgttgagatcaacaacgctcttcttaaccaccaagacgatatccaagaccaatatacgagaatcgtcaatgtgggactcgtcgttgatacggttgagagtcatttagattggaagattgaggagttagaaaagaagctcaataactcaaatgagttttcggaatgagaagcaaccaatcttgccaagaagaagatgagtttcctaaggcccaatcccgatatgaggaggaaacgaaaaaggaaattgaattcctagtggaaaaatgaaaagacctaatttcctattccaaaaaaggaaatcttgaccttataaaacctctagggattcgtccctcgcgtttctcctcaataccaaatcgagcaaaaagataacttagaagaagaagaagtcgtcccttttgaagtagactcgatggccggacacaattctagagaagaaagccttaaaaccgaaaaggaagaagtttgccttgagagacaagtaaaccgattcgaagaactttccgaagaaagtgatgaactcaccaacttttctagtgaagaaggaaaagacgaaaacaagtcaactagaggataatgacacgaaagaagatgtaactttggaggacgtggttaggagacaaggcgaagttgaagaaaaacaagtcaagaatgttgaaaatcaatcacacatccgagcatcgcatagaagggtaaccatggactcttcaaggaaatacgtaaaattacttgataggattcttgatttggataagaaggttgaggacttatcagcgcgcattggagggaatgaacttatggagagcaaagaagaagactctagccctcatgtgctttgtgacgcggtcacaacctaccaagaacttcacgaccttgaagaaggagaatcgacgaaagggatgaggaacctcccgggagaacaagcgtttacaactggctcacccttctaaaggaccggtggcatccacgtatgatagattgggaagacttggagattttaactgagtcgttgctaagctaccacgaggtacacccttttctaaagcttgttcggcttaccatattgaccatttctttcttgagagttgtgaaacaagaagagaaataaaggaactatatgaggaagccctacaccacttgaaaccgttcaacactcttcaaaagatagagagtctgggaagattccttatgacttgttctatacgaggtgttgaattcaaagatgccctatgcgattccggatcatgcatcaacattatgacaaagtagacatcaaagaagctcgggattaaggagctacgacctttggatgtacagatcggacttgcggactcgtctttcacggttcctgaagggatagttcgcaacgtttatgttcggatcggaaggtgcaatgtactgaccgacttccatgtcataaaggtcgagaaaggaagacccacccagctcatactaggaagagcattcctacccatagccggcgctataatggattggcctaatcgaacggtatgcttcgccaacattgatgtcgaagtatttcacgagattgtaccatttaccccggccgcaagaaggagaaggaagtcatgtacgagaactcggaacaactacccgaggaattccaatccaagagagctcgcctagggaggaacaacccgtcttactacgcctagtaagacccaaacgtcgagccaacgacgttaaacaagcgcgctaagtgggaggcaacccactgggttactttttccttaggatttgattttgcttttgcttttgcttttgcttttgcttttgatcatttcagtatttgtttcagctttttataaaaaataaaaaataaatg

SEQ ID NO: 12984 - DNA, 3000 bp, Unknown
  misc_feature (1)..( 3000): cDNA_ID_3027355_gDNA_ID_2214586_Annot_ID_186650 3000 nt of promoter + ATG
cttgtgcctgaagcggtgaaacactaggtccctaaaaagggggatcacaagtaggacgagagaggtctcttgcggcccaataattggattttacagtatatttactagatttagtataataccagctgtcggcatcactcttgtaagtacgactcggcctaatccctaaaatgaaagtgatatcagaagaatcaaccaaggcttgaaggcgtgaattaggtcattaacataaaggtgtgaattccttatgttaagaatactttttgctggccttgcagggacagaaggaatccaaggatcttgccatacacgggttcgccttctagagcctattgttcgtcgtagacccgagagaagaagtggtttagctgccataatacttctccatccaaaagaggggcagttagtctttcctatatgtataggatcactatacctaaagtatcttcccttcaacacccgactaaggagacgattttgaaacctaattagacgccataattgctttgctaataaggcaagattaaattcttccgatgttctgaactctaggccaccatcagaaaagagtgtgcaaagcttatcccaagctatccaatgaatattgttgctttcttcccttgtcttccaccaaaaaattgcaattgcactactaagttttgagcgaatacctttgggaagaagaaagcatgacataacatatgtcggaagggcttgtgccacggaattaataagaacctctttgcctcctttagacaagaattttgatgtccacccatttattcttttttgaaatctatcccccacaaaggaaaaaacttggtttttcgaaccatgaatttgttccgggagtcctaaataggatcccatacccccattcttaaatattcgaaaagatagtttaatggtattccgaatagagctattcacctcatggacaataaaaaattaaagacttgttagtattcagttgttgtcctgaagcctcaccatatgttcggagaatatcgataatctcttttccttgtactgggcctgctttacagaataaaagactatcatcggcaaaaaggagatgagaagtggagggactagctcgtgagatctgaattccttggattaggccatgccactcagcatctttcaactttgctacaagagcttccatacacagcatacacaataacggggaaataggatcgccttggtgaatccctctcgaaggtttaataaaacctttagggatccatttaacagaattttgtaagataccgacgatatacagaagattatccaatctacccatttctgagcgaagcccatcttcaacattaaagcttgtaggaatgaccattccacgcggtcataggctttactcatatcagttttaatggccatgtacttcttcctacaagctgtattcgtgcaaaaagcatgaaaattctcttgagcgacaaggatgttgtcagtgatcaaacgctcagccacaaaggcggattgagtctctgatataaggtccgaaagaagacgttttagtcgggagcttaagaccttcgaaattactttgtaacttagattacaaagactgataggtcaaaattctgacatttttctaggtctttctatttttgggatcaagcaaatattggtctcattcagccgtttatcaaaaaagccggtggaatggaagttttgaacaagtctgataaggccaggccctgtcaggtcccaatattgctgataatagaaggttgtcatctcgtctggaccgggagctttatcaaggtttagtgaaaaagaggacgtttaacttcttctataaagttcgctttgtgagtgttttgttcatgtctttggtcactaacacgggaacttaccagagaactgagtaaaaaactcgaggatttgacgtagaaaaaagagtcttgaagtaatcctctgctaagtgttcgatccgcaactcattatccacccataggccatcttggttaagtaagcctagaattttatttctagcccttctttgtttcgtagaagcatgaaaatattttgtgtttttgtccccaagtaggagccatatctccctacttttaagcttccaaaaaacctcctcgtctatgtaagcctggcagagctttcattttagggcaagtaagtcttcagtagaaaaattctcatcttcgtatggtagatcaagctgagaatgtagttcaagaatgagcttctcggaatttgttcaattggatttttccaaatagaaatagtttgtctacaattcctaatcttttggaatattggaaagccctctccacgagaggagaaagcccatccttctttaacaaaatctttgaatcctggtttatctatccaatgtttatcaaagataaagtgtttataaggacgctgagatttattctaaatggatgctagaaggggtctataatcggaacccctcaattgtaggtactctggtgtacgtttacaagaaaacaggtaaaagacgactacaatcagcgacaaccaacgtagtcgtatatttaaacgacattttggcgacggatttacgactacagtgcgacaactcgaatatttgtagttacatagttgtttacttacgactaacatagatagtcggaacatagtcgacaagtaacgactatttgacgattatattatttaagggagaaggttgtcgttacgtagtcgctatttgacgactatcataccgtctatctaatttagtcgctaattggacgactaatggacgactactttacttagtcatcctgtagtcgtagaaacgtcgcataggagtcatataaagtaggtgaaaacgtgtttcgcattggtaagtaggtacacctaattatttagtggtagtcgtaaattagtcacaaaaattggcctatataataaactttcacgaaactcttctttcaccaacaaatcaaaacaacaacaacatcaaagaaaaaaaaaatttagttagtttattgtata

SEQ ID NO: 12985 - DNA, 3000 bp, Unknown
  misc_feature (1)..( 3000): cDNA_ID_2702702_gDNA_ID_2214587_Annot_ID_135356 3000 nt of promoter + ATG
tttttttttaataaggggagagaaatacttttcttttttcacattgctctcaatatcatgtatgaacaaggagtcaagttctattaacactaaccgtttgatgaggtaaaaggaagagcagtgagattagctccggccttaatggattgtgttggaaaccaggatatcctcaagtttgttggtttgccatctagattttccaatagtcggattgagtcgcacctgcagcattaatcaaccaggcaataatctaaagaatagagatcataattcctaacaaaattttgactcaataaaacgactcaaaaataaggaaaataagagtaagaataagactcaaaaaagaaaaacatagttagtaacttcctcccctagacttaaacgtcactgtccctagtggcattcaaatccggagtaagcgagaaaaataaaagaaaaacaaaaaaaataaaaggaaaagaaaaacaaagaaacattggtgatgatgatgccccagggaatcatcaccaaagacaagggatagtgcctccaccagttcagaacaacaactttgagatcaagagtggtctcatctccatgatccaaggaaacaagtttcatggtctacctatggaagatcccctgaaccatcttgacagctttgataggctctctggccttaccaagatcaatggtgacattgaagatatgtttaagctcagactatttcccttctctttgggagataaggcacaccactgggaaaagactctacccccagacttcatcatctcatgggacgattgtaggaaagcttttcttgccaagttcttctctaacgctcgcaccactagattgaggaacgagatctcaggcttcacacagaaaaacaataaaactttctgtgaagcttgggagaggtttaaaagctacaccactcagggcccccatcacggtttcaagaaggctacctgatcccgaaacttttgtagttagtgtcaccattaatcatgattcattcccaagagctttatgtgatctcggttctagtgtgaatcttatgcctcgttcagttgctatgcgtcttggatattccaatcttgagcctacctttatcactcttgtgctagcagattgttctacccgaatttcggatggaattcttattgatgttcccgtgatgattggaaagagtatgattcctatagactttgtagtcttggcttatgagaaggaacctaaggatccattaatcatagggagatccttcttgcatacagctggagcaatcatagatgtttgacaagggaggatagggctgaatgttggcgatcttactatgcaatttgatatgaacactttggtcaagaaaccgatcatagaagggaaaaccttcttgatagattctttcacttcctcagcttcagatagtatttcagagatggaattagaagacccactagagcgagttttggtctctttcatagaggatagtgcagatttggactgcgaaacttcaacatatactaagctgctagatgagaccgaacatgtgatgaaacttacagttgaagaagctcttccatctgtgacttcaacaccgactcctacttcagattgggatccagcaaaggctcctaaaatcgaattgaaaccatttccaccagggctaaggtatgcttttcttggtgaaaattatacttatcctgttattgtgaatgcttctcttaatcccgtagagctcaccttattgctaagaaagctgcgcaatcatcgcaaagctcttggctattctcttgatgacattgcaggtatatctccagatgtatcatgcataggattcaccttgaggatgagtctaagtcttcagtcgaacataagagaaggctgaatccgaatctgaaagaagtggttaagaaagagattatgaaactgttggaagcagggattatctatccaatcttagatagcagttaggttagtccagttcatgtggttcctaagaagggaggtgttacagtagtcaagaatgagaaagacgagctgattcctactcggacaatcataggacatcggatgtgcatcgattacagaaagctgaatgctgctaccaagaaagaccattttgccttaccatttatcgatcagatgttggagaggttagaaaatcataagtattattgcttccttgatggatactcaggattctttcagatcccgattcatccagatgaccaggagaaaacgacttatcagagaatgcccttcagtctttgtaatgctccagcgacatttcagagaggtatgatgtctatcttcacagatatgatcgaggatatcatggaggttttcgtggatgacttttcagtttatggatcatcatttgaggattgtttagagaatctctacaaagtgttagcaagatgtgaggagaaacatctagttttgaattgggagaaatgtcacttcatggtacagaatggaatagttttaggacacaggatttctgagcatggtataaaagttgatggagctaagattgaggtcatgacaagtcttcaagcaccggataatgtcaaagcagtgaggagtttccttggacatgttggtttctataggagattcatcaaagacttcagcagaatcgcaagaccattgactgctttactctgtaaggaagtcaaattcgagtttacacaggagtgtcatgatgcatttcagcagataaaacaggccttgatcagcgcaccaattgttcagccaccagattgggatttaccttttgaggtaatgtgtgatgcaagtgattttgcagatagagctgttctaggacagaggaaggataagaagcttcatgcaatctactatgcaagtagaactcttgatgatgctcaaaggaattatgcaactatagagaaggagttgttagctgtggtgtttgctttcggaaaattcagatcttatctcgttggatccaaggttattgttcacacagatcatgctgccttgaagtatttaatg

SEQ ID NO: 12986 - DNA, 3000 bp, Unknown
  misc_feature (1)..( 3000): cDNA_ID_1836462_gDNA_ID_2214587_Annot_ID_135358 3000 nt of promoter + ATG
agagtaggaacagatggcttaatacaggaggccgaaacacaagatacttttactccactactaaaacatgatgagtacgaaatagaatcttatcaatccaagatgaagcatgtgtgatacatagaggagatcaaaacatagcaagggttgggactaataactttgagaatatgtacacttcaatgcctgtaagagaggctaactacaatgacgcttttcaaggatacactagcaagataacatcacatattaacaatgatctcacaagactaatgactgagcaggaaatcgaagaatccatatttgcagtggaaccattgaaagcaccaggctcggatggtttcactggcgagttctatcagcatttttggtcgaaaataaaaggctccattattcaagaggtaaacaacgtttttagagaaaacaagctatacgagaatcgtaaccacactaatctctgtctcatccccaaagtggaagccttgtcaccaatgggtgatttcagaccaatagctttgtgtaatgtaagctataagataatctctaagattctgggtaatcaactaaagaaacatcttagaggagtgataatagataatcaagcggcttttgttctggggcgaatgataaccgataacatcattatggctcatgaagtttattatgctctgaaagcaagaaagggtcgagcgtcctcaaacatggcaataaagaccgatattactaaagcctatgatcggttggattgggattttttggaggaaactatgaggcgaatgggatttgatgacaaatggatatcttggatcatgacctgcgtgacattagtgagacactcggttttgattaatggagcctcacaagggcactataaaccggaacgaggtatacgttaaggagacatactctcaccatacctttcattctgtgtgcaaaagtcttatcgcatctgaagaaacaagcagaagctacgaagcaactacaagggataaaaatctgcaacagaagtccttctttatctcaccttttatttgtagatgattcgttattcttcactcttgcaaattatcgatctggcatggcaatacagaatatcctaagtaatatgaggaggtttcaagacaggctgttaatttaagaaaatcagctataacctttggtcgacttgtgaagtcaaatacaaagagacaaatccgtcatttactaggaatcaacaatgaaggaggtggatgtaaatatttggggcttcctgaacagtttgatgaaaagaaatcagaactttttcaatacatcgtggaaaaggtgaaggaaaagactcaggaatggagcaaaatgtttttatcccatggaggaaaggaagttcttctcaacgcagttgctcttgcgattcccgtctactcaatgaatgtttttaagttaacaaaggagatttgtgaaaagataaatggcatataagcgaagttttactggagctcaggcaatgacaaaaaaggtatgcattggttctcctggaatcgtctaagcttgccgaagagagaaggaggtttgggattcaaggatctaaagaattttaacttggccttgttaggaaaacaagcatggaggatcttagaacagcctcattgcctgatgtcaagaatgctaaaaggaagatacttcccagacactaatatcatggatgctaatcaaggtcagaaggattcttttatttggaaatcaattttgcagggcatggacctactaaagaagggatttcgctattgtgttggtaatgggactctagttaatgcgtggttggatccatgctgcccattcacccgccgagaccgccacaaaaaaactagggatgccctagatcagcatatggttagtgagctcttaaactcaacacgcacatattgggatttcatcaaactcgctacttagataatacttgatgatgtggagaatgtcaaaaatattaaagtttgtgcattatacaaagactgacattatacaaagactggcatttagactatgaaatctgcatatgttatacaaacatatgttttgaaggagataatcatgagttggaatcaattatcaacagaagaagtccacacttttgagtttcaattttggatatgagagattcgagcttagaaacaaatatttctaggaagcaaatttttatgaataggaagaaaacacaacaaaccagcggatattctcgtaaagcagcaatgacctcaaggaacaaaatttatctttcataatcatattctttatgtaattcataatgctatgtgtttgtatcatacgttatttcaatattaataagaagctacaattcaaaaaaaaattaaaaccaaaatctacaccaaactttttttttttttttttttttttgtcgtcctacaccaaactttttaaaaccgaaaatacgaacttaaaaaaccaattatagtatactttttttttgttccgttttaatttttgttttatttcgataaatatctctggcgtagattagcgagagaggtttagctgtcgttttacattctctcaaagctctctcttttatagctttccaataacaaatcccaaatctgattctttcagctaaaaatcttacatcaatcaatcgaattgtcaaaaaaagatatcacaacccttcttctgaattctcatttcttaagcttatacacttgaaatctccaaaaaggtaccatttttatgactttgttatctccgttttgtgttcgttgtttgcgattctcaattgggttaaaagggtttagtcgttaaacatttccatcttcgtttttggacttgatgtgaatttaaagttgggaccttttatgttttgatccaaagaaaagaatctgcttaattgttgttttagtgtcagatttgtttcttctttgatgcaggggaaaaagaaaatgagttaggtgaagtttcagaaccatagagacgacgatttgatcgttgcgtaaaccaaatgatataaagcaaaag

SEQ ID NO: 12987 - DNA, 3000 bp, Unknown
  misc_feature (1)..( 3000): cDNA_ID_3027424_gDNA_ID_2214587_Annot_ID_186675 3000 nt of promoter + ATG
aatacgaagcagttgagtataaatttttcgtgccgaattgtccgcttttacatttgcattacaagatattaaacataaagagaagattgtgaattgttccttgtagctttggaaatcctccaaatatgctgaaaatgctaattcttgattgtcggcaccaattatacacttcatcgccgagagtagagcttcaacttctatggagtggagatagagttctacgcagattggctactcctatggttgacgactctccatttgatgagatgcaaaaccacccttatccacaaaacttatcgcttcttttccatgatccatccacaaaacaacaaaatccaaaataaatattattcttaattttagttctctataatgttttaaatagtttgtattaatgtactcttaactaatttatcatctaaataatttatgtttcttttttaacttctaattaatcagttttcatatttggttgcaatggaaaattaaaatataaaagactcctaagttgttaaaaactacatcaaatctcatagaaaataaatatctaagagtaagaaaaaggaatcaagaaggagcattttcgtcatactagaaaatgaaaaagacactgaacctatgtcttgcccgatttggagagtactattcggatcacataattgtcaaataccgctatcaataacagaaaagtagccaatttaatctaaaatagttaatgagatttcaacaactaatatttaaattgattcatattggtataataggagtatattccaataacaaattataaaaatttaatgtactatctctctttgaacatatttctaaatagggaaaactaggaaaaatgatatctaccactgttttgtacatattttatttttttggtaaaaatgtcaatttggacaaacataaacctatactttattttaagttgttttcaaaaaaagaaaatcacaataacatgtagatatacaagaatagacatgttatgaagtgaacttttattggttttattgaaaatgttgattttcttatagataaaattttgtgtaattttgttagaacatgttttctagagttctatgaaagtaagagtgtgtattctacatttttgtacacgttttaacaattttagatttgttttctgttcttaataattcagaagtccgaatatcaaatttctaaaatatttgaaactggcattatacgatttgttctatgctccaaatttctaattacttcataatatgctattgttagaattgtaggggatgtattataataatgattttggaaatttttgctttttttttgtaaaaatcacacgttatgcaattagtgattttaaaatctcatctcaaatttcatgttattgaaattgaaatttatgtaaaatcatttcaaatctcatgttattcaatcatgaatttcttaaaaccataagaaattgactgttattcaaacaaccaaatttgttttaaaaaatattgaaaaatgatttggtgagcctaagccctaaggatacctttttagtgtaaaaataagaactaaacaatcacacctctagaggtggtatttgatttttttttgaaaagaactaaaaacatgtggctaacgaaactaaactattgaacaatctcctctcactacaagaaaacagtcattttgcgaggaacaattacgagggaattgcaggtattttgctacaccacggacgaacgttgctaatccctcgcaaatattgcgagagtctgcttcctcgcaaatattgcgagagtctgagtactttgcaattaacgatatcaaccctcgcaaaccactcgcaataatctcgcaaatctttaccctaaaccctaaaatacatagaagtgatttgggatctttgatttttatttataaatgtaaatctaaatgactgtataatcatacaatttgattatatggtgatgcacaaaaatatattgtatatgtttcaatatcaacatttcatattgaagatgttaaacacttattattcatattattgaaaacacataagttcatcattgatgtatttgggaaaaatgtacatttgaagtttttgagatgaaattagattctaatgtagatatttaacttcctaatgattcagaataactaatccgaataattttaagtagtgttttcttgtattttttcaaattgactcaacaatgcgaggtctttgcgagagatttgcaagtctgtcgtagcagttccctcgcaaatatttaccataaaccttaaattatttaaaatatttagtcatgtttttatttgctgagagtcttattcgaaataggagaatctaaatcagatctgattcaaacactgaatcaaaatggtgagttaattggttgaagaattgcgagggaattgctagacgcaatcgcacttccctcgcaaattttaccctaaaccctaaattattaaaaatcataaattgcgagggacttggtaggagttctcgcaattccctcgcaatatgtggtgcgttttaattggtttaaaaatcttcctcgcaatttcaaagcaaactatgcgagggttttgcgaggaaataaatttctatatatactcgaagacctagtttgagtgaagctcaaaccagccgcatcaaaccctaaccctaaattttttcttcttcttctctgatctcttcggcgccggagctcttcttctccgatctgattccgtcgccgcctctcttcttcttcttctctaatctgttatactcatcgccgcctctcttcttctccgatctaattacggcgcagactctcttcgccgcctctcttcttcttcgatctgtgctccagaaccgccgcggctcttcttctctgactcgatctgtttggcctcaaaggtaacctctgtttctccgatctaagttcttctctcaaatctgacctattcttcttcgatccgatcttacttcttttttcccagatctaacacttgatttgttttttgtgcaag

SEQ ID NO: 12988 - DNA, 3000 bp, Unknown
  misc_feature (1)..( 3000): cDNA_ID_3027434_gDNA_ID_2214587_Annot_ID_186672 3000 nt of promoter + ATG
tattatgagagggtaatgatgatgatgatattgtgttgataatgagtaaattgatgggttgatgaaaccatttggaaaaagattgattacactcaatcggtttagaaattttggtacaagtaagatgtcattttttgttctctaaagtctaattaaatttatctttctggtatggttattcgattctccaataatctatgtttcaattttcaagttttgaaaaacaaacaaacataacttttagctttttatgcttctttaacatattaatcaaatatgcatgtggaacattaaaatcaaagatgataactccatataacatattcttaagaatctacaatgactttaacctcaccaaaattagcacctggtgatttttaactctttttacttttgttttttattggctcttctaaaaagatgttcgtaatgcaaaaaaattagcttccaaaatttataaaagctatatagatcttacttaaaagatttatcaaatgcattgagctcttaatcactttctaatgaattcttttgttttacatatatcatgaatcatgacaaataacattcaatacctacatacaacttaacaaaattacatttaaaaacaaaaaacccgcgacttggcgcgggtttcgccctagtatggataaagaccctttggaagttttacgtttagcggaaaaagaggcacttttatggcaggaagcgcaaattaagcttcatgttgaaagccatggtcatttgaatttcggagctcgatctcgggtaccactacaagaaaaaggctaaattccaaccgccatattagttgttaatttgtaggaattatatgtttccaataaacttagaaaagaacatatatttgttggaatatgatcgttggaaatttgtatttgtcacaaatttattggaaacgtttccatctaataattctataaccaatttgttggatagttctgatattttttttattgaacatttgttggaatttaccgtaaagtttctaacgaattgttccaacatatattttgttggattgtcattaataatttgccacaaatattcaacaattctgaaggtttgtttatgggaaactactaataacatatttgttggaactttgttgaaacgttttcttggaatcgtgtgagaaatatctgacgcttcattttttggaacttcatagaaatatattgataatttaattgttgaaaatttattgatatttttcattgtaaatttgtgaataacttctgataatttaattgttggaattttatcagaaattactttttgaaaatatgttgatatattttactaagtttccaacaaaatgtgtgatgaaccatttatcaacttttgttggaatatcacatgttttcttgtagtgggtgagggatatctcacaggatactaactattcaggttttcgttgttttgttgatggatcatggacagaaagtgatcagttttcaaggtaaggatggtgttgtacatattcatcaggagagtcaccaaccatgggcgccgataatattcgtagaagtctatgtcctctacatacagaagtggaagctcttctttgggcgatgaagtgtatgatttgagtagacaaccaagacgtagctttctttatagactgttcagatttggtgaagatggtgtcttcccaaccgattggccgacatttactgtgtatttggaggaattgcaaaaagcgacaaggacgaattcacaaacttctctttatctttaatttctcgtagtgctaatgtaaaagtgaataatttggcgcggaagatccgcaccgaatcgcatcatgtcatatatgtaaataatatcccccgagattggctcgtttgatctttaattaattttggatgacaaaaaaaagaaatttgaagctcatgtggcgtatgttttaaaaatgctgatgtggacacatagagaaatctcaatgagcttcttttattagtagtagattatttattgtaaattatgagaattgttatataggcaattttactacggacaatttatttcagcccttgttagatccacgaaagacgacacctttttctgtttctccatgctttggatggtcaccttcaattattatctctgcgtagaatcctggcgatcggctataattttacatagttggagatctcctgcacacttgtcttcattgatctgcaaatctgctaataattctcaatattttggatacgtacttcatatatctagatgtagaagcattaatgaactattggtcaaccaatagacaaagggttccacacttgccaaaataaacaacattccaaaataactctctaagaatttgtttaccaaaatagctaagtagcaaaataaacaacatatcaaaataactactaactagcaaaagtagaagacactccaacatgactcactagccaaaataattaatatcccaatagtttaatataaattaagattaatatcaccataaatgtataaattttcattatattacctaaaacacacagaattccatcaaatgttttgacttcaaattttgtatgttattttattgacaaaaaacagattcaaacttatggatttaagaaggaaaatcacgaaattcgaatataatataaatcacgagactcatttgttgtttttaaacaatataaaaagaggataatgcaaactatatatatccattcaaacaacataaatcatatttcagtttctaagaggtttttctcaactctttattgcttactcaacatttcaattgtgtttttgttctcctttctctataaactgatgacaacctcgatgtcgtcactattcaaaacaaaagatctttgattttaattgttatattattcccatttttctatttgatttttcttttctgcatgtaaaaaaaatgagttatacgtagaaacatgacttgttttatataatgcagatttaaattctattgttggttttcttcaatccctgaca

SEQ ID NO: 12989 - DNA, 3000 bp, Unknown
  misc_feature (1)..( 3000): cDNA_ID_3027442_gDNA_ID_2214587_Annot_ID_186670 3000 nt of promoter + ATG
tatacaaaccatcatacagtcaaacacagtacaaggattcatgtttgcaaatcggctataccaagagggtcttaagtgcagctccatttacaaactcaaaaatgtggaatggtgtaatacttcaaatgctatcaaatatctcttcaaatatttcataaaagaaatgttgtagttcaacaatttcaatcaacaaaggcaaaaccaccacctccaatactcaagatacaacaagggttgaaaaggaaaggattgtagttcaagagtagagtattttagatttctgcttgtaggctatgtggcatacacaaaataagcctaaaataaagattttcattatgtcgacttttgactactctttcactactttagttgcaacacatacatttttcaatttacttatcacaatgatgaaactgctattcaaaattcatagctaacaaaaataaacctaatctaactcaaaaattgctcacaacgaaatatcaaaaaattcgttacagaaattaccaactaactacaaaaaaaaaacgaaaataaacaaatcaaaacaaaaacccacaaatcaaataacaatattactaaatggtttcgaacaaccgctaaacaagaaaatcattttttttatttttatcgacgaaattcttatacatttaaaatccatttcaaaacacattttaaatagatatataactcataaaatgacaataaaaaaaattggcaaacaaaagaccatcctattctttgaaaaccaatgtaagagttggcctcaagatacaccatcgcatcagctaacttaaaaagttctaaggagaagcaacatcggataatatagaattcacgtttgactctaaatcatgtagcaacatcaactaaattaatttgaagtcttccttaataaaatatatcgtgcgtagtccggatttttccctagttttgggaatcaaaattaaatgttagttgatggatctcgattagtaaattccattactattggttttgatattactagtcaataatttatttattttggaatacacaagactataaagtataggaatataagtaacatgaacataaatcttcagaatagttactattacaaattaatatgtagaaattagaagccattaatgaaacgatgtcgtgtctttgtaacttacaaaccaagaaaaacgataatgggcttataataataaaagcccaatatatatcttcataagttttgttaacagtctttgtacttaattttctcctcgagagctaagattagaaatgacgaaaacgacgatgacgaagattcccaatcttccagacgatttggaatcggagatactctctaggattccggcaaagtctctaacgaaattgaaaactacttgtaaaagatggtacgttttattcagagatccgaaattcgcgaagaagaacttgggtaaatcagcgagagaggtgatgttagtgatgaatcaaaggttacactcaattagcgtcaatcgccatggaattcacgagggcgttgatccatccatggagttttcaggtaaactcatccggctaagcgattcgaaagacgtcgtagtatctaaaatctatcagtgcgagggtttggtgttatgcaccacatatgggaacaatagacttgttgtttggaacccatgtacgggtcaaagaaggtggaacttgttaccggtataatgatggctatgctcttggatacgttaacagaaaatcttcgtgtagctgagtttgaaatctttgattttggatctgattgtggaagggttattgatgatgctatcacttggggaatattctctgctggtgtgtctttcaatggtaatacttactggattggtggagagaaagaaactggttttttcttgatggattttgatttcacaacagagaggtttgggcgttttcctcttccgtatcagagttatgattatgaagatatcgcggttctatcggtagttaaggaagaaaaactctccttgatgaatcagaatattcatataaattcttcagagatgaagatatgggtgactaataagtttgatgaagccaaatacttgtcatggagccagttcttagtagtggattttgataaatttacgttaccaaatttgaacagcgtgataactttcttgttggacgaggagaataaagtggcactgtgttgtgatacagacatggaagatgaagagaggaccaaaatctatattgttggagtggatctttgtaaacaagtctttaaagaggttacaaagggatcagttcttaattggccatgtttcgtcagttatgctccaaatttggttcacattcagaaagacactcccaaagttaaaaagaaattgagagcaaaggaggtaagtctaatggatcaccttagtttctttttgcttttccttgtggtcatgtttctttgaacgagttagtcaaactttgttcctcttctttgcttttgaaattgattggtggtgatcttatgaccttactcaaataagttctgtttagattggatgctgattgagaaaaacagagcagttcccgaagattaaaacatatgagacttcatgattcatagcacataaggatagtgttcttgtcaagcaaatcaaagagctttttgatatgtatatatcgttgttgtatatggtctcgggttagaattctctttaactggatctctctgtgtgtgtgatgttttacaggcacggactagacgcaaacttggcaagaagccttaacgcaagcaacgtgaaactcaaatccaaggcatatccaaataatatggtggagtaaaggaaaacacaatttttcagtattgatcaacaagtttgcttgcaactatgcgtgcagtcttatactaattgactattatacactctcgtctctatttataccaacttctaaaccctaatttatgtttgcagtattgtcgctttcttcctaggaaggtcagacgagaaatcatcataagataaacaaacaatg

SEQ ID NO: 12990 - DNA, 3000 bp, Unknown
  misc_feature (1)..( 3000): cDNA_ID_3027463_gDNA_ID_2214587_Annot_ID_186664 3000 nt of promoter + ATG
agttctatcagcatttttggtcgaaaataaaaggctccattattcaagaggtaaacaacgtttttagagaaaacaagctatacgagaatcgtaaccacactaatctctgtctcatccccaaagtggaagccttgtcaccaatgggtgatttcagaccaatagctttgtgtaatgtaagctataagataatctctaagattctgggtaatcaactaaagaaacatcttagaggagtgataatagataatcaagcggcttttgttctggggcgaatgataaccgataacatcattatggctcatgaagtttattatgctctgaaagcaagaaagggtcgagcgtcctcaaacatggcaataaagaccgatattactaaagcctatgatcggttggattgggattttttggaggaaactatgaggcgaatgggatttgatgacaaatggatatcttggatcatgacctgcgtgacattagtgagacactcggttttgattaatggagcctcacaagggcactataaaccggaacgaggtatacgttaaggagacatactctcaccatacctttcattctgtgtgcaaaagtcttatcgcatctgaagaaacaagcagaagctacgaagcaactacaagggataaaaatctgcaacagaagtccttctttatctcaccttttatttgtagatgattcgttattcttcactcttgcaaattatcgatctggcatggcaatacagaatatcctaagtaatatgaggaggtttcaagacaggctgttaatttaagaaaatcagctataacctttggtcgacttgtgaagtcaaatacaaagagacaaatccgtcatttactaggaatcaacaatgaaggaggtggatgtaaatatttggggcttcctgaacagtttgatgaaaagaaatcagaactttttcaatacatcgtggaaaaggtgaaggaaaagactcaggaatggagcaaaatgtttttatcccatggaggaaaggaagttcttctcaacgcagttgctcttgcgattcccgtctactcaatgaatgtttttaagttaacaaaggagatttgtgaaaagataaatggcatataagcgaagttttactggagctcaggcaatgacaaaaaaggtatgcattggttctcctggaatcgtctaagcttgccgaagagagaaggaggtttgggattcaaggatctaaagaattttaacttggccttgttaggaaaacaagcatggaggatcttagaacagcctcattgcctgatgtcaagaatgctaaaaggaagatacttcccagacactaatatcatggatgctaatcaaggtcagaaggattcttttatttggaaatcaattttgcagggcatggacctactaaagaagggatttcgctattgtgttggtaatgggactctagttaatgcgtggttggatccatgctgcccattcacccgccgagaccgccacaaaaaaactagggatgccctagatcagcatatggttagtgagctcttaaactcaacacgcacatattgggatttcatcaaactcgctacttagataatacttgatgatgtggagaatgtcaaaaatattaaagtttgtgcattatacaaagactgacattatacaaagactggcatttagactatgaaatctgcatatgttatacaaacatatgttttgaaggagataatcatgagttggaatcaattatcaacagaagaagtccacacttttgagtttcaattttggatatgagagattcgagcttagaaacaaatatttctaggaagcaaatttttatgaataggaagaaaacacaacaaaccagcggatattctcgtaaagcagcaatgacctcaaggaacaaaatttatctttcataatcatattctttatgtaattcataatgctatgtgtttgtatcatacgttatttcaatattaataagaagctacaattcaaaaaaaaattaaaaccaaaatctacaccaaactttttttttttttttttttttttgtcgtcctacaccaaactttttaaaaccgaaaatacgaacttaaaaaaccaattatagtatactttttttttgttccgttttaatttttgttttatttcgataaatatctctggcgtagattagcgagagaggtttagctgtcgttttacattctctcaaagctctctcttttatagctttccaataacaaatcccaaatctgattctttcagctaaaaatcttacatcaatcaatcgaattgtcaaaaaaagatatcacaacccttcttctgaattctcatttcttaagcttatacacttgaaatctccaaaaaggtaccatttttatgactttgttatctccgttttgtgttcgttgtttgcgattctcaattgggttaaaagggtttagtcgttaaacatttccatcttcgtttttggacttgatgtgaatttaaagttgggaccttttatgttttgatccaaagaaaagaatctgcttaattgttgttttagtgtcagatttgtttcttctttgatgcaggggaaaaagaaaatgagttaggtgaagtttcagaaccatagagacgacgatttgatcgttgcgtaaaccaaatgatataaagcaaaagatgcaatcgagaatcgtcggattagctccggcgttttctctcttccctaacctaaacacacctcacaaaaccttcactttccatcaaatcttagttctcatcatcacattcacagcctacgcttcctttcacgcttctcgtaaaccaccaagtatcgtcaaaagcgtccttggtccaccttctcttaattcatcttcaattgataatggctgggctccgtttaacggaacccaaggaaccaagagacttggtgagcttgatttggcttttctttcttcttatgctttgggtatgtattttgctggacatttaggagataggattgatttgagatactttcttgtgtttgga

SEQ ID NO: 12991 - DNA, 3000 bp, Unknown
  misc_feature (1)..( 3000): cDNA_ID_3027479_gDNA_ID_2214587_Annot_ID_186660 3000 nt of promoter + ATG
aaaggaaggagatcttatagcaattataggacaaagtgcgatctactccctcgaaacgcccggctcgtgaatcaataaagacgtcaagctgcaagatcatccaagtcaatattaacatgccagagccatcccgaacagtcggtatcggaagagaactagagggggagatgaaggaaaagctgattgccttcctgaaatcaaggtcgtccaccttcgcttggtccacaaaggatatgactgggatcgctcaaaaggtaacctgtcacaaattcaatatggatccgacttttaaaccagttcgccagaagcgcaggcggttgggatctgatcgtgccaaggctgttcaaaacgaggtcgaaagactgctgaaggctggtctgatcaaggaagtccaatattctgaatggctagccaacccggttgtagacaagaagaaaaacgggaagtggagagtttgtgtcgattataccgatctgaatagagcgtgcccaaaagacagttatcctctcccacacatagaccgcctcgtagaggcgactgccgggaatcagcttttgtccttcatggacgctttcttggggtaatatcagatcttgatgcataaagatgactgtgagaagaccgcttttatcatagatcgcgggatctattgttatatagtcatgccttttggcttgaagaatgctggggtgacttaccaacgattggtcaatgaaatgtttgccgaactgttgggagtcacaattgaagtttacctcgatgatatgctggtgaaatctttgcaggcggaagatcacatgaaacatcttaccgcgtgttttgatatcctcaacaagtacgagatgaagctgaatcctactaagtgcacgttcggagtgacatctggcgaattcttaagatacatagtcaccgaacgaggaatcaaagccaatccaaagcagatcagtgcaataatcaaactaccgtccccctagaacaaaagagaagtaccaaggctgacaggtcgcatcgcagctttgaatcgctttatcgcccgatcaacagacaagtgcctttctgtctacaaacttctacgtggcaataaggatttccatttggatgagaaatgtgaaaccgccttccaggagctcaaatcctaccttatgagcaggacgatcttggccaaacctgaggttggtgagactctatatatatatgtctcgatgtcaagttcggcggtgagtggagtgttagtaagagacgatcatggtaatgaaaaactggagaagctagcattggcagttataaaggctgctcgtaagctctgaccctacttccaatcgcattctatagtggttttcaccaatcagccactttgaacggtacttcataacccaaaccaatccgagcgaattacaaagtgggcgatcgaaataagcgagtatgatgtggagtttcgttcccaaccaagcctcaaatcacaagtcctggcagatttcataaccgaactatctccatgtgtgatcgatgaagtccctaaagaaaactggatactctacgcaaatggctcttcatcactacaaggttacggtcttggaatcctactccagtctccgaccagggaggtgcttgaacagttgctccgacttccattcaaagcatccaacaacaaagcgcagtacgaggcacttctcgctggacttcgcctcactgaagggattggggccaaacaaatcaaagcctttagcgaactcaactcgtagtaagccagtttagcggggacgaaagaatgcgagcttatctttcgttggtccaagatatgtcaaaatagtttcacaagtttgacctgattaaaattctttggagagataactcttcaacaaatgccttagccgctctagtcttgtcgagagcataagcaaaccacgtatcaaactaccaattttgacatgcgtcatcgtggatcctataacgaccatggatgtagatgccgacgcaaccgacacgccatatatcgaagtagacttggaaccttcagcaaaccgacacgtctacatcgccgactttgtaatctagctcccgttagcaaacctggatggaaccaactctaataagaaatggctcctccacgtcgacggctcctccaaccgacaatgacaaaagtaggaatacaactcacctcccccactggggaagtcatcgaacaatcgttccgactcagattcaacgcatcaaacaacgagtttgagtacgaagccctcattgctggcattaagctagcccaaggaatggggatccgcgatatacacgcccatagcgactcccaactcatcaccagccagttccacggggaatatgaagctaaagacaagcgcatggaagcgtacctcgaactggtcaaaaccttgacccaacagttcgaatcatttgaattaactaggatccccagaggagaaaacacctctacagacgccttggcagctctcgcttctacgtcagatcctttcgtcaatagaattatcccgctcgaaggaatagaacacacgagcatcgacctaacggtcaaacatgctgggagggaaaccttggcaacttacaacttcacgcgagtaacccgaagcaccactgccgcagccagagctctcgcagcagctgcggaggcaagtgcaacggaggaggagccagagcttgaaacccccgaacaacctgccccgtacaaacctgaaccctagaacgactggagaatcccaatcatcgattacatcgaaagagggatcacacctcccgacaagtgggagaccagaaaactcaaagcccagagtgcaaggtattgcatcatggaagggagacttatgaaacgtagtgtcgcaggtccctatatggtgtgtacctacgggcaacaaataaaagacctcatgaaaagcatgcacgaaggacaacgtagcgtcgcaggtccctatatggtgtggacgtaccctcgccctcagattcaaaaagcaaggctacttctggccaacaatg

SEQ ID NO: 12992 - DNA, 3000 bp, Unknown
  misc_feature (1)..( 3000): cDNA_ID_3027483_gDNA_ID_2214587_Annot_ID_186658 3000 nt of promoter + ATG
catgtgcgataagtgccaacgacacgcacctattctgcatcaacctcccgaggaaatatcctcgatatcttctccttacccgttcatgaagtggtccatggacgtcttaggtcccatggaagcttccggtgggaagtagagactaaaaaacctgctggtcctcaccgactactctaccaaatggattgaggctaaagccttccaacaggtaaccaagaaacaagttgaggacttcttgttggaaaatatcgtatgccgtcatggcataccatatgagatcgttaccgataatgggactaaccttacctccggaaaaatcaaagcattctgtgacaagtggaagatccgtcttaccacgtctacccccaatacccacaaggtaacggacaggcagaagccgccaacaaagcgatacttaacaacatcaagaaaagacttgattccaaaaaatcaatgtggtcagacgtacttcacggagttctctgggcctaccgaactacacctcgcaaatcaacgcaagaaacaccgttctctctcgcctatggtttagaagaagtaatcctcgtcgaaaccatagtaccaagcgtgagaaggaccgccagtcctgctaactcagacctgtacacgcaaatgttacagtacaacatggacttcatcgatgaacgcagagatcatgcagtgatccgagttcaaaactatcaacaagctgccgcccgctactataactccaatatcaaaattcggagattcgaagtgggagagctcgttctacgaaaagtgtttaccaacacgaaagagctaaacgccagaaaacagggaactaattgggaaggtccctatcgaatcaccgaggtggtacgtgacagcgtctataaactcgaaatgccatgcatctcaagaaataccacaaataggtactcaaaaataatcgaactacgataaggcttgatcccttggcagggtacgtaagcaactccccccaagagcgcagccaccatttcaattgaactacgataaggcttgatcccctaaccaggtacgcacgcagttccccctgcgaacgcagccaccgtcttaactcttccgtttgaaacagtttcttcaacaaggaaaacaaacattacatcttccatcaaagaaggttagctgctcacctaacagttcaaccacccctcgataccaagaaggtcccttccaggtgaccagacaccagatcgtcgtttactttacctcatttgtactcaacaattttgagataagaataaaagaaaattttgatactcaatatcatgttttgcaaaataatcgtttccactacgatttaaacctcattcgtaatcttacgatacccaaagcccaacatccgaatgttggtggatccactttgtgatctcgcttccaaaaagtcaacagtgaaccttacctataaaaacacatcacttcgacatcatcggagctcacctactacaaccatatctaactccttccttcgctatcaacacataacatactaaacaaggaagaaacgaaggtttcattcgcgatctggcgataccacaagcccagctcccaaaatctggcaggtcccttgtgtgacctcccttcaacaggttcccgagataaaccactcaaacttactcaagtttgaacctacgaagaatataccatatcatatccgaaataacttggactttaaacaagtccaattattattcggaacatgaacaaaacgaggtgatcatacaccaaaatcgataaagtatcaacacacgaataaaagacaaaaagtacttgttaaaagggataaaagccttcctaggcatcaaagtacttaactgaacaaaggataaaagccttcctaggcaccaagttcaaaaagaaacaaacaaaaggatgaaagccttcccaggcactatgtccgaaacaaaaaacacaaaagcctaaaacgaggagcgtaagtgatcactccttcagttccccggccggcgtggcaaaaacagtaccagaaccctccgcgagacctctaggaaatgcatctttgttgctcccgaactcatccaagccgattggcgttccttgcttgtcgacgtccatcggacctaccaccgacatctccaaaaccggcaggatatccaacttacttagagtgacgtctgatacctccttcgatttgcactgcgcctccaggccatccagctccgcttgcaaccgaggtctctccacggtcaaatcgatagcagccttcgtgatctggtcgatcaaagccaggttcgactccacctcggccgcttgaccttccaacactgtgtactccttcttggcgacccacttttccttgaacccagctagcaacctcgaatacgcaatggccagttcaagctcagcatcgtgaaccgccttctttgctccttgcgcagtcaaagtcaggtccatcacccttttggagagctcctccctcctctgctccaaacgatgaatctggtttctcgctgtctgcttgtcagcctgcaatcccccgatttccatctccatgagcccgatcttctcagcataacctttctcgagatcttttgttggagctggattcccctccaggaatccactttcgaaaataccaaagaaagcccacaaagcccaccaagcccaccaagtagaggacctacgcagctgatgagcccacatacgcgaatgggtacttgggcctgataagcacggtcacctaatgaagggagataagcgaataacaacctaggaactaacgaggagatattcgcggagcagacctgatatctcggaaaagacgtgccgaatatccaggagaatctccgcagatcccggacctgacggagctacctatataagggagcaaggacgacttgtaaaacacattcaatccagctttacattcacacacatacttctagccctcctttctcataatctcaattacaaatctctactccgcgacctgccagcgaactggccgagttccacacaatg

SEQ ID NO: 12993 - DNA, 3000 bp, Unknown
  misc_feature (1)..( 3000): cDNA_ID_2710154_gDNA_ID_2214587_Annot_ID_135360 3000 nt of promoter + ATG
tcgtgtggagatggagagggagaaaaaaataatttaatttcaatggcatgattgtaaattaaatgttttggtgaggcttgacaaatcaatcaaatagtaatctacagaaaaaatcattattttgctaattgtaaatattaaaattactaattctctaattatgttgagaaatggttacttatgcaacatctcataaaatttgtgatcattcttttgggggtttggttgtaattgattatttttttttagtatcatttttaggtggttaaaaaaattttcgtaaataataaaccgactaaagctgagatatgtggattctatgatttcagattatgattcaggagataagttttgaaactttgttattgaaaaaatagaacgggaccattgcatgagatgcatctcgtgtaacagtgttatacgatacctctcataaaaaaggatagtcaaccctttaagtaacacgttattcaattaccataaataacaacttgccaagatacctctttttcctcctaaatttactagaggaaaccaggttacgcccataaatgtttatatattttttgtagaagcattttaactttgtacaaaaaaattgtaaaacttgtttttcttaaacattgggagaatctgtatcacttagactaaataatttgattttttatatttttgttgactgtatagtttatgaatccaaaatgacatgacaaaaaaaaactaatacgaaggagaaatattatttcaattgcttctttatattttaaccttctttcattaaattttgcattatttctcatatagtttttatataattcactgtctccggcgctgatgtagcagttgctcgccggcgtcgaacacagtcttctctttgttgttccgctcttctcccaaaaaatcaaaacaagtctagtctcaatcttttcaagcctctagtctgtcatcttcgtctccttccatctttaatctcgctgtcgcgtcttgccaattgtagatctgttagaatcttttctctgaagatctttggctcagcgtaccgggccgacgtactttgcctcatttctgggagaaccaacagctacttcgttaccggctcatttttttccgtttcttccctagccacgcgtttcatcttttctggttaaagccggtggttgttgtttcaccgaccttcctttcggtgatctctgccatctattgatctcaatggttaatgatttgttcgcctctgtcacccgccgccgttgcatgttctcgacctcgtttgtattaggtcagatccctactatacaactttggaagaagactttagtttgggcatggcccatcttgggaccttttgggtggtgtagaggcccgttaagttttttgggctgctttcttttggcctgccctaatgttttgcaatgctcattatttgcacccatcactatcttgggagaccttcgtctctccctttgctacatgttatctgccgcctgtttcggcactcaacggttcatcggatacttctccgggttccatctgcttataccggatacttcttcggcaagcccattttgcttccgatcgagaaccacatatgttggtttggaacccgtcaatcttcggcgaagtttgctcaatatggaatgataaggtacactaagtgtatgtttttttttatttgtggtatatgtttttttttttggccaaaaaataataattgaaacttttaattaatgaaatctgaagatgacgtggcgtatggagagagtgttttagaaacgctgatgtagacacgtggagaagcttcaatgagctttttttattagcagtagattattgattgtaaattatgaaaactgttatatatccaattttaccacggacaattccttccaaccattattagatccacgagagatgacaccttattcttcttcttcatgctctccgttattaaattcacgagagacgacacctctttctccttctccttcttcatgttcttgatgatcaccttcaatgatcctctctgcatagaatcctggcgatcgtctataattggagatcgtctataattgcctccattgatctgtaaatctgctaataatttgcctccattgatctgtaaatctgctaataatttgcaatatcttggatacgtaccccagatatcttgatgtagaaacattaatgaagcattaatgaagcattaatgaagcattaatgaagcattggtcaacaaatagactaagggttccacacttgccaaaatacctcaatagcaaaaataaacagcattccaaaataactctaagattttttttttaattttttttttaccaaaatagttaagtagcaaaataaacaacataccaaattaactactcactagcaaaagtagacaacactccaacatcattcactagccaaagtaattaacatcccaataatttaatttaaattaagattgagtcaatagcaaaacttaatcaccttagatatataagttttcattatattacctaaaacgcacagagttcaatcaaatattttgacttcaaaatttgtatgttattatattgacaaaaataagattcaaacttatggatttcataaggaaaatcataaaattctaataaatgaggataaaaacatgagacttatttgttgttcctaaacaatataaaaagagggtaatgcaaactatatatatatatatccatccaaacaacagaaatcatatttcagtttctgagaggtttttttcaactctttattgcttactcaatgtttcaattgtgtttttgttctcatttctcaataaactgatgagaacctcgttgttgtcacgattcaaaacaaaatatctttgatcattataattgttagtttttccatatttctaaatttttttctgcatgtaagaaaaatgagttatacgtagaaacatgacttgttttttatgatgcagatttatactcgattgtttgtcttcttcaatccttaaaa

SEQ ID NO: 12994 - DNA, 3000 bp, Unknown
  misc_feature (1)..( 3000): cDNA_ID_2994483_gDNA_ID_2214588_Annot_ID_135363 3000 nt of promoter + ATG
tataaagcaattcataatttgtgaacttgaccaagattttagcacgatcctcgcttcgcttcttgtctcccttgtgacgcatatctaatataaacataaattcattatgtatcatgtatgtatgatcttagttctatattgacgcaagaaaattcaagtatttgttcacttcgtgctacctatgaatgtacataaattttttttaaaaaaatatttgttactaacgatcatataagatagtattaagttattcagaaaacataattaaaatagaaattgaaggtgtaggtgtgtggtttagtcatcgatatagccaaccagtgacaaccacctcgactctctttgacctaattatttgaccactccttccactttacatcataaaatctgaaaccacttaccatctctcgtcacatagctagcagacgatcgtcttcattatgtggttgtgactctcattctaatgtaatcctggtaaaaatagcatgcgagtgtcttatcgatcctcgttgtttatatgattaaatcatttattataaaataaacaaaacacaactaatattttttgcattaaaaatttaaaatattttaggaggagtgattgtttcgacgaaaatatattttatatagtatgaacatgaatgagtaaaaggtaactcattttggtgtgtgtgtcaaattttgattttaagttttttttgtttgtttgttaagtgtatcaacgaatctctagttctagctttgataccaactgaagtagcggaagttttaatggatagaactagacatccgttgattcctcggaataccagaaaactagaattttttggatctgttgattcctcagaataacagaaacgagagaacgtaaggaattcgttgattctcttcgaataccgaatcctacatctttttataaccgttgaaatctttcaagatctaccgaaagcaaggaattagagaatactcttctctgaaaaggtaaaagcttaattttattaatcaattaactgaatacaattttaagttcaaaagtcttaattataataaatccaaaattttagaaaattcataaaacaataaataaaaattatctaaataattaaataaaaatatgaggaaataataaagacaatttgaaattatccaaatatatactgcattaggtagcatgcggcttgcaagactatagtatttgttttagaaactataggtctattagctagacagaattaagagctatagaaaagttgttaaaattgataatgcgatgctttttcacataactcaagaaaaccaaatcaagttccgatccatcattgtttgtcgaccaagggatgatcagtcgataggtccacgtacgttgttgtttaaatgaaaatagttaacatggatgtaaatttaataagtaaacaatgaaaatgacaaatgaagtagagaagatggagaaaacaggaccaagggcttgtaaaagaattgccaaataaacaacaacgtggtcctatcaccttctgcttctccctacgcaccaaccagtcaaccatactcaataggtttcattacaagacaaataacacactctcttttgtcttttctcttttttcgaatgggaaacactgactagctttgtttgtatatttaaatcgtttctaacagagagagcgtggcgaagtgtgaacacaaacacctagaaagatctgagagtcaattcttctgggtgacatatgcatgtgaactgtatgaagacgcgttttggggtttatcgtttaaaaatcattagatatgtgactgaccaaagtgttaatcaaagatctgcaccaacaccttttacatatactatattctaatacgtagaggcagcgtagaacactctagaagaagtactaggtgaattatgatcgatatgccattcatctgagagcagagaatggaactttacgcatgtttaattaaaacaactttcaaacttgtcttaaaatatgaaaattactagttcctactctgattaagataagattggcattatattcatattcttgtacctaatatataattgaagcacttgaacatatttagtcatatagtcttgaattttgttgttgtttttccctttttttgtggggtcaaactgagttgctgtaaatttgaacatacatatgaatatgcatttaaattgtggccaacagttttagaaaactgttatcaaatcaaagatactttaaaaatacaaaaaagtagtgtaagatacaagaaagaaaaagttgccactttctcatgtcgcatatatataacgtttctcggaacttgcattttctctcttcttgtttacaccttcctcgcctgttacgagtaacaccaatatttggacttattggatggttgccttaataaaaaggaaaaaaaaaaagaaaaagacccaagaacaccaaagctgtcgtgggctcttattgtttatctgaaactaagccctattactattgggcccaaaaatcaattacgtaaaagagtttgcctgttatataagttgtttactattgtggcccaacagataaaaaagggaatatccggcccattctctttcatcacactccttgaagaggtgataggtcatgtaatttgattaattaagaaaaacgattgagttagacgaagaggcaatggtaggagaaggatagtttgggtagacgaaacggtagagttttggttattctcagattcttgttgttgagagactgatgaactactagaaaaaattaccagtatctccctcaaggttaaaagcgtcatttacggtaaattggggaataaaatggtaaagagaaggaggctttttggtggtgggagtaggtgatgccaaagtagacgactactaatagtagtaaacaaaacctttggctttaacactctcctccaaatcccagatctctctctgtctctgtcccgcggagtccccgagagattgatcaccatcacttttgtaccttccttgtactacctatg

SEQ ID NO: 12995 - DNA, 3000 bp, Unknown
  misc_feature (1)..( 3000): cDNA_ID_2710222_gDNA_ID_2214588_Annot_ID_135365 3000 nt of promoter + ATG
ggatatctcgtgtggatgactactggcaccactggcaagatgtcttcgcaggagctctcattggcacccttgtagccgccttctgctaccgtcagttctaccccaacccttaccacgaagaaggatggggtccctacgcctatttcaaggcagctcaagaacgaggagtccctgtgacctcctcccaaaacggagatgccttgagggctatgtctctgcagatggattcaacatctctcgaaaacatggaatctggcacttccaccgctcccagatgatcctcctctcttattatttgattcattatttggtttttcattttgatttggccgtcgtcgtgagattgtgaatggtgtagctacatactgtatgtgtattcaaaactctacttgtaccattacatttttgtaaatccactcttcatgaaattgacgtttttctggtgtccgagaggcttgggtcgctcgaataatctcgtccaatagactaatacggctctagtgaacacggtatttacatgtttgtgatctaaactgaaatcagttatttcttaattcgtaatcattcttgggttaacattttctcttataatctgatggttgaagatggcaaagccattgttagcatagccatagctggttcaatcatccacaacactaaattactcgagctctccacatgcgtaatctctctttctctctatttctcccttcgtttctctcattcttcttcttcttttaatttctgggtagctattattttagtgtagaacaaagtttgacacttgtgcttacgcacatgcgctgccaactatgctgcaggtattaaatcagttctgaaaatattgaagcacaactggaaaccgtttcttttgtgcactcaagatattaaaatggttctctgtttctgaaaatattggaacagaactgaaaactgtgtttttgtcatgctagcgtattgttatattgtgttttattgagcaaatgatgatactagcaattcaaatttcatctcttctctttgttattatgaatttcatgcttgtattggaagacattattttgcaaaaatttgatttttgtttactcaaggacccattgtttcttaaccattggagtagaaatttgttaaagactcttattagtttcttaacttacaaaaagcaaaattttaataaaaaaaaaaaagttaaggatcatggttaaggacctaaccaatggggatggtcttagcttctgatctcactggtctttgttcgattgaatcaatccaagtttcgtaagtggtgatggtaggtaatcggagcagcagcgcatgtaaccatcggcagttgtcgaaagcttgtatagtcacatacctccctcatcgtctcttctcagtgtcgccaggtaaatcttctcaatcgtttcttttgtatattactcatagagtcgtgcgctgtctctccctgagaaggttcaatcgatttcttccgattgatgattgatgtatcataatcagaacaaaggttatatttctgaattggatgtgtctctgaaattatagcggatgttgtatgtatgggaacacaagagaccaatgatgatgctaatgtttgattgtcatcattgattaagtgaactaatcaagcagaaccatgatttgttttactttgttggtgctagtggtttggggctatctctgtttctaattcgtatatatgttatggaggttaagaggactcttcaagctttatgggcacttgggtttcttggttctttggctacttgtgcagcccttgctagaccagccggtgataacttggttcattatgtcgttgatcatccatctgctgtttggtttgttggtcccctttttcaaagaaggtaaatatcttgcttctgcataaggcttcagataatgatttattgttcttaatcaatgagcatatatgatttatgtttgtggtctacgaaattagtgtatttttagatgtgttatgtaatgttgaacaacatcactagatttgttttgtgtgtctcatgttagaggatttttggcttcggtttgtttgtttctttcttctgaaacacttttgtgtcaagtctttaatcttctctgtctctctaatgttatgaagaaggagagttcaaagattgtggttatataatgttttagcattacgagtggttaacaagagttagttaatgtgttataaattctgttgcacggatgagagtctgataaaatggaattcaaatcagagaaaccaggttcagtttttcctctcaatattgcatcaaatcttttttagtttgttttggatagcaaatctttgattgttagtctcgagactaacatgattttgtggatcgtggtaacataaccacaaagttgtctattttatgatttgaacattctacacagtcatcctcatcagtggcaaattaaccaggtttgtgtatcaaagagtaggccatgttctgagtatcttcaagaagaggatgatgtttttttgtatagtttttgtctttgatatgttttcaaatgaatcttgtatactttgtcatatttattgtcatgaatctttgttattcaaaatgtgtttatcaaaaatgtatcaaattttttgtatagtttgtcttctctatctttcttttcaagcaatctaaactcaaataccaaaatattttttcaaatttgtctttcttaagaattcctactattggacatgaatatttttgagagtccctaagctagtccttagctttatatttgtcaaaatttatattagaaaattcttaaggattccttaaggatcttaaccattggggttgcttattagtttttttatattacttgaattacatatttatttagtttaaagaataaataataataaaaagacagtttggaggggtatgtaaaaagtaatataacagaaaaataaatatcttgtctgaatcagagagagagctctcaacaaccaaagctttggactctcaggccaggaagactatg

SEQ ID NO: 12996 - DNA, 3000 bp, Unknown
  misc_feature (1)..( 3000): cDNA_ID_2710168_gDNA_ID_2214588_Annot_ID_135369 3000 nt of promoter + ATG
tgggacaaatgaccaaaatcttacccccagaaaatggataaatcttacagcacaagtgcccatttataagctgctctagttcttgttcttcagtaaagtgggtttcagactcataaggcacctcagactcggtcaagccagagtcaagtgtcccagaaacttggcatgccttggccatagcctaagataatgaccagaaaaggttttaacaactcagtccatgatgaacctcagaaaacaatgcgtttggagaatgtggaaattttggattaaaactggcctagaagaatatatagtctaaataatacaaaattatgaaaaagaaatgtctgcaggtacttgtttgtaataccagtaaccaaactaacttgtcactattcctaacaaaactagagaaaggaaaatcagatagcaatggcctaggcagattagtaccaggttgtaattagcttagtaacacacctggatcagtgcacagcttgacaccttatcttcttcttctcggctccgtaagttctaaagttttccacaataagaataacatacattgagtagttgatagaaaagagtaaagcaatatgggagagagaaggttgcagcaatcaccttagttagagtgactgaagattccaaaatccggtcggatgctctcatagacaaaaagaacctatactctcgcgcaacaaacaaaaactatgagtgacagaaagaataaagggccatgctagagaactagcttattgtgatagctttcatttcaagcaaacaagtatattactataaagagcaggaaacaaaattgcataacctgtgatctccacgcttaggacgagaagttaccaatgatcccgtaaacccgacaccgagaaccggatatcctatccacaagattaaggaagttacaccaatccacattactatattccaggacttcttgctaacaaaggatggtgaagtgaagaaagagagcaagtacctggtttagagagcttaagcgcccgattgtaggctaacaaggccatctccttggccaatgcttggctacagtgttggctcggaacctaaaagagagcgaacgaaaatcagctgattaatggagagaagagaaacatcgattgctataatgaaattgagaggtttatgaacaaaccctgccgagtaattgaaccatagatactctcgaataaggaaccacggactcgagaagcgtgttcgacgctccaggaaccgacatcaaccaacctaaagcctgaaagagaattcaatttcgatcactcaaaagcacagagcaatcacatacttgtgtatatacgaatcaatcataaagagagagagtgaaaccagagaggcaccgccgcaaagatagacgacggcctgcgtcggagatgagtgaatggcttcgacgacggtacggatcgcagcgtctcccattgtttctctcggtttcgtctcctcccattgccgtgccagcaaaaagccaaattaagccccccaaagtttccgtaatttcaatttatccccaacagtttccgtaataacaattcatgcccaaacgtttccataattacaatttatgcccaaaataattttatattgcactaaaacccaagttgtttgatttactagtatgtagcctcggagtcgtcgccgttagtccgtgaggagaaaataggcccactctggcacactctctctgggtttaggtttaggtttttttggggctctctatcctaagaaactaggagacatcacacttcaccaagtctacttatcgacaattttatcgtatcaccataacgacaataagggccggactaatgtttgtacacatgtcctctccttttacccttttaaggctttagctaaatctaaaccacatttataatcgtttattatatgaatcttcttcttgcgaaaaaacatgtcaagctactattctaagtaaaataagaaagatgagctgtgatttatatggtaaagtaagatataaaagaggtagtactagtactgtaaaagcagactcgaggaataaagaaagcaggaagagcgtggtggtatcttgtggcacctttcttctctagtaaactccactgttatgtttgctctctcccaatcgtaactagtttgttcaatgctcatttgaaactacacttgttactacttgttactacacttgctacactctattaatatgcatcacttggtattttatggagtttcgtgctagagcaacatcatctaagaaataaaaaatgaatgatactactgtagtagtaatatattgacaagatagattaatagaaaaggacaaacactgtaaatgttacctacattgacacttgacagatcaatcaaaggaccccaatatattacttttcggaataaaacaacaatcatgacaaaaggtattacaagatgtaactatttgaataaagatatctgcatttgtaacattttgtatataggagagattacaaagatattgggtctgattggtaaccaaaagctggacaagttttttacctgttagctgaagctattagctttatcggaatagtgcaaaactgttagaagaagctgtataaaaaagctgtacaaaaaagctaaaagtaaaactttttgtaacacttttaataaagtttttatgatcgattcaaaactgtataaagcttaagtttgttaccattcaaacccattagattagtggtcaaattagcgtatggattacttcgccatggccttctcttttctccaactttcacctctttctttggtcatttcttttttttttgttaattctcttctcccaatgcaaaaacagagctctctctctctttctctctactttttgtattctttctttctcctttttcttcaacgagagtatctttttcactttactcttcactccatcaatatcacactcttcttgctactatctctctttgctttgtacaaagccaacactcgtctttttgttctaatttgcatctgataatg

SEQ ID NO: 12997 - DNA, 3000 bp, Unknown
  misc_feature (1)..( 3000): cDNA_ID_2710208_gDNA_ID_2214588_Annot_ID_135372 3000 nt of promoter + ATG
gatctttttagtaatatagaaaccaaaaatttaattataaaaatttatatattatatttaacttattggttgatatattatttttattttacatttattttttatttatatatcatcaaacttattttttcttttgtaaaaatatggaataaccaaaaaaccagtgtccaaactggaatcaaactaaaaccaaaccgaatcgagatatatatggtttttatatggtttcaatatttataaattcgaaaaccataaaactgtataaagcgaaccgtaaccaaagcgaattatgtatggtttctatatggttatagttttagtaaaactaaaaaattgtaaaactaaaaattttgaatcgaaaccaaaccgaaaaaccgtaagtccattcctgagcaaaaccttatctaaacaaaatgaagagctggatagaagtaatgagaaataaaattttgtttgcaaaatagacaaataaatactcctatttgaaaagttatattttgtattcatataattttaaattttatatacacctatttgaaaatatagagtataaaataaattaaaatggaaataaatcaaataaaaaataatatatttctaattacaaattatctataaccggatatagctaaatatcaacaaatgttatcatatttctgcatgcaaatgttaaataaatcaaagcgtattaataatagattaataatggaatagaagatatttttttttttttactgaatttgtggcatgaataaacagaacacgtatcgtcatctctcatgcgaacatgccaacaatggttattgtatgtttaattaagcaatggttattgtttgtttaatttagagttaggactaaaaaacatgccaacaaaaaaaaaagttgagaagagatcagattaaatgcaagtttacgacccacacgcgcccacttttaaaattttatgaaaaacggcaaatttctgcatgggttagtccacagatttgggggaggtggcgtcgacgcgctcatgctgagagtgggtaaaagacttgcgttttgcagttcaataaatcacgcgcttcacttttgggccgacttttatattgttcaagtatccattgagattagtttccatacgattttaggcctacgtattttggaaaagcccaataagagcacaatgtaatgctttaatattcattagcggtgatagcatttgcgtacatgaagcttaaactgttatatttgcagagactgttggatgtttgacaaagtctgaagctgaataagtcaagcgtttatttaggagttgaataagtattttctgttgcagtttgtttccgtttttatttcctgcaatctctctttcagttgttgtaaggcttttataaaagccattgttcttgttctgtttcaatacacgaatcattcagactattctctttcattaaagcaagtttaaggttctgttttactttagagacttgtgaaataaccagcacaatttgatcattcggtactactattacaagattttcactaaccctaattataggtagaaccctggataatacgattacagattctaatcagctcgtagtataatgacagtcgtaaatacctaacaaggcttctctgtcacaatatacaaatattagcactctttaaacgcttcccatgcaactctgcaatgcgattccataataagaatagaatgcaacacaatactttatcaatcaaagagtaattgcactaaataaaatgtcttgcgagccaagactttcatgcgggttgagaagtcaatagttcgtgtattatgaagtaataaagtgttagggttaaaattattgatctttttagtaatttagaaaccaaaaatttaattataaaaagatattatatttaacttattcattcgtaaaaatatggaataaccaaaaaaattgtgttcaaaccggaaccaaaccgatatgtatatggtttttgtatggtttcaatatttataaattcgaaaaaccataaaaccataaaaatcgaaccgtaaccaaaacgaattatatattgtttctatatagttatagttttagtaaaactaaaaaaaccgtaaaaccaaaaaatctgaatcgaaaccaaaccgaaaatccgtaagcccatccctaaacaaaatcttatttaaacaaaatgaaccaaaatgtagagctggatagaagtaatgagaaataaaatcttgtttgcaaaatagacaaataaatatttaattaggaaattggaaagttatattttatatttatataattttaaattttatatacacttatttgaaaatatattgaaagtataaaataaattaaaatggaaataaataaaatgaaaaaataatatatttctatttacaaactatgtgcgaccggatatagctaaatatcaacaaatgttatcatatttctgcatgcaaatgttaaataaatctaatcgtattaataatagattaatagtgaatagaagataatatatatatttttaaatgaatttgtggcatgaataaaaagaacacgtatcatcatctctaaatgtgaacatgccaacaatggttattgtttgttaaattaaacaatggttattgtttttaattaagagttaagactaaaaagcatgccaacaaaaaaaaagttaagaagagatcaaattaaatggtgatttattttaattataaaatcccgattgagtatggtctatggagattatattgcaggtctcctttaagaattaaggaattatcacaacacaaccaaaatgtctcttgtggatcaaatacttggcgatggagcaggttacatcattatcaaatacttatcatttttaaatatgaatccatgcacaatcctttcacttagtagaatatgattaagacctgacattcttgtagaggaaaacaaaatctattcaaagaagagactaaccggctttaccttacgattaataaccaattgggaatgttgttgtagtggcagatctatg

SEQ ID NO: 12998 - DNA, 3000 bp, Unknown
  misc_feature (1)..( 3000): cDNA_ID_2712929_gDNA_ID_2214588_Annot_ID_135375 3000 nt of promoter + ATG
tctgcaaatgagtcccatatatcaccaagcacaaaataaggcacaagtttattataatcatcatctgctcttctttctcgtagcaatgtctacacagagattatcaccatcaccatcagagaacaacacagacttagattaaaaaaaaaaaaacataaaatagagattgtaataaaccttggataaaaactgagccggtacggatggtgtgaccgactctaaaaaccgatctagattactggaagataaatcggacggctcgagttgttgtttatgcggagaaggagctgatgatggaacgttagagacgtcgctctgagctctacggagctgatcgatgcgctgattggccctgcgagtttttgcggaagtgtagaaaggatcgtcgccgtgtctgcctctcgtcaactgaaatccagcacccaacatctccgagtagtcgtagttgagtttttacctatatatctatatatctatctaagcttaatttagttgatttagcgtgaatatgtgtttgtctccgatgagacggcgaagaagcttggtcgaatcggagattccaaagaaaggggtaaaaatggatcgaatgaaggagaattgatagaacaaaaaccttctgatgatatctaagctccgattaaacaggcaaaagattagtggaagaggaaaatctgaagaagagattcgctgaaatggagagagatttggtaatttcaaaaaaaggggtcaatgaagagagaaagacgattggttagtaattggagggggagagacaaaaaccattgaataacacatgaatccctcataagttagtgtttttacattttggtccttttcattttgatgattgattacagttttacccgaaacttctttgtaattcagttatacgcttacttataaacaagttaatcatacggtaatgcaaggtattttagactgctcagatgcataatgtagatggtgcataggaatgatttggggttatgaatgtaacattttaaaatctgatgagaaatatgtgactatgggaaatataaaggggttaaacattggcaaaagccaaaggccatatgtatattaggaggctctttaatttaatggttgatactcgatgcttgcttgctagatgctgacaagattataaagaaataaaaaagaaaggctgtaaaacatttggtctttctttttttgttcatagataagcttcacaatgttcaagagtaatcaaaaactatactaccattgaagattcgactaatgcatgtacaccaactacattcatcattcattgacaatgacataaacgtatcagaacatatatattcatgtatttagtaacacttatatgagattataaggagttttttgataagtgaaatgaatgaattttcacatattattgagcacctgactctgcattctgcaataggcggctagtttttatcagccacataagtagtcttttattatttgaagatatgcacatgaccaacacattatagtgttctttttgcctggcttcgataggtccacaaataatgggtttgatagaaaacaattcttgcataatgtgggggattcgcctagctagacatgaagcatttttttggagtatataaatggggattttagcaatactatgattagtatttggattatgtaatctgtgatacttaaacacattgcctgcatataaatccatatattatttaaaatatatcatttttgatttttgacagaaatcatagagattacggaaacagataaaagcacactccagaaaattagagacaaatattactattcaaaaagattcagatcgctactaagtgagggtcgccaaatcgcgagtcgaaacaccgattttgagtccgcgaaattcggaaatttgcgtggttgccacaataccgaagtactggaatcctcatcgtgaatggaatctctatatgtaatgtttcagtgtagtaaaattcaggtcttagcatttgctttctagatttgtatgtctaaaataagtgttaagcttgaatgtttgataacagtatcgaccataaatctcccatctaagccgataatgtgttttgatcatcattgtgaattttaaatcagtgaaccataagatagcccaattgggcccaaataatgttgtctgaataaagcccattatcaacagtaacggagttcaaagagtgggtaagagatgtgcgacgtcgttcaggagcttctatatcacaaatcttccttcattttctcagtggaagaggagggaagctttcttctgtagatcttcgcttcctctctctatctatctctgttgagaagaagaatcgaaactttgaaatctgtgagaggaggggttcatagttcgattggatttgatgtctttggtgcatctgcttttgttcgccggccttgtaatcgccgcttcctcttcttccccgggctcgcgcttgattctccgggaaatctccgatcagaaagacaaagctgttgaattgaacactaccaacttcgattcagtccttaaagacacccccgccaagtatgccgtcgtcgaattcttcgctcactggtcagttcttcgattgcttttcacttttcacttaaatctccacttttggttggtgggttttgcagtttatctactacctacagagtttggtgctggatctagcgttgggttctcttgcaagtgtgttcttataggaaaagatttgaactttatgatcctattagtgtgcttcttctctaatcattgctactagaaggctttatattttcttcagttactagtttgggcgtttactgatgcgtgtatcgttttcaattgattctaggtgtcctgcctgtagaaactacaaggtaacataaactattcaaagcctcaactttggagatttccgttgcctaaaaagtgttactcttatgcagcctcattacgaaaaggttgcaaggctcttcaatggtccagatgcaatacatccaggaatcgttttg

SEQ ID NO: 12999 - DNA, 3000 bp, Unknown
  misc_feature (1)..( 3000): cDNA_ID_2710192_gDNA_ID_2214588_Annot_ID_135380 3000 nt of promoter + ATG
agcaaagaacctaggaaagagatttagctatgggctatggcccaaccaaacccaacccaaccactgccggttcagtatttgtgatttaactaataaccgaaaaaacatcaaaccagaccagaaaaagccggtacaatgtctctcgacatcagctgactcaaaattagcaaatgtttgatgaatcgttcaaaatccccaacccttaatttcctcctaaactttctcctcctctgaagaagaagaagaagaagaagaagaagaaatgacgcactccttcaccgattcttcctaccaacaattccacgatggcgaaactcctcgagacctttccttgtgttccctccaccgaacgaggccgcggcattttgatctccggcgattccaaatccgacaccattctctactgcaacggccgctctgtcttcatccggagcctccgccaactccaagacgtccaagtttacggcgaacatggctatgctgttaccgttgctcgctactctcccaacggcgaatggatcgcttccgctgatgtctctggtactgttcgcgtttggggaacgcacaacggcttcgtgctgaagaacgagttcagagtccttgctggtcgtgtcgatgatctccaatggtctttcgatggacttcgaattgttgcttccggcgatggaaaaggcaaatctcttgttcgatccttcgcgtgagtttctcctccacttcttcttcttcttctttcctgattttgagattcaatttcgagtccttggtaattaggcaaacaatttaggttttaatgatgactttgtagaatggaatgatctctagggcttgatcaatttgtgtttgttttatatatgtagatgggactctggcaatacaatgggggattttgatggccattctcgtagggttttgagttgtgccttcaagccaacgagacctttccgaattgccacatgcggtgaagacttcttggttaacttttatgatggaccaccttttaagtttcactcttctcacaggcatctttcttcttctcaattcatatatgtctcttagatattaacagtttgttttcttgactaatagtaccatctgctacacagggagcattccaacttcgtcaactgcatcagatattcacctgatggtactaaattcattaccgtaagctctgacaaaaagggtatgatttacgatggcaagactggagataaagttggagaattggcctcagaagatggtcacaaaggcagtatctacgctgttagctggagtcctgacagcaaacgggtaattgttgttaggatatcaatgtgtggccaagctatgcaatgtttagtactgatatttgatgagtttttaggtgcttactgtgtctgctgataagtctgccaaagtatgggaggtagctgaagatggaactattggctctgtaattaagacattgtcgtttatggaatctggtggagcagaagacatgcttgtgggatgtctttggcagaatgatcatctcattaccgtgtctcttggcggtactatgtccttgttctctgcagatgatatggataagcctcccttgctgttatctggacatattaagaacgtcacttctttggctgttcttggggaaaaccagaagacgattctgtcttgtagctatgatggtctcattgtcaaatggctaaaaggggttgggtacagttgcaagttacaaatgaaagacaccaaaatcaagcgattagcggctactgaatctagcattttcatatctggatatgataatatggtacaagttctgctaacaaaacaattgttcaatgagatatgggtttggactgtgttaaagtcaatgttacatcgcatatgacatcttcacttcttgacaggtttggagaattcctttaaccgacaacggatatggagctgcagaacatgtcgatataggccatcagcctctggacataagcatagccgttgattctcccgaagccacagcactagtctcgtttgattccggagttgtattgctcaatggtctgaacattttgagcaagatcgatttgggttttgctgtggcagcctctgtgatctcacctgacgggaaagaagcgattgtaggagggcaagacgggaagttacacatatactcagtctcaggggacaacaacctcaaagaggaagcagtcctggagaaacacagaggtgctttgacagtgatacgttactctcctgacttaacaatgtttgcttctggtgatgccaaccgcgaagctgtagtctgggatcgcgagaccaaacaggtgacgtgattagagttgttcttgtatgtcttatatgttcaatcatgcttaaacgctaacctggaagtgcggtttttgttttgcaggtgaagctaaacaacatgttgttccacacggctcgtataaacagcttggcatggtcaccaaacaacaagatggtagccacagggtccatagacacttgcgtcattgtatatgaagtggacaagccagcttcaagtcgcataaccgcaagaaacgctcatctcggtggagtgaacgcagtcgccttcattgatgattgcaccgtagcaagttccggagaagacgcttccgttcgtttgtggcatatcgaacctcagtgacttgtcgttataagctttttttttaaccgtccttgaaagttgtagtctctatatattaatttgacaatggcttgtttgtattaaagcttgagtatctcttatcatgaaatgcacacgtgtctaaatctatatggtcaaatttactctgttgtgctgattagtgccgagtcaaaggttaattaagtattgagggaaaatttaaacaaaggttaaataattagaagaagagataatgtttggagccttggttggttcttacttgttactttgcttcgtacggatttgaaggctttacctcaccggagcttccaagtagaagacgacactgagtcactgacacagggatacaaattatg

SEQ ID NO: 13000 - DNA, 3000 bp, Unknown
  misc_feature (1)..( 3000): cDNA_ID_2710188_gDNA_ID_2214588_Annot_ID_135381 3000 nt of promoter + ATG
atttctcttaaattgtactaccactatttcaacaagatggtactcgtgcgcatcacatgcaactattaagtatagcttgtagattcatgtttatttcaagagtatatcaccttgttattcaattaccttcttttctgccacgttgaaattttagaattagggtttggatggttatgatggttaaggcggacaaaatcgtcaatggatcaaacctttttttatttaccattcattaattatagtacgcagtggtctggataaaaaataatagaagaaaaccgcaacggaccatctacggaccgtttttacatataaataaatttgatccgcatcgatttattgtccgcccaaaaatgaagtagactgaatagcagacaaattaaaccgttttgtccgctgcatccattcaaaatcttagactcgctaaaatatgaacaagacaaaataataaagcggaggtaagaaagaaaaatatgccataaactccaaaattgtattttacaaatacctaacgttctttagattatatcgagggtcgctagtatttaaaaggaaaataacagtgataaaagtgctaacttttgtgggaaatggattctaggttgaaaaaaacaggacttttgtaagcaattttcaacttaacaacatcatgcggatgcgcggtacaagtcttctactcttgtggaccatattaatgctttgatttgattgatataatacgcatgcattataagcttaatgggttggttaattatttgcgataatcattttgtcttttgcattactatattattactcgattgctacttttttacgttgatcacggaaaattaacggtgcatgcttaagacaattattatccatcatttataatttagatgcaccttttatgtcacgatgaaatctggaaattgtactagtcaggtacatttctaaactcacttttaatcttttatactacggtcactcgtgtctaatttcttaattatggtctggtccgtccactaacgaggttgtggacctaatagcaagtgtctagctagtgatacttaacagatgttacaagaaagaaagaaaaaagtccaaaatgatggtctcctttgcaacttggaaagctataaacaatgacataacagctgacacaatatctccacatgtacgttagagagggtttccataaatcatcactaatcatagtttaaatcaacttgacggtccgatccgtacaatgttaaaagtcagtcggaaatatgtagctttgaatctttgtttttaatgtttaggctacagttattgactaattcaaaagatttaccatgaacttttgatcactacatacaataataatgtgcctattgtctatatatgatgtgtctaatgtgtaataatttgtctactgattagaagtcaagagttaagaaacgttcaaagaacgtggtaagaccatgaagataataattatgaacaaaaaaaagcaagaccatgaaggttacgttagttaaacaaggtacgtcacgtaatcacgtttaagtgtgatagctacgtgaaaaccatgtggcctttatattttttgtatgtaagctcgcaatatcatttcctgcgaagttgccttcctcgtccactaatgacgaatatatatacattcatttgaaatttttgtcgtcaatattggtcaataacctaagtatatatatattccatttttattgttattaatacgatattgcacacaatttgtgtattagtagtataaatattatgtattgactgatgaatcatatgtacatcgtggttcaaattaaacagctcgaatacacattatcaaaacgtgctttatccatatttgtcaaatttgtgtcttatccgggggaaataaataattcaatttccaagtctagttaattaaatttcaaaaccttgttaatctccattgatgacccatccgataaccaaataaaatggattgcgaatgaaccaatcatatacgtacagattactttctatgatgaattaagaaaccaattatatcaatgtgtgactaactagtcaaaaatgatcaaacgtgtctcaaaagtatatatttaatgctaggtagtgtgatttaacaattgagagaacaaaaacaaaaaacataccaaatgatagttccggtttatatccattcggttatcaattcgtatccattcgattatcaattcggttcagatttttatctattcggtttcggtttgtatccattcggttatcagatattttggttataaagtttagtatccattcgattattttgaaattttggttaggtttcggttcggatcctgttctttcggttttaaaatttcgtatccattcggttattttgctttcaaaattttcgtacatttcagttatttttagatatttcagatatttttcggttattttcgattatttttactattatatatatatttcacatatttttaattatttaatatagaaataactaatatatttcggatattttcggttatccaaatatttcggtatagtaccgattcgactttagttctttcaattatagaatttagtattcattcagttattttaaatttttcagttcgattattttactttggtttgggtttgatatattcagtttggtttatttggccaggcctaacaagcgagaagagaattggtagctgaaaagagcaaagaacctaggaaagagatttagctatgggctatggcccaaccaaacccaacccaaccactgccggttcagtatttgtgatttaactaataaccgaaaaaacatcaaaccagaccagaaaaagccggtacaatgtctctcgacatcagctgactcaaaattagcaaatgtttgatgaatcgttcaaaatccccaacccttaatttcctcctaaactttctcctcctctgaagaagaagaagaagaagaagaagaagaaatgacgcactccttcaccgattcttcctaccaacaattccacgatg

SEQ ID NO: 13001 - DNA, 2408 bp, Unknown
  misc_feature (1)..( 2408): cDNA_ID_3027530_gDNA_ID_2214588_Annot_ID_186703 3000 nt of promoter + ATG
tcgcctgcagctttcagtgtctctaaagcttcaacaaagataggatagcgtaggacaactccattttctttcatgtacacaagaactcgagtcatgaaagatgtttccccaaatttcaaggctttcgctatcagaatattgcaagctgctttatctggctgcacaccaatttcttgcattttaaagaatatgtccaaggcttcctcacattttcctgcaaaatcaaacgaagaaactaacacatcatcatcaacaaggctacaaaacattcagataccagaatcatctacataaagcaaaagttttggattttcagctaagcattttaacaaacacttagtgtgcaagagaatgaagttgacctgtggcgacaagatactccatcaatacagtataagtgtgacaattcggagaaacccgcgaccgtaacatctccttatacacctccgtggcttcttccaccctcccatcagcgaaaagcatcttcatgtaagcagtgtacgacacaacggtaggttcgcacccattatctctcatctcctcccacaacctcattgctccatccacatcaccggagcttgaaacccagtgaatcagcgatgtataagtcaccgtatcgatcaacacacccttctccttcataaggtgaaaaacagagtacatggattgaatccgaccggcttctccgaagatatcgagcatggtggtataagtgaagtggtcgtgtttgaaacccttgatttgagcagcccagttgaaaaagagccaagctttctgcatcggaggatgtgctttcaagacacggttgataatgtgagaatcccatctgacgccgagatgtggaagctgttcttgagcagagtcccaattggagtacttgaggatgttatagatgttggatacaatgtctcttgtgtaaacactgggatctggtagggtctgtgttttcacaagtttgggtttttgggagaatcgcttggagttggtgggttttagacgaggaagagagtgaagtagcttgacggagctccggcgattggagaattggattggggtattgcggaagatgctagagaagcgcatgaagctttgcccagagagataaccaattctaaactccaaccttgcagtgtattagaaagctttgtttgaataagacgccgttttttattcaagtaaaatttcaaaaatctagattcaaagaaaaaaattcaaaaatctaagcaaatctttaaccacaattataaagttagggtttataatttgacttaggacctgggcgttcgggtattcgcttcggttttagttggattccgattccttcggtttttgagtgtagaatccatatatgaaccgaaacagtttcagtttggtacgggtttggttctagttctttcggttatgaagtttgggatctattcggatattttatttcagatatttcggatattttcgagtatttttttggatattgtggtgttatatatatattttcaagtatattttggtattttaggtatttttgattattcaatctaaaaataactaatatttttggataatataatcatatttcggatatctaaaatatttttgggttcggttcctattattttggttctagaatttaggatctatttaagtattttaccatttcggttcggattcgggttcggttctttttgcttcggttccggttcggttctttcggttcagttattatgcccacgcctaatttgacttgtgttttactcgcttatctgtccacttttatcttcttgtgaaattttcaagttacaaaaacaaatacttggcaccaaaattgtgtgaattagttagttaatgatcaaatggttaaataacacaaagagttgtataatttatgtccaaaaggtattacaatttcgactctttcgagtttggaggagtcgaatcgtggatacatatatgtatgagaagagagacaataaataaaagaatgtggttgatcaagcttcaagggcaagtaacataagtgtgggaagaataaacttgtgaatgagaaagagggtttagtttgttgtgacatggagaaggctgtgaaggaggaactggacctcgttggagcttattctgcaaagcaaaccttctacctatatcttccttcttcattctcagccttgacgttgccgatgttcctcttgatcccaccaaagctataaaacacaacatcactataatgaatttccacatgatcctcatgataactcggccttgtaacgcggggatgaatggtctagtggttgattagtatgaggaaacgttgagttagctaataatgaatcttttgagggaattaagaaggatgagagataaaagttttgatggaggaaatatataaagatacatggagagggagagagacaatg

SEQ ID NO: 13002 - DNA, 3000 bp, Unknown; identical to SEQ ID NO: 13000
  misc_feature (1)..( 3000): cDNA_ID_2710188_gDNA_ID_2214588_Annot_ID_186698 3000 nt of promoter + ATG

SEQ ID NO: 13003 - DNA, 3000 bp, Unknown
  misc_feature (1)..( 3000): cDNA_ID_3027548_gDNA_ID_2214588_Annot_ID_186691 3000 nt of promoter + ATG
ttgaaggttagaaacaacaaaggccatttctgagcattagtttttaaatttgaagttacctggtatgatataagagcataaaagatgataataatatatatcatcatcttagtatatagtatctacaccatgctttcggttctagtagagaaatgaacgcacaaaccttatcagcaaaaggttcacggatgtatggaaggtctctttcaagatactcaaacatcaaacgaccttgagagcctaaaggttcgccatcatcactggaagagtcttcctgatgttgatccctcaatgagatacagtctactctagcagaaacccgctcggaatcactatcgctgctaacatcgctacttgaatcccgaaaatcactgtcgctactatcaccaggacgcctgccataggaaccgtacatgacataatgaaaaacagcttgttatactataatgctgctatgatgagttcacaaagaattaagaaccttgatttaagagatgaatccaaggcatgagaatgagcatagatttgaatggctgacaaagaagggacatagtattggataacacgatccttgttgttattcaaaacaagaggcacaccggtgccgtaagcactccactctgcaaatgagtcccatatatcaccaagcacaaaataaggcacaagtttattataatcatcatctgctcttctttctcgtagcaatgtctacacagagattatcaccatcaccatcagagaacaacacagacttagattaaaaaaaaaaaaacataaaatagagattgtaataaaccttggataaaaactgagccggtacggatggtgtgaccgactctaaaaaccgatctagattactggaagataaatcggacggctcgagttgttgtttatgcggagaaggagctgatgatggaacgttagagacgtcgctctgagctctacggagctgatcgatgcgctgattggccctgcgagtttttgcggaagtgtagaaaggatcgtcgccgtgtctgcctctcgtcaactgaaatccagcacccaacatctccgagtagtcgtagttgagtttttacctatatatctatatatctatctaagcttaatttagttgatttagcgtgaatatgtgtttgtctccgatgagacggcgaagaagcttggtcgaatcggagattccaaagaaaggggtaaaaatggatcgaatgaaggagaattgatagaacaaaaaccttctgatgatatctaagctccgattaaacaggcaaaagattagtggaagaggaaaatctgaagaagagattcgctgaaatggagagagatttggtaatttcaaaaaaaggggtcaatgaagagagaaagacgattggttagtaattggagggggagagacaaaaaccattgaataacacatgaatccctcataagttagtgtttttacattttggtccttttcattttgatgattgattacagttttacccgaaacttctttgtaattcagttatacgcttacttataaacaagttaatcatacggtaatgcaaggtattttagactgctcagatgcataatgtagatggtgcataggaatgatttggggttatgaatgtaacattttaaaatctgatgagaaatatgtgactatgggaaatataaaggggttaaacattggcaaaagccaaaggccatatgtatattaggaggctctttaatttaatggttgatactcgatgcttgcttgctagatgctgacaagattataaagaaataaaaaagaaaggctgtaaaacatttggtctttctttttttgttcatagataagcttcacaatgttcaagagtaatcaaaaactatactaccattgaagattcgactaatgcatgtacaccaactacattcatcattcattgacaatgacataaacgtatcagaacatatatattcatgtatttagtaacacttatatgagattataaggagttttttgataagtgaaatgaatgaattttcacatattattgagcacctgactctgcattctgcaataggcggctagtttttatcagccacataagtagtcttttattatttgaagatatgcacatgaccaacacattatagtgttctttttgcctggcttcgataggtccacaaataatgggtttgatagaaaacaattcttgcataatgtgggggattcgcctagctagacatgaagcatttttttggagtatataaatggggattttagcaatactatgattagtatttggattatgtaatctgtgatacttaaacacattgcctgcatataaatccatatattatttaaaatatatcatttttgatttttgacagaaatcatagagattacggaaacagataaaagcacactccagaaaattagagacaaatattactattcaaaaagattcagatcgctactaagtgagggtcgccaaatcgcgagtcgaaacaccgattttgagtccgcgaaattcggaaatttgcgtggttgccacaataccgaagtactggaatcctcatcgtgaatggaatctctatatgtaatgtttcagtgtagtaaaattcaggtcttagcatttgctttctagatttgtatgtctaaaataagtgttaagcttgaatgtttgataacagtatcgaccataaatctcccatctaagccgataatgtgttttgatcatcattgtgaattttaaatcagtgaaccataagatagcccaattgggcccaaataatgttgtctgaataaagcccattatcaacagtaacggagttcaaagagtgggtaagagatgtgcgacgtcgttcaggagcttctatatcacaaatcttccttcattttctcagtggaagaggagggaagctttcttctgtagatcttcgcttcctctctctatctatctctgttgagaagaagaatcgaaactttgaaatctgtgagaggaggggttcatagttcgattggatttg

SEQ ID NO: 13004 - DNA, 3000 bp, Unknown
  misc_feature (1)..( 3000): cDNA_ID_3610384_gDNA_ID_2214588_Annot_ID_186687 3000 nt of promoter + ATG
gtcgtagatgagaagcttttcatcgacagaccaataataagctcgaagactagcaatgttaggatgttttagtttccctatggcttcaacttctgtctgaaactccttgaatctctgagaccctccttcacccaatctccgtacggccagtgtgagcccgttctctagaaccactttgtagacaattccgattccgctcttccccagaacgaaagctgacgcctttagcagctcctccaggttaaacgcaacctgagcgtcgaggggaacaatgtcgcaatgctccacgttttcagatggcgtttcggattcgtctttacggaaacacagacactcagaagcccttttcttggattctttctcgactccgaattggttctcgcggttacaagcgcagaactttgagtagcagtaagtgaaaagcaaacccacaaggcagataccaaacacgtcgcagagaacaatggcaatgacggcgcttttgctcaaaccacttgatttctgtttggtttcagagttagtactatcagaatcctcaggtgggttgttgcttgggataaaagggtaagaggcattgaggccaagttgatatccttggcaaaggtccttcaatggaggcccgcatagaccagtgttgccgataaacgctgttggtcctctgttcataagagcaccggtttgaggaatgggaccggagagattattgaaagtgagatcaatgtaaaccttttcaggaagatctccaagggcaggtgggattgagccggtgaagtgattatgagagaaatcagcagttccttgaaggttggagaggtttccaatgtcgctggggatggagccgttgaattggttgaaggcgaggtcgagtttctccagagagacgaacgctgagccaaacccatcaggcaaaggaccagacaagttgtttctgctgacatcgagtgttttaagtctgttgcattgcagaatcgaaagtggtaacgacccgttgaagagattctgtgacaaatctaaggtctgaagaagcttcagcttaccgatctcttccgacaatgacccatcaaaggaattgccgtaaaggactagactttggagtccctgaagatggaaaagctgaataggcaacgacccataaaacctattgctccggagattcaagtgacggagactggagagaaaccctagagacgaagggagagaaccgtaaagattcttccttggaatgcttagagacaccaccctgagttctttgcaagttacaccgttccacgaacaggcgttctcgtctgatgagttccaattgttaagagaacctgtaggatcatcgtgaacgctttgtttaaacgttaagagcgcaaagccttcgtcgtttaagccacttatgacagtcacattgcagagaagagcaacgaagatgatcagcgaggccaacattatcagatgcaaattagaacaaaaagacgagtgttggctttgtacaaagcaaagagagatagtagcaagaagagtgtgatattgatggagtgaagagtaaagtgaaaaagatactctcgttgaagaaaaaggagaaagaaagaatacaaaaagtagagagaaagagagagagagctctgtttttgcattgggagaagagaattaacaaaaaaaaaagaaatgaccaaagaaagaggtgaaagttggagaaaagagaaggccatggcgaagtaatccatacgctaatttgaccactaatctaatgggtttgaatggtaacaaacttaagctttatacagttttgaatcgatcataaaaactttattaaaagtgttacaaaaagttttacttttagcttttttgtacagcttttttatacagcttcttctaacagttttgcactattccgataaagctaatagcttcagctaacaggtaaaaaacttgtccagcttttggttaccaatcagacccaatatctttgtaatctctcctatatacaaaatgttacaaatgcagatatctttattcaaatagttacatcttgtaataccttttgtcatgattgttgttttattccgaaaagtaatatattggggtcctttgattgatctgtcaagtgtcaatgtaggtaacatttacagtgtttgtccttttctattaatctatcttgtcaatatattactactacagtagtatcattcattttttatttcttagatgatgttgctctagcacgaaactccataaaataccaagtgatgcatattaatagagtgtagcaagtgtagtaacaagtagtaacaagtgtagtttcaaatgagcattgaacaaactagttacgattgggagagagcaaacataacagtggagtttactagagaagaaaggtgccacaagataccaccacgctcttcctgctttctttattcctcgagtctgcttttacagtactagtactacctcttttatatcttactttaccatataaatcacagctcatctttcttattttacttagaatagtagcttgacatgttttttcgcaagaagaagattcatataataaacgattataaatgtggtttagatttagctaaagccttaaaagggtaaaaggagaggacatgtgtacaaacattagtccggcccttattgtcgttatggtgatacgataaaattgtcgataagtagacttggtgaagtgtgatgtctcctagtttcttaggatagagagccccaaaaaaacctaaacctaaacccagagagagtgtgccagagtgggcctattttctcctcacggactaacggcgacgactccgaggctacatactagtaaatcaaacaacttgggttttagtgcaatataaaattattttgggcataaattgtaattatggaaacgtttgggcatgaattgttattacggaaactgttggggataaattgaaattacggaaactttggggggcttaatttggctttttgctggcacggcaatgggaggagacgaaaccgagagaaaca

SEQ ID NO: 13005 - DNA, 3000 bp, Unknown; identical to SEQ ID NO: 12996
  misc_feature (1)..( 3000): cDNA_ID_2710168_gDNA_ID_2214588_Annot_ID_186685 3000 nt of promoter + ATG

SEQ ID NO: 13006 - DNA, 3000 bp, Unknown; identical to SEQ ID NO: 12994
  misc_feature (1)..( 3000): cDNA_ID_3027572_gDNA_ID_2214588_Annot_ID_186678 3000 nt of promoter + ATG

SEQ ID NO: 13007 - DNA, 3000 bp, Unknown
  misc_feature (1)..( 3000): cDNA_ID_2707172_gDNA_ID_2214589_Annot_ID_135387 3000 nt of promoter + ATG
tcatgtattaaggtaccttaactctgatcatttgaacagaataattcttgatttggtaaaccaatactgagctttagctttaccgtatttttttgacagaaaatcacaattagtaaacctctttccgcaattttgattctacttttttctttgcaaatactgatctcggatagtcaggattcaactggtcaagataccaactcaatgttactaattcattttctttgacgtctctaattgatttctttctttctatgataagcttacgtgatcagtccctctttatatagaccatgaaaccaaacccttaagaagaataaggagtctacatcaaggagatctcaaaatcgaataggcttttaaattcttcaaacataaccaaattacacatctatatcttgaccaaattgcccaccttcattttgaacccagagagagagagagagagagaatgaatcaagttaccaattgtttgaataaagtatttgaacgtatatatgttcctatcatatggtctagatcactgacatatgtagtgatgtgtcttaacgagttacttacttgtgatgtatatatattacaagtggatatacatatgagtttttttctgcggatccgagaagatctttagatgctttttgaggattcaaagtacgttattcctataagaagcaaagatgtgaggcttgtgtagcatcatggtctatgattccctttatgtgaaaattttcctaaaagacttgtttggatcagtttggtccatttgccattttttgttggctgattttttttaatgttcctatatacaaatttatatccgttttgtgaatattacggtgaactagatgataatccaaaattgtatgaatagactttttattttttctataattaaaactgaattattgtggtagagagcgatatgaaatcgctgtgcggctactttatatcataaaatacttttttttttgttgagaaacatgttgcttaattagtatatggtcggattcacaacactttaattttgtaacaaatctatttattttgctctgaaatcatatatatctcacgttctactttctccgagtttcaattttagatgcaaacataaacctaacatcataaagactgtacaacaacccaagaattgaagattagagacgacacctacataaaaatcgcaaaagtatgttcaatgtgataacaagtaaaacttttatctatagagattattgtaaagaaccaagcttagatcattgcaagatgcaagactcatttttaacgtaagtattattcatcaaactcttagaacgagattgatatatagcatcatgcacattaactatattatataacgatctaaaatcataataatcaatatgaccgcattattggagatatatagatcaatctcatccacgggttgctctaaaccatcccatgaacggagcaaaacccttctttaattttgtcttcttgaccgaacaatctctctcaaaatccttctctttcttgtttctctcctcttcgtccccgacacttgacatcacacgtgtcagcaaaggcgagctcgcgaatgtcactagtctcctcttttccaactcctccgtcgtcacaacctcttcttcaaaatcattagacgtcatcgtttgatgctgttccacgaacttgagttcctcaatctccggattgtctaggcgactcgacctcgtcctgctgagccgttgtatctccttcttaccaagttcgagttcttgtgttagagttttgattctgttggagaggctggtgtttagttgtagtgttcttgtcagtgtttgttttgtctgctcaagctcgagtgttagagatggtagtcttgatagagaactcggagttgaatttgtttcctttgtccgtatctgaaaccgtcaaagacatgtgatgtaaaaagtaaaaactatacgagccggaacgtatcaatttattcatatatacaatgcccattcaaaactataaatgtatgtgtacatattttttttttttcatttggttgtgttgtatatctagtcaatagaaaatggttacaaatatatctgacatattaattagtttatatatacagtatatattatgtatatataaaatattatttcaaaatagtaatctttgtgatgatattgaagtattgaacattgtttattttcgttgtgataatatagaacattgttacctctctaagcctagttgcatagatctctccggctaaaactttctctccgaacatggccaccgcttctttcaccgacccaaacgctgcttttgtctctatctccgctcgaccacttctccaaacgtttcctctctccattactatctgcttaattaattatgcgtataccttccatcaatattacatcacacaagaattagtgttactttttgtgtcttatacagtaatttggagggtgttagattcttggcgttcactacacttgaatttggttaataaaaattataatgatggcttttgctcctgtctaattaatattcgttagctaaatgtgaccatcttgataacaacacctctcctaaaataaaataaaatgcacacaggcctcttgaaattatattgggccgaaaattttggcccattaaggaaacaataaaactgggcggtacaagtcggcgatctcgcccgtgaatcctctcggagttcacagaactcactattcaaagagagtcgtcacagagaaacaaaaatgagagggaaaattgcttagagaagcatcatcttccatagtcttcctcctctaattcgttagtctttgttcaaacgattctgggaaactctccagaattgtctctagtttagtagcttttgtaaaaaaccttcgctaaaattccacttgttttgacctagtctggcacttgtacggtgcgtttagagatcgtcgcgtcggtgatcggcgaaagagctccgccgtgtaaattatttcgctcagctctttgttcaccatg

SEQ ID NO: 13008 - DNA, 3000 bp, Unknown
  misc_feature (1)..( 3000): cDNA_ID_2710240_gDNA_ID_2214589_Annot_ID_135392 3000 nt of promoter + ATG
tctagtactcttttgtcagtgtggattctgtgacggtacacttgtaaattctagtattaaccaaacaagggtaatatcggtatttaagcagccaattaaagctcttgggccgtttaaaattcttaaaagcccattaatttcgaaacgccacctgtcgagacataattgggtcagaggattttaacggtggaagatgaagaagcttatctttttgcaaaatcgtttcttccttcattcatcatagcttcaaaatcttaaaaacaacaacaaaaatgaaaagtctccactttttagctcccaattcaacgattatcaatctgaagcaacaatcttatacaaaaaccaagttccagttgcatcgtagcaacagaagaactctatcgataaactgcgtaaacagtggcggtgatgaagagaagattactcagccgttggatggagtggagataagattcaaaagaggatccagaaggaaaatgagggaagagggttcaggagaaggaggaggacaaagcgggaagaaaaaagagactgttcaaaagccatgggaagagatgacattgaatgagaaggcattggagctttatgttggagagaaaggtttgttgttttggctaaacaaattggcttacgcgtcgatatacattgtcattggaggttggatttttttccggtttgttggaccggcgtttaatctttatcaactcgatacaccgcctcttgatcctaagaacatcttaaagggttaagaaatgctttgtagctgtgtctgcattctctgttccaaaacattttgaggcttatatattcaagttagtttcgagtaatgtgtagccatgtctcactagattaagatacacaagagaacaacactcttcatgaattttcaagattgttctgttggagttatgtcctgatcaaggatatctcgtgtagtcttgcacctgacatggaaaagaaaatatttttttcttcggctttttgtttaccttaactcaatgcaaagaatcagaattattaactgaaaaaactagattaaaactcacctattgcactctgctcgtgatgcataattgtgattcttgcaatttgtacacatccagtcgccatcacgccattgtttcactctaagaaatcagacaacacaaagaattgggaaggttgcaaaagatcacgccattgttctagcgtttagaaaacaagaaaacaatggagaccagagatcaatacagtaccccattccaagtaaagcaggtgttgagtgttgttgtagaaacgggagaggaagttgccaatttgagacccttcctaggctcataccaggaaaagatgcatatatcgctgactgtgtttgcatgcttgtctgcacaacgagccagaagaaacagaggttggttaagcagcaagtaaaattgatgaatgtactaatcaatttatgcgctctaactaatccttacatatccttgattcagtcttttgctatcccattcatgagccaaagcttctgatgctaatctctttgtaccaagggctgcaacccaaaataaactttcccatattaaaactcgtgaaaggattatcagacaccttcgggttatataagattgcacgcgcatcggtcttagacaaaaaccttacctagtggagctatttcattgcactttttgcactgcagagacatacaaaacagaaatgagtaaaacaacaagccggaatctgcaagtcggttttgcattgtgaacccatttcctcacctgtatacgagaggaataattgtgaaaaccacatctgcaaatccagtcaccactcctccattctttatgaaccgaagcttgatttgtagcgttagagaatgcgagtaaagaaccaggttgatcatgtgactcaggtccacgggtgaagtaatggagatgagtttgaagagaagctccagggatagcaagtgctgacaatgctgctacttccttagattgcccacatttcttgcacttttctcgtgatgcataattgttgttagtacaacctattgccacaccacaccacaccacacacccaaacgcaaaacgtagaacgaagaagatacacacgcacgcacaccacaacacacccaccagcaaattccatataccacataacacagaatacacaaaacagctcaacctagttataagtaaatcccctaattcacaattccaatctaatgaaacatcaaatgtaaaagggcatttgaaagttgaaggatttgaactcagaacttacgaattagatcaatcctagttttcattcacaattcaatctaatgaatccgcaaatggaaaagggcatttgaaagttttaaggatttgaactcagaacttacgattctgatcaatcctagttttgcttctagttcattagcacaatctgggaagctataaaagaattgaattgagataggagaagaaagaacgaaccagtgcagatccaatcgccgatacgaggaagccacttagagtttggagaagtattattatccatgataagacgaggctgcttgcatctgttacagaatgatctaaacgcataattcctgtttctgcatcctaaacattcccagtctccttctcttccgtctcccatttcttcttcccggaaaaactccagtctccggcgacgacgactcactctttttcgttcagagaggagaaagaaagagaaagttgaagaaagctaaagctgggccacatttgttgtgaagtgactaggcccattaggcccattaatttcttcagagaaaatctctttcgtccttctcttcgcaggtggcaatcgttacttactgacatacatcttcatcagtgatttttgggtttgaaatttctctagatcgattttggatttagatctctttgtttctactgcttttcatcgttggatctgcgttttgcaaagggagatacagaaaggaatagctttgaattgacaaggtttctctctaatccaaccgaatctcaagcttcc

SEQ ID NO: 13009 - DNA, 3000 bp, Unknown
  misc_feature (1)..( 3000): cDNA_ID_1977060_gDNA_ID_2214589_Annot_ID_135393 3000 nt of promoter + ATG
tttagagaattctggtttcttatgagttaatattgatattggatctttgatctctctctctctcggtttcagaatgtgtaatccggatgttgaatctgaaccaacctttgaatccaagtggaactgcgaacgaagaagtttacaagatcttgatttacgataggttttgtcagaacattctatctccattgacccatgtcaaggatctgcgtaagcatggagttacactcttctttctcatagacaaagatcgacaacctgttcatgatgttcccgctgtctactttgttcaaccaactgaatccaacctccagaggatcatagccgatgcttctagatctctctacgatacctttcatctgaatttctcgtcttcgatccctcgtaagtttcttgaagagctagcttctgggactcttaaatctggttctgttgagaaagtctcgaaagtgcatgatcagtatctggagtttgtgactttggaagataacttgttctcgctggctcagcaatctacctatgttcaaatgaatgacccatcagcaggggagaaagagattaatgagattatcgaaagggtcgctagtggtttgttttgtgtgttggtaacgcttggtgtggttcctgttatccgatgccctagtggtggacctgcagagatggtggcgtctttgttggatcagaaactgagggatcatcttttgtccaagaacaatctgtttactgaaggtggcggtttcatgagctcgtttcagcgtcccctcttgtgcatatttgataggaactttgagctctcggttgggattcagcatgatttcagataccggcctctcgttcacgatgttctcgggttaaagctcaaccaattgaaagtgcagggagagaaaggaccaccgaaatcgtttgagctggacagttcggacccattctggtcagcaaacagtactctggagtttccagatgtcgctgtggagatcgaaacacagttgaacaagtacaagagagacgttgaagaggttaacaagaaaaccggaggtgggagcggcgctgagtttgatgggacagatctgattggaaacatccacaccgagcatctcatgaacactgtgaaatcgctcccggagttaactgagcgaaagaaagtgattgacaaacacaccaatatcgcaacagcgctcttaggacagatcaaggagagatctattgacgctttcactaagaaagaaagcgacatgatgatgaggggcggaatcgacagaactgaacttatggctgctctgaaaggcaaagggacaaagatggacaagctccggtttgcaatcatgtacctgatctccacagaaaccataaaccaatcggaagttgaagcagtggaggcagcattgaatgaagctgaggctgatacaagtgcgtttcagtatgtaaagaaaatcaaatcgttaaacgcatcttttgcagctacatcagcgaattcagctagcagaagcaacattgtagactgggccgagaagctttacggacagtctataagcgcagtgactgcaggagtcaagaatctgttatctagtgatcaacaattggcagtgactcgaacagtcgaagctttaacagaaggaaaaccaaacccggagatcgattcttaccgcttcctggacccaagagctccaaagtcgtctagctccggtggtagccatgtaaaaggaccgttcagagaagctatagtgttcatgatcggtggaggtaactatgttgagtatggaagtttgcaggagttgactcagagacagttaaccgttaaaaacgttatttatggagccactgagattcttaacggaggtgagttggtggagcagcttggacttttgggaaagaagatgggattaggaggtccggtcgcttcaacgtcattgtctggtggtcactgagtgttactcactgttactttcttttttcttttggcttttgagagtttttttttattaatctataaaatataaatccccagtggtgaattatttaacaaacagtttacagtctcgttataacattttctacagaacattttaaggtgtgtttataactccattagttaagattgttaaatggtttttgtcataatctttgaaaaagtaaatgacaattagctaggttgtcattaataataaaaataaataaaaaggtatgaacaaaagtctgaaaaagaaatttgtaatctaacattactaatttctaattaacattttttatgccatttagtacagtgtttttccaaaataaaatatactcctatgatattttgcataagaatatattatactaaaaaagagaagaggaaaaaagcaaaaaatcaaaagaaaaaaaaaaagtaaaggagcaacaaaagcaaagcaggtggtccgttcccatttctctgtaatttgtcttcgtctctaccttccatctctctcacccactctcctcggaaaccacagcgacggacggacggacggacgataaaacttttgcctctaatttgctcctacaaatctggaatcagccggagcgaatctcgaagcttatgatctcgacttgtgaggatcctcttttccttttctttttcttttgtataataataattatctcatccccgatcgatttcgattttcatatggtttctcgccagaaatgatcgattctctcgtttatttcaatagcctcagatgattgaagatgataattcaacagttaataacgcttctcttttttttagtggctttgtgttttgaccagccaatctaaatcactggtcacctttgttttgatctctgttttgttgaatttttgtttcaaacttaaacgaagctaaaaggctaatgggttggtcttaattctgaattttgagagagttttaaaatcatcttttatgagctaagccatgtttgaagctagatctgcctttaactttggttttggttttaaacttttttgtttctaacttgttgtaggctgaagaggctggga

SEQ ID NO: 13010 - DNA, 3000 bp, Unknown
  misc_feature (1)..( 3000): cDNA_ID_4255088_gDNA_ID_2214589_Annot_ID_135396 3000 nt of promoter + ATG
gaggaagaatttgggtttgaccatgatatgggtctaaccattccttgtgatgaagtcttcttcaggtctcttatctccatgtttagataaagcccgatatcggagacagattattattcttgaagaaaagatttctttattggaaagaaaatttgaagccgagatcagtaaatccaaaaacaagaaacaaactcattttttagggttgtctgattaagatgcaagaacatggctaaaaagcttcgtaggcattaacccgtttgtggtttttttctttgctaaatttattagtcattttctcttttaaatattttgttgtagttggggtggggtgggagactttttccctcaagtcaacgtaaaatgttgatcgatgatcttgagaggattagctagttaacttctaaaactttattggttaagatcaatcaagaatcctcaatagttttggtggtttgtgctaacgatgtttatgtgttatcatcgttcgagttaaaatccgcgtaatatataatgttgttttataaaaaaaattagtacatgaatggtccaacaattcataactcacgttcttaacctaatttgtgactaagactaactaatcatgtgtaaacagctttctatttcttcgaaaaatttagaattacaaagacatagtttcgtatgacaaagtatcacggtgtccatcatttgacaaaagtaatgatagaaatattacttagcatctttataaaagtaatactttctcttttactaagatacaggttacgagattaatcataaaacactcgagtcataaaacaatttgttttgttttctttcaacacaaaagttttgctatacgtgtattcaatatttatttgtcggtgtgtcaatcaccgtaatttgactcatttccttttacatgtagacgtagcaagtagtatttcaaaagattttatgtgtatatatcaattatattgagtcagatttttgtgatggatcattatggtcctaccaaccagagtccctacatatacttgtatctgtgcgaatttatagttgttacctaagctacaaaaaaaattgaagagatcttccgtaatatagatgaactaatttgatgtcccattatgtttctcgtaaaagaagaaatacatgtgtatttgacaagatggtacatagaccgctaaaccatcatgtcctaacaaagtagattggtatcatttgcaaaatatgtcacttaacattaatgttcttcattccttaataccagtctacttgatgagtctctcctctttttgatgagctagtctcgcactttttttcatctctaacttttgtattttatgaaatgttcatagactttattcaaggcacattactatcatatatctggatttaaattgccataccgtattcacgagacaatttatatgtaataacaatttaaaaaatgcattgtctgctcagaagctagcttgcccatattgtgtgttcttctaacaattttttattgtttcttctgagggtttttgcattaaatatgttattgttgacatcatagatgctagtggatatatcatcgacgacgaactcgagttgcttaataattatttccagtttcatacatcatcatcatattatagaacatatacctttatcatatgtatctcaaaaatctataatcagcttgatattaacttattctaaagttcaaatcagttttaacttttaagaaaatattatgagttttctaatttgattcggttttcgccgggttaacctgaaatcggaatctggattggacaaagtacaaaccgtgggttagtattagtaacatccaatttgggcttgcccgtatttgtctgctcagaagctagcttgcccatattatgtgttctccaaagaattgtttattgttattttggagagggtttttgcattaaatatgttcttgtgttgacattattgattattagatgctagtgatataccatcaccaaaattagaattgcattatcatcattttatatatcaatctatatatttatcatatgactcagactatcatgagacgcattttttttaagtattatgaataatataccacttgttcacgttttaacgtttgaaaaacatgattttgctactttttacgattcaaagtatttattaagaatttacgttcttgaaaagtgattatactgtatatataactataagtaaataaaacttttttcgacgaaatttctgatgataaataaaaggtcggatatatttgactttttttttttttttaattattttttgacgataaatttttcgttgaaaaatcatcgaaattttcgacggattccaatgatcaaaaattcgtcaataatttccaacgatattctgactaaactaaatctgatgaaatatttttgacggctttccaaccaaaatatttcgttgtgacttgtcaaaaatccgttagaatactaagcaacttttcgacagattttcagcaaaaatattcggtaatataacgtgttaaaaatatgataaaaaaaaaaacttgatgaatctactaaaactaaattttcaatcatatatatctattattcatatatttcattcattttattatttttctcttaacaattatttagttattctggtatcgtgtaattatattcatatgatttattctgatattgattcggttagcatccggataaatctgggttgggctttttaacttggtttttctaagaaaaattctaatatgatttggttagcatccggattagtctagtttggtaggcctgcctttgtgattcttaactcggtcttttgtatgggtttgaacaattactacaccatttagattcttctgacccatatcaaataaagatccacttaggcccattagggttagaacaaacatgaggttgcagaataaaaagggttcattttcctcactctcaagttggatctcaaaaccctaatatctgaacttcgccgtcgagagcatcc

SEQ ID NO: 13011 - DNA, 3000 bp, Unknown
  misc_feature (1)..( 3000): cDNA_ID_2710254_gDNA_ID_2214589_Annot_ID_135400 3000 nt of promoter + ATG
ggtaaaaatgctgcctagcaaaaacatagatcatgaatttgaattccaaaattaccggatcctctcaacctttggcacctcattgttgtgctgccaattgagtgaaaatacgattacacgaaattaaacaatagtgtcataattggaagttggtcgtcgaaccaatggactgatgttttgtagacaagttcaggaatatgagataaaggaacatcgatcagctttcgcaaaggagactctttgaacaacttcagccatggaaattgtactccggaaatcgctctcccaaagttatcgagaaatcgcaatagttgaacctccaactcaaacgcatattttttctataaccaaacagaacaaacaaaatatgatagtttttatttagcaaaaaaaaatgaattttgatttatggattatccatctagatgagagttacacatcgcatgcatcgactgacttaccgatcatttcgaggaggtaagccgcaagatctgaaggatcgatagacactataggcttcatctctttctttgggttttgactttttactttccttcgccttcagattttcattcctcacctccacattagcatttttctcctcaaatgaacggaaaacgtcctcaccggtaggttggtttccactggccgcctgatccgctggttttcgcttccgaatgctcttcgaggacacgactttcttccatccatggtcgtcgacgtgggagttacatttagaagtctcacatacattgtactcgatcggttccattaccttttctaaagtctctcacttttttcgttgttttttgatatttgttatcactctctctagcctctagcatacttaaaccaaagtggacgacgtgattttatcgaaggaagaagggtttttcataactttgtgacataaacgttattagggttattctttatctttttattattagatttgaatatttttgcttgtaaccacttatttcattaaaatctgcatcttttaacatttatctttttcagataattataaaaaaaaattcaagaaagttatttaaaattaaatccctttgacataattacaagaaagttaaactagaccatatgttttaaaattgaatacctttcacataattacctttaaactacataattagaaaaaaagtttttagcttatttgtcaatcaaagatcatttaaaagcggtttgccaaaaaaaaaaaaaaaaaaaaaaaaaaaaaaaaagatcatttaaaagctacataagcccacaccatctacaaatacaaactatgattaatgaaaaacttatacaataccttattcttgtaaatatattttaaatctttaccaaatcacaataattctatttgcacaccgcgaaaatatctgaaaggcttgcttccattaatcggtaataattaataatttttaaaagtcgaatcccatatttagtgtagaaatattgttattattatttttgaatactgtgagaattttagattaattcataaatatttacagctagcgtgtgtaacaaaaacaataaaattgagagtgaataaatatataaaaccgggaaagattaaaaacaataaaagccaagaggagagtgacgtgaatgaatgaatggggacatggtactgaaggccacgcgcaatggaacggtccacactctctcctcctcacctttatattcaccaaatgggatcgtctttctcattaattcgtcttctttcttcttcttcctctcttcaccacttctctcttctttctaattaagttgttctcaccagtcaccaccattgatcttcctaggttttctttttgtttccgtcacatactcgatcaattataattatatattcggctgcgaagatttacaaggtaaacttaatatatcaacaaagggatttcaagcacatattagtataatacttacttatacgtatgtgtgtgctattttttctttttgttacgtatgtgtgttctctggacttcgagtatggatcatttgtaacttttgagcatcactaatttctcttttttgatcatgtttttaaaaaaaatatatatttttgctggttaatatatgtatgtagcttttcctacatattgagatcaaacgttaaatcgattctggattcatctttgaaaaatgtttaaagatcaggaacgtcaaaatcagtgtaaatcttctgtcgttatgtcataacaaagaaattaaacatggggttttatgaatctctaggtttgcatcgtcccctatatagatatattttttggatgaacaagctttttttgtttgtatactgctagggttatcctagcctttagtatatttatgattataataaattgatttcaatttaaaaaaaaagaaaaaaaaagagttttgagaagaacgccgttcttgatgatcattgccgccatttactaacattaatgtacaacagaacagcatcattataactccccatgtccgtttgttatgatcgcatctcatcttgatttcttcaactcaaaacctaaatttcatacatgtaaatatcattttacgtatgtatgcatgtatataaattaataaaaatatgtaacttattgatcataattatgcatgttatgagagagtttaaatggtgagcaagtgggaattcaccacgaaatgagttttatatatgcttatatctcataacattttgtcaactatctctcgagtactttataaatgattttgttagatagcactctatgaatgataattatatatttttcttcttattcttcttatttgtcttcacaaaatttagcttatgtttttcattatagctctaatatgtcgccttccactatcccatgttatcatttgagatcttctgaaatcatatgttgtgatctcaaaaattatatataagtatagacgaaaataagagaatatttccgtacatgtatatttatattattgttcattttggtgtttcattttgttggtgtagaaataatg

SEQ ID NO: 13012 - DNA, 3000 bp, Unknown
  misc_feature (1)..( 3000): cDNA_ID_2710260_gDNA_ID_2214589_Annot_ID_135403 3000 nt of promoter + ATG
ccatatatttacatagaattttcaaaaattttattatcttattaatttatcgatttgtatcaatttttacactagtcccaactcggaaccagaaaaatttattaatttatagaagttattaatttatcgaatattaatttatagaggttatactgtatttctcttttatttgggttgtatttcttctttttttactgagtttgagatttaattttaataaaaattatcagtttgataaaaaaaaactaaaaatataattttctttataaactaataaaattaagtttctcattctagctaaaaggcttagcttaatattattatgaatattattcatctttcctctttcaaaaaacatatttttcatcttgattatcatcggttgcaaccaaaacgaaaggctaagtttcatattcattttactcccaaaccaaaacaaatagaggtaaataaatttttcgtatttcgtactggagctttaatgttaattttaccatttgttttcacccaaaaaaaaccacctgaatttcttgaacaaattcacaaggaaattaaatttgttttctgggttttaatttgtaacaaaatatcacctggttttattaaactagttccattagttaaaattaaaaattgccggtattgttttgttaaatattttattttgataaaatcctctgatctctatcattcgaagtcaaagctgttttgttcacgtaaaactgcatgtgtgatcctatatattgtatattgataaatacgtttaacaatgacaatctagtgagatagctcatgtcacatcgacctatgatcaatggattacttcagtttgataatatgtttgtatgtgatcacgaattatatattatataccaatcgatttttcattgttttatgtactataatttgatttcagctcactacatataatatttaaacgtgacatgttcatcttttttcgtcgtcgatcgacatatcaactataagattagtcggttgtacgtataaatcttgaccttttaccatggatttgtcctataaaagcttactagagactagagaccagaacgcattaatattattaggtctatcttctatcacttcatagtgtttctttaacactcatgttttgcaagtgtcgttttgtactattggaaaagattattgttataaaaaaaaaaatgaaacaaaactctaaaaaatcagttaatcttagttataaaacattatcctgctagaaatcattgcaactttaataaagtattgagtcttgaatcgttatgtccacttcgtttattttatataaaagtttgtcaactaattaatagctgattttttttttcttttaagagaaagaagatctcgaaatgagaattaaagataagatatatggttaggtagcgagtagaagaccaaagcaagaaactacgaccacgacatcttgcacataagaaaaaaaaaaagtagttcaatttcattttcgctttggtccactttattatttaacaaaaaataatatctaataaattacattaatataacagtccgtgttagactaagacacgaagcctcccccactaaatcgacgcaaataaaaataaacaaatggtggggttaagagtttaattcgagctgtggaatttttttataaatatacaaaaataataatatttaaaataatatatattacgataacaaatttttatgtcaatcaattatattttaagaatcttctaaaatcaaatattattgaactaataatttgaataataattttaattccactattattgaaaatattcatatcattagtttttaagggtgtatagtgaaaaaattcctcaatttcaaatatgttaatacaaatttccctttttaaaaattatcatgaaattggacaaactatatttatattgaaaaagatatataaacttatacaacacaaattgtaaacaaaaataacatgatgttcttcaataaaattataaatcatcaaacctaaactctaaaattgtcaaagtaaaaaacctaaattgacgaattctaatttattatagcgaaattctctgatgtttgtatgatgtcgaagttgattatgagagattttgtaaaattttgtgttttaattttaaccatagtttatctaatttttacgacaatgtagaaagacaggattaagatatttgaaaaattgaagtttttttttataaaatatataattgaataatttcttatagaattttagaaaaaaattttagataaaattaaaaaacacaaatgtaattcttttatgtagaatttggggaaccagactacaacaaatcataaatttctctaaatttacctaaaatcatattaaaaattaataaatcattatgaatcttaaattacttaaaatataaatttgaaaatactcctctaactcagagatcaattttttctaatgcctcgtgatttttttgcatcttgtagcttagtcacctatatatatttttagtggtaacaagattctctgttaaaaaaataataaaaattaaaaataataatagtttattttatgggaaaagacgcgagtggctcccaccagcctcaactttgcccacgtggaaccagccatatgcgcggcgtttagacaacaaaaaaaaagcgtgttgtttctttctctctctagaaagtcaaaaaaaggagacagacaaccaaacactgccttgtcacatctctctctctcttgcttttggcgagtaacgagtaagtccattttccatgtgcccactgtgtcttctctccttacacgccaccatctcctccacctcctcctccctcccttctccaattcccaattctcctccaaaccctagggttagggtttccacgattgcttcaccttcccttctttttttaaaacctcagatcttccgcttcctcgttcttgtctttttgttgagctgagaagcaaaaaaaaagtgttctttggcttcacgaggagccaacaacgaatcg

SEQ ID NO: 13013 - DNA, 3000 bp, Unknown
  misc_feature (1)..( 3000): cDNA_ID_2710264_gDNA_ID_2214589_Annot_ID_135404 3000 nt of promoter + ATG
gcttgtgttaagcgtactgaagcattcttcagatcgagatctaaatggaattgtggtaagttgttcaatttttatctgttttctcttctttgagatggttcatagtgatgaggatggttttttggtttcaggttggcacatatgtactacttgtcaaaaggattcgttctacatgtgttatacttgtccgtattcagtttgtaagaggtgtgttagaagctcagagtatgtagttgtaagggagaacaaaggattctgtggaatttgtatgaagactataatgcttattgagaatgcagctgaagctaacaaagaaaaggtatgagaatcctgtctacattttgttactttctcttactcgcagtactacaaggttatttgtggaacttgaggtctgttcttgtaatgtcgctttgtttttttaatgtggattctttcttctagctaaatgtattacatgtacattttctaggttcaggttgattttgatgatcaaggcagctgggagtatctttttaagatttactgggtttctcttaaagaaaagctaggtttatcgttagatgatcttaccaaagcaaaaaatccatggaaatcttcttcttctactgccgctaagcgaagaactactagtcgggttcatgaaaaggatgatggaaattctcctggggttatgaaaatacgtcgtgctaaagtaaggaaaatggatgctgtttctgtgagtaatttgggtccttctttggattcaaactgttctttgggtgacagacttccacaattgactagtgctgctacttgggcaaccaatgagcttttggactttgtggggtatatgaaaaacggtgatatttctgtcttatcaaagtatgatgtccaaactctcgtgctagagtatgtgagacggaataatctacaaaactctcctcagaattctgaaataatgtgtgactccaagcttatgagattgtttggaaaggagcgagtggacaacttggaaatgttaaagcttcttgattctcacttcatcgatcaagttaggtctccagtcacagataattcagccggaggagtcactgaaactatgtcttaccaggttaatgcgggcagaagctgtgataggttaaatacatctgaacagcatcaagaaggggaatcacagcaattgaacgggcacagtattcaagttagaccttccagttctgatagcagaaaccatgcagttgtaaaacctgacacaagtgccactctgtccaataagccaattgatggtttggatacaaatatggtatggttatatggagatccagatgggaagattcatggaccattttcgttatataacctgcgacaatggaattcaagcgggcatttcccaccagagctgagaatatggaggttgggtgaacagcaacacagctccatacttttgactgacgcattaaatgggcagttccataaaacagggttattacagaatcattctatccccaagcaggaagtgacagctactatagctaacgatcaaaacaggtctgtggctgttcctaaaatagagagtagaatacttgacttcagccccaactcagtgtgcactgaccagagtgttatttctagcagtaacagtgtcatcacaaggagctcggatgtgagtaacaaaagcggaaacaattgtagccacgccgtgccattggatttttctctttctaatgaaagggatactgtgggttttatctctctctgggacaaaagaaaagttgaaagttctttgcttgtacaaagcccaataagctgttcactctcgctggctacattacctagaaactcaaactgctctctgccaccacatgaaagatggagtgctggtcagacagatggaaacagtgcagcaacgactgcttgcaatcaaaacggtagtcttagcggctcagctgagaaacaagtcacggctacagtccagtcatgtggacagaactggaatgctgcaactccaagcagtgcttcaaatgtgtgggattcgaactcgggtttgacgtctttcccagacaatcaagaaatagactttttagatctctttagtccaactttcaaattcaactttgcatctactaccactgattggcaacccattgtggctggacctgacgaatgcgacgaatcagtctcagatcttttggcagaagtggaagccatggagtcccaaaaacgtcttccttctccaacttcgacattccgtggtcctgaagaattattaatccggcactcaataaacgatagcttcagtcccgcagaaggacatagcccagcactagatgtaagcaaaggtgactccatgagctccacaaacgatcttcaaatgcattcacgatctaacagcaccgtgcatttttagtcgtgggctcgggttcacatagagagaaatcataacctggggcacaggttaccatagatcatccaatgtcctagattcgtctgatcgatggtggactatgccctctttcttctctttttttttgcaggattattacagaacataaataaatggcagaatcatcagcaaaaatgaaaaaaaacgagtggtgcatatgtagaagatgtttcttcgcggtatttttgactgcacccattgttttcttcagtatttaggttttgtaacgttgtcctgtgttaagatttgcacagacatacccaacttctgtatcttttttttttacattgtttgtacttaggaacaagtataaaaatgggaagaaattgttgtccatggatgtaatcaaaacatttgtagggatcatatcatcttattattctatatatatgataatgatagtgtaacgtttcattctttttgttttgaatgtttcaaatctatttatatcatgacaagtgtaggctccagtttattctacttgtttttggaaaatgagacgaactctattgatcgtttctggatttggaaactttttgttgtttcttcgatttcgtttttgttgatctgagttg

SEQ ID NO: 13014 - DNA, 3000 bp, Unknown; identical to SEQ ID NO: 13012
  misc_feature (1)..( 3000): cDNA_ID_3027601_gDNA_ID_2214589_Annot_ID_186737 3000 nt of promoter + ATG

SEQ ID NO: 13015 - DNA, 3000 bp, Unknown; identical to SEQ ID NO: 13011
  misc_feature (1)..( 3000): cDNA_ID_2710254_gDNA_ID_2214589_Annot_ID_186734 3000 nt of promoter + ATG

SEQ ID NO: 13016 - DNA, 3000 bp, Unknown; identical to SEQ ID NO: 13010
  misc_feature (1)..( 3000): cDNA_ID_4255088_gDNA_ID_2214589_Annot_ID_186729 3000 nt of promoter + ATG

SEQ ID NO: 13017 - DNA, 3000 bp, Unknown; identical to SEQ ID NO: 13009
  misc_feature (1)..( 3000): cDNA_ID_1977060_gDNA_ID_2214589_Annot_ID_186725 3000 nt of promoter + ATG

SEQ ID NO: 13018 - DNA, 3000 bp, Unknown; identical to SEQ ID NO: 13008
  misc_feature (1)..( 3000): cDNA_ID_2710240_gDNA_ID_2214589_Annot_ID_186724 3000 nt of promoter + ATG

SEQ ID NO: 13019 - DNA, 3000 bp, Unknown
  misc_feature (1)..( 3000): cDNA_ID_3027620_gDNA_ID_2214589_Annot_ID_186723 3000 nt of promoter + ATG
cgtccgtccgtccgtcgctgtggtttccgaggagagtgggtgagagagatggaaggtagagacgaagacaaattacagagaaatgggaacggaccacctgctttgcttttgttgctcctttactttttttttttcttttgattttttgcttttttcctcttctcttttttagtataatatattcttatgcaaaatatcataggagtatattttattttggaaaaacactgtactaaatggcataaaaaatgttaattagaaattagtaatgttagattacaaatttctttttcagacttttgttcatacctttttatttatttttattattaatgacaacctagctaattgtcatttactttttcaaagattatgacaaaaaccatttaacaatcttaactaatggagttataaacacaccttaaaatgttctgtagaaaatgttataacgagactgtaaactgtttgttaaataattcaccactggggatttatattttatagattaataaaaaaaaactctcaaaagccaaaagaaaaaagaaagtaacagtgagtaacactcagtgaccaccagacaatgacgttgaagcgaccggacctcctaatcccatcttctttcccaaaagtccaagctgctccaccaactcacctccgttaagaatctcagtggctccataaataacgtttttaacggttaactgtctctgagtcaactcctgcaaacttccatactcaacatagttacctccaccgatcatgaacactatagcttctctgaacggtccttttacatggctaccaccggagctagacgactttggagctcttgggtccaggaagcggtaagaatcgatctccgggtttggttttccttctgttaaagcttcgactgttcgagtcactgccaattgttgatcactagataacagattcttgactcctgcagtcactgcgcttatagactgtccgtaaagcttctcggcccagtctacaatgttgcttctgctagctgaattcgctgatgtagctgcaaaagatgcgtttaacgatttgattttctttacatactgaaacgcacttgtatcagcctcagcttcattcaatgctgcctccactgcttcaacttccgattggtttatggtttctgtggagatcaggtacatgattgcaaaccggagcttgtccatctttgtccctttgcctttcagagcagccataagttcagttctgtcgattccgcccctcatcatcatgtcgctttctttcttagtgaaagcgtcaatagatctctccttgatctgtcctaagagcgctgttgcgatattggtgtgtttgtcaatcactttctttcgctcagttaactccgggagcgatttcacagtgttcatgagatgctcggtgtggatgtttccaatcagatctgtcccatcaaactcagcgccgctcccacctccggttttcttgttaacctcttcaacgtctctcttgtacttgttcaactgtgtttcgatctccacagcgacatctggaaactccagagtactgtttgctgaccagaatgggtccgaactgtccagctcaaacgatttcggtggtcctttctctccctgcactttcaattggttgagctttaacccgagaacatcgtgaacgagaggccggtatctgaaatcatgctgaatcccaaccgagagctcaaagttcctatcaaatatgcacaagaggggacgctgaaacgagctcatgaaaccgccaccttcagtaaacagattgttcttggacaaaagatgatccctcagtttctgatccaacaaagacgccaccatctctgcaggtccaccactagggcatcggataacaggaaccacaccaagcgttaccaacacacaaaacaaaccactagcgaccctttcgataatctcattaatctctttctcccctgctgatgggtcattcatttgaacataggtagattgctgagccagcgagaacaagttatcttccaaagtcacaaactccagatactgatcatgcactttcgagactttctcaacagaaccagatttaagagtcccagaagctagctcttcaagaaacttacgagggatcgaagacgagaaattcagatgaaaggtatcgtagagagatctagaagcatcggctatgatcctctggaggttggattcagttggttgaacaaagtagacagcgggaacatcatgaacaggttgtcgatctttgtctatgagaaagaagagtgtaactccatgcttacgcagatccttgacatgggtcaatggagatagaatgttctgacaaaacctatcgtaaatcaagatcttgtaaacttcttcgttcgcagttccacttggattcaaaggttggttcagattcaacatccggattacacattctgaaaccgagagagagagagatcaaagatccaatatcaatattaactcataagaaaccagaattctctaaatttccagattcctaaaaacaaattaatagatcgaacacaatctatgaagcaatagaagaatcatcgcagaaacttgagattataaagagataattaccagtctgtttctgacggagattgagagccatggaagcttgagattcggttggattagagagaaaccttgtcaattcaaagctattcctttctgtatctccctttgcaaaacgcagatccaacgatgaaaagcagtagaaacaaagagatctaaatccaaaatcgatctagagaaatttcaaacccaaaaatcactgatgaagatgtatgtcagtaagtaacgattgccacctgcgaagagaaggacgaaagagattttctctgaagaaattaatgggcctaatgggcctagtcacttcacaacaaatgtggcccagctttagctttcttcaactttctctttctttctcctctctgaacgaaaaagagtgagtcgtcgtcgccggagactggagtttttccgggaagaagaaatg

SEQ ID NO: 13020 - DNA, 3000 bp, Unknown
  misc_feature (1)..( 3000): cDNA_ID_2686045_gDNA_ID_2214589_Annot_ID_186719 3000 nt of promoter + ATG
ttttattttggaattgggttatatggtagatgtattttaatcaatatttagaatatttataaaattttattaatatgttgttttgataagagttaaaaacttcagttttttaacaattgtctaatgtattcgtggtatagtgttacttaataacaattataaactgtaaaatataaatattttataaaaataaaattagcaagttttaatatatattacctttaaaaaataaatcgtcccgcgttatatcgcgggttaaaatctagtcgatttatatttacaagatcttaggttgaaaataacatacaaactaccttcgtctataaattaaatataaattggcataatatctggaaaatttcttacaatcaagtcatgacgattgacgaatattgaaagctcaaacactaatgttgtacgttgatgaactaattaaaaattcaataaatgctctaaacatataaacagtgtaacgtaaggtgtaaatagcgaataacatatgacagactgaatataaggctcggatcgtagaggggaccatgttccaaacccaattttcccccattaatttccgggaaaccaaaataataaaagctaattataaacgttttcatgaaattagggcaaaagtacaaactgaaactaatgatgccctaaatgaaaatgaaatctctgcaataaagaagagtggctttaggggccacgtagacattagttacaaaagctctgcgtcttttagccctctgcctcttcaacagtactttacgacaatgaaaaagatcgtgatgcgtaaattaagatcccctgtttctcactgcatgctcgttaccgtacgtactcataggagtttataaatcaaagggcctatagagagtattctaagtagcaaccactacgtaaagttttaccaaaaaaaaaaaccagtatgtaaatgtgaccatatgttcatgtagttgcttgtgtacatctttttttttttttttaacttcaaactttatgctttattatagtgaagaagtataatcctcatggagtgtacatctatatatacactgcatacgcatgtagagtaacaagacattctttgtttcttgtcaaaagacattcacaatccaactagagatatgattttatcatttgttagttagtttatagtttggtgacttggtgtaatctcctagttggataaaaatattggaccgttgattcgatagaaatgccaaacgacattacaaatcggatatatcgattggatggaatccaaaagtttatccaatataatcgactaaagttaaaaaatgagtaatccaccagtctaactaaatactttctttaccaacaaaaatttgggatacaactgagtttatttaggtgataaaagattataagacttaaccttttaacaaaaaaaattttttaagacttcaatccttagattgttttccaaatattaatagttacaatagttagtttgtaaaacctatttttaattttccgatactctttgcacgttgtgttgaatccgagaaatcatgggggctatataaacaaaactatactatgaaatagccaagcaacttcagtgatcggatctttggttttttattttaaaaaaaataaatattttatcagccgtatcttcagggccattccccataaaaactataatagcttctatgaaatttgtagattcctaaaaaaatctttatatatcttttatatacaatatgtggctgttacgtagaacaataagactatacaaaagttgggtattgttccttttcaattacaaaagtcatattcactaaaacaaagcccttcaaactttttaaaaaaaatgaataaatcacgcatttatacaaaaagatccatccatgctcctataaattcgagcatataattaactaaagaatactcaacatgttcataagtacacctgtcttcacactcgtttcacacattgtaattgacataaattttaatatcttttaaagcaaagcataagtaaaattatatagagtatttcttcaacacatttccggacgatatcaccacgaaaaatatcctatatcacctatgtgtcatgactcatgaccataaggaaggaaaaatgtatttttatgatcaaacggttttcactttttttattattcattctagaaaaaaattataatcgttttctttcattcctacgatacaataattcataacgatcttttagaatttttgttttgttttctgtgtgtatgggtaaatatctttcatacgtagacagatacataacaattaaagctggtgaagtaataattgtgaagagacagagaaattgaaaaaagagagtttgtttttcgtctaagtaaataccgatgatgccctcacctttctaattccctcctttgtccctttccattttcatgtttatttctaacttctctgtccctttcaatccttctccaccagatatcctctgattcgatcccccacaaattttttcataaaaattattattattctcactaaaactctcaagagtagtttcgatttttcctctgaataaaaaaaaatcaaataatatatttgacaagagaatttccttcctaaacataacattttatttgaatgttaattcaattgattatttttctttcttatatccttttctttggcaaaatttatttcttatatccaagcacatttttcaatagggttttgtatgtatgaaatcatatctacatgcataaaagaataatatagtgaataactgattttctagaatattgtaaaaccttctttttgggtccccatttatatatataactcaataccttactatctctctatatatatataatcttctctctcacacaaaacctaaaatctctttactaccagcaagttgttttcttgctaacttcaaacttctctttctcttgttcctctctaagtcttgatcttatttaccgttaactttgtgaacaaaagtcgaatcaaacacacatg

SEQ ID NO: 13021 - DNA, 3000 bp, Unknown; identical to SEQ ID NO: 13007
  misc_feature (1)..( 3000): cDNA_ID_3027627_gDNA_ID_2214589_Annot_ID_186717 3000 nt of promoter + ATG

SEQ ID NO: 13022 - DNA, 479 bp, Unknown
  misc_feature (1)..( 479): cDNA_ID_2709642_gDNA_ID_2214590_Annot_ID_135405 3000 nt of promoter + ATG
aagttataaaccacagaaagaagtcaactaagaatctaccagaaaaaaaggaatttctttaaataagatgactgtctttctatgaatgaaaacagctttggtcacacataagataggaaactatttctagatagtttcatgccaagtttgtcactaaattggtcaaaatatattggcaagtttaacattttcgcataagataataacatatacttatatttttttaagaactaatttgccaatcaaaagtagcaataaagtgaagaaaaaaagtctaataaagtgtagaaattaatcaaattttaagtcctaaagttggaaaaatggtaaagaagcactcaaaaaaaaaaaaaaaaattgtgtatgtgtgggccgaatttgagaaaccagtgacaccaataaaaacctcatctttcaatctcacacaagtatttgtgcctactcatttcctccaaacgtcaaacatagcagcagccatg

SEQ ID NO: 13023 - DNA, 3000 bp, Unknown
  misc_feature (1)..( 3000): cDNA_ID_3027649_gDNA_ID_2214590_Annot_ID_135409 3000 nt of promoter + ATG
attaaaggcggtggtcttggctgaggtgtgttgcagggcggtgattgcagagatatagcttttgatgtgactgagggtcgaggatggggagttgaattgatttctgtgtttgattgttttgctggtggttgagatactggttttggctgaggcgttttgctgcgtggttgatgtaaaggacgggcttctgttgtgactgagggtcgaggaagggcggttgaattgatgatatccgtcttggattgtactgctggttgctgagatattggttttggctgaggagccttgcagcttgattgatgtaaaggaggggcttctgctgtgactaagggtcgaggaagggcggttgaattgatatctgtgttggcttgtactaaagctttctgaggtattggtcttggctgaggcgtgttgctgtgtggttgatgtaacagacgagcttctgctgtgattgagggtcgaggaagggcggttgaagtgatatttgtgttggattgtgctaatgcttgttgtggtattggtcttggctgagacgtgttgctgtgtggttgatgtaaaggacgagcttctgctgtaacagagggtcgaggaagggcggttgattgcatctgtgtgtttgattctactgctgcttgctgagatattggacttggttgaggagtgttgcagtgcgggagaggagctgaaagatttggaggtgtagcttccgctgctgtgactgagggtcgaggaggagcagttgaattcataggttcagctgctgtgactgagggtcgaggaggagcagccgaattcataggttcagctgctgtgactgagggtcgaggaggagcagttgaattcatatgcctgttagtttgcactgcttgctgctgctgcgttgaatgttgagagctcctgggtgctaaaaaaagggaagagaattagtgtcgctgtttagctcatttgctttatccaattatactcttcaactttacctcttacggtagcagtatcagtggctgcactcttcactggacaagtagacttgtaagcattcgccaagagactgttcataacaaccaaactccttaacgcttcattcttcttcgcttgagcgttatacgcagcatctacctcttgggatttcctatcatactcactgcgtgcttccgccatcttcctctcgagttcagccttcaactctaatgtctgcttacaaacaacgagacaatgagcagagaggacaggaaaccgaataaagatagattaaccaagaattagaaaaagactaaccgtctcttcaaagcttttcagtaaggtcccttgttctctgctcagcttctccagctcgtggtcacatatgtcactgaacgaagataaatgtaaccgaggactctgtcccatatgattgttgggaagagacgtaaccgctgatgcattgactgttaatctgctatgtaagacgttaggaggctgaacaccaccttcaacgacatcctctgaatggttaactacacaacgatcacaacatacaaaaatcttaacattctagcacaccaactataattaaagcatagcgatcactatcaatgggcagatcctgacctaaaggagtcgatgtagaagtccaatgctccgctgctgttgtgatattttggacgggaactgacgaagatggtggacaacccgtaccttgagctctctgtagacgaaaaatctaattcgtaagcacaataaacgatctgaaaccaacaaagagtaacagtcgttttcaagaagcagcaagtaacctgatctgatctagcagaaccttgaatatctaatatagaggcatggtctggaaaacgactcgaaaactcttgaaccaaaatggcatcagcatcatgacttgttctattactttcttctctaatcaacggcgcttcctctacattcaaaggtaactctaaggaagcagctccggaaactgaaaccggtggcatcactgtgtcacaaaccatatcttcagtcaaaacctcaggtatatttgctgaagacaccattccaggcccatctagttgagtactacccgatttactctgcgcttttggtaaagaatctgtaacttcttgagtttccattggaaccataacatcaaattgctttcaccagtgaagaggtttagctacacatcataacatatctcagtctattagagaaaacaaaaccaagctattcaaatttacaatctttgaagaacacaaacacactaatcaccgagaagttgaaaatgagagtgacactttaacaatcatagtagcaaaacatagaatcaacgaaattaaaaccatattatatataaaaatcgtaactttattcccaaatttcatatatgctagattgtgaagaaccatttttttcaattcgattttgaaataaaaaagatccgtgaaaataaaattgcgagttattgtttgagaattgaaagagaagaaaacccagaaccgaaaatagacttaaccctaccttaaaatgaagaaacaaatgtcggattcaaggttcttcttcctcgtctacgtgaagtccaggttaagaacagttaatagaatcaagagacatggagtatttaattaagctgtgttgggccacatttattaagctgttttgggccttcggcccatacctcaatttcgattgggtttgttgatataacatatacatatgttttttttattttttgttgtgtcagtttcgaacagtgtttgttttgtcattctccctcaacaacaatgcccgtcaagtggtaagctttgatccaatttcgttttccaaaatctcgatttttttcgtttctgttctgattactcttccgattcttgtatttgggttttgtttttttctagggttttacattggcaaccaaaccaaggatcaacagtaagcagccaaatcctaaacgaagcaacacaatgtgtagagagcatcaatggtgtgaaagaaggaagatggaaagcaacactcaactattacaaacccatg

SEQ ID NO: 13024 - DNA, 3000 bp, Unknown
  misc_feature (1)..( 3000): cDNA_ID_2710285_gDNA_ID_2214590_Annot_ID_135410 3000 nt of promoter + ATG
ccttcgaaatcttcaaccttcagagaacaaagatgcaatggaaactcttgtcattacgagattatctacgcggacaaaacctattccaagggaatcttggcaaccgagacggtcacgataccttccacttcaggagagccctttgtgatggctgaaacaaaaattggttgtggcctcgacaacacaaacctccagtactcagggtttgcatcgagttcttccggcattgttggtctaaatatgggacctttgtcgcttatatctcagatggacttaccctacccaggtcttatctcttactgcttttctggtcaaggaactagtaagatcaattttggaacaaatgccattgtggcaggagatggaacggtagcagccgatatgtttatcaagaaagataatcctttctattatctaaacctagacgcggtcagcgttgaggacaacctgattgcgacattggggacaccgtttcatgccgaagacgggaacatttttatagactcaggaaccactctcacgtactttccaatgagctactgcaacctagtgagggaggcagtggaacaggttgtgacagcagttaaagtacctgacatgggcagtgacaacttgctttgctactactcggacaccatagatatctttcccgtgatcacaatgcatttttctggcggtgcggatcttgtcttggataagtataatatgtatctcgaaacgattaccggaggaatcttttgtttggctattgggtgtaatgatccgtcaatgcctgctgtctttgggaacagagcgcagaacaattttttggtgggttatgatccttcttcaaatgtgatttctttcagtcccactaattgttctgctttgtggagttgaagaaacaaaccaagagattctcttttctacattttcatggttttaacttcagttttgtttcgatttatttgtactgtcactaaaagcatatgacatagacatgtttaaatgaaaaaatatgcgaatgagttacacaattaatcgaaattcaaatcacaatctgctataatctcaagttttttctggagtttgcaacttgttctatcaaagtcttttataagttcattttttctcaatgcttcttatagataaacatgaccaaagaaagaaatcactaatattgcaaagcacataattttacctagaaatactaagttatgttttggtttagcctctcacagcttgaacggtagcaatcatgtgagccatcacgagagcgtaacgaacagctgtgtgttgtggagtgtagatgtctccaagtccaaactccccaaagttgagatctatgttcacaaacttacccggcaacgaccttttagccagagcttcattccatatctccaagaactcctccatcaccttttgtgccttttccattgatgatataggaagatactccacctgcaagtaacaacacacaaactcaaaattgagattacaagaaacaagacaatcaccaaaagggaacagctccatataccctttaggtgattagattagcattgagactatagggatttaagaaaacaaggattttttcatcatcattgtgattacacgaaacaagactaaagaaacttgtagatgcatagtcaacaatcaacaatgttcaattttcatcatctgtcttaacatcataaacagcatcaaggatcatcactaaaagatattacaagaaactcttttaacaagaaaaatctgtagaaaaacaagattttcatctttaaaattaatcaccactgttcagtgttcatcatatctgtcttaaacaagaaaaagctggaaactttgtttacctccatgacaatgcctctaacattctcagaatgagtaggaacaactttaccaactctcaacctaaaatcaccaagctgatactgaaacccatcaaagtaaagagccactttagatttataagactgaagcttctccataatcaactgaatcgaagaatcagcttccaagacaatcctctgcgtcctgataatgaaatagtacttattcggctgatccgcaagtgaaatccctagaaaatcacgaggaaactccaattgattcgcttggtcttttaacatgggtttgtaatagttgagtgttgctttccatcttccttctttcacaccattgatgctctctacacattgtgttgcttcgtttaggatttggctgcttactgttgatccttggtttggttgccaatgtaaaaccctagaaaaaaacaaaacccaaatacaagaatcggaagagtaatcagaacagaaacgaaaaaaatcgagattttggaaaacgaaattggatcaaagcttaccacttgacgggcattgttgttgagggagaatgacaaaacaaacactgttcgaaactgacacaacaaaaaataaaaaaaacatatgtatatgttatatcaacaaacccaatcgaaattgaggtatgggccgaaggcccaaaacagcttaataaatgtggcccaacacagcttaattaaatactccatgtctcttgattctattaactgttcttaacctggacttcacgtagacgaggaagaagaaccttgaatccgacatttgtttcttcattttaaggtagggttaagtctattttcggttctgggttttcttctctttcaattctcaaacaataactcgcaattttattttcacggatcttttttatttcaaaatcgaattgaaaaaaatggttcttcacaatctagcatatatgaaatttgggaataaagttacgatttttatatataatatggttttaatttcgttgattctatgttttgctactatgattgttaaagtgtcactctcattttcaacttctcggtgattagtgtgtttgtgttcttcaaagattgtaaatttgaatagcttggttttgttttctctaatagactgagatatgttatgatgtgtagctaaacctcttcactggtgaaagcaatttgatgtt

SEQ ID NO: 13025 - DNA, 3000 bp, Unknown
  misc_feature (1)..( 3000): cDNA_ID_2710289_gDNA_ID_2214590_Annot_ID_135411 3000 nt of promoter + ATG
tgaacctatgaattcaactgctcctcctcgaccctcagtcacagcagcggaagctacacctccaaatctttcagctcctctcccgcactgcaacactcctcaaccaagtccaatatctcagcaagcagcagtagaatcaaacacacagatgcaatcaaccgcccttcctcgaccctctgttacagcagaagctcgtcctttacatcaaccacacagcaacacgtctcagccaagaccaataccacaacaagcattagcacaatccaacacaaatatcacttcaaccgcccttcctcgaccctcaatcacagcagaagctcgtctgttacatcaaccacacagcaacacgcctcagccaagaccaatacctcagaaagctttagtacaagccaacacagatatcaattcaaccgcccttcctcgacccttagtcacagcagaagcccctcctttacatcaatcaagctgcaaggctcctcagccaaaaccaatatctcagcaaccagcagtacaatccaagacggatatcatcaattcaaccgcccttcctcgaccctcagtcacaacagaagcccgtcctttacatcaaccacgcagcaaaacgcctcagccaaaaccagtatctcaaccaccagcaaaacaatcaaacacagaaatcaattcaactccccatcctcgaccctcagtcacatcaaaagctatatctctgcaatcaccgccctgcaacacacctcagccaagaccaccgcctttaatctccaaccatactccaacttcttatcaaccagcttctgctccaccagtgcatggtatagcgcgaaggaccatggcacctcatttaagatcatctcgagctcccaactctgctgctgcaccatcaacatatccaaggttggctcaagaacaacaaaagcaacaacaaaagaagtcaaacagtagcttggtctatctctcagatgacgactagtgacaaatctttgggagtatataacatcagtatatagtttttgaagtttctcttaagggaatatataagttcgagaggccctttaaaacatttgagaatgccttgtacgaaggatcatttcgaatactaattttttggagaatatcaagtaagttaactaaaatatttttcacaaatttgcagtttaatcaaaatttatttacataattctgttatttttactctataggaattttcaaaatactttttttctccttacttcgagttttgaaaatatttttcatgcagcgaatctctgatatcaatttagcgccacgtggcacgtgacataccccgatctctaataaatgaactctttttaaaatcgcccccctcgatacatcagttcactagtttagtgactccactcgaccacaaacgctaacgcaaacgcagtcgcgtggactcctctgtttatttcgcgttttagatttcttaattctcattctgatttgactgtggaaagggattcgtttctccttcaaggaaaaagttttatctttgctggaaactcaactacaaacgcggttttgctccatttcgcgtttgcgttttagctccaatgctggtactctctgttctactataagctgtagcaagctccaaatcctcaaaaatcgacattgttgcttcttcatattaaggtgggtttctcattaaatatgcgttttcaattcatttccctacatgtatgaagaaatcatgaaatggggttccccaaaaacttcaccttttacttggagagagcatcattgaatttgtgggacatgattctttccatcaaaaagttagattttttcggtcaatggtggaggaaacaggtcctacaatcgaaaaccggttttttaaaccggtttccgacaaccgacaccgggaattgtgagtcccacaatcaaaaaccgggttttaaaccggttcctgacaaccgacaccggaaattctgggtcctaacaaatttcaacagtttgcttcgaccaacgttttgcttttccttaaaagcaaagtcctttttggctctatctaatttggtttgtctataattttggatcaagaatctacaatgtcaagttcataaagaaagagtcatgtgagctaagttacagtatcatcatatagttcttgttaagattcacaaaatctaatatttatcaattttggtaaagtttaagatgttttgattataatataaagattttgccattagtaaacagtttaaagttaagagcttttcaatgattctgcctctttgattactataatggttgaaaggtcactctcagatttgcaatgcccgtttctttctattggtggttggtctgttttcattccatttattattgtatttgccattctttgactaatcctatactcaatcatttctttaatcacattattttagtaatcaatatccttcaagatgctccattacttctttttaatatcctcttgtctgcaacttccttttcttgactctgtagttcttacttcaacttcaccactttgcagggtaatgtaatctatattagctctcttgtttggttcttttagtgttttggttgttgtgttatgatgtttgttgtctgtatgtgaaaacatagccaactaactttagagggaactaaagattttgcagaatcagatgagtgacaatggatctttaaatgattgatgtggaccgtatatctatcgctatgagtttcttgttttctcttctaactctgggcccttttaagaattggagactcttgaccaaatcatagaatgtttttggttcatagtgggtgtaacagagttagaatcttttcgatgtctgttcaccaactcattcattcacattacactgtagttttacctgtgaattctataaaaattctactctacttgtaatctggtctaatctaaacataacttgtttcaggttttagattcttgcactcttggaggttgagcttagttcgacatgaaggtctttatctaatctccactcgctggca

SEQ ID NO: 13026 - DNA, 3000 bp, Unknown
  misc_feature (1)..( 3000): cDNA_ID_3027649_gDNA_ID_2214590_Annot_ID_186760 3000 nt of promoter + ATG
aaaaatattttcaaaactcgaagtaaggagaaaaaaagtattttgaaaattcctatagagtaaaaataacagaattatgtaaataaattttgattaaactgcaaatttgtgaaaaatattttagttaacttacttgatattctccaaaaaattagtattcgaaatgatccttcgtacaaggcattctcaaatgttttaaagggcctctcgaacttatatattcccttaagagaaacttcaaaaactatatactgatgttatatactcccaaagatttgtcactagtcgtcatctgagagatagaccaagctactgtttgacttcttttgttgttgcttttgttgttcttgagccaaccttggatatgttgatggtgcagcagcagagttgggagctcgagatgatcttaaatgaggtgccatggtccttcgcgctataccatgcactggtggagcagaagctggttgataagaagttggagtatggttggagattaaaggcggtggtcttggctgaggtgtgttgcagggcggtgattgcagagatatagcttttgatgtgactgagggtcgaggatggggagttgaattgatttctgtgtttgattgttttgctggtggttgagatactggttttggctgaggcgttttgctgcgtggttgatgtaaaggacgggcttctgttgtgactgagggtcgaggaagggcggttgaattgatgatatccgtcttggattgtactgctggttgctgagatattggttttggctgaggagccttgcagcttgattgatgtaaaggaggggcttctgctgtgactaagggtcgaggaagggcggttgaattgatatctgtgttggcttgtactaaagctttctgaggtattggtcttggctgaggcgtgttgctgtgtggttgatgtaacagacgagcttctgctgtgattgagggtcgaggaagggcggttgaagtgatatttgtgttggattgtgctaatgcttgttgtggtattggtcttggctgagacgtgttgctgtgtggttgatgtaaaggacgagcttctgctgtaacagagggtcgaggaagggcggttgattgcatctgtgtgtttgattctactgctgcttgctgagatattggacttggttgaggagtgttgcagtgcgggagaggagctgaaagatttggaggtgtagcttccgctgctgtgactgagggtcgaggaggagcagttgaattcataggttcagctgctgtgactgagggtcgaggaggagcagccgaattcataggttcagctgctgtgactgagggtcgaggaggagcagttgaattcatatgcctgttagtttgcactgcttgctgctgctgcgttgaatgttgagagctcctgggtgctaaaaaaagggaagagaattagtgtcgctgtttagctcatttgctttatccaattatactcttcaactttacctcttacggtagcagtatcagtggctgcactcttcactggacaagtagacttgtaagcattcgccaagagactgttcataacaaccaaactccttaacgcttcattcttcttcgcttgagcgttatacgcagcatctacctcttgggatttcctatcatactcactgcgtgcttccgccatcttcctctcgagttcagccttcaactctaatgtctgcttacaaacaacgagacaatgagcagagaggacaggaaaccgaataaagatagattaaccaagaattagaaaaagactaaccgtctcttcaaagcttttcagtaaggtcccttgttctctgctcagcttctccagctcgtggtcacatatgtcactgaacgaagataaatgtaaccgaggactctgtcccatatgattgttgggaagagacgtaaccgctgatgcattgactgttaatctgctatgtaagacgttaggaggctgaacaccaccttcaacgacatcctctgaatggttaactacacaacgatcacaacatacaaaaatcttaacattctagcacaccaactataattaaagcatagcgatcactatcaatgggcagatcctgacctaaaggagtcgatgtagaagtccaatgctccgctgctgttgtgatattttggacgggaactgacgaagatggtggacaacccgtaccttgagctctctgtagacgaaaaatctaattcgtaagcacaataaacgatctgaaaccaacaaagagtaacagtcgttttcaagaagcagcaagtaacctgatctgatctagcagaaccttgaatatctaatatagaggcatggtctggaaaacgactcgaaaactcttgaaccaaaatggcatcagcatcatgacttgttctattactttcttctctaatcaacggcgcttcctctacattcaaaggtaactctaaggaagcagctccggaaactgaaaccggtggcatcactgtgtcacaaaccatatcttcagtcaaaacctcaggtatatttgctgaagacaccattccaggcccatctagttgagtactacccgatttactctgcgcttttggtaaagaatctgtaacttcttgagtttccattggaaccataacatcaaattgctttcaccagtgaagaggtttagctacacatcataacatatctcagtctattagagaaaacaaaaccaagctattcaaatttacaatctttgaagaacacaaacacactaatcaccgagaagttgaaaatgagagtgacactttaacaatcatagtagcaaaacatagaatcaacgaaattaaaaccatattatatataaaaatcgtaactttattcccaaatttcatatatgctagattgtgaagaaccatttttttcaattcgattttgaaataaaaaagatccgtgaaaataaaattgcgagttattgtttgagaattgaaagagaagaaaacccagaaccgaaaatagacttaaccctaccttaaaatgaagaaacaaatg

SEQ ID NO: 13027 - DNA, 3000 bp, Unknown
  misc_feature (1)..( 3000): cDNA_ID_2991219_gDNA_ID_2214590_Annot_ID_186767 3000 nt of promoter + ATG
aattgggcaagctttcaagtgtacaaagtcagagtgcgattacttcttgcacaagtcatgtttcgaccttcccggtgagatccatcacaagtctcacacaaatcaccctttgaccttgctccattctccaccgaatggcctatccacttacacgtgcgatgcgtgcggtgagtatggatctgctttcacttaccattgctcagagtgcaaataccatgttcacgtgggatgtgcgtttgtccccgagaacgtgaagcgtgaagatcacgaacacccactcactctactttacaacacaccatgcaaaggtcgtaaggacggtgtggtgttcatatgtgatgtttgcgaagtagatgtgtcggagaatctttgggtgtattactgcaaagaatgtgactatgggacacatgttcattcatgcacgacaaatgaagacaatgggccaaaaaaaggaggagaagaagaaggagaatcaagctcattatcgacttcaaggataaagtcattaatggaggctgaaaaagagatgagagagatggcgataatacatcaactacagttagatgctcttgacgcagcaggtagttatgtcggttcatgggaaccaaggagaaaagattattggtaaatgatgaatcttgggaggaccatcaaactttgtttgaattatattcttttgttttcattctgatatcgttctttctttgtatggtttgcaaattattatttttcatgtggcttgttgtaatgttatgaaataaaaatagttatatattttgctgtttgatttatattcaccgattctgattgatgcttatatattactttgtttccatcgcttctaaatgtcaaatgataatattctaagatcatagcaattgagatcacatgcttaaacaacaaacaacgacatttttttcacgaatccagtcttactattagaggaataacgaatcaagaaaaggttgttaagagagaaaaagaaaacaaattcattctcattcatcttaattgggaccggaaagattacattggaacctcttatatagtaagagatactctaaaactgagataagtaaacaccacaaaacaaaattaagagattagggtgtgtttgggatttgcactgagcttggaacataagagcacacaagtgggtaacaaaacttgtctctagattcgccaagatccactttactcaagattccattatttccaatgatgtaagcaatattgcgagcgggaaggtgacatttgtctattatctctttatcaagaacaaccgcgaccttcttctcctcgtcaacgaagaaactcctaccgacattaggaaaccaaaaaccagcgactggtttcatatcaacagcaaataacaagttgctccacgacactgcattaggctcaatcttattagtaatccatatctcgacgacggatgcccggtgaaacagcaccgcaagctgctcttctctaacactagcaagcgtcacagtatctccaaatacggctcggaaaggcagaggcagacgcggttcaaatcttgaaatcaaaggatagtagaaaatcagggtgatctagtgatggtagaccatgaaatgggatctcttctagggcataccagtaagtgtttccctttagagacacgccactgtgtttgtacaaaatataccagtctggagtgaaatcatcaatgacctcccatgaattggagtataaactgtaaatctgaagctcacgaattcggtccctactggtctccaagtactcattcacgaatctcaagattttgtgattctttttctcgtatccgagagcgtacttcacgcacttgtggtagatagaatttctaggtaattcgatataccttgtttgtcccaaataagggttccaaacaacaaccctagaagagtctttgtctctgtccttgttgatgcataagaataaacccttggcagtgaaagattttagatattttgattccatctgcattgagattacctataggatctatagacggagagagtagatctacgctcatcaaggaaactctatagtccatcatcatcaccacctcaattccattcctctgtttcttctttaaaaagctctcacttttcgttatagtgttccactttttgcaggtcaatcgcagtttccccagagatttcaccggaaccctagagagcacctcctcctccatatcaattggaagatcgaacatcttcgaatcgaatctcccaaaatctctctctcttttccgtgtctatcaatccatctcttcacgccctcttttagtgatataacttatctttttcaatttgggctttatggtaatgggtcaaggcccattaaggggtctcgtttagaactcttgattaatgtctgaaataagttttatacatttcttcatttggagagtcatttcgcagagacgacgcatagcttcttcacttgtcagctctcaacgtttctcacctgaaatttcacttctgcttcgtcttctcgagccggatctctaatttgtaaagctccctctctctttcttcttgttcttcttcgtctccttctacactgatggatcgttatttagctatttagggttttgtgagttgcattaactagagtaactcgcgaattcttctcctttgccttgcgatttggggaattttttagctccatcagccaattttacaattttgtatgtatccgtggatttatcacatgaattgtggacctctgagttttttttttttgttaggttcttctcgctttagttttgcttttaggtacataaattttcctcctttatgatttacttgctcttgggctattttcttttatttgtttggtatggagtatggactctagagtttagtttagtttttttttttgggcacattggttggaattagtcttgttttattctgaattgtgtaatcaatatctgcatgcttgtggtgatgcagggaattcttatgtgatggtgtaatttaagttaag

SEQ ID NO: 13028 - DNA, 3000 bp, Unknown
  misc_feature (1)..( 3000): cDNA_ID_2710271_gDNA_ID_2214590_Annot_ID_186763 3000 nt of promoter + ATG
aaccactctaagttggaaggtaaataggagcgtatccttatcgactcttgatgggctatgcagccttttgcttctccactaatgaggacttaatacgatatagaggtgatacatcatatattcctacacacatgtttgggaaaaaccgagtctaagtatgaaaatttcaaagatgttatatccaacataatcatatgttttgctcatatgtttttaatactaagaactattttctatagtcttgattacttaatattagaatttagaagactagaagttttcatgccctatgagaataagcaaaatgctaaattttccggctacaatctacggtattaagtttgaacgaactattttcaatcttttgcaaagatttttcaagatagttgaagttaaccaaaatctttgatcgaagagagtcgtcgttccatatggtaagtttatacattgtgactgattttacaaatgtttaggaaaagtaattgggtagtatagtaacatcattacatcaacatgttggataatcgaagaaagagaaggtgggggatgatgggatcaatcaagaaaagcccatatggtgtgttccacagactggacgaatcaaacccatttattccaaatgtaaccgtccattaattgccaacccaagctttgtctcttaatttattctttactctataaaaatgaaccaaataagaattataaggaaaaatatcaaaagcattttcagaggaaagttttatactcttactgcattgttgcaattacatatgggtatgtacatatagccggtcctgagttttagaaggtcgaaaactagagaaaaaaattagagaggcgacaaaacattttttcgatgactagagaaatgacatgaataataaaatttcgatgaagtgaacaatatcgtatacgtttactaaaatgaattttctttgcaattcatcttcaatatataaatatgtgagtttccagtagaaacgaattaaaatgcaaaactgatggattttttatacattaacaagtgtggaaggtgtatccaacttattttagttttgaaatctgtcattttgctagttcgagactacattgaccgattcatcttatactattgtaatagcttaaatctcaatataatatgcaaatagtcttcgtattttgaggggtgtttggcatttttttaaaaaattttttatgacatgtgaataatctaacgaaatatacagtggtgcaattaaagcaatctaatccgatgagtaaatacgtcgagatttgtgaccaaattattactatcgtaaacgtagtttcggatagatttaatgaatagaagacaaatatggtttgctataggcgacgaagcaaatactataacacttgaacaaattagttaaaacatcatcaaatgcatgtatgtatcaagggcctagggattgattcaattcaccaacacaacacttacaaagagtcatctaaaacatgagggaaactggaacctaactttagcgtggactaaaatgctctataaacaagatgtatatctagaaagaaacaaacaaagtaaaactaatcagtagttcgtaaaaattggaaccaaattaaatatttaagagaaacttgaaagtcaagcagtgtggtccgtgcaagaactggtacaaacacatggctggattccaaaaaacgagtcaactccttggatcttacaaatccaccatcttattaatttttgaactctatgttactactattagtatacatgtccatgtactgacacacatacacaaatattgaaggagatatgtttttcttttatagtgattggctttttttgtaacactatattgttaaagtgtgatttcgaatcattgagttaccagtgactaaatatcaaaccgaagattttttgaatcggttgatgtttttgatcttgtaagtgaattttcctaatcgttaatctttacctttgttatatctctacattaataagtattcttgagatgatactggattccgttctagtggagacatatgatcattcacattcactaatatttcccttgttcatttctaatttgagtatgttcttgatctcggttcatcgattctccaccttcttcaattgcgcgcgatcggtttggctaattggctgtattctattaaccttcaatctcggcttcatcttaatgccagtttctcaacatgaggtgtgtatttcattacattaatcaacaaacaaattttaaattaatcagatttatatttaaatggacaaactctttctttctttattctattttttttcatccaaaaaaaacaacaacttgtttttatcatcataatttggctttgtactttatataaattacatatgtgtaaacaactatattagtaccacagtagctacgttttaaaagtgtataaatcatgtgatccgtacaaaaaaagttccactttgtccacacacacaccattgcactagaaaccttttttagcatctctttctaacatttttctttcttttgttctttttctctcaacacatagtctctttctggtcctacttcttattcttacagcttcttttgttggtgttcttgtgtcggtgccttaatattcaactttcctttttttgttttcacatcgaacatttcccctaaaagtaatctctctatctgttggagggttttacggcttttttgcttgtagtctaagcaactaaaacttttttccataaaccagattcatctcatctaattcctctttaaatcatactttaagcttctcttctgtaatcttattgctaatcatttcttgatattattatgcggatttgatctttcgtacagttgtctacaaacacacgtgtctgatccaaatatgggtttcgctttcttcccttttcttctggaaaatttaatgttcccaagttggcttaaatggttccttcattgataaagtcagaggacttctcgtgaagtcagaggatttgataaagaagaagac

SEQ ID NO: 13029 - DNA, 479 bp, Unknown; identical to SEQ ID NO: 13022
  misc_feature (1)..( 479): cDNA_ID_3027674_gDNA_ID_2214590_Annot_ID_186751 3000 nt of promoter + ATG

SEQ ID NO: 13030 - DNA, 3000 bp, Unknown; identical to SEQ ID NO: 13028
  misc_feature (1)..( 3000): cDNA_ID_2710271_gDNA_ID_2214590_Annot_ID_135412 3000 nt of promoter + ATG

SEQ ID NO: 13031 - DNA, 3000 bp, Unknown; identical to SEQ ID NO: 13027
  misc_feature (1)..( 3000): cDNA_ID_2710293_gDNA_ID_2214590_Annot_ID_135414 3000 nt of promoter + ATG

SEQ ID NO: 13032 - DNA, 3000 bp, Unknown
  misc_feature (1)..( 3000): cDNA_ID_2710297_gDNA_ID_2214590_Annot_ID_135415 3000 nt of promoter + ATG
atagtagacagtatacacttcataagacattctggctttaactgcacccttatggttgccatctgactaggcattgctatcagaagaggagaatctactgatcatcaatcgacttcaccaagttcttcgaccatttgttctgcgtcggctgaaacataaggttcataacagaatgtctcctttgtgttactttaatatgttagagatatggaaggatattttccaatgcaattatctcagttactttaagttttatttaacatactattttattttggtaggttgaaaatgagcttcccgaaaagatagagagattgatacgctgtgaggcttctgcttatcagaagctgttgatgaagagggttgaggataatttgggttcgattggaaatgcgaaggtgttgttttatgctctaggtgttggtagttttgcgataatgttgagttatttttttagttattttcttttgtttacagtctcgtgcagtgcacaactcagtaatggagcttcggaatatttgcaatcatccatatcttagccaactgcattcagaggaggtaatggttttcatttatctggaagtgttattgtaaatgcaatgaagcactggttagcgcactatggacaaccctaatgaagggcatttcacttttattaggtcaataacataattcctaagcatttcctgcctccaattgtaagactgtgtggaaagcttgagatgttggatcggatgttgcctaaactcaaagcaacagaccatcgggtaatgatttctctcttttccctcatggtaataggatagttgtgatgattcaatgctcttaaagacgaaagcttattattgaagttgggctaagtgttttcaagtagtgtgctagagtaccttgcattgcgttcgcctctggaggattaaagtgtctattacgaaaagtttttgaaattatgttttgattggatgaagcattactgttttttttccctttatttggttgcttacttgcttctatatcacttcacgcaaaacatcaagtcctcaactataagattttctgttatttgtgaaacgcacatatatattagaatttgtaacttttttgcatttttaccttaaatttaatactgaagcttataaatggttgttacttttatttatggtatgcatgaattcccacaggttcttttcttttccacaatgacaaggcttcttgatgtaatggaggattacctcaccttaaaggggtacaaataccttaggctggacgggcagacatctgggggtgatcgtggtgctcttattgatggtttcaacaagtcgggttccccatttttcatatttctgttgaggtgatgtatcatatatcatggctggctttctgtagttctaatctctatcgggatgattcatgttcatttttaatagatttagttatgttcctaaatactacaagttgtaaactcttttgggcgttcagtacgactgatatgtatttgtatgtgattgctgaatcattcatggaatttcagcattcgggctggtggagtaggagttaatcttcaagctgctgatactgtgatactattcgacactgactggaatcctcaggttagacctagcatttccatatgttaagttatagttgaatactgtggacatcaggccggacttgaagcagcatttattatacatttcaggttgatctgcaagctcaagctagggctcacaggattggccagaaaaaagatgtgcttgttcttcgttttgaaacggttagttttttatttattgtgctcaaggaaattaaacatctgaataaatgggttgatttgtgattggttgtaacttttaccctggtgtttttagtttatgttgtttcatcattgggctacataatgtagtgttgctgtcctaaatctatggctgttcaacatgacttatgaggcaaatagaacagtgcagtactcttgggagatactaattgtttcttggctttttccctttcaattgacgcgttattatataattaagctgtctgaactgtttgtttgtctttcgtccttaattatatcctaaggtgaattctgttgaggagcaagtcagagcttcagctgagcacaaacttggagttgctaaccagagtataaccgctggcttttttgacaataacacgaggtgaatcgagagacatcccttttatgcttcaagaagtttcaactaccaattctctaaaaaaattcttactttgtaacagtgctgaagatcgtaaggaatatttggaatcccttttgcgtgaatcaaagaaagaggaggatgctccagtattggacgatgatgccttaaatgatcttatagctcgaaggttaatactcttttgcatcgttttttatacagaataatttacttgcacaaattttaattttacaacagcctatgcatacgtggttttaaaataatcctgatagtttggttcctttgcactatgataaatctagaaattctaccaagattactgccaacaatttgtacaaagtattttactttctaactgtaaatatttgtcttctatattattttctattttcatagcatctactgttttttcatgtgttctgtgttaattgatagcttggcttcctttttaattcttagatgacaatctttttacatttccatgcatctcgattttcttttaactttcttgcagatctgacatttttgttatctttctagggagtcagagattgatatctttgagtccatcgacaaacaaaggaaagaaaatgagatggtatgcttgttcttattaactttattttcgggttatatcgttttatgatgtttatttgaaaaagatatggccgtgcaggaaacatggaataccttggtacatgggccagggtcagatagttttgcccacataccatctataccctctcggcttgttactgaagatgatttaaaactactatatgaaacaatgaaactaaatgatgtcccc

SEQ ID NO: 13033 - DNA, 3000 bp, Unknown
  misc_feature (1)..( 3000): cDNA_ID_2712990_gDNA_ID_2214591_Annot_ID_135419 3000 nt of promoter + ATG
ttcgagtcttgctactgcgatttattagcagatttgcagattaatggagacaagtgtgtagaagatctacaacgaagtacaattatagtcgttcgccaagattctacgcagataattgaagatgtccatcaagcgcatggagaaggagaagaatgtgtcgtttgtcatggatctaataagggtcagaaagaattgtccgtggtagaatcgtctatgtaacagttttcaaaatttgtaataaatagtaagtttagacggcaaaaaaaagaacttttttttacgaaatagttttatcttttgacgtaaaatagtatttgtgtatctccttaatcataatatttttacttttgatttagaaaatgatataattttaatttttgatgttaaaaatgatataatttttttttttttaaaatggatgacaaaaaatgatataattttacttttgacgttaaaaaagcgaaaaacaagttttactataaaccttcaaacttattttactaacactcaaacctcaaagtaaattttctgtttggatctttctaaaagataatagagtcatgtcaacagaaaactaaaacgtgtttttttttgtcatccaaaaataaacgagtcattcgtgaagaatattgtttacatatataatataaatcggttgggtacgatcttttcgtgtcaaaatatccgctttaacattagctactaaagattaaagataaagaataccttgtgaactcatcattgtcgctctgtaactcctccaaatacactaagaaagttgttcattcggttggaaaagacaccatctacaccagatttgaacagtctgtaagaacaactacatcttggttgtcggcaccattcatacacttcatcgtacaaagaagagcttccacctctgcatgtagtagtggaaattgatttcctctgagtaaaatgtgttatttttttttctttttaacctcaaaaagtaaatttattttgattgacgaaacaaaaaaactatttaatgtcaaaaagtaaaattaaattatttttaatgttgaattatttcattaaaaaaaatacgtttaaattttttgtcgacgggagttatggttcggttatcttttaggacaaaactaatagaaaacttaatttgaaggtttaaagtgttaataaaacagtttgtaggtttataatactaataaaaatatcaaggtttaaagtattacctaatatcacttataaggttaaaaaaatggttttctcaagattaaaatttgagcagatatgtgtgatatagttgctgggtttattttagagttaatgttctaaagttatatatatatatatatatatatatatatttttggtaaaagattaagttttataccattttagtttttttaacagaattacaaagattacaaggaacagaataaagcaatatacagaagataaatacaacattactactcaaattgcgatagatcgcttctaaatgcaaaaagataggctgcgaggtgaaacaccgattccgagctcgcgaggcttggaaatttgcgtgattgccacaagaccgaagtattggagtcctcatcttagttgccacgagcaaaactatccgaaacatgtccacaaaatctcgagatagaagcttatagtttctccgagaactaacgcaaaaacgcataggcaagcgcggacttctacactaactcaaagaattagtgatgccacttagacttattcgccgcctctattcaacactcaacaaccttgccaatgcaactagaagctcaaaatcgcaaagagaaccgacaccaacaaaacctgaaactacaaaactctaccttaaagtaaccgtagaaatgtgtcggggacgaagaaaaatggagacagagaaaccatatccatggctgaggaacttgccaccttcttcaacccactaaaggaggagagacactgtccaccaacaaccaacccacaatgcctctaaccgccacgatcaagccgaagaaccaaaaaggttctgagacttgcctccaaaagagactctcgccggtttcaaacacactaccaccgcagctggaggaaaaactaaggtaagagagaccgagaagagaaggtctgcttaccaaggctcccgctgatgtagcaaaagagccaaaaacacgaggaacgacgacaagtgaagaaatccggcgatgcaccaccggtttcacagaaatggaggatggtctcgccgttaagagccacgaccctgctacaaacgccggatcaaaaccaaaaccagaaacggagaaccctatacgcacaacgatagatctgatgcccaactcgccggaggttaagccttaaaccagcgccgtccatgagcgtcgaatttcagagttcaccaggaaagcaagcaatctatcccaaactgagcgtggttgacgcagtttcaccaccaacaagaggcaaagagcaattctcggagaggccaccattggagcaacaaaggctagatggagaaggagacaaacagagagaaagggaaaggagagatggcctctccgacaactagcaaaagagcgtcgttgctggagaagcagaatcaaagctcaatttagggtttcacctgctttatcgccttatttgggagttatatatttgatacccgaaattcacatgtcgtctataaccaatctaaaatacgaaatatttgcatgttaggacactttatttaaaattttaatcatttataacacttcccaaaactggcacactttttgatcttattcccatcttttccgcgtttacaattaccgtaacacccttggcggaagttcagtcgtccaaccgaaaaccaaccctaaccggtcctcatcactttactcttttttaccttatccaccatctcttgaacatacccttctcgattcaaattagtgcgcttctggtaaaagccataatccaccatactcggttattttctttcaattcttccgtggtctcccttcatttctgtcaaaa

SEQ ID NO: 13034 - DNA, 3000 bp, Unknown
  misc_feature (1)..( 3000): cDNA_ID_3027702_gDNA_ID_2214591_Annot_ID_186784 3000 nt of promoter + ATG
gtccaaagctttgatatataagtggagttttacaagagacttcttaaaacaaatgctagtgacaaatcacctagtgagtgtggaatgtggccgtttctaggagaatgagaggctatattctctaagttcactcatgaaatccaggattgttcaaagccaaaatgaacacaatctagagaacttgtttttacgagaaaaagtagttgggttttacctgttgtctaggtttacataaaaatctgggtggttaaagacatcatgttcacctcctggccaagtaaattcgacaaatattaacagtgaatagtttaaggctgaaaaatactactatctcatacacatctattttttgcatatactcttgaaagttgagtctgtaaagtctaagtcagtttaggttatcgagtcagtcaaaagtctcaaatgtttagagtcaattttattcatgtgggggattgttggaactcaattttacacaagtggctccggctaactcttcggtgatttttccggtgatggccatcaccggaatgaccggattatggagtctttgaattccttgtaatgagcactataagatagtgtagttacatataaaaattgaagttattatgaatgagtaattgaggtccaaagtggtgagcttgaaagcttataataacaaatattgacaattgtcccatattagaagttttaagatctctcctctagcatatatggtgctacccatttaacatggttcactagctattgggaagggacactatggtgtaggagatgcaagtcctttatgcaaaacaacacacacacacgctccgccgccgtcgtgccgtgccgagccgggcttgggccttgggctcttgggaaatggggcctttggcccacaaacaatgttctttttggggaaaatacttatgaggctttgttgcattatttgtaatatttgcaacatagtttttggcccaaaacgaaagcccatatcgtttccataactaaggtatattcggaatattaaaagcatatccgaatattccttattcgaatcttaattccttaaacggttgtgataatggctccgctaatcatgcccacgtctttgacttgcgcatcactccgaatcccacgatctttgatttgcggattgcatttcctcacctctctcctataaaaggaacacatcttcctctcattgtactcactcgttttttttgctaaaagctaaaacgaaactctctccctttctccctttcttctcaaagtaagtcaagagtatatcgtttatttcatgttcgcagattccgctatcgagtgctgcgataccggttttatagtgattgtattctgcgatccactgctcataaaaccgtcacactgcgggagctagtttgaattatggaaagagatcaaatctcgtcttcactcgttttcgaaaaacgtctttcctaatcgttttataaagatttttgatttattgcaaatcaggatttcgcggtcctacaatccattcaatcataataggaaggataaaaaggggaaaaatgtcaaaaaaatcgcgaactttcaaatttgggacaaaaaagcatgaattttcgaaatatcaattaaataccaaagttattgttgactttagaattaattagataacttttatcgattttgccaatttgggcacgatgttaagtcaattgacggaaaaattaacagagttaagtcttctgttataaattccgttaacttatgaaacaacgttgttttgaatctaattttttattacaagttcaggaattgaactcgcaacctttaagataaaacaacattcctttatgggaaaaacgtcgaaaaaatcaccaactttcaaatttgggacgatttaatcttgaacttcacgaaagacaaataaatcgtaaagtttttgttgattttcgaaattaataacaaagttattgttgacttgccatttcagtcatgtcgttaagtaggttaacaaaacgacgtcgtctacttcaacttccttcttccgttttctcttctttcgatttgatttgggctgaggaacattgttcgtctcctcaccagatgggattcgaatcgattcggcctctataggatttgagataatgaaatcgatttggggatttagggtttaaatttgtttcaacagaagaaacgatgttgtttgtctctacaataaacgacattgttttgtcctaacagagcagataaacggaacatgaacgtcgtaaaaaaattctgttaacctatgtaacgacatgactcaaatgggaagtcaacaaaaactttgtcatttatttagaatgtcaacacaaactttacgatttatttgtcttctgtgaagttcaagattaaatcgtcccaaatttgaaagttggggatttttttgacattttttccattcctttaccgactaagctgaatcatttatttgtttgtttctcagaaacatacatatttatataggttataacaaaatgcccaaattaataaaagttaggtttcgatccctttgtcacagtcaccaaataggcgagtatcttgccgtcgtcaactcatcgcatcctacacaacacgaactcaattaagtagaagaatatctctagaacaagaaaccttaatttcagcacaattttcagaacatgatcaatctttccctaaccaatttcaaaagttttttccaagagaaaacttgatcaaaaaatgcaaagatgatgaattctttttaatcgttgaggtttacatcttaatttttcgtcccaaatttgaaaatttacctttatttttgacatttttccaaaaaataccaaaacaaaactttggatgacaaataaaagattcacgtgcatctcacgtgcttcgtgataatttaacaaaagtgtagaattttgataattttgtaaaattgtaaagttgcgtttgtcttgttgaatcgcccgtcactaaaatcctctccgagaatcctcctccgatctgccactagctatg

SEQ ID NO: 13035 - DNA, 3000 bp, Unknown
  misc_feature (1)..( 3000): cDNA_ID_2712980_gDNA_ID_2214591_Annot_ID_135423 3000 nt of promoter + ATG
ataaatacaaagaaagtgaggattcacctgtttgagcttcccagtgagttcaatcatgctagcttgaatctccataaaagcctgttgtaactatacacattacaattccattttctgcaacatcttactggggaaagaagaatattccactagaaaattgagctgatttaagagagagagaggtactcacagctctggttgcttcgtccgccatgtctgcagatcttgatctttgaacgaaccccgacgtgctagagaagggtctttcgttttagggtcaaaaagttagaactacccgggtcgggtttcagacggcttagcccggtttatcaaggctttattgggtcaaatcggcccatttataattaacgatgattttatacttttaaaaaaatatgtgtttgcattggaacaaacaattctacccaataacacaatttaatttacccatttggttttagattgtaccatgattttgtaaatcaaagactcaaagtcattgtcttttttttcttgtataatcaaccacccaaaccattgtttgtatcgtaaccaattcagctaacaccaccaaattattttaccatattatattttaagggtgatttgcattatcatacactttcgaaaacatgttgagcaaaagttttgccgacaggcacacttctgatcaattataagggtgatcaattataagggggaaaaagacttaattgaccctattaattaaatcaagtaaaatcggttatttagggtaagagtttggggaaaccggtttattttgtttttgcaaaccggagaaagcatggaacgaataactatgtcatcgaagtttgaatgacgatgaacaaaagaaagagaagctctgaagtttgaagcaactaacaaagatatcataacgatggtaagaaaaaatggattggtaacaatagtagaaaatattcgctgatatattattgactgtctaagataaaaaatttatatattgcagggaactgaggatggcttctgttatgtaatatgcggggattggaattgcgaggaggatgagaagtggtatgttgaggttaataaggtaatgaaatctcgaattgtgcctgtatataaaggtattaagctatcagaattcgtggaagccattagagtagaatttggaatttcaacgagtacgaaggttgatttaagcttctgtaccccaaatataagagattttaccaccggagataaaacaccaccggtcgtcgtgacgactgatgtggggctaagttattttatgaagatattggaagcaaatgttggaaccaacatgtttgtaaagtttggaacatcttgtaaaagagttttaaacaattctgaggttgacggtgggctagtgaagaccagttcagttaaggaagatgacggaagagggaataagtcgaaacgtttatgtggatcagaagatagtatatcgaaggtcgggttgaaagaatttttgctgtcctccgaagatgaagaatttgttgcagaacttgaaactatagaaagagttataggttgtgaacgaggtcctcttgttagtgaaattttatctgaagatcttgatgatgaagatctagtggatgaaggaagcgaagatcttacttgggatgagattatagaagtaaaaccccaatcttatgatgtggagttttggagcccattcttggatgaggacatgggtggctcaaatgcattggatataatatgtgtcggggaagaagatgctgatgttagaatgggatttgcgtcaccaacagtagacacagaattggtggccagtgtggaaggtgcaggttcgaacatggaaattgatgatttgataacgtcttcgattaagcatccaactgatttacttgcaaacagcagtggaacgggaaaagttgttaacaatagaacaggtgattgtaatacaaatgaaactgcaagagaaaataggaagctgtcggatgtggacgatgaagagtttgatattcctcctctgtttgatgacacggagtatgaagctgccataatgccggatatagatagggctgacggtgaagatgtatataaaggaaaagtttatgctagcaagtcggattgccaaattggattagctatatatgctattaggcatatgtttcacttcaaacaaacacgcacaaaacttgattcatttgttttaaactgtgccgatgagaaatgtgattggcgggtaacagctcatgaaatgcctgagagtggatattatgagatacgcaaagctaaactagaccatacttgttctgtggaaactcggaaaatgtacaagaagaaggcaacttcaagggtgatagcagctgtgtataaagcacaatatagtgagcctgttaaaggacctgtcccgatggatttgcaaaagctgattcttgaagatttaagagtgtctgcatcatatagcaagtgttatagggctagggaaaaggcagtagttgatgtgttaggggaggatgatgatagcttcaccaaattagctgaatatatggagcttataaagatgacaaacctaggtaatatgacaaacctaggtagtatgacagaccttgtgacagatattgaggaaaatggtgatgaacgttttctttatatgtttctggcatttggtgcctcaatccagggcttcagatatttgagacgggttttggttgtggacgggactcatctgaccgggaaatataaggggtcttattgactcctagcggacaagacgcaaattatcaagttttcccactggcttttgctgtagtggatagtgaaatggacgaggcttggacttggtttatgtagaaggtagagagaattattgatgacagtgcaacactaacaataatttctaatagacatccaagcctatacgttgcaaaaagcagagtttttccactagcacaccagggagcatgtatagtccatctccaacgaaatgttacatcaagatataagagcaaaggattagcaaagatg

SEQ ID NO: 13036 - DNA, 3000 bp, Unknown
  misc_feature (1)..( 3000): cDNA_ID_2712968_gDNA_ID_2214591_Annot_ID_135427 3000 nt of promoter + ATG
aattctatctgagttagccacaagagacccctatacagtagcaatgacattaggtaaataatttgttctattcccccttatattgtttttttcattctatttctgtgtgtagagacataactgtttttcattcaaaacttgatatgtgtctcttgatctttttgctgcagaaaagcttgcgtctccaacaggtatgctcaccaggccttttatctcttgacgttaatctttttgctggttatttcgtgtttatttgtgctaattataaagaagtgtttggaacacgatctgggttagctgatatacctttcttctgtacaccaaattaggggctttgcaagatatcctgcatatgaatgatgttcttgctagagtttctctggctaggttgtgccactcaatatctagagctcgggcattagatggtaagtactatcaacctctttctgctgcccgttctcgctctgtttttttttcttcttatctggctatatgggagagatcttttgagaacttacatgttgctagtttcctttcaatcttcctacagagaggcctgatattaggtctcagttcaactcaattctctatcagctactcctagatccaagcgaaagggtatgctatgaggcgattttgtgcattctgggaaaacacgataacactgagaggcatgagttctatgactttgatttctcttagttcattctttgtaaggtattgaataaccaaaatgtactgcatcatttaggatggatgagcgtgctgctgggtggtatcgcttgacgagagagatcctgaagctgccagaagcaccatccttgtcctccaaggataaatctaataaaaccaagcgtccacagccccttattaagcttgtaatgaggaggtactcctagcttggtggaagactgtgtttagaattgcagatcttatggattccctttcctcactagaatgttgctttggattgtaatgatcgttatggttgtgtttcttgttaaagaactttcgcaaattgatcctgttctttcaggttagagagctcatttcgcagtttctcaagaccagtacttcatgcagcagcaagggttgtgcaagagatgggaaagagtagagcagcagcgtttgctatgggattacaggacattgatgaatccgttcatgtaaatgcattttctgatgctctagatgatgctgagaccaatgaaagttctcatccagaaggtacattgtcagtatcctcttaatatgaattacaatcttttttttttattttgttagatgtctgacagatgcacaaatatatttctaatttcgtatggagcataaaattgtatgcaagcttttggtctataagagttttgttcaattttgttgtattattatttattatacgttgaaaggtcaccaactacaaatgtgagttaagtcattgcatctatgctctgatggcgcatcaatatgctagaatcgttacaaaactacaaatgtgagtaaactcaatgctctgatgtccttacaaaaatagtataatatcagtcttctcttcagacgtaaacaaaggaacatgtttttctgtcctattgctttgattttctttaccgaattatctaaatatgtagggtatccttatatctttcgagttttaacatgttccaaatcactttttaccttctttcccactctttggttacttgtttacccttatttttagcaggaattctatatatgttctaacatgttcctactttgtatatgttcgacttttgcaggaattcggagaacatcatccatatctgcagggcctggtcgcagtgatacaattgcaagtttgctagctgcattaatggaggtggttcggacaacagtagcatgcgagtgcgtgtatgtccgggcaatggttatcaaagcattgatatggatgcaaagtccagatgaatcattggatgagttaaaatcaatcattgcctcggagctttcagatcctggttggcctgcagctctagtcaatgatgttttgcttactttgcatgcccgctttaaggtaagtatgatgttttcttggcttttttgattttccagtgtagttgcgaacagtttcaaagttaagcagctctgttgtttgtccacaatcctataagtatttagtagttctctgatgtacggaatctctttaatttcttagattttgtaacaagagttatctggcagaaacatgttacaccatggactctatcaattttcttatccattgcgttgaaactgaagaaaaacttgttattgaggagtaatgttaactgttttcttctgactagttaactctttttaatttttctttcacaggcaactccagatatggctgttattcttctcgaaattgccagaatatttgccaccaaagttccagggaaaattgacgctgatgtcttacagctgctatggaaggtattctcttcttacggatataattctaaagctattataatttacttacataggttgtatatttcgtcctttgatcaaaaaaaaaaaaaaaaaaaaaggttgtatatttcgtcctgtttcaaatttttattgtgtttaggacatttttagatctttaagtttgtacgcttgtttatttaatcttttaaagctatataattggataaaaatcatatttgtactgtatatttgcaaggcttaaattattgtgggatattttactgaatttttgctacctcagatagtattttttaacacaatttatcatctgattgacttctagacatgtcttgttggagctggtcctgacgggaaacacacagctctggaagcagtcacgatagtactcgatctaccacctccacaaccggggtccatggctggactgacatcaattgatagggtctctgcatcagatcctaagtcagctctggcgctgcagaaattggtgcaagcagcagtaagacttcctcataaggttttacatgaatttggtaatgttttcaacacatg

SEQ ID NO: 13037 - DNA, 3000 bp, Unknown; identical to SEQ ID NO: 13034
  misc_feature (1)..( 3000): cDNA_ID_2712964_gDNA_ID_2214591_Annot_ID_135428 3000 nt of promoter + ATG

SEQ ID NO: 13038 - DNA, 3000 bp, Unknown
  misc_feature (1)..( 3000): cDNA_ID_2713019_gDNA_ID_2214592_Annot_ID_135436 3000 nt of promoter + ATG
ataataacatttaattgtttgcgtataaaattgcacagttttattacttcatgtctttttcttctaagcaaaaacaattgggtattaaatgtccaaataaaaattaattgaggttttttttggtttttttcgttcttctttagttgatgttttataaaaatgcacacctattaagaaataatataattatataattaattttgcattgaaaattaaaaatatcatgtatttaaaaacaaaaataaaagcttaaaacatcatttataagagaacggaaggagtattaagtgtaatcttttgcattttgttttaaaataagtgtcattttgtcatttcaatgtatatgtttgataataagattttcagttttattcatattatattaatgtataaaccaatagaaaatatataatatattaataaaaagtaacatagataattgaatttttttaaatatatgtgtaacaatcttaaaacacatttctaatgaaacaacatttgcagataaattgttttttatcaaccacatgttgttcaaatcgagtaagataaaagtaaagttacatcaatcttcattatcttggttgactttaaaatattttccaaaaaagatataaacttgtctggcgtatttttacttttggattattttatttctctcagttgtttcatatatggacggagtatataggatttcgcacgtcggtttgtaacttttcacaatgataattattcgcatttagttatcatcatactccatgaaaatgccttgttactccatttacgtatttaaattttattgttccttgtcttgtccaactcctaaataatttctgtcaagaagaatttttttatatatttttgtcataaaaaagagaagagttgtctaatattatatagtaacaagtttagagttttcgtgttcgttgaggacttttcgtttccacattgtcaaatactataataagttagaattgttcttttttatttcttcttctttttattgattttcttgacaaatgggtggatgacaataaggagtgttgagtttttctatttggtagtcgtaagccaataaaaactatataacagtctatatcacttgaattctgactgattaaattcttttaaaacgaattattctctttggaaatatttctccaaaacttattttaatattataccttgactatttgattattcttcccttttattattgacttttctcctgagaagaacaaaaccttgtctgattcggtttgtcaaggtgtaatatatatttttttttttttatcaattctcatatatataatgatgttgagatgtattagtcaagaattttctatactttttaagcaaaatcatgaaggtttctatgaggcttctgagtcatttcttgagcatgttcatatgtgacgtccctgtagccctcatagattaagaccacaaaacttggtctacacaagttttaacaaaagaaatagcatcaaaaactttgtctggtaaacttagatactttgaattctgtcataactatggtctatggtataagttatgagtggtgaataaggttcctcataacttggttaaagaacatttcttaattaggacttgtcgaaaaagttgtaatacttcatacttgtagtaatatacgtactagtgatgacatgctataaaagtcatattggtttaagaatgataacataaccatttgtatcattagttgtctaattttacaagagccatttgtcacataaatatataaggttacgtgtggaatcaaaaactaggtagctaacaagtctttaatacctatatgtatcgttaattcaactgctgtgtgtaggtttgattctgatcatgcgctcgtgtgcatgaaagtaccacacatgcatggaagtcaacgtacaagttgataatatccactaggtccgatctaaaaattatgtcacttcaactctgtggcacggcattgaagtcatcagccaccatgcatcatctattacgaaaccgatttctttggaatctgaatctgaatgttagtcctagtcccactaaaggttgcttcgtcgtaaaagttaaagttttttttttcaagttttttctttctttctattctataatttccaaaagatcagattacatcaaattcagaaatagaaggatagtttaagttcatttcaatgaaagttgttgtagcgtcactatttttttaaaatatccgtttttaacaaatttagctaaatgacatttactataatgtttgttttgtctattatacataattaagaatcttttaaatggaacgcaaggagtattaaatattgggtttctgaccaaaagaaaggatggcattgattactagagatttcaaattctttcaaatgatatctaagtacgtacaaataatatctaagtacgtacaaataataatgtatttttaaaaataatatgctcatatattggtccaacatttaatggacaataagaagacatggtgtgaatatatctgactcactagccgtgcatggattggctgcttcagaaatttctgcactctatccacttgaaggtgacatatatatacacattttaatagtggttattggtacttacttggagtataaatatacgcacatatcagatcagattgtatcattattgtctacatatctttttgaagccgtcataacttgcaagtaaagaatggtcagtctaatgttctttagttcggcctcacctttatgctcttctccatcaaaaattcccaaggctaggtacttgtttacaattataatgcaagacatggattcaaatattttacgctattaagaagtctttctcttataatcggcttcttgatacacttaacttcactctttcttctacagtttggacttcgagatgaagaaacttggtaaatttttctcatcttgactctcaaaactatgaacagaatatagttttatagttggttatcataagtctcttgtcctaatt

SEQ ID NO: 13039 - DNA, 3000 bp, Unknown
  misc_feature (1)..( 3000): cDNA_ID_3027753_gDNA_ID_2214592_Annot_ID_186810 3000 nt of promoter + ATG
ctcaccttaacaaattgattctaatagcaattaaacccaggagagactctccttgcgtctgaaacagtccagaaacgtcctgcaacaagtccacaaccaaaagcaaccttgaagcaaactggacaggaaaaccagaaacaaaccgtctcaaagacgaaacctacaatacaagctaaccgttaactattcaatcgctccggtgaaatcctagctgcagacgtcagaaagctgcccacaaaatctcgtgccgatcggaaaacagacgagaccacgatctcagtttcaatcttcgctgttcctaattcgcgtatgagaaaacgtgtctcacgaaactgcgaataactcaaccaagtttaatccaaattcaattctgtaaactggagaataacgataaaggacttgggaatacctctaccaaatttcgttaccttttaccacgattttatatgacgaaactgatttctcccaaaccctaacgattctgctccttctccttttctctctttttctcctttataaaacgaaaagtggctaactaaagccctaatttcgagtttccttattttataggcacactttagggtttccaattaacccaaccaattaaaccggatgatttaaaaacaaaccctaaccgattttccggttcacgggcgttacaaattattacttaaatgggttaacccatttaacaactcagcccatcaaattaaatgagttatgggttgacccaacccattttgttaaatgggttgggtcaacccataactcatttaaccctaaactcatttgattatgagttgagttgagttgggttacccattttgacatccctatacgtacataacatttttcaaaagtatgagaacaactatactttaacaatatatttttatttaattattatatataaatagatttatgaaaaaaaaaccaaaaaataatcaaatgtttctaatgtataaactcaataaatattgtgtatgtcgcctttaataaaacataatctaacatatttacatgtccacatatatgtacaccgtaaattgcatatacatacacataagaaatttaatgaagggtataattgtaatgaatgtgtacggaattctcatcctctgtctatctatcctcgtagacaattgttagaaattttttatactcattttaatgtggtgtcatgtacgcttcaacaaatatttttatgtacgtacataatataagatttatgtgatttaggtatttttaggatgtaactgtttggagcagtcgtacacgtgtacgtgtatctcaagattatcgtgtacgtctacgtgtttaatttaaaatcttatctattctccacaaataatatcatataacataacacttactaaaaaatttcaaaataacaattaaatagaaataacagcatcaaaacaaaaagtatcacatatatcgtactaactacataacatttggctaactcgccgtatgcactatcgtagataccaaacattacgaagattcgtaaaaagaccataattctctttaacagaaccagatataattttactgcagcataccaagtacttgatcctccagtgttgataggttctcatctaaacaacatcaatgcgaacattttttttattcatagtagggatctaagtgtaaacatttctgtgtcattttgtccaatccaataaatacagtgtgaatattatgttaatgatgtgggaccttcttgatgaaactaaccatgggttaaggtgaaaacacaataaaaaccatatttgaggtaccaaatgtatttgaaaacaatgaagaagtagatgaggaagaagaagtcgaggacgataaagaggatgaacagaaagagggtggtgatgacgaacagaaagtatgaggaacaaatatacattgaccatatatttttatttagttattatatatgcatagattttataggaaaacctccaaaaatatattccatctaatcgaaataaccaaagatttctaatgtacaaactcaataaataattgtgtatgccgcttttacaataaaatataatcttacatatttacatgtccacatatacgtacattgtaaattataaatacgtacacttaaattttttaatgaagggtataattataatttttgactcgtcttcaatctctttaaccctaattttgcagtctcttgttaacaattatctcagaaatcttgatttttttggatttacgttttgaatgcttattacatctaaatattgtacatctagcatatttttagttcaaaaagataaagaatttgagttttgtttaattgtccagtggttaagtcaattacttcggaagaacacttgctttctcaccggaatctcgtttatcttcttcgatgacacattcactttcgtttttttcgttttcaattacacatgaactcagatttttgtttttttgggattttcgtttttgtttacaactaaacactgtacatctattcactcctaactaagttgtgtgtacgcactctacatcgttacaaagttaaagggcattttcgtatgaatttgccttaatggctaaacattggaaggcccagcccactctgccaatacttgaaagaaaaactcaggacggtgatcacggtgaaaataacttttttttaatactattaatcatgattatctagtttttttttttttttttttttttttttgtttacctaattggtttgttcaatatcttaccactaaccactaatctctttcaaactttgaaaataatagatagatgctatagaaaaataatcaataaaaaaagactagcaggccgacaatggaaaataataatcaaagtattttggtcattcaagatgcgtgttgcggagagacttatgggatgggatagaactcgagggagtacctgaagaacctgagattgttgttgagccatttctaacgatatcagatggaataatagtccattttctcatggccacatgatgtgatc

SEQ ID NO: 13040 - DNA, 3000 bp, Unknown
  misc_feature (1)..( 3000): cDNA_ID_3027767_gDNA_ID_2214592_Annot_ID_186804 3000 nt of promoter + ATG
aaaacgaaggcttatcttcgttatagtaaactgataatctcttaaaggaacactcccattcactaaaacaccaaacacacaaacaaatatttcatcaccataccacaacttacaaagatatatcataaagttatcaatctcaacaaacctggataaatccaagttttagctgcctcatgatcaattccaactaaaggactattatcgttatcgttacaccactcggaaacaacttgatgattttttggtttatgttcggttctaccgatgaatttacgagagtagattgtcttttcgcaggtggcttagtgagatttgccgtaattggtggatgagcgtttgtggtttttcagacaagccatgtcgatttctttgactgctgcttcccaatcgaatacctgtaggagaaaatctagaagttgaataattaaaaaattgattcaaaaacgcagaaagagattgaacttacgccgtcttcttcgatattggaaccctagatcccacccaagttaacaccaaacacgtcgtatccatgatgatttgtccacactgcattctcatttcaagtataacacaataaaccaaaaccgatattatcttctattaaatgtataacattatatcctaaccaaaacctaataaatccaatcttgtgactcatatggttgattcataccaacacacaaaagttcatacatcaatgaatatcaccaatttcacgagtagcgcccatctttttgttgaccattagttcacttgtttgtagacactctaatcattatgtggattgatcattctagagtatatcgtggatgctgcaaatctcaaaaaatcattagccatgagagaccaaacaaacaagctcaaacttatgtcaaaacgatctagagtgcaaaatgtatcacaatcttaaggaaacctagaactttattatttcgatgcataagtttttaccgaagcgataatcaccaatttcacatacatcatccattttgctttgacaatttgctcacatgtatatggatactcttatcatcgttccttgataaatcttaccaaaactttttatacctcgatataacaataaacatataaagaaagtttgcgtctgaatggacagattcccttggatgacatcaataagtggtggttgagatcgttggtggggatgaatgtatgatggtcgtgaggatcaaaccaagcacgaatcatgggactaagaataaagttgttggctttggccaagcactcgctaaaacgaattcgtcgttgtgtcaaacaaatccttcagaatcccgacgactactgctccctactcgctgaattcaatgtgtcaaaccctaaaggattgctttgcccgtagaatagatcatgctcggaggcggaagcagaggtggtggtggagaagcgatggtggaccatccggaacgattgcagtgagagatgaagtgttgaaaattggacttttagttttgatttggaatattgagattcccgtaaaaaaattggttttgattttggaaagagagagaaatgaggacgatgtagaagagagttgagagagacgacgtcgtgcaatgtgattaaaaggacaatttaggaattttgatttggtaaagtgccttctattttcaaagtgcctaatcccgtaaatagttttctaaaagtgtctcatagtgtaataacctctttttcaaattcctttgttgttggcattccagattaaacaaaaaacagtcgaataatcaaataaacggatgggaatgtgacacgtttaggcatttttaaagaatattattccttttgaggcactttctagggaatagacactttttacactaattcctttttatttggacttttttaccctcaattcaaggaaacgtaattagaaataaaggaaatctctctctctctctctctctctctctctctctctctctctctctctctctctctctctctctctctctctctctctctctctctctctctctctctctctctccccttccatgatttgtagagcctctctctccatagtttctgggctcgattttattccgtctccatcgcttctgggctctattcctctttcgattatggcggcggctcaccagaaatcggtggtaccgattctgcaaacaaataagagaagcttcttaaacaattcgatctcgattatctcaggaatttggtaaaagttctatatccataaggtcttggaggcggaggtctttgcaaactgtaagaaaaatcaacaaacaattttttagtatccataataacaagtccatttaaatatatacattcggaaacctttttactgatccatatccattctatataacatgtccataataacatgagattcgattaaccatggtttgtaaagaaaccaaagttccatgtccataaggccttggaggtggaggtctctgcaaactgaaagaaaaattaacgaacaattttttggtatccataataatgagtccatttaaatatatccattcggaaacctttccactgatccatatccattctatatatcatgtccataataataggagtttccatttaccgtggtttgtaaagaaaccaaagttccatgtccataaggtcttgaaggtggaggtctctgcaaattgaaagaaatatcaacaaataattttttagtgtccataataacgaatccatttaaatatatccattcggatactcgatgctacgtagatgaaacgagttttacctatgagagagagcaaaaatcaaatcaagccgccattgttgaagaagaaaaagtttcttaaagaactgaatctcaaatttatgtcaaaacaaagatttaaattgcaaaataaatcacaatcttaaagaaaccaagggcttgtaccctccaattaagataatttcttctttggcttgagattgaaatcaaaaaccaaaaatcaaattaccagagccacccatttgctcaagacggtggaggagcccgtgatg

SEQ ID NO: 13041 - DNA, 3000 bp, Unknown
  misc_feature (1)..( 3000): cDNA_ID_2713015_gDNA_ID_2214592_Annot_ID_135438 3000 nt of promoter + ATG
ctttcatgagaatggcctctttctctctccgcaaaaatatgctgaagaccttctcactgttgcagctatggatgaatgctccccaatgcctactccactgccacttcaacttcataaggttcctcatcaagaagaactcttctctaatcccacttattttcgaagtcttgaaggaaaactgaaatatttgactttaacaagaccggatctttagttctctgtgaactttgtctgccaaaagatgcatcagcccacaggtttagattacaaccttctcaagagaattctccgttacgtcaagggcactctctcaatgggcattcacttctcgaagcactctgattttaagcttcgggcttacagtgaaaaggaatcagctgacagtgagtttcgtcttcgtgcttatagtgacagtgactagggtggttgcaaagagacacgtagttccacaggaggttattgcacgtttcttgggactaatctcatatcatggtcctctaagaaacaaccaactgtctctcgcagttcaacggaagcagaatatcgctccctttcagaaacagctcaagagatgacttggatttgtcatgttcttcgagaattaggcattcctcttcctgttacgcctgagctctatggtgataacctatcttcagtctacttaacagcgaatcctgccttccacgctcgaagtaagcactttgagtttgattaccattatgttcgagagagagttgctctaggctctttggttgtcaaacacattcccggtcatcaacagattgctgacatcttcaccaagtccttgccatatgaagctttttgcagtatgcggttcaaacttggtgtggattttccacccaaaccgcgtttgagggggagtatcaaaccgacttctcaaaacgataatattttgtctgctacaacgaatgggccaaaggtttgtgtaaccaaaacaaacgagttgggccgaaaaacacaggaacccatcaagtctaacaaagaaacgatgtcgtgcaatgttcaatgatcatctcctctacaaacagacaaaagaaacagagtcatgacgaaagctcgtacggaggagttacagcttttaaaccaattctcagccattatgggttagagacaatgggatgaagacatctggagagtttacttaggttttacaagttcatgtgttgtgtataaatactctatgtaagccgctgtaaacccttaagaaagagaatgaatgaaatttaagagttcaaggtttaagcttttcatacaagctattggcgtatctcttattttccaattttttttttttacgaagtatgaatataatccagtggcattggcatatttaacctgaatcatgtaaaatatgggaaaataattaatatgagataaagagaaagtgaaattaaagaaagagtagtcataaacttgaaacagcttctttgataaattctatgaatatgagataaaacaaaacgatggaaagggagagaaaactgattaaaaaaattgatttgattgagagttaaataggatcggagataaaacggtttgaaaacatgatatatttcattttgaacattgattagtaaatttaggatctaagaacagttttagacaaaatagaaggcagatatagatatcgaagaataatatttttattttagaactgttttttaacagatttttatttttatcaaaatcgataatatttttattttagaactgttttttaacagatttttatttttatcaaaatattgaaacaaaatctatgtggcaaatttttatggattaggtgatttgtgatttataagataaaggatatccgtctatttaggcgggtcttatcatttttttcttatggataaatattattatagaggtagcaaaccgtacatgggctaaaagccctacaaacattaagattacaggaaacattttttaagcccaacataagcttcaaagcattacttaatagagaataaatgatatgtggctctatccaacttcacatgtcaatagctctaaactgaacagctacacagtggatgaataatctaaagggttttgtcatcaacctccgccgtccaagtacgattccggtgagaaaatcatcgccgatattaaaatcgaagcttgatttttctggatttcaccgaatgaaaccaatcgaaactccatatagagaattaacagctaaagacaatctaaatatgcaacgaaaatttcttttttttttcaacttaaaacataaatctctggattgattcctgtaaatcaaaaattcaaaagatcgacccaggtaataataatctttaagacactaatcacataaaccgctattaccaactcataatttatgaaattattgaaaggaaagcaaaagtcaccggatacaccagagaagtatggcagaagataactagaattcggttaacgccgtttattaaacccgatgttaccgaacatgagccaaccatctccactaaagatcgctggagatgctagatgataaacccgactaaatggggaaagataagcaccaaaataacattcggactgtgcatcgaagggaaataaacttttactattgtctgaatttttctttttcccgacaaacgttattcattacttaaagagagtcattacaatgttgttgctcaagccaaataggtagagtatcagtgtcagaataaaagcatgcagaaatacaaccaaattttaaagagaaaaaagagagagaaagcatttgttattaaaaaagtgaatttgtttttaaaaaaatcaacacatatttaggctattgtttctagttatgattatcgccaaaattttcttttgttgggcttggtttgttttcaggcccaatagaaattaaaaaccatttcaaatttctactcttttcgtctcactgtcaccttctccgacggtcagacctcaaaaactcatcctccaaatttgatacctcttccctcacaatctccaacaatg

SEQ ID NO: 13042 - DNA, 3000 bp, Unknown
  misc_feature (1)..( 3000): cDNA_ID_3027781_gDNA_ID_2214592_Annot_ID_186800 3000 nt of promoter + ATG
taatactttaactcagtcatgaatttctttgccgaaatccagagactccgggtctgaggagccagtgcatatacttgcgtattatggcacttccggtccagcattatatgatgagttggaagatttcttggtgaagataagagatgggcgtttcgttcgtgggagagaaatggtattgaaattgaataagctaaagatacctttaaaatgggagcatgttaccaggattgcaggcaaggatgttgccccgggtaggatgcatgtagcccgagcgcttcttgaagcaggctacgtggagaatttgagacaagctttcactaaatatttacatgatggtggacctgcttatgctacgtaagttctagttcttcactaggttacctgatttttttgaaccttgcgggatttaagcgtttatgattatcttatgctagtctagtgcttaccttaggtgggttgtagtggactttacctctgttgacagctcatcaactatattagagaaactagagagtagagatctaacatgctaaaagaaagtttagggaaaatgagtttggatattgtaggattggttttgcatattgctttgggcagtggttgatagttagagacttctattgctaatcagttttcttatttggtgtagttcgttggtacttgtttaaaacctgtcagtatcacactgacttttttctatgtgaatggttgcataaccttattgcagagggactgagcctatggccgaggaagcagtaaaacttatatgcaaaaccggtggtgtagctgtgcttgcacatccgtgggcgttgaagaatcatgtcggtattattaggagattgaaggatgctggacttcatggggtcgaggtttataggagcgacggcaagttagaaggtctctcactctctccctccctcgttccctctctatcagtctatctatctatttgagttcactgaattttaatgttgattgaacagtgtttagcgagttggctgatacatacaatctgctaaagctaggaggatcagattatcatggaaaaggcggacgcaatgaatcagaattggggagtgtaaaccttcccgtgacggcattgcaggacttcttgaacgttggacgtcctatatggtgtgaggccattaaagcaaccatgagagcattccttgaccaaccatcagattcaaacctctccaatatcttaaggttcgataaggcaaggattctgaaaggaaattcagcttggtcctgtggtaaggagttgatggaccgatgtttagcgatttggttgaccagtgatgagagaaacagcaatgactttgaggctctcagattgaagctctcttttgtaccaatcatgtcaaacggaacatgtgtcacagttggtccttaaatatttagtctggtctctttttatcactcacttcctaacaatatgctatttccacacgaattttagtaattaccaaatcccatggaagatcacttggatataagaaacaaaaatataagagatgcttgttttcacttttaacaaacataaaagttttaagttccaacaaaatagtacacatatcaagatatatagaagaatcaattatggatttgtcgttttattggatgacatttgtggattttactcttttttgaatagtttatggattttgcccttgctacaaaaatgtgatttaacatgcgttttattcgttatgtttgggtttagtcggttgtggttgttcttaggatttagtatttcgtatcaagtacgtatttttaccaaaaaaaatcctcaatacgtacatttttatgttttaaaaaatgacatccgtaagattttagtaaaaatggtaatttcaaaaatgggctatattaatatctatgctcagatgattgaaatattaagaaactatgcatgataagttaataattaatcctctctcttcatcgatataatttctcccaaaaatacccctataaaaccaaaataacaataacaggttataatatagttgcggaagcattacatgctgaagatatacttgaagaatataccccaccgacaatagaaacataaaagattttatccatcattgctaatatttatggggttgcaagtatatcgattatatacgttggtctatttatgagcactgtattctcttccctgcaacaacccaaaaactataagactaaataacttagcttccgacaactttaatgcaagagggagctaaacacacaggaaatcaaagctaaaaggtaaacgtaaaagttatgaattgtaacgcccgtgaaccggaaaatcggttagggtttgtatttaaatcgtcaggtttaatcggttgggttaattggaaaccctagagtgtgcctataaaagaagaaaactagaaattaggactttagttagccacttttcgttttataaaggagaaaaagagaaagaaggaaaagaaccagaatcgttagggtttgggagaaaacgttttcgacatatctaatcgttgtcaaaggtaatgcaatttggtagggttatttccaagtcttttatcgctattatccagtttacagaattggttttggattaaaattagttgagttattcgcagtttcgtgagatgcgttttctcagacacgaattaggtccagcggggattgtaactgcgatcgtagtctcatctgatttccgatcggcacgggtttttgtgggaagctttttgacgtctaaggctagcgattcaccggagggatttaatagttaacggttagtttgtattttagggtttcgtctttgagactggttgtttctgttttttatgtccagtttgcttcaaggttgcttttagttgtgacttgttgtaggacgtttctggactgttttagacgcaaggagagtctctcctgggtttaattgttgttagaatcaatttgttaaggtgagtgcgtgaccatgagcttatctgagcgattgggttgtatgttttgttttgtgtgatg

SEQ ID NO: 13043 - DNA, 3000 bp, Unknown; identical to SEQ ID NO: 13041
  misc_feature (1)..( 3000): cDNA_ID_3027777_gDNA_ID_2214592_Annot_ID_186801 3000 nt of promoter + ATG

SEQ ID NO: 13044 - DNA, 3000 bp, Unknown
  misc_feature (1)..( 3000): cDNA_ID_3027828_gDNA_ID_2214593_Annot_ID_186815 3000 nt of promoter + ATG
tacttaggcttttaagatcaggttgcagtttaagttcttatactcaatcatacacatgacatcatgacatcaagtcatattcgactccaaaacactaaccaagcctcttcttgcttctcaaagctttgatggtgaagccaaagttcgtataaatatttggctttgtatcttcgaacaaggaaacactctttaggctattaagatcagttgcggttctagttcttatactcaatcatacacatgacatctagtcatatttgactccaaatcactaaccaagcttcttcttgcttctcaaagctttgatggtgtagccgaaatccgtatgagtctttggctttgtatcttctaacaagaaaacactacttaggctttcaagatccggttgtggttctagttcttatactcaatcatacacatgacatctagtcatatttgactccaaatcactaaccaagcttcttcttgcttctcgaggctttgatggtgaagctgaagtccgtatgagtctttgcctttgtatctttgatgtaggtcaaattgccttaagcccactctttcaaataagagaacgattgtagcactgaagggtcgaattccacaaagctctcggatcacacaatagaccaaggttttgaatctacatatacatttttggtagggtttttggccaaaaatctttcacctatttactatttgcaatatgagtccttacaaatttaatctcaatcaaatactttataactaaaaacttacaattagtttaattgcattaattagttgaattaactctttcctaaatttttattctcaattaaatcatttttattgaactatattcgattaaggctaatttcctaaaatatatatatcgacattaaatttaaatatctaatttttttgtcactatatttgtttatatatatatataattttgcttttagtttatatataaaacacatatagttaataaaatattagattttttttgcatctgatgaaattcaaattttttcaaacaaacatataatactccatcgatgaaaaaaaaagttttaaagcgactaatagtgagttatgaataaaaagcgactaaatccggtaatcgtaaatcgatgctaaaataaatagtcgtaaaaatagtcgccaaatagcgaatattgtacgactaatattcatagtcgtaagagtagtcataaaatagtcgtcaaatttagtgactaattgactaatctgcgattaaatttcacgaacataaattgtttgtagtgttatagtagtagagtagtcattaaaaattcgttaaaatttagtgactaatttacaactatattgcgactatggtcgtatttatgtacaagaataccatattacaaaataaaattacaaacattataaaaaataagaatacatcatcctcctaaaaacataactaaaacaaagtagataacaatctttaagaaagaacttggttaaattaattcttttgatctcaatttttcctccttgtcttacatctttcatgttttcttcttctccaaaaactgcctcatggttatttctaccagaagaaaatgctgatatgctatcataggtctggtcaagatcatctccttgcaaacagaacacaccatgagaaggcaaggacataacatcttaagacgaacctatcaacatgattctggccaagcattaaatcatgatttgccattgcagaaacaatagcacactgcttaaaaaacaaacaccgttaaaaagacaagtagttctcacactatagcaataaaagaacagtacatgtaacaagagaacatatcaacaagttctatttatccaactatagaacacaaacccacataagaccaaagcatgagagactatatcaatgtgagcttaaattaaaaaaaaaagtaaagaacttggcgagataagccaaacagttcttaaggcacaatcatcattttcgcaacttaatatcttcggacctcacagttaagaacttgaatagctacactatcataagaaacatatgtaaatttcttggtcagacaatataggcaacttggtttttaaaagatcagttcaattgatctcagctgttaaatagtttatcactctatagctaatacattaagaatgtttagagaaagataaacacagatttgactttgtagtgatcactaacctgaattggtcccttttttttatgttttctctatgaaacaaggtttgacaaaaattaacaccccattacttttttagaaaaacaaacttcgacaatatccaatcacaatgatagctttgaaaccagaaattatagacatatcaagctaaaatgatcagctcttctaattatattcaaagagaagtggatcaacatgagaaaaagccattatcaaagttcagaaatcaaaactcgtaaaagacaagacaccattgattatcagatctttaaatttaaaagcaaaaaccatgacccgttactttgtccaaagtctaagtacattcaaactatgagagaaagtaaactcgtaccttaaacccaactgaaactgttgggacttttttaaaacatctcttaggctgcgctggaagaggtccatccctagtctacaagagaaatcgagacaaagtaagcaaatatcaaaacttaccaatccaagcagtagcaacagatgctaaagaagttccaactgcatacacgaccatgtgcctctcgaacaagtcctaagtgattaaatatattagcgagatatgcgggcagtttggaacaagaagttgttaagattgttccacaagtttttgatagttgtagatttgattttttcggatcctcttagagattcttttgtaatctatttaaagcattgtaaacacttctcttgaatatatcagaaaactgaacatattttcccagtcacaatctctgaattcgcatagtaacagagcctttctcttaaaatttttgattggaaaatagagaagtgattctctacgacg

SEQ ID NO: 13045 - DNA, 3000 bp, Unknown
  misc_feature (1)..( 3000): cDNA_ID_3027801_gDNA_ID_2214593_Annot_ID_186823 3000 nt of promoter + ATG
ctgaaattatgatctatctctcgactttattgcatggatggtttaagtactacagattcaaatcaatccgactaatggaaaatccagaaagccaatcaacaaacttaaggacatccattcccaacataatccacagaggctggagctaatctcactgctcttccttttacctcatcaaaacggttagtgttcataggacttgactgcttgttcagacctagttctttcttaaagattgttatctactttgttttaattatgtttttaggaggatgatgtattcttatgttttataatgtttgtaattttattttgtaatatggtattcttttaaatataattaataaaaatatgtttggaaataattaataataaatattaatattaatactgaaataaatacataaatactgtacaaatatataaatactgtacaaataaatacaatactgtataaatacataaatacgaccatagtcgcaatatagttgtaaattagtcactaaattttaacgaattttaacgactactctactactataacactacaaacaatttatgttcgtgaaatttaatcgcagattagtcgttaattagtcactaaatttgacgactattttatgactactcttacgactatgaatattagtcgtacaatatttgctatttggcgactatttttacgactatttattttaccatcgatttacgattaccagatttagtcgcttattagtcataactcactatttgacgactatttggcaacttatcgtgtagtcgttaaaacccagttttcttgtagcacataagaattagaaccgcaaccggatcttgaaagcctaagtaatgtatcattattaaaacttatacggacttcaactataccatcaaaacgttaagaagcaagaagaagtttgtttagtgttttggagtcagatatgactagatgtcatgtgtatgattcagtataagaactagaatcgcaaccggatcttgaaagcctaagtagtgtttcgttgttagaatatacaatacaaaacactcatacgtacttcggcttcagcatcaaaactttgagaagcaaaaaaatgtttggttagtattttaggagtgagatatgactaaatgtcatatgtataattgagtataaaaactagaatcgcaaccgaatcttaaaagcgtatataatgtttcaaaggcggatcaaggtgcaagactacatacataggcacgtgccccacactactattaattgttttatgctatagttataattattcgattgttacatgagaaaatcagacaaattatctctcgtgcacttcctatcttctttcttcttattcctttgttttactttcttcttaaactctgaatcttctttactgtcctctgtttgatctccatagtctttcccgagactgtaaattttcctcttcctcatgaaaagctgttctaaacaactcataagcttcaaatgaagaacccggaatctcatttgtctcatttcttaaatccccatgaatactccagcatgaattcctcttatacttgtgatccatacctctaattaccagatgatcaagtaccgtgtctcctggttgatgacacacattgcggcaatctacacatggacaaaacatgttgggaggattacccagcttcctcgctgatgctttcacaaaatctgtggctccttgctcatactcaaggctagtcctggagaacataactaacataactaagattaagatacaactccataccttgaaagccaaacccaagacttgtccatgttacaataagatcacagctccacgaccaaaagatacatacatttgtgataaaagtttctagagttagacactataataactagacgcaatcacataacaatatgaaacatattttaagaaaattcaatgaaatatgaaggatatatatacctctaagtaacaagaatgttgattgatggatatgatacttcaaggaaacaaggaagcaatttgagattctctagaacaaatcccttcgcttcaaactgaacaaatactttaaaatttgagatacctttgatttgaaactctatcaatgaccgaaagcttcctctgtaaaactctatcaatgcacaaactgaaaacaaaatccaaatttgaaaccatcacacattcttgtcaaaacaaaaaaagctagaaaacagaagacagaagaagccattaacttgactccaactccaaaaatcgaaacattacttgtctcaatcgaacataaagaacatgttaccttattatatagctttacttctgtcgaaatctcctccctgtcaaagcaaattgaaaaaatcaaatagggaaattttaaccctaaatcaaaatcgaccaaaacaaaatcataccaattgctcacacaaatttctccttaactcgagcacaccaatctctcagcaaagcaacctgcagtcaaaaacctaaattagatgaataacagtcgaaagaaattatgaggtggaagaagagagagatgtgtatccaaacctagatctgctgaaaaccccaaattagtatcgattatctctttagaattaatggaagagagctgaagattaaagcaattgttaagaaaaggttcatgcgtgaaacaatggagagagctggagagagtagtgtggaatattgagagggtactcaattttttgtggccaaaattttgctaagtactagcgggcaaaattggtttctttctaaacattacacagcgtttaataaatgataactgctatattatatgtttaacctagaagcgtgactcagaataaaattttaatcacccaaacatagcgtttacaaattttaaaacgttatagaaaaaatgagggttgtttactatagcataaaagtataaaacgctattttatctactaatcaaatcaccactcatgaaactgtctctgctccagcatcagaaatagtaatagtgaaggaacaggatgttcacatg

SEQ ID NO: 13046 - DNA, 3000 bp, Unknown
  misc_feature (1)..( 3000): cDNA_ID_3027817_gDNA_ID_2214593_Annot_ID_186818 3000 nt of promoter + ATG
gtgaaaagcgaactcaacacttagatttcacagaaatgaatatatttttccaaaaagtgtaacttcgaaaaatccttgaaggataacttggaaaaatccttgaaggatgaaatctagtcatgtgaagagcgagctcaacacttagatttcaccacagtaaatatatttttccaagaggtggaacttggaaaaatccttgagggatgaaatctagtcttgtgaagagcgaactgaacacttagatttcaccaaaatgaatacatttttctaagagaaggaacttggaaaactacttgagggatgaaatctaatcttgtgaagagcgaactcaacacttggatttcaccgaaatgattatatttttccaagaggtggaacttggaaaaatccttaaggggtgaaatctagtcttgtgatgagcgagttcaacacatagatttcaccgaaataatatatatttttccgagaggtggaacttggaaaaatccttgaggcatgaaatctagtcttgtgaagagcgaactcaacacttaaatttcatcgaaatgaatatatttttccaagagctggaacttggaaaaatcttcgagggatgaaatctagtcttgtgaagagcgaactcaacacttagatttcaccgaaatgaatatatttttccaagaggtggaacttggaaaaatccttgagggatgaaatctagtcttgtgaagagcgagctcaaaaaatagagttcaccgaaatgaatatatttttcaaagaggtggaactcggaaaaatccttgaaggatgaaatcttgtcttgtgaatagcaagctcaacacttagatttgactgaaatgaatatatttttccaagaggtggaacttggaaaactttttgagggatgaaatcttgtcttgtgaatagcaaactcaacacttagatttcaccaaaatgaatatatttttccaagagatgaaacttgaaaaaatctttgagggatgaaatctagtcttgtgaagagcgaactcaacacttagattttaacgaaatgaatatatttttaaaatatgtggaacttggaaaaatcctccaaggatgaaatctagtcttgtgagtatcgccgtacggaactctcaagggattttcagctcttcctccgaggaacttgatgatttctacggacgagaagaaaccgcaaattacatggggccaatgaggagccacccgagagtctcccaaaaccggagctttaggaaccgagggaaaatctcaaaccaaggtaatattcaacaaaggtctattcttagcgagtttcaggaacctcagtgagaattgcctattccaacaccggcaaatgagaactcgaccctagaggttttgatcaagagactcgaagctagttttcaagaatgccaaaaaagtgtcgacgcctcaatccagatcatgcatgaggacttaaaaagcaaaattaattccctttagaggaagttcgaatacttgtcttaataggaaaatgagactacctgcctgattgagtcatacgagaaatccttcagaacagaagaagggcacccactgatcggtgcaccattgcaagccataacactgaggagtgggatggcttacagacaccagagtatccgaaagatcaggaggaggaagaaaaaccaatccaagcaagcctgtgagacctgtcacgatccgaatagtggaagagacccagaacctcccatacacattcctagccaagaagccgaggaagaagtaccgccaagccgcgaaagcactactgcgaccaatcttatctctccctcggaccgtatctactgacctaaggtaccatacccgaatgctgggaagagcaccaagaaggagaaagctaagcaacgagagcttatcgggtagttaacggtaaggctaccttttgttgaggcttgtgccatgatccccactcttaggaaataaatgaagagtatcttaaccaacaacatcagcctagaagacgaggtaatgatgatgacccaagagtgtagcgccatcctgcaagaccagacgacatgaaagaaaggtgatcctgagagttttgtgttgtcttgtgctattgatgatgaactttttgagtgatgcctatgtgattgaggatcaagcatcaacatgatgccgctcacagttactaaccgtcttggatactacaccttcaaacaaactaaaatctccctaatactggcagatcgttctatccgccatcctgttgggattttggctgatattccgataatgattgggggatctcaaatccctattaattttgttatcctggaagttcacaaagagcataaggaccactgatccttggccgaccattcctgtctaccgccagcgccattatcgatgtcccgaactgaaaaatcgaccttcaccttggcgatttcataatgaagtttgatatgaatgagactttcaagcaagcttcatctcatgatcagattatctatctcgatgagatagaagaggcgtctggtagaatgtgtaggggaaatcattctggaggatcccctggagatagctttaatagaagaaaaggaggagtatgatttcctagtggattttgtagacggttcaacatggatgctggattccgctataagataagccaccaaaggatacccaccaaaggatacgcctgcctcctgggccgacctgataagtgtgtattttgcatgttttgagcatccatttgtcatcactttagcatcatatcatcactgttatatatcatttctcatcactttgcatgtttaggatagttttgcatgcatgttgcatatttgtgtttttcaggtgatttggagctgttggcgagctaattggaagaagcggacatgatcatgtcaaaccactcgaccccctggtcgagtagaagcttcacgacctcaacagaccactcgaccccttggtcgagtagaagacttcatcaattcacctcaccactcgacctcctggccgagtaccaccatg

SEQ ID NO: 13047 - DNA, 3000 bp, Unknown
  misc_feature (1)..( 3000): cDNA_ID_3027824_gDNA_ID_2214593_Annot_ID_186816 3000 nt of
tagagaaagataaacacagatttgactttgtagtgatcactaacctgaattggtcccttttttttatgttttctctatgaaacaaggtttgacaaaaattaacaccccattacttttttagaaaaacaaacttcgacaatatccaatcacaatgatagctttgaaaccagaaattatagacatatcaagctaaaatgatcagctcttctaattatattcaaagagaagtggatcaacatgagaaaaagccattatcaaagttcagaaatcaaaactcgtaaaagacaagacaccattgattatcagatctttaaatttaaaagcaaaaaccatgacccgttactttgtccaaagtctaagtacattcaaactatgagagaaagtaaactcgtaccttaaacccaactgaaactgttgggacttttttaaaacatctcttaggctgcgctggaagaggtccatccctagtctacaagagaaatcgagacaaagtaagcaaatatcaaaacttaccaatccaagcagtagcaacagatgctaaagaagttccaactgcatacacgaccatgtgcctctcgaacaagtcctaagtgattaaatatattagcgagatatgcgggcagtttggaacaagaagttgttaagattgttccacaagtttttgatagttgtagatttgattttttcggatcctcttagagattcttttgtaatctatttaaagcattgtaaacacttctcttgaatatatcagaaaactgaacatattttcccagtcacaatctctgaattcgcatagtaacagagcctttctcttaaaatttttgattggaaaatagagaagtgattctctacgacgatggcagcgatgaacccatcaacgaacccgacgaccactgaagtccgacgaaccatatccccctacgacaaccccggtgctgtgatttcccacccgttgctgcaagcaacaaactacgatgagtgggtctgtagcatgaaaactgcattgtgctctcgaaagaaatttggatttctcgacggctcaattgcacgacctgcagaaaactctcccgatttggaggattggtggaccattcaagcgttacttgtctcttggataaagatgtctattgatccaagtctccgatctaacgtctcacaccgtgatgttgcgaaggatctgtgggaccatctaaagaaacgattctctgtcactaatggactgagaattcaacagatcaaagccgagctagcatgctgcaaacaaaggggtctagccattgagacctactttggaaagctaactcgcatttgggacagtatggcgaactatcgtcctttgagagtttgcaagtgtcgtaagtgtgagtgtgatcttggcacacttcaagagaaggacattgaagaagacaaggtacatcaattcctttttgggctggacgatacacatttccgaacagtgaggtcaagcttggttttgagagttccgatccaatctatggaggaagaatataatatggtacgacaagaggaagatatggtaagaaatggaatcaaaggcgttgaatagagctcagaagtaaacgcatttgctgtccacaccactacaccatttcaaagagatgagagagataagtcagtgttttgcaaactctgcaacagagcgggtcattctagcgacagctgctatggcgtgataggctatccagagtggtggggagatagaccgagatctcgctctacgtctagctgtggtcgtggacgtggaggctcaaacagaggggctggaaagagtcgtggcagcacctcgtacgtcaacgccgtcggagttaatgaaccaacaggttatgcagccgctaactacgtcatcaccgacaatgacagagatggagtgaccggtttctccgattcacagtggaaggtgattaagaatctgctcaatgctaacactagcaaagtctatgaatccgaaaaactgacgggtacgtactcttttccctcttggataatggatacaggggctacacatcacttgacgggtcagttagaaatcttaacggatgttaaagatattcaaccagttggaattgtgttagctgatgggagacaacgagtgtcagttaaagaaggatcagtgaggcttgggccgaattggacactaaaatcagtttattatgttgatgggtttcaatcaaatttgatttctctttgtcaattgatggatgaaaatcgttgcgtagtgcagttagctgatcatttccttgttgttcaggaccgcactacgaggacggtgattggagttagtaagcaaaagggagggaccttccttttttggagtttggagtctgtaacatctgttgaagttagagatgagaagtcattcgagttgtggcatcaacggatgggacatccttcagctaaagtagttggtcttcttcctttaatctcaaatgttatttcttctgaaattttgaataaagcatgcgatatatgtctccgcgctaagcaaacccggttgtcttttccaataagtgagaataaaacgaaaaggatttttgatcttattcactgtgatttatggggtccatatcgaactccaacacactctggtgctcgttatttcttaactatcgttgatgattactctcgaggagtgtggttatatttgcttaacgaaaaatctgaggcaccaaatgttttgaagaacttcatagccatgactgaacgacaattcgaaacccaagtttaagtcataagaagtgataacggctctgaatttgttagtttgaatgagttcttcaagaaacaagagattgttcatgagacatcatgcgtcggcactcctcagcagaatggacgggttgaaagaaagcacagacatattctaaacgtggccagagctctacagtttcaagctaacttgcccattgagttttgggggaatgtgttctcagagcggcatatttaatcaatcgaacaccgagtatggtctggaaagga

SEQ ID NO: 13048 - DNA, 3000 bp, Unknown
  misc_feature (1)..( 3000): cDNA_ID_2713041_gDNA_ID_2214594_Annot_ID_135444 3000 nt of promoter + ATG
gatgagtctcacaataataggaaaggaaataaaaccctaaccaagtaaatagtttccaaaatcaataatataaaaaaagaaatgatcctaatagaagaatatatccttctgccttcatgtcaaaatattcgtgatgtgtatttgatgtgtactccgtgatctaaattagttgcttggagatatggttctactcatatcatagtctctagccatatttaacaagcactatccttgattgtctgaatgctttatcaggtttacctttgtatgcgttttcttttcttttttctttttttttgttagcaccgtttaatttgtgttaattgtaaaaatctatatgttaaatagaccatgcaacctgtatcgtagatcataatactttagcatcgtttggacgatattttacgtgcatccaatatctagagtttggctgaattgtcagccatatactagttgcaatctcaacatttcaccataattttttttgtttcttaaataactacaaaaaaaagaaaaatctcgataaaattatatatatttttagatttgtttttaaaattacatctccatgaaccgattagttaaccgataatatgaaaaacattcatttgacgttttatagtgaattagttaaaaaatatatatggttttatatattacgagtgtgatcgatacgtaagaaacaattcctagtaatatatatcttttttttgtcggttcctaataatatatatcagagactaatactggagaatttcctagaaaccttacaactttttttcttgtagataattgcgaaatgatgataatttagctttttgacatggacaggtacgtgtcatatctctctcaaatcacatcaaaataaaagttcgttccatatttcgttaattcgttccatttaatttttaaggaaacatgattttttaatggaacatgttattctaacgtggttatgtgaacttctaaattctaggttatgacatccatttatgtaaaaaattagtatattatatttttaaaagaataaatatgttacaaaaaataagattgcaattttcataacatttaaatgtatgccaaaattatcctaaaactaggtcacaacatttcttttttacttttactccaaaattttgtcatcccacctaattatttattatttagatggtagtacaaccttctagataatctttactctttacaatcaacgtgaaaggaaacgacaaaaaaaatgactcttgtgtcaaagagaaaaggaagtaaccttccttggccacgtctgaaaatgcggaaaaaggactttgggtcgtgacagtgaaacttagagatcttgtcgacaaccagatcgcttcacttgattagtgatactttatcatcactattttagtatttttcgtgtaattttaaatttcatgctctctcttggacttggtccgctaatgattccgatttttatacagcttatcaatcactgtaggagtatcattaaaatttatgtatttttgataattacgaagttatcatatacccatttggactctagcctctctatatcataaaatcagttatgtgaattgtagtggctagtagaatatgagttagtataagtgtatttgtttgttttattagtcacaagtcgtttgtcttattctcaaatagtaatttgtatagatatatagatagatacaataaagtatcaaactagtagaaaatcggtacccaatctaattcattagtaatcaattcatatctaacaatattttatgtgttaatatattggcaacaacttcatcaaatatgtggcaacgattacatcaacgtcgtaaaaaacgtggcatccacgtcagtagccatgagaaaagatatatggtttcacacgattcaataaatttagatataaagtttaaattattgaaatattggatatatattagcatagaaatgtttgtagttagaattaaatacagatactttactttactatgaaatgaccgaactttgttcaaatttgccaaaggcaaacgctaagaaattcacttttgagtaaaatgcaagtagaaagatggtacctacaagactacactcagtgacttggatactgattaaataaattgcatggatagatatttcgatcgcggtcggcatgaattaagtatctatagccaagcaatttgtcagtcaaaagctccattagaaatttaattagaatatttgtattcacgatagccaagcaaaagttttgcacgctctaaaatgaaagtcctatagtagtttctacgcataacgcattgctctttttatgctatacttactattgttcagtgcatatagatttgtctctatatatccctctgtcggcagagatttcaaaaaagatccttaacaagtatcattagtgcacgccttaactatccaaatagtaacaaacttaaacaatagaaaaacttgaaaaaatgtatcaattttcaaatttgatacgaaaaaacttgaacttttaaaatattatttaaatcataaagttttctttgatattttttgtaaaatagtcaaattttgttgaattcaccatttcgaacatatcgctaaattttcataaataaaattaactttcgattaagagaataaaacaacgtcgttttatcaactacaaaacatagtcgttttgttaaaaaagcgtagtggactggagttgccattcacgtttattcatatctagttacaatgaatccaacaacggaccataaggggcccgacgcaacacgtataatactctgatacttatcttcttaattactacttaatttgtttctactgtgataaatttcctttaactttacttttgataaaatattgtcttctttttattctactacggagtagttttttgacttttctcatttcctattctgttcgtttctataaatagagggcatgcaacgtaacatattactcatcacttacttaacatactaagagagttattagaacttgcaaaaa

SEQ ID NO: 13049 - DNA, 3000 bp, Unknown
  misc_feature (1)..( 3000): cDNA_ID_2710341_gDNA_ID_2214594_Annot_ID_135452 3000 nt of promoter + ATG
tgtaaactgatatataattaaatataatatgaaaattcgtcgttaactaattattatgaagttttttctctcttctctctttcataccttttagagagaaaaacactttgattctatcgattggatttttcccgtgaatagccgtctctagtgaatcgagtttttgtccatcatcttgtggctccgttagccaagatagctagcttctgtctggcaaatctagcttctataagcagttttggtcggcttttatatttgtttttagtttttttttatagattttaattgatgattcgttttatagattttaattgatgattcgttttaggtgttagtcacttaaaatcaatctatcgacttgtatctctggaagctcgatcttgcaaatcgcctaaagtaaagagaagaagagttgtttccagcaaatttggattgccatagccgtctctagttgtttttggtgcttcgatcaaacaaaattttgtgaattaatcagaatttttcctttttatcttatagggttgaatgatctgttattgatttacttctctatgtctatgcagaatctggtgaaaaacaaagtaaatcgatgtttaagaaatttacagcatcgattgagttcaccagaatcggaatcgttgacgacaaagattaaccggaatgtttaacgcatctctcatacgtgtctgtttttattacatttttggattgtaggcctgaacctgtacactttgtttatgaatctttaataatagataaaataaaacacttattattccgagcacgggcttgcatatggttcggttaagttcctgtttttcatatctttctttttatacgatttgtcagcatcattcagccatcgttattgacttgttgcctttgaattttgtatcgaaactaactaaataattcattgaacgagtgagactctaacacttgcatggtctatgtttcaggagagcttagatgtgcctataatcatcactaaccacgagacagctcactattagcattaaatgttaatacacatttcgtttctaaattctaacctttacgtgttgggtgggataaacaaacccgagactccacatttttctactagcattgacaatctgtccttatcacaagcttaaaggagaaaaatttgaacacatttttttagaaaaagaaaaaaacaattattgttgtcattaataaagtcggttaaattatttaacacaaataataaataataaaaataaaggataaaaaaaactatttcgacatataacatgtttcatacgaaaatatataaatgatatgttgtccaaacatatagtactttataggactatcacttttgtaaggattttggagataacgactactaagaacatttttaatggaagattgtattgaaaattttgtgaggttatattggatgaaaaattgacagaacccgttttgtgaagaaatttttgagaaaatggaaaaggtggacatgtgttcacatgcatttgattggatgtttagttttaataaaagaaaaaaaaaaaagcgtatattgttatctttacaaaagaaactcggattttctttctctctatttctcgcacgaagataaaaaccggtgaacttttgatttcctatgagttaacaccgttttatgtgtatatttgtggtatttgaggcttccaaacgctcaatttattaatttgacagacggtgttgattatcgctggaggaagataaacccattcagagaataacgaatctgatttggagagttttcgttgaaggaatgtctaaattaggtatgaatcaagccattctagcatgtatatgataactaaatattgtattttctagttaatatatgtaattttaattttatttaatattcttaagataaatttatcatgttcaacatgtgctactgtatttatctaatcattttaaatttgactaatatttaaaaatgcaatagttttgcttaaacttaaatcaaagtattattcctattttcgaaagtttgtgttgttatttatagtataattacatttatttaatttttataaaaaatatattttgcataatacacggtatagtgatccggtatatgacctgacgggttttaatataatacaagacgggttttattgcggaacgggttacataacatagcgggttaaaatcgatattaataaaaaattaaaatatttttgacaaaaaataataataattaaaatacatcattagccaacgctttgaaaaagttaaaatcttcattttattaatttgtcaaaaccaccaatattattttatgttgaattaaactaatttcattaattaaaatatatgaaacagttttttcgaattttaatgcggattaaaacctaattttttttttgttatttatagtattatatttatttaattttcataagaaatatattttgcatccactgaaaatatttcagtattttaggtcctgtaaatttgcaccactttttaaagccgtccgtaagtgtagccctttgatgatctatttattgatcagtatcactttacataggtttaaaatatgtcgactaaaaaaagggtcgtatccataacaagtaccaagagtggacgacttttcttttctgtccaaaaaaacaacaacaatgataatccaataatgaagtttttgcatatcaatattgtttaataaatttatcgaaatatccaaaagactagtgggtttgccatttatggagtttcaaattatttacaatgcgtccaacatccaaccagaataaggggaccgacgcaattaaactcatatatacttagacttttctactttgttttaattgtgataagttccttttctctttattggattacggataagttatttgacttttctcattccctcctcctcgttttctttaaatagaggccatgcatggtaacattttatgcatcacttgtttctccataataagagagttttaagcatttgaaacaaaaaaa

SEQ ID NO: 13050 - DNA, 3000 bp, Unknown
  misc_feature (1)..( 3000): cDNA_ID_3434336_gDNA_ID_2214594_Annot_ID_186855 3000 nt of promoter + ATG
tatggttttttggcaaggttgtttgttgattgcattgttgtatctaccagttttcttcgttttaattttcaagacagttatgcgcctaagttgttgctgaaagctccatcggtttaatctccacgcggatttccttagagttcgggaggaaattactttgagaagttcttttctttgcagatttgataatgaagattggtgagattctctaattaaaaaccgttaagacttctttgcttgaagatctggcgatttctgatgattttggagtttcctaaggattcttaccaaatcgacaatgaccaacaacgatatatgcttcacatgtccatgcgtcttaaccttgcttcatagtctcacatgtggctttgcgttggaatctttaaatcttacttctacaaagggtttagtttcctagattggactttctttaagttgggcttcttcttataagttaaacttgttggttctttggttatgcaacatggatgcttgtttagataatctaatattgtaaaatttgatgtgtttgtcgagtcatgtaagtgaaagattccacttttgcaacaaaagttttaaataaagtgcaacatttatgagaaagaaaaaaaaaaggttttatgcaaaaggactctccaaatgattttttttgctagacaaacatccatctcaaaaaaatacaggtcaatatcacagtctcaaaagtcacctacaatatagtccttccgtatatcgatgacgtaacagtcgataactccgttggaagacataagagttttgttaaacaaaccctccatatatttttttatttttgcaagacaaacctcaatgtcaaataaatacaatattacaatctcaaagtcacccgcgatatagtcattttgtatagcgatgacatgacaatcgataattccgttaaaagcataatggatatcaaaatagacctttgttttgcttttgttgaaaaccacatgattgtgtgagtttcgttattagaaatagaattgagggaaataattagagttctttcatattatatcttcttctttattcatatgaagtttggagattcatttttcttttccatttcgatcttcatccatttcgatgtatgtgtttgttgaattgtgttccacatgatcaaaaatcttggtttgattttaagtgattcatttacagttttgaagatcccaatgaaaaataaatatgaatctccaaattttcagataaataaaaattcaataattttggtgtatattgttttatgggtaatattagtagataaccaaataaaacatacaaattaagaaactagcagagagaaagttttttgttacaaaataaccatggatcccacgttgtcggaagaaaggaaataacaaatctacccttcatttgttgtaagatgaacagtaaacgaaatacatccgtgtaatttttcaaaatagcatgtaacattaaaatttcacatgttatatttagtttaaaaacatgctatttcaaaaaacgttatgaatttttaagaaaaaatattcttatgaaattcttttacgtgaacagaatcttaaaaaaaaaaaattatatgtgattttaataaaaaccatgtattactaaaaaataggaatatatttttaaagaaatcacgtgtgatcttaataaaaaacgtgtattactacaaaatatcatgataaaaagagatattaaactgaatagaatgttttttccaaaaaataccaggtgctttttaataaatactatgtaataagagaaaataacaagataaaaagaggatattatgttatcgcatgtatttcggaaaaataacatgttacaaaggacatttacgtaattacacgtgttttccaacatgtttccgacaagatactgtgattcaaggttagtttgtacattcttttcaaatctatagtcatttattataaatactcttgttttattgtatgttttctaatgtagttattggttgtcatgtcatcactacacaaaaagataatattatgagtgatttttaagattgtagtgttgacattcatttatttgatatgaagatttttttttacaaaaaaagtttacatagaaattttttacactaaatctttatgtttttaatagagttatcgtctatatcaaacctacatttatttgacataatagtttatcttataaaaaatgacttcatctgttcttttttatttgattggttaggaaaaacacacatattaagttaaacatattaaaattgttaaatgtattattttttgtattttacaattttttataactttaaatcaataatattcaattatttttatcaaagtttataattaattaataataactaataaatatttcataaaaaatctaaaaattaatcttttaaaaacttatttttttcaaaaaacagagagtgttaaatagatagatttttttacacaaaacccaaaaaaaaaaactaagaccttgaatgttttttagattttgtaagagtttttgatttttgttttttaaaaacttattttaataccaatcaagattttaaaattttggtttccctacaatttagtaaaactattttattgtagttttccattcatatttaagttttttagtttttctaaagtttagaaaatctagtttttactcaatcaacgttattttttcaaaaaccaaaaaccaattttttaggggtttttaaaacaaaaatataataacaaaaatctaaaatctatagactaaaatctaaactcaaaaactgaatcgaaaatatccattcaggcctaatacatccaatatttcaatacttcttaactcttaactcttaagttttaagtaattaaatatataaagatctgttgccaagcgtaccctttttataaacattccaaataactatctccattctttggagttacccaatttcgacgttgaacacaaacccttgcttctctcttctctgtttctctctcgcagcgaaaaatcatg

SEQ ID NO: 13051 - DNA, 3000 bp, Unknown
  misc_feature (1)..( 3000): cDNA_ID_3027905_gDNA_ID_2214594_Annot_ID_186847 3000 nt of promoter + ATG
ccacttttgtagaaaggggtaagcctcacgttacttttccaaagaacccaaatcctgcctctcctattaaattcataatttgttaaaaccgaccatcctggaaacaacttttcactcagctcctgcatcttattctcctggacccgtgtttcaagtaaacaaccaaattgaaaattttgttcttgaacccatttctttatgattggatgctttgcagattcgtttaaaccactgacattcaagaagaaacccgtcatttagcgatgctttggagggagccctaaactctgaccactaggagtgtgcctagttgaaggagtagaaggattggagagcactttatgtgcagactttgatccacggggtaaagatgcccgaggtggcagctctaaaacccgtgaccttaccactgagtttttttttccttattttccacctcttgtgtttgagtatccgcctgtttagacttctcctcaggctcgtgaggttccatctctttagatatttcctcccctatatcctctgcgccacgaagtacaaagtatgagtttgataaaatagaaacttctccaaacttcaatcctacatgacttttcccggggctaagcgtagtcttaggagtgatccatccttcatcctctcctctctctacctctacttcccccggagcgttagattgaatcttaggcacctcatccaaagttacatgaacaacttccttagcttttcccgtaattggagaggatggctgaactggttctgaagcaactgcgggaatggttacaaaatcactattccccgtgctggttttctcaatagataaacatgtttctttaagatgaccccatttaccacatccattaaatctcggaggcagccaaggatatgaatatgtaataacagcatcgagctctccttcttcctcacccgtgaatacgtactctctaggtagatcttttgttaggtctgcttctattaagatttgtgcttcatcaaaactcacacaagcttccgtttttggatgtaaccgtattggcttacccactgcactagccaagaactccaaacctttatcagtgaacattgacgggggaacatctgtgagagtaaccaaaagctgaatggatttcatagctggttgagaatcttcttgaaaaggcgtccacttcgagagcaccatcggaatgtccataatgttccacattcttctattcagcactctcctcctcattgcctcattccttatgcgaaatttgactgttgttgcgtttacttcatacacatcaattaagtttaaattatctccaaattttattcacaatcatgtgaatctttcccacatgcggggccttcgtactaaggaatcgaccaaccaaaaaatcctcccagagaggttttgcacctgcaaaaaacctctttcggaacaaccactctttctttaccatcaactgcatctaccacaaacttttgttttgtgaagatatgtttttttgcagcgttgagccatgatttcttaactggtggagacaccacctcaacaactgttggagtagcatctagacctaacgagatctgctggtctgaaactgtctcacttgtatccgacaccaaaaccccttgctcacccttcttcgtatcatcagatttctcctcctgactctctagaatcggtaaactgttagccaaatcaatggccgacaccgaaacctcaccggaagtgactggagaggctgtcggctgcagcattcttgcttggtacgcaaaaaaaactaatcgcctttttttgtctcctgccacgtcagccctttttcttctttttaacctttgtctttctctttcttctttgtttgatttctctctcgtttttaccactcttagataaattataggtatgctgccaatctctctcttgataaatctaggctgccaagtgttcttcatattgatgggttttctctccctcattttgtagataatctctttatttctttggtcggaattcaatctttcttaaatttttcgttgtcatgtctttttctataattctttgtcactttcttccgtaacatgttatttctttgaattacacgtaatagcagaatatctctctctttaaaatgttacttttttgtattacatgttatttattaagatcacatgtaatttgtttttaaaacatgattttaatgttaaaacactttatttttctacgcttttctttaagtataatatgatttttttttattaaatgacatgttcttttagagcgataagaaaaaaattacaagtttttctttatctttaatttttcgtagtgcaaatgttaaatcagattctttagtacaaaaaattcgtaccgaaccgcatcatattacctatgtaaacaatatttctcaaagataactcttttgaacttaattattattggttgacaaaaaaacatgtttttttcacaaataacaatacgctactgcatttttgtctatgtttaagaagaaattttcacaaaagtggacgaaaaaagatttgctctaaccgtttgtcaaagtgagaactggttttcacgttttgtcttttcattcaatttcggaccaaattaccctgggaaaacttaataatggcacaaaccaaaccgtgcagcagttcgtatcggttgagttgacggcgtaaaccaaaccctacagcagttggtttcggtttagttgatgcggttcagttttgaaaaagacaaaaaaaaaaaactgaaacgaagaaacccgagaaaacgataaagagaagagagtaacggagagatttgagagagaatcagaaagcgaaacgaaattaagtatccattgcttcaaaattcaacataacttcgaattgttgggtagttgaattgagccacagaactcccacatccggggaagtgaaagttaatgtttttcccagcgaagccaagagaaagttactgtttattccggcaaaatttgaacctccggcgagatagcatctttagct

SEQ ID NO: 13052 - DNA, 3000 bp, Unknown; identical to SEQ ID NO: 13049
  misc_feature (1)..( 3000): cDNA_ID_2710341_gDNA_ID_2214594_Annot_ID_186841 3000 nt of promoter + ATG

SEQ ID NO: 13053 - DNA, 3000 bp, Unknown
  misc_feature (1)..( 3000): cDNA_ID_3027851_gDNA_ID_2214594_Annot_ID_186831 3000 nt of promoter + ATG
cgcaaggcaatcgggtacgtaaaatattatacatttcagcctgcttacaaaaaacgaagatatgttcgtgaggctagctattcaaacttgaactaacgtaccatttgataaatttatacaactatttcgccagttccattttatggacttacaatatagtaaagtcagaacacacttcacttgagtgatgtggaatcctaggaagttttgtgtaaattatgtttcgaacgtatatttaaaaactatagtttcgagtttatatatgtactttaaaaaaaaaattgaggtggaaaactaaattgaagtcaggaagagggcttcacattttcacgtgcttaagaatgtctttgaaataacgtgttttttgggcaggcatggtgaagccagagagtgaggaaactgtgcaacctgaaggttatggcggtggccacggaggacatggtggtcacggagggggaggaggccacggacatggaggacacaacggaggagggggccacggacttgacggatacggaggaggtggaggacactatggaggaggtggaggacactacggaggaggtggaggacactacggaggaggtggaggacactacggaggaggtggaggacactacggaggaggtggtggaggacacggaggtggaggacactacggaggtggtggaggaggatacggaggtggaggaggacaccacggaggaggaggccacgggctaaacgaacctgttcagactaagccgggtgtttaaaactatataatatcttcactaccatgcatgattgcatatatatatatacgcttatgtattatctatatgcctataaataaaccatggtgagtttgtaacgcagtgccttcagaaatgttcggaataaatttccataatattagtataatgtctctctgtttgaattataaactgcgctgtttgcataataaaatctcttgtagctaggtcatgttactctctttcagtttttctttgtaacagtattatatccttattcatattgttagggaatatttttcttaaaagattaccaaaagcctgcaggaataaaaaaaaatgattactaaaaacctagagactatcgaggttttgcatacaccaacacttacgaagttcattaaatatatgaaaccgatacgagagatgggatcatcagagaagggagataaagacagtagaagcttcttaattgtcgcagttatgttctgatcttttccttatagaattagacttttaatattttcgtttttagttttaacttacgtcggttgtaagagatctatatataatcatcttccaaacattacccttattttcaaggctttgcttctgttgggtctcttcgcagttcttctcgtcatctccgaagtgtctgcggcaagtaaaattattgtatgcatttcaatctactttaaagaaacaagatatatgataaaaatattttatacatttcaatcatccaacactaaagtaccatttgataaatttacatcacttaagtgaagtgtggaattctagtaccattttagaagttgtgtgcatattatgtttagaacgtatatttaattttgtaaaccttttttgaaaaaagcattaatatactttcaaatctttattgaacgcacatttaacattttgcaagtacatgcttaacaatatctttgaaataatgttttatttttaggtaggcatggtgacaccagagagtgatgaaactgtgtaacctgaaggttatggcggtggccacggaggacaaggtggtcacgaccatggaggacacaacggaggagggggccacagacagacccggtccataagggccattgaagcaatagatttaggcctcaatatttaatggctttttactttaaatttattttgagtcctttaccataaatatatttttagagccttttaagattttgtttaggcatttagatacaaactaattagtatctctaatagtgaaatttgatttattgtgaaatgttttttcaaaattggacttttcaacattttttgggatttattttgttgtttaagtgtatttttgaaatttgttttgttgttaaagtgtatttttagaggtttaatgtatattttattattatttatgatttttcataatgtataaaaaggactgtttttaagctttgcttaaggtatcaagatatgtttgatcagcactggccacagacttgacgcatatggaggagtggaggacgtggaccatgtggtggtcacggtggtggaggtggctacggaggaggatacggagttggaggacacatgattaacgaaccagttcggactaaaccgggtgtttaaaactatataatatattcagcaccatccatgattgcatcaatatatgcaattatttattatttttatgcatataaataaccatggtgagtttgtaatgcagtgctttcaaaaatgtttggaataaagtttcacaatactaatttccgctgctcgcacaataaaatcgtttataggtcatgtaactctctttcacttttttcttgtaacatatttattttcttatttataatgttggaaatttttcttttaaagaaaattttaccaaaacctagagactaagactatcaaggttttgcatatacctgcacttaaaaagttcattagacatacgaaagttccgtaaagagccggttcagtttccttaaccgttttctggtttcaaaataatttaaatatttaaaattattaattttaaaacttaaattaaataaaaaaactgtcttcttcgagaaagcagaacagttccgatgaaacgaagagtgatttcgaagaaccagagaaattccgacaaaactgaaacacaattccgattgaggctctgttcgagttcgagtcgttgctaaagtggagaaaatttcgatagagttcgtgttaaagtgtggaacaataatacaatttttgggtttatcgattgactgttcagagaagagctcta

SEQ ID NO: 13054 - DNA, 3000 bp, Unknown; identical to SEQ ID NO: 13048
  misc_feature (1)..( 3000): cDNA_ID_2713041_gDNA_ID_2214594_Annot_ID_186829 3000 nt of promoter + ATG

SEQ ID NO: 13055 - DNA, 3000 bp, Unknown
  misc_feature (1)..( 3000): cDNA_ID_2710348_gDNA_ID_2214594_Annot_ID_135455 3000 nt of promoter + ATG
gacgatggatagaccactcagcaaatgtcctgttaggtacatcatcaggtcctagcttagaattgatgggattgtttcgaaagctaaaagctggagagctaatgggaagccatggagtgcataagaccctacaagtaaaccccttattagttgttgagcatcgtaaggagtttggaaatttgttatcctccccaaagtacgggtaaaggacacccttccccatgggtatttgcagaagaactccaggttcttagtcatctcgacagtcttcgaagtaggcctgttggggttactgtgggccgctaccacaccgtcaaccaaaataataagagatagtgccagttgctttcacccctccatgctttcctcctcctgcagccagctcaccaaatcagcaattgttggaatcgtgtccccaaacctctcatcaaacagagtcttccaaacactctcacactcaggtttcacactgataacatcatcaacgtctttcttcttgggatacttcccacattccagcccagttaggataataaattctcttaatccaaatctaattggatgaccgccgaatacaatccacatctcattcaccttctttgtcactaactgacggcatattagtccaaggacaagcttagcattgaaagatgccttgtttttgggtattttaaaaagttccccaaatggagaatcgagaagaaactgcatctctggtttcccctttagtacatttgctatgtcaaaaatgtacttcagtttagagtacgcgttcatcttcgtctcggaaggataccggtctagagcaaagagtcttggtggtaactcttcaactgtaagatcttcagtcggagcaacacttggactacctgcaattaaaagtcatatattgttaagcaaaccgaagtagtgtacgtacacagacattttccagattataactcaaaatcatatttttggcggaaacagagatttccaattctacttctcaatttttcatcctaaagatatgctaaattccgacaaattctaaccctttaatcaaacaagctttacaattctgatacacccaaagacaacaaacggaaaattagagattctaacccagttcctccgttgcctttgtcgcagagcgttttctccgcggggaaactcttaatacccgcttctccttccctggaccatgctgcttcctcgggacttcgtcgttagctttattcccagccatagctaaagatgctatctcgccggaggttcaaattttgccggaataaacagtaactttctcttggcttcgctgggaaaaacattaactttcacttccccggatgtgggagttctgtggctcaattcaactacccaacaattcgaagttatgttgaattttgaagcaatggatacttaatttcgtttcgctttctgattctctctcaaatctctccgttactctcttctctttatcgttttctcgggtttcttcgtttcagttttttttttttgtctttttcaaaactgaaccgcatcaactaaaccgaaaccaactgctgtagggtttggtttacgccgtcaactcaaccgatacgaactgctgcacggtttggtttgtgccattattaagttttcccagggtaatttggtccgaaattgaatgaaaagacaaaacgtgaaaaccagttctcactttgacaaacggttagagcaaatcttttttcgtccacttttgtgaaaatttcttcttaaacatagacaaaaatgcagtagcgtattgttatttgtgaaaaaaacatgtttttttgtcaaccaataataattaagttcaaaagagttatctttgagaaatattgtttacataggtaatatgatgcggttcggtacgaattttttgtactaaagaatctgatttaacatttgcactacgaaaaattaaagataaagaaaaacttgtaatttttttcttatcgctctaaaagaacatgtcatttaataaaaaaaaatcatattatacttaaagaaaagcgtagaaaaataaagtgttttaacattaaaatcatgttttaaaaacaaattacatgtgatcttaataaataacatgtaatacaaaaaagtaacattttaaagagagagatattctgctattacgtgtaattcaaagaaataacatgttacggaagaaagtgacaaagaattatagaaaaagacatgacaacgaaaaatttaagaaagattgaattccgaccaaagaaataaagagattatctacaaaatgagggagagaaaacccatcaatatgaagaacacttggcagcctagatttatcaagagagagattggcagcatacctataatttatctaagagtggtaaaaacgagagagaaatcaaacaaagaagaaagagaaagacaaaggttaaaaagaagaaaaagggctgacgtggcaggagacaaaaaaaggcgattagttttttttgcgtaccaagcaagaatgctgcagccgacagcctctccagtcacttccggtgaggtttcggtgtcggccattgatttggctaacagtttaccgattctagagagtcaggaggagaaatctgatgatacgaagaagggtgagcaaggggttttggtgtcggatacaagtgagacagtttcagaccagcagatctcgttaggtctagatgctactccaacagttgttgaggtggtgtctccaccagttaagaaatcatggctcaacgctgcaaaaaaacatatcttcacaaaacaaaagtttgtggtagatgcagttgatggtaaagaaagagtggttgttccgaaagaggttttttgcaggtgcaaaacctctctgggaggattttttggttggtcgattccttagtacgaaggccccgcatgtgggaaagattcacatgattgtgaataaaatttggagataatttaaacttaattgatgtgtatgaagtaaacgcaacaacagtcaaatttcgcataaggaatgaggcaatg

SEQ ID NO: 13056 - DNA, 3000 bp, Unknown; identical to SEQ ID NO: 13051
  misc_feature (1)..( 3000): cDNA_ID_2710352_gDNA_ID_2214594_Annot_ID_135456 3000 nt of promoter + ATG

SEQ ID NO: 13057 - DNA, 3000 bp, Unknown
  misc_feature (1)..( 3000): cDNA_ID_2710360_gDNA_ID_2214594_Annot_ID_135459 3000 nt of promoter + ATG
tttgatacataacaatccactccatacatgactcattaatttttcatttgtaacctgaaacacaacagctttcatcatagctaacgtatgttctagacatatcaagcgaagaagattcaccaaagtcggttattttatttgatctcctcttcgagatcacaaaatattttcgttgtttcaaatatgtaacaaaaaaaaaaaaactagattagcagattcaaaatatcaacaactatgttacacaacttacgcatctttttcaagcatctccacgttcatgaagcatgcatcaaaaccatgaggtagctacttaattcccaattgtttatatacttacttaatgcaaataatgtaaccatataaatgacataacttaacaatcatttttttattttcatgtgaatttaaattttctttagaacgtgccaatagtgagaaaaaaaaacattaagacatcaagaagtgaagaaagtaataatttatagggtgatttgcaagaataacaaaaaaaaaactgaaaattaaatatatagcacctattatgtatcaattaagtaaataacactctaaccatgaaaaaagtctaaacgacccttgctttagtctttccagaggtaagtgggagagatgtcgtcgacattgaacgagatgatgattggtgaatatagagatgttctagtgaaagggaagaagatagaaatccagcgaagaggatgagatagacaaatccaacaagaaagcaaagaagagaaatgaagacgaattttcagcggctgggatatgcaacatacaccagagatgacaaacaaggggtataattgtcccaaatacataaaatacagaagatatcaacttgtttttttgaaaattgttagtttcttaatttaatttttgggagatttgcaaaactactattttttactactattttgcaacaatactcttttatgttatccatttaaaaaaatacttcttccctttaacagaatgaacaaattaccctcatctaataggaacatgtaattggaaactaaaattttcccgccaaatttttggagtcaaaatttattttttccgccaaaaaataatttccgccaaactttttttccgcaaaaaaaagaaaaaatttcccgtcaaaacttttttataaaacttttttctcaacaaaaaaaaatacttttaaaaatccttgtaattttttttgccgggaaagagatttacaagggattttaaaagggttttaaaagatttacaagagattttaaaagggttttaaaatatttacaagggattttaaaagggttttaaaaaatttacaagtgattttaaaagatttacaagggattttaaaaggttttaaaaaaatttacaaaagtttataattgatcttgtaaattctttaaaaatcttttaaaactcttttaaagcatttaaaaatctcttgtaaatcttttaaaacccttttaaaatcccttgtaaatcttttaaaacacttttaaaccctttaaaaatctttaaaaaaacctttataaatcttttaaaactctttaaaatctcttgtaaatattttaaaacccttttaaaatcccttgtaaatcttttaaaacccttttaaaatctcttgtaaatgttttaaaacctttttaaaataattttaaaccctttaaaaatcgttaaaaaacttttgtaaatcttttaaagccctttaaaatcccttgtaaatattataaaacccttttaaaatcccttgtaaatctatttcccgccaaaaaaactttttttcgcggaaaaaatatttttggaaaagaaattttggcgggaattctatttttgaaattttttggcgggaaaagattttgatggaaacattttggcgggaaatttattttagaatattttaagcgaaaaaattttcttaattttttttgctgttagttttgcaaattttcccaatttatatgagatatgtcaaacattaagacattcaaaaccatgggacggctacttaattcttaattgtttatatacttatttaatgcaaaggaacatacgaaaatcaagaagtaaagaaagtaacatataaattatttgtttttaattcatatgtctatatgcaaaaaattaaacatataatttttgtaattaaaatggaaaactaaaaataagatggagtgtatataattaaattatatttttatcatagtaaaacaaatatttaaattatatggcaaaatcgaatttgtaagattgaaatttcgtttaaggaaatacaaaattaaatactaaaaaagtatgtgagttattattttaaattcaaatatcattaataagatgaaatgtataaggactcgatagtccaatttactcatgtgtatagaaaggctaatcgtttagcttatggattaccaaattatgtgtttttgttattgcttagtctacatatatttgatgtttgtcgaaatgtctgagtgtagttattatgttatgaataaatcgtaggcgcttttgccctctacatattactaaaaaaatggaatgtatagaactaaatgacaatttattacgatgaaatagataatacaaacttacgatgtatagtaaaattaaatgtatattattaaaattttatttgatacaaaaattaaaattaaatattagaaaaatatataatcatatttactattcaaatttaaatattattgataaacatttaaataatttatattttacattcgaattttttagacggactttatctagtatataaatattgttaataacttacatcattttattttttaattttggtaaaataataatatatcctgttttcattaattaattttgactaaggtctctttaattatagagttgcccaaagaattattctcagatttgtccatctccgagcatctggcttctctgtcgcatcttctcttccctttcccccaccgacaattctattcatctccgatcaaaaactattcctttctgatcaca

SEQ ID NO: 13058 - DNA, 3000 bp, Unknown
  misc_feature (1)..( 3000): cDNA_ID_4257502_gDNA_ID_2214594_Annot_ID_135462 3000 nt of promoter + ATG
tctctcatcgtagggatttttttagcgactaggtttaaaaattctcaaaatctggttacgtctatttcaattgcttctgagtttgcatgaattgatccttgattctgatttccaacgatttcaattttgattgcgttaacagttataagaatccgcaaaattatatgttgaatgattttatcgccgattctgtattgtttcgtgaagtagtatgcataatctttgattgaaacaagttttgtgtttattgatgcaaatacattatgatctttattcaagtggagatgaatattgatgttgaagttactaagtttcacttgtctctcttgtgttccgtggtcgagtctctgttgttcacggggcgtagaatcgctatttcagtccctgtacataatctttgattgaaacatgttctgatttggtgctgcttttgctgaggaagcaaaatacattatagtctctgttcaagtggaatcctaagatattatcactgagtatgtgttgttcacgaggcttagaatcactattttagtccctggagcctggagtagtagtgtacataatctttgattgaaacatgttttgattttgttctacttttgctgaggaagcaaagtacattatagtctctgttcaagtggaatcctaagatattatcgctgagtctgtgttgttttacgtgggttagaggatgttgatgtgttgaaaattgatggatctgtgttttttttgctcttgaatgttacagaaaagagacaagctgaagcagcacgtatcagggagaagtatccagacagaataccagtatgaattttggctattttcatttaagaaaattgcatagcttttgccttattctctctgaaattgttgcaggtcattgtcgaaagagccgagaagagtgatgtcccggatattgataggaaaaagtaagtccttacttctcttgaggagttggatataatctctttcttctcactgaaagtggcttcaagcccttttctgagaaccctacactccctcacatttagtaatgaattggttaattggatagaaataatttttttttattgaaagatctggaggaatttctggttttcatggtttgttgcttagggataatgaattggctgacttactattcaaaactttaggtacttggtcccagctgatttgactgttggccagtttgtttatgttgtacggaagcggatcaagctcagtcccgagaaagccatcttcatttttgtcaagaacattctaccaccaactggttagtttcaaacacgttccttaatcatatacttttccagttcaaggaatcatatctttttctcagttgagctaatagtagtagtgttatccttttattgcagcggcaataatgtctgcaatttatgaagagcacaaagacgaagacgggtttctatacatgagttacagtggtgagaacacgttcgggatcttcttctaatgcgcttggaatatgtggatgcatcagattatcaatgtacagtctgtctatttctctgcttgtctctagttttcatgacattggacgaagcttttgaaacttgcatgctatgttattaacatgataaggtcttccgttcatggtgttaatttggctttatgctacacttaatttcaaacttagtcgctatatatagttgaggtcacttggtgtcctccttgaatattggcccggcctatttcactagtcgttgaaccgttacgatttctatcttctcaaagttagctcgaccgtcaaatctctaagctcttgcaatctctgcttctaaggaacacaaaacagagataactttagctataaatatttagatttcaaaagcaacttgatttaggtaaatttgtgcacactctagaatagattatcatctgttacagattattactgtacaatccagcaaaaactaggcctgggatttcggattaacccaatgaccgaactgaacaaaccgtttttttggttctgataaccgactatgaagggaaggctaaaccgatcggcgaaattataattgaagttcggttctcggttcggcagacataaccgatcagttttctcggttaatagatactataaatataaagataaaaacattagatctaatctttttagcttcttctccgtttccttttgatcctcatccatggctatttagtcaattctctctatctgcatgtggttttcactatggtagcacgtcggggcatatttcgttacggagatatcgtcatccctcgctatcaccgtcaccgtcacagacgtagatctgctgattatgaagagggtagcggcaccaagataccatcaaccctaatttttaataggtttggatttttagttattttgggtttaagtttgtttttcgttttggcccaattattggtttgtaattataaaattttgtttatcttcgcccattctataatttttgttttgacccattatcttgattttggacttattcggtataaactaaccgaactaaaaaaaaaatcggtttagttcagagttgattttgaatcctataaccaaaccgacccgaaccaaatctttattcggtttaatttgacaaaattttaaagaaccgaaaaaaccgattaaaccaaaccgaaccgattacccgaataaaccgaatgcccaggccaaaaacaactgaaaataaaaaataaaaaatgagataggagaatatttaatccgacggtggagaaatgttgatataataaaacgtgatacagaggatcataaacccgcaacatgagaaacgtaataagttaagtcaaaaaaacgaaaaagccagaatcatatttgtggctctggtttctccatccaaacaaaaacaacacccaaaccttgtccacaccaaaatgttaaactcaaaatccaaccacacacacacaatttctcttcctctctaccattaacatcgatcagaaagaccgagagagagagggagaagctgattgattatg

SEQ ID NO: 13059 - DNA, 3000 bp, Unknown; identical to SEQ ID NO: 13050
  misc_feature (1)..( 3000): cDNA_ID_2710363_gDNA_ID_2214594_Annot_ID_135463 3000 nt of promoter + ATG

SEQ ID NO: 13060 - DNA, 3000 bp, Unknown
  misc_feature (1)..( 3000): cDNA_ID_2710374_gDNA_ID_2214595_Annot_ID_135465 3000 nt of promoter + ATG
aatactaaaaaagaaagtttggattcatttcctacacaaatttatggttttataaatgtacaaagaatattgaactaatatttcatgttccgattatatataagttcccattttcaatcgatgagattaataaagaaactttctggagtatatatttaacattttcgattttatattatgaagctaaagtatgtacagtatgttggtgaaaaaacatggatcgttaaataaaaaaacatattaaggaggagaacgaccgagcatcttctaaagaagattaaagcataagaacattggaataaggaaggtgaagtattgtcgtggacattcctgagtgggaagactcaccattacatacataattaattagtaacaaagacattggcgcctgtcttgttcccgttgcttttccccatctttatctccaattctctctctctctgtctctcttgttctactactttggggaagatgatagcttcttcttcttctccctccatcacttgttcttgattctacttgtggtcctccgcttctcttttcaggtgattggtcattgatctctggtttttttattttgcaaacttatgggttttgcttttcgtttttttctctgtcttactaatccgaatctgattcaaagtttacaactttaactaggggtttttctcactgaactcttatgagtgagacatagattcgtcttctaggtctgtttccggagggaattaattaataatagtatcaattttcgattatttttctttggttgattctctatcgaagattgtcgatgcttccaaagttgaagcctttgttacttctgaactcaggattgtcttgtgcctcgctgtagattatcgaagatagttgtggttctgggtaattagcttttggtgataaaggtttgtgctttacacatcttctgctactttttgggtatggcctaactaaaaaaagtaacttttagtatctctttccgatgatatcgattttataggagtgaatctctcatcttgcttcggagtgaaacaaatcatgtttttgttttgtcggaatgcttatctgattgcagtgcatatagttgtcaaagtttgttcttgatggtgatgtagaagctcttttatttgacatatttggttctttgtttagtttatttttagtaggatctagaagatcatggctcaaaggaaaggacctgatccgcctccgcctcaaaggcggattctgcggactcaaactgctggtaatctcggagaggctatgttggacagtgaagtggtgccatcgtctcttgtggagattgctccgatccttcgtgtagctaatgaagttgaagctagtaacccccgtgttgcttacttatgtgagttgaaataattaaaaaaatcgcctggtgatgtgatttggtcatcttatatgatcttgaaaaatatcgtcgtggatgtttctatcaggtcggttttatgcgtttgagaaggcacacaggcttgatcccacatcaagtggacgtggtgttcgccagtttaagactgcgcttcttcaacggttagaacgggtgaatatcgtctcttcatttactctgcttgagttttcatcttcaccccgttgtcttgctaggggattatgtgtcattttgccttatatcccaaacttctgcaggagaatgaaacaactcttgcaggaaggcagaagagtgatgcacgcgaaatgcaaagtttctatcaacactactacaagaaatacatccaagctttgcaaaacgccgctgacaaagctgaccggtttgttgacatccctgtcttatctctattgcaatctatctttctgtgattctcattcataatacaaatttgttttacttgtagtgctcaacttacaaaggcatatcaaactgctgctgttctctttgaagtcttgaaagctgttaatcagacagaagatgtggaagttgctgatgaggtgacctgattctagattatattttgtagtatttaagtctcttacttctgatcttatcccatgctttcgtggaaattttgatattctttattgatattatttgtagtatgaaagctgttaataaaaaattttgatattctttattgactcactgggttttgttcatcctttttcttgctggtagattttggaggctcacacaaaggtggaagaaaaaagccaaatctacgtgccttacaacattcttccccttgatcctgatagtcaaaatcaggctataatgagatttcctgaggttaaccaaacattccactaactgtttcaattctatgtttacttgtcttttgagacggaaaataaataacacttttctgcagatacaagctacagtaagcgcacttcgtaacactaggggtttaccatggccagctggtcacaagaagaaactcgatgaagacatgctagactggcttcaaactatgtttggttttcaggtgatgctagcgaatatcctgtttggttagttgattgaggatttatccctgtgctgattgtgctccaaacctttaaaatggcagaaagataatgtttcaaatcaaagagagcacttgattttgttacttgctaatgtccacattcgacagtttccaagacctgaacaacaaccaagggtatgtattcttttcaacttggatatgagggtttcttgctcgtctagtcctctgtatctgcactaacggcctaaattacaatttctgcctttagctggatgatcgtgcattgactatagtgatgaagaaacttttcaaaaactacaaaaagtggtgcaagtatttgggtcggaagagcagcctttggtgaggcatctccttgtaacacctgcttttgagaatttattttgttatttcttaggaatatagaaacagatgtagtacataaattggatactataagtctttgtgcttagttatctctcttttccctgcttgtaggttgccgacgattcaacaagaggttcagcagcggaaactgctatac

SEQ ID NO: 13061 - DNA, 3000 bp, Unknown
  misc_feature (1)..( 3000): cDNA_ID_2710378_gDNA_ID_2214595_Annot_ID_135466 3000 nt of promoter + ATG
attttcacgggaaggtaaaatagtacaatcttgtactgccatttagacagtcaatttgatcttggtgcacaaaatgatatcctactcgtctcgtttcttgtggcagtgtttcttctcttgcatggtttatgtcgaatcaggaaaacagctttgttactattgggcagagggtgctagctagccccttgaagtaagttttttttacatctcgtggtggaattctatgaagggagacctggatttgtaactttcattttgactcctccagggtacgattccattacggtcatccagatgtttttgatcgactgtttcaccttaccagaggtggtgtctgcaaagcttctaaagttatcaatctaagtgaagacatatttgctggtacttgcttcatcgccttttctccggtgacacatattatgatctgtttccatacgtttttgtttcgttctctcataccttcgctattttcaggtttcaactctactcttcgtgaaggcaatgtgactcatcatgaatacatacaagttggtaaagggagagatgtaggactcaaccagatttcaatgtttgaggcaaagatcgctaacggaaatggggagcaaactctaagccgtgacctatataggctggggcaccgatttgatttcttccgcatgctttcttgttatttcactacaattgggttctacttcagtactatggtaggtcatattcctttttctttatcttatctcacgatcagtatgatacatgggaagtttatctcagtctgaaacattatctgtgtctttcttacagttaaccgtgcttacggtctatgtatttctatatggacggctgtatctcgttcttagtggtcttgaagaaggattgagcaaccagaaagcttttcgatccaacatgcctcttcaagctgcacttgcttctcaatcatttgtgcagattggtttcttgatggccttacctatgatgatggagataggtcttgagaggggattccataacgccctaattgattttgtactgatgcagttacaactcgcttccgtgtttttcacgttccaactggggacaaaaactcattactatggtcgaacattgtttcatggcggcgcagaatacagaggcactgggcgtggttttgtggtgttccatgccaaatttgctgaaaactacagattctactcgcgcagtcattttgtgaagggtattgagctgatgatactcctgctagtgtatcagatatttggccatgcctatagaggagttgttacatatattctgatcactgtttcgatatggttcatggtggtgacttggctctttgctcctttcctgttcaatccctctggtttcgagtggcaaaagatcgtagatgattggacagattggaataaatggatatataaccgagggggaattggtgttcctccagaaaagagttgggagtcttggtgggagaaggaaataggacatcttcgacactcgggaaaacggggtatcatcctcgagattgttttggctttacgcttcttcatctttcagtacggactggtttatcaactcagcacctttaaacaggaaaatcaaagtttgtgggtgagagctcttacccatctcatgttgctcttcttgttttcgaattctcttggtttttaataaattgattctcaatgtttcacagatttatggagcttcatggttcgtgatcttattcattttacttattgtaaaggtatgataactatcaccatgaacatattcattcacattttgggtttcttaagtatgagataccaacaatcttttaatcgatcaaggttgtttactaaactgaatgtaactaatcacagggtctgggtgtgggaagacaacggttcagcacaaacttccagcttctcttcaggatcatcaagggttttgtgttcctcacatttcttggacttctcattactttcttagctcttcgttttttaacacccaaggacatcttcctttgtatgctcgctttcatgccaaccggttggggaatgttactcgtaagttctcattcctccattaaactcctccaaattgtttttaatacgtctttgtgtttgtcttgtttctgagatagttgctgcaattcattcaaaacattctctcttttcttttcaagattgcacaagcgtgtaagcctctgattcaacggctaggattctggtcatcggttaggacgctggctcgaggctatgagattctcatgggtttacttttgttcactccggtagcgttcctggcttggttcccgttcgtgtctgagtttcagacaagaatgctctttaaccaagcatttagcagaggattgcagatttcacgtattcttggtggtcagagaaaagaccgctcttccaagaacaaggagtgaaacaaaaatcatataagcagagaacagttacacatgtatatagtttaatactattgaagacaattatgcctcttttactacgttcttacaaagtaatctatggttctttaggagttgtgtattccggattttgattttgtttcggttcggcttacttggttcttaaatcttcggtttaaggaaatagcgatagtgtagatcggtttggcaaggttttgacttttgattgcattggttctattttgtattaaataaaagataagtccctgaaattgtagttgttttcaaaatactcaaaatattttagtacgcttctaatctaaccccaaaaggaagaaactgtatacgaccggaggttctcaatcgaatactacaccggttcaattcgattctgtttataaaccggtctctcgcgattcaattcgtcttctttttccaatttccagttccttcttcttccattgtcgagttttcatgattttcccgcaaaacccttctcgtttatgggtttaaccttcctgtgtcaccaaaattttctccgtaacttatcacctccactttttcatatctgtaatcgctgaaggtaaaag

SEQ ID NO: 13062 - DNA, 3000 bp, Unknown
  misc_feature (1)..( 3000): cDNA_ID_1580388_gDNA_ID_2214595_Annot_ID_135467 3000 nt of promoter + ATG
taaacctttttaagtactctttagctttcacaaataaaataaaaattatatatgaaacaacacaaaatattctataaacgtagctatcttatttattgacatcctataatatattggaagtgaaattttagtataacattaaaatcctaattttaaaggtttttaaagtatgtcggtcaaataactttttttgacataactacaaaataaagttcagttattactaataaaaatataggtatattctaccatttcctcgtaataactgacaaaattttgcaaatcacccaatttaaatttaaatttgatataaatttacaacattcaattttttaacgtgtatttttggtccgtccgccaaattttctttttgacaaaatagccaattaaattaaatattttgtttcttttatctctaattgaaattaaatgcagatatgtcaggtaaaaaccatttccttgtaaccggtcggatttcacgagatttccggcgaaactccggcagtaggtcagcatggggaaccaacttcatgctcttatctgagtcgctaaacctcactttcctcagcattgaacgaagtctaacgagccacaacgagttcgcaattccttatcctacttactttcaccctacgtcaacccccgagatccttcagtggcaagaaaagatcaggcttacaaaccggacggtcctcttctcatttgccggagctcaaagaccaagcagaaaccagaacggtgtggttcgcactgaagttataaaacaatgcaagagttcatctaaaacgtgtaggtttcttgactgtgacgtcaatgcaaatagctgtgatgatccgatcagtctgatgaaacttttcgagagttcgactttctgcttacaaccgccgggtgattcgttgaccagaaaatcggtatttgattcaatcttggctggttgtataccggttttctttaaccaaggaagtgcatacaagcaatatttatggcacatacctaagaatagtagcaaatattctgtttatataacggttaaggagctgagaaccggtggaaagaacaaaatcgaagagattttgcgtggaataccaaatgagagagtggttggtatgagagaaaacgtaataagattgattccgaagattgtgtatgctaaaccaaaccggaacaaaccggatggagagattcttgaagattcttttgatgttgctgtgaagggagtgctagagagaatagaagggataaggagaaacgaattcaaaactgattagcaaattttatagttagcctaaacaaatgaagatgtcctacatttgttattgtatttaattgttcataggtcttgtacaaagataagtctatcaaacatggcaaactttctccccaattttaaaaccttttgatatgcgaaaatttcaggatctatgatgtagtaggatacgtatgtctgtgaatgaccattttaatgtcccctttgagactcttacgcttagggagagaaacagacgaagagagaagacatagaatgtcattgaatcatctctcgatagctttcattaatgtttgtcaataaggattggttaaagcattagtatatttagtctcttatcttcggcccaaagcagcgtaaagctttgaatggctttgttggaagacgtaaagcagtagtagcttgaagcaaagtgtggtgtggtctatggggttcttaattttaacggttctttctaaaggtgattaccaaattttggttgatatcaaattttataactctcagttcttatatgtatatctctcgctcttctaatgaatatatctattcatattttggcaaaacatataattatattttattttcaaattgtgtatacctaccaatctaccatcatggttaaccaaaaatttgtatcataactaattaactatttttgttttgttttccgttgaactaggaggccaggaggggagaggggtttataaagttatatgaaagtattgttgtgtcgaaaagaaaagtttatttcgttaaagagcttgattgttaacaaatacataaagacattatacatttcctcttgtccgtaacggattgagttgttaattattgaatagttcggcatacgtataagagaaggtgctacgtgagcagcatgcgaagagaagatagggcagatgtcaaattcagttgatacgtgtcgctctcctaaacaaaaactctctcttgcatgataacaaaatcagcaaaacgacaacaatatttcaacaccaaatcgaggcgataaggaaaaggctaaagcgacccatgatccctcgctcctttcgtcaaattagaatttaaaactgtttcattggtgcaattaaatgatcctctaaaaagtgtttgaacataattatttttccatatacatccataattgtataaacttttgtgagaagaaacctacgaaatttctgtctttttaacatattaatatcaactaatagatggtgatctaaagtttaaaaatcaggtatcaaataatttcaatttcattttgaattataagtatggactagttgacaatcataaataaaaaccttaaattaccaaaaaaataatccaattgcttagattaggatatataattagtgtgttcgaatccgatttacaataaaaacaaaattacagatcggagcaattcacatatatacgttaaaaaggtgggggctcacttcacgtggagacttaattggatcagaaaagtaacttaaaagatgcggaaccccgaaggtgccgatggcatggggacccattcacgtacacccaaacacaaacaccaacattgcctaaactctttctctatataaacacttctctttctttttctttctctcacacaaaaatacaacaacttagatcagtctcaaagggggaaaaaaaacttaaaagaaacattaagaggcaacacaaatcacacaaaagatcaaattgaagcctaagaagaaggcaaaaagtgagaagcaatg

SEQ ID NO: 13063 - DNA, 1289 bp, Unknown
  misc_feature (1)..( 1289): cDNA_ID_3027952_gDNA_ID_2214595_Annot_ID_186905 3000 nt of promoter + ATG
ggctctgttcatcttttgctatgttaattatctgattcgtttgagaaattctgcgatttgagaacgaagtttaagtttcttgttgatgtcattgatcatacagagataaaattgatttgtgtctttcgaagtagagatctgttgtgtgtaagcttactcaagatggtgataatggcagatgctgtatattatcaaggatggagttcgtgaattggatcaatggtgtaacaagcttcttaagtacggtgaagcagtctcctctggctctgtgaaacaagacgacagtcctaaggttcgagaatcttcttgacacacaatctcaatggaatcttgctggtgaaatgcatttggaacaatcgtattggtctatcaaacatgtccttcattgagttgttcatttacttggctcttatctaatctctgagttaaagtcctgtttttaagcacaatgattgttgctcacttacttgtctcttatgatcttctgagtttaagtcttgtttttgagcacaatgattgtttgttgcggtgcaggcagtagatgaggtagtacaacaagaggagcaaccaaaagagtgcaaagaaggtgtgaaggtcaacagactcggtgaggcctttgtggttgagatcaactgtccatgtggaagaaactaccaaactctcttctcaggccgtgactgctactacaagctcttgtagaatggtgaccgctacctttttgcagttgttagacattcacattctttgatcatcatcaccattagttgaaggatctatcatgctgcatattcatcacaaaggttttctgtagataagaagacattcacactctgtttcatgcttgtatagatactaggtagctatacgttccattgtcatatactctcttgtgcattcgcttacttgtaatactcttaaatatgtttcattcgttaaaatggaagtgatttcttgtgtgtttgttatcattcttcttttaatgttttatgcgctaaacaatgttgtaaacacaagacggaaccatgaccggtctgggttttatctagatcagtaagtttgtaacccaaaatcaaaattgacaagccgaaaaggagaaagaaaaaacccaatttttaaaaccctagcgttttcttctaaagccctaatgtgtaaatattaggccgtttttgggcttcacaggatagaaataaacagagtacctaaaacgacgtcgttagaaagtagcatccaaaatctctatcccatgacactcttatatctcaatctattaaccttggagataatccatg

SEQ ID NO: 13064 - DNA, 3000 bp, Unknown
  misc_feature (1)..( 3000): cDNA_ID_2713048_gDNA_ID_2214595_Annot_ID_186901 3000 nt of promoter + ATG
cgtgacaagaatcatacatgaaaatgccatgaagattcgtgacgatggtgtgcctgtgaatttggtggacctcggatgaataagcatgcgcttgagttgaggaagtggaagatgaggggaaactggaattatgtctttgttaaaggttggaacgatgtgcttgatgctaacaagtcgaattcgtttaaggaaaaagacgtctttcctctctggtctttccgatctggaacaggtaaactctgttttgctctcacccctaaaaattccagcaacggctctacttcaggagaatctggcagtggcggcgatggtgcttctacttgaggtgaatctggtcaggtaccgttacccattcctccggcaatagattctagccactctggccaaggctgttcaggagagagcagctctagttcttcctaatcataactctgcttattgcttaagccacaagtaaaacggatttagttttcaggcaaatctggcttggttttctttcttttttttgttcagttgatgaaatagtggggttttgtccaaattgtgagacccatgatatgatgttttgatttgagtttctttctttatgtttgatttttttttatctctctctgatgctgcctatgtttacttatgattagcattgaaaatgcagaacaaaggagagagaacttgttttcttatattatcacaaaaagatccatcaggctacaacaacacacaacaagtgtaaagtttcttggctctactaaaaactcaaaagtcaaagttggatcaatcatcaccataggccttgaaacaataccgctcaatataaggagcgttaaagaaaagatcagcttccaaccatttcggataccgaacaagatctccagctaaaaactgcatatacctcttgcttccttcgggaacaactcgaacctctccttgttcaatgtaaaccaactgatccacctgccaatcccatggcaatttgcatttccctgtcttccaaactgaccatctcgaaaccccaagttcctccaaccgtttctgtgaaactttccgttccactttaacattgtatagctcctctaatggtttctctgtctgcatacaagtcaccctaaaggctctttgaactgacaggttatttgtcttcttacatgtagtgacagaacctgggaatggtgtagtcattatcagacttgccatggctgcttttatccaatcttgtcaaacctgagatccacaatgaactttaaataacacatatcgaaaacattgtgatgtgttaaagtcttgtaactcctgaaacagagaaagaaggtgaatttcttaactctagtgagtaaaagtgaattatattgtaaagctgaaggctttatcatttaccctctttgcaatagcttatatgaatcaatgacacagcgtaacacaaaaactcacaattcaggaaattagctaatgcccatttgctatttcgattggaaaagtgaaaactcatcgcaaaattgatgatatacgaatttaacccaacaagcaaaaaaaaggttgtcgatttcaaaaccaaaaaaaaaagcggaagacagattatacgcatcgaaatcgaatttcttaccagcggaagtgtgagtgagagtaacccttaaaccctgaagcagtcaggcttatccgatccccgatataataaatgttacagaaacgaccctaatatttatatttgttttaactttagactagaagtttgttttgagttaatgtgacccaaatattttttctatagacgtaacgttttcagatttgacgtaatccattggtcaaacttttgcattgagaatgttgacgtagatgatcttttgcatagcgcgttatatcttcttttttctttttctaggtgtggttatacgtgacgaaaataaattacgtttagtaaatggagaactacattggtcggttaaccaaacaaacaaccaaacttctctaacgttgatattctatattattaggtatacactaattaaatcacaacttgcgttcacattctcacctgatatgaaaccaatactcaatttccttaactggaaaaattccatgtggcctctagaagataaagttttcggatttaatattttttcgtgaattcttacagaaaggaaaatggttagttgaatctctaaatgaaactattctcaaaataacatatattttgttttacgttgttaagttgtttactattttgtcagcattgtgaggtttagttgtaatattctctctttttcttaattaacatgtagatattcccgtagagaaagcactaaacttttgctttgagaaagaaaagaaactctttattaacaaagaaaggaataacatataactcaaataaagacatgctgaatttatcatttcattcatggtgcatattctaatgttgttaaaagtaaaatatttcgcattagaaaggttaacaaaaacaataaaaaaggcatatcttcatatcattgttatattatattttttggtttaaaatatttaaatcctctgtcagaaaccagagagaggcgtattaaggtttctgcgttttgttaaattgatcttgagctctaaaggctgtctaatgcagtgttttatttaattagcctttataagatttaggcaaatatacataaacaactaagtaaatatatacttcctctgtttgaaaatatattagcatatctcaataaatattgaaataaatattattccttgcatgtgtgagtcatttacttattcttaaaatttgagttacataacaaaaaaaaggaagcttcgtagcagttttcgttcgtcgttggaataaatatatggagacttagcaattaatggtgccctcacgcggttctactaaaccgacctcctttttgcttcccttacctatatatacatatatctctatcttcacttcatattaatctacacctctacatacgattttcattaaacacttttcaaaaacaaatcataatctgttcgaag

SEQ ID NO: 13065 - DNA, 3000 bp, Unknown
  misc_feature (1)..( 3000): cDNA_ID_3027964_gDNA_ID_2214595_Annot_ID_186898 3000 nt of promoter + ATG
tcatgctatttatttgatttgtaattcgtaatttgaaccatgtcctgtaattatttggcaggcttttgagccccctatagacttgagtaaacacatgcgcgagccaataacaggagcactgtctatggaggtcagatcaagacttggaaatttatccttttcattttgaaatctttaatttatatgtataaatgcaggagctccaaagggaggaacatcatcatgatcattccctcaagaatgcagagataagactcaataacaagacatgtgaatttgatggaggccacttaaatcatgaccatggcagtgtaatcatgccaactcatatacttttatacctcatatagtgtaattctaattctaatgttgctctcttttctttcttaggtaccattttcatctcatgattggttggattcttcgttacaggcgcatgttcctctggttgatgtaaataaggtatgctttttcacttttactatggttgattatattagttttttttcatcctagcaactcataattgttgtagagctattttagtgtgaacaaagataaaaagaatatatcctcaattctcaaaatgtacatgaaacatgttagaggtgagaggtgacacgcacaccagtacaattgtatatatatatatatatatatatgttggatgttgtgtgtattgctcaccaatctattacttagaaatgtgcatgcatggtttttgttgtattctaacacaggttcgttgggtaataaggaatatagttcgagactggggagcagaggtaatcatatttttgtttgtcatgatggcaaggatgagatcctttctctaatatcatgatcacaactttagtggtatatacaatcttttgacttacagggtcagagagaacgagatgaatgctacaagcctatccttgaagagcttgattccttgtttcctgatcgtcacaaggagaggtacactttctgacttttgagtttctgacctcccatcaatgcattctgagtatttttgttttaccattcaatatctaaatttggtggctttgctgtctaatccataaactctgcttacaaagttaacgtatatgatttgcagcactcgtccagcctgtttagtccctggtgctggacttgggcggctggcccttgaaatttcttgtctaggcatgcagtggagaagcaaactttttttttttgttttttttttgtagctttgatgatagcgaggaattaatataacaactcttgtacattggaacaggtttcagaagccaaggcaatgaagtttcatactacatgatgttatgctcaagttttattcttaattagtaagagtttcttacttttctcttatacatttttaacatcagccagcaacaaacttataagtgtgtttctaagttgcttttggagagtctctaaatttgattgagttaatttcttgattctgttccagttttgagttttgctctactttttttcttttttctttttcataagtacacaattgcctggtgagtggacaatatacccctggatacacactaactgcaattcactctcggatgatgatcaactacgccctatttctattcctgatattcatcctgcaaggtatgccttatcagagagagtactttgcctatggtttggaaatttttgatagctttaaggataaagggactaagcaacttgtattggggatttcatggagctactacaatcatttatttcaatttactaaaaagtttaatgtaaacactctctgagagcagtgcaggagtaacagaaagtttctcaatgtgtcgtggtgattttgttgaagtattcaatgaatcaagtcaagcaggtaagaaatggtgactacttgcttttgtttaagccaatatgtgtatgttttataccaaatacaccactcatcactgagtttcaggaatgtgggatgcagttgtgacttgctttttcattgacacggctcataacatcatcgagtacatcgaaaccatatccaagattttaaaggatggaggagtacgtaatttcctatacgtaccctcctttccaacgtctttgatatttcatcactcgcctatctaaattaatgaatttatccatcaggttttgataaatctaggacctctgttgtatcactttgcagacgagcagggccttgaaaatgtaagcattggaattgtcacacaatctctcgctagataaataaatttgatataacaataatatatcttacttgtttctccttaggaaatgtcgattgagctaagtttggaggatgtaaagagagttgcttcacattatgggtttgagatggaggtaaatctacacaatataatgacaatgacatttgcctgtcagaaataaaacatctcatgatgcatgttcttcctcacttatatgagtggttgtcctaacaatatttgcagaaagaaaaaacaatagaaacaacgtactctacaaacccccggtctatgatgaaggtcagatttttttccatgtctttggatttgtggttgacttttggatccagagatgggtttaatttgtgcatgatgttgtgtgtgtctgttgcagaaccgatactatcctgtcttctggacaatgaggaagaagtgtgctataacaacaacttaaccaaatattcctcaaaactatatatgttttattctgttgcatttgtttttaaggaattaacgggtccaatctaaaacacatactatttcttttgttgttgcaaaataatgaaactgtgtttttcggttgatgtttgaaaaccaagtaaccaacactcaaagctaaacaaaacctttggcctgtgggcacaaagctaaaattttattattttctcggcactactacgcaaataggctaactaaggcccattaaataatatgaggcccaacttgaaaaagactcgtttcttgttactaataacctttccgatgaaatcaactccaaaaccgaagagccaccacc

SEQ ID NO: 13066 - DNA, 3000 bp, Unknown
  misc_feature (1)..( 3000): cDNA_ID_3027968_gDNA_ID_2214595_Annot_ID_186897 3000 nt of promoter + ATG
ggaatagcgccagctgtcaagaagaatattgacggtaactaaacaaaaacaatcttaattagtgcttaattacttatatttttcttaagacatttgggtgaatgatattattatctgggcagattttctagtggagaaatttggattctcagaaagtaaagcttcaagcttaagagttgaactcttcaagacttatggaagtactctcgctggtcttagggtaatttcacttctccattttctaaagaattactagttcattatatatcattgctttctaatttatttatttctttcttataaattgtaggcgttaggtcatgatgttcatcctgatgaatatcacaggtaataatcaatcatcttcaacaactatataaatattttgatctcaggaaagcgatttttgttcttaagcttttttttcttgcaaaatctgttttgtagtttcgtgcacggaaggttaccgtatgggtcgatcgaaccaaacaacaagctacgtaaccttctcaacaaaatcaaacagagaaaaattgtaagtttaatcttttatttattgtggcatgaatttttcttgggtccatacagccaacactaataaatgatcatttgttttttcttgggtccagatatttacgaattcggacaagaatcatgcggtgaaggtcctcaagaaacttggtttagaagattgtttcgaagagatgatttgttttgagacaatgaacccaaatttattcgggtcaacaacccgacccgatgaatacccggttgttctcaagccttcgttgaccgcaatggatatttgcattcgtgtagccaacgttgatcctcgccgaacagtaatattcttatttatttaattatttcttatgataaaactattgtatcatcattacaataagcaaactgtttttgtaaataggtatttttggatgataatatccacaatattaccgcgggtaaatctgtcgggcttcgcacaatcctggtaaatttttgttacatttcacatttattaattccctattttgcgacatttgtatgtgttagtttcaagttttaaaaatttggttacaaaaaggtgggaagagcagaaaagacgaaagatgcggattatgcggtggagacggttactgagatagctacggcggtgccagagatttgggctacggcgacggcgacaggcggatttgacgttggtggtgagaggatcagacggagcaagagtgagctggagggtatggcttcaatagcagccgtcggtgcgtgacgtgatcgagtgggcggatcgtggccgttggataattttaacgtctagtggttgggattgtacaggtggcgttaaaatgttgataatgcatatgtgaatataaataatagtggtggtggacaatattcatcccatgtggacaccaaatgtgaatacgcaatcagataatattatgtatgatgattatgatttcaatatgtgtacatttttattcaactgatttttttaaagtttgattgggattttataattagtctgttcgtttcgtcgccgcgggtacctgcggctgcggtagacgcaactagttgtgtttgtttggttgccgcaactacttgcggcaaaacgcagcgtcaaacgcagttttctgcggttaaaaattttagacgccatttaaatttagcgtcaaagatgaaagagttgcgttatatatcctaaatgacaaaaatatccttattatttttgaaaattcacaaacaaaccaagcgattctcttcttcaacaaacaaaccctaaatcccaattctcttcttcgtttcttctgtcaagatcaccaaacatgcggcagcgtcggtggcaacgatggcggcatcgaaacgaacacaaaacctgcggttgcgacagcggctgcggcaacgttggcggcgacgaaacgaacaacaacctgcggcagtgttaccgttgccgctgccgcaaccgcagccgctgccgcctgcggccactaaacgaacagactaaatatagttttttattagagatatgctgtttataattttatctccaaccaccatgatacatattacagttaaatctctataaattaataaattctttcactcccgaattgggaccattataaaaaataatataaatcgataaattaataagataataactttttgaaaagtcctatgtaaatatatggtctcatcaatatcataaattaataattttataaatatatcaattatatatacattatatgtaagaaattgttttgaaatataattctaatatttttttgcttaaaacttgtatttattcttatttaaaatttagttatagtattttactttatcaaaaacttttgatgttgttttctaaacatgatattattatttacttgtaattgatttttgaaagatattttctataatgaaaaaaatcttatagaaatttttgaaaagttactaaattaagaaaatctctgtataaattaataaatattaatttatcgataaattaaaacatctataaattaataaaattttgcagtctcaacattattaatttataaaggttttactgtatttgataaacgaatcccttgcgatttatatcttgctgtatttctaaatcctaccgaagttttttttctactgtaggaagtaattcacagttttatatctatggtatttataaattctgaatgtctggcattacaacatttaaaacgttcctaacttactccattttcattgtaggagaaataatataacatttatatctatgttagtaatataacattttcaaattgctattgttatattttcaaatttggacctcatgttccttagtaggccaaactttaccccattttcatagtaggagaaataataaaacgtacctttcagaaataatcttacgtcaaaatatatccttaaataacagaaaagtctttttagtcttcgtgtatacgaggaaccataatgatttcatcgtcagagatg

SEQ ID NO: 13067 - DNA, 3000 bp, Unknown
  misc_feature (1)..( 3000): cDNA_ID_3027979_gDNA_ID_2214595_Annot_ID_186894 3000 nt of promoter + ATG
accgggtattcatcgggtcgggttgttgacccgaataaatttgggttcattgtctcaaaacaaatcatctcttcgaaacaatcttctaaaccaagtttcttgaggaccttcaccgcatgattcttgtccgaattcgtaaatatctggacccaagaaaaaacaaatgatcatttattagtgttggctgtatggacccaagaaaaattcatgccacaataaataaaagattaaacttacaatttttctctgtttgattttgttgagaaggttacgtagcttgttgtttggttcgatcgacccatacggtaaccttccgtgcacgaaactacaaaacagattttgcaagaaaaaaaagcttaagaacaaaaatcgctttcctgagatcaaaatatttatatagttgttgaagatgattgattattacctgtgatattcatcaggatgaacatcatgacctaacgcctacaatttataagaaagaaataaataaattagaaagcaatgatatataatgaactagtaattctttagaaaatggagaagtgaaattaccctaagaccagcgagagtacttccataagtcttgaagagttcaactcttaagcttgaagctttactttctgagaatccaaatttctccactagaaaatctgcccagataataatatcattcacccaaatgtcttaagaaaaatataagtaattaagcactaattaagattgtttttgtttagttaccgtcaatattcttcttgacagctggcgctattccagtttttagagggtataatgtgtcatccaaatctgatcacaattagagaaacaaaccaaagacaattagaacaactttagtaaacacattttaccaaatttgatatcacgtatttgtataaatgttttaccgaaaatgaggcagttgatcggagagaaatccattacaagagaacaagtaagtaagaaaatatataatttgtttagaatattgagaaattggaggatttatatagcaaacaacaataagaggcgtgaagaaagggagatgtttgaaggtatttataggaagacgagtcttttctttttagtgtttgtttttctctattttttaataatggatactgactgctgactcatggttcaaatccctttcgtctattttatctggttatacattttctttgaacatccattacattataaaatatgatttgatatttactcggatcatattctatcctcatttgtgtttcaaacttgcaatggccgctttctatcttaattaaacaatgttaaaccactttttaattaacctaacgtgttaagtctctaaaaatgttctaattaacttgtattaaaacgctatgaaatattacttattcgatgtcttcagcgagcatggaacttcgtccatgttttttttttttttttttttaatgttaaacttaaacttcgtccatggttgatagtaaatgttactataacgttccaatattttaacttaatagaatttagtttttcaatgccatcacaagaaaagttacagaaaaattaggcaacgcgtcgctatagtttgtactaaacatcgatgaagtatcatatgaaatgtccatcattaggttttaacttttagcttttagatgttttcttaacaacatcgcctttatgtgaaattcaaatatgatgtcacgatcgactcactagcctaattaagtttgtgcacacaaaacacgtgtgtttcacacaaaaaataatatcaattcctagtaggctactacgcgttgacagaatatgcttcgttcagttgtacgtgtttcacatgctacaccagattattggagaatgattagcaaaaatctcatgtactactgattagcattacaaattcctaaaaaccacgaaaaaaagaagaaaaaaatgccatgaatctatctaaccagcagaaattaggaatcgtgttcttttcacacataagaaatacgatattgctagtgataatgttctgatttttttaaataaaatagtatacttattaattgatagttgttgagttgtctgtggacctctcccaaacatcagcacttccccatcaaaagatgtcaccaatatgttgcgttattggttggacattttctacaacttcttcatcttctatcgtgaaagattccaacatgatactcttattattttctgctttcattattcatttattaaaatttcaattatcatatacttatttgaataaccattggagccagagaagaatgacaattaatatttctagtccaaatcatcacatttgttctcttcatctggagtctagcaacaacaactttcatcatcgtatgtaactagataagactcacctaaataagttgtaaaaaatatataaaatttttaatagaatattttaagttctaataataatttatattttttttatctaaatattttaaaaccaattctaattttacaaattggattctgcaatacaatctaactatttatttcatgtaactttgagtattagtaacttgtcttaaacatatttgagtagtgtagtacaaaacctgagacaacatatttgaggcaaattttccttgaattgcaaagaaattacgtcgaaatttttctgaaattcaggacgaaattcctttccccctatgcgtggtcagagaagtagtcacttgttttccagagattcttagaaaattcttttctccattcaattattggggcttatgtcgtgttcttcctttgcaacttccgtgtttaggcaccgaagtttccaggaaatataccaaaaagtttcttttgtctgaatattaattattaacgacgataggatgtaggtaatttcaattccaaccaaaaaaaaaaaaaagacatacagattttgctgtcccagaacaagttccttcattgcgtcttccagattcttcttttctttcaaacaagaatcgatcaaactccttttgtttctaagaaagaactcgagatcggatg

SEQ ID NO: 13068 - DNA, 475 bp, Unknown
  misc_feature (1)..( 475): cDNA_ID_3028020_gDNA_ID_2214595_Annot_ID_186874 3000 nt of promoter + ATG
tgtattgagaagttttaaaataatatgttacttgtaaatatgattagtattgaacatacttattttaataataaatttttcaatatacaaaaaaaaactaaaaacaatagtgaatttgtaagaaaaaaaatagaatgtgatgtggaataattttattttaagaaattgttttcaatgatatctaattatctatcccttttactagctcaagagatataaacataatctcatatatgaattggtgttaaataatatcagatttattggtgttaagaaaaactaatttgattccacatgtttttgttgttctcatattcacattcataaataatatatgttgatattttaccaactaagctttatacttctgtttactataaaatgcagacctcttcacattatttcttacaagtcaattccaatatcaagagctctattctctcttaactcttttgatcaagtagttatcaaaatg

SEQ ID NO: 13069 - DNA, 3000 bp, Unknown
  misc_feature (1)..( 3000): cDNA_ID_2710382_gDNA_ID_2214595_Annot_ID_135468 3000 nt of promoter + ATG
tgaggggaagtcatttccactatgcccatactgctacaactctcctccatttgaaggcatagacacactttttggagcctctaagacgcccaatgctcctgccaaaaccaaaaccggtgcaggcatgccatgttctctctgtcctcatcccacatgccaacactctgtcagaaaccaaggagtctgcgcttgtccagagtgtgaaggcacgctcgtcttggacccggttagcttccccaagtggaaactcaactgcaacttgtgtagttgtatcgttttgcttccggaaggtgctcatcgcatcaccaccactagtaaccgctgtcccgagtgtgattcagccatcatagagatcgatttcaacaagaaaactactcctctggagaacggagccactctgcatcaaggatgtgttctatgtgacgagttgcttctctcacttgtagaagtgaaacatgggaggtcctttgtgaggcgtggaggaaggggaaggggacgagggagaggccgaggcagaggagggagaagaggctcaaaatctgtcgacccaaaaatgagtttcagagacttttgaaactctaaactttgtgtttatgtctttgcgttacttgcatatcattggaaattcaaaattctgaaatactgcctgcgtttcaaggaacagtttataatctttttagctttacttcgattttttccacatacacttatctaaaacagctccccaaaacttttaaacatttgactaattcttgtttatgccctaaagaaaagctaaaaaacccaagtgtaatcttttgggcttgtcacgtgtcacatgtcatgcatacaatctttccttttttagatcataacaacatagttgaatgcatgatctattctctttgcaattactctgttttttgcttgtttaaaagtttttgaagaggaagagcaaatcattgattaggaaaatggagaaagcagttcactcgtcgaccacgtctggaccggcggttccaggggagacaacaaagaccggaacctccataattgacactgcagcctccgctgttcaaagttttgcaccggttaaccaaatccaccaacatctctgcgcgtacgtaaaacccgatctttgtcaactccacctctttttaagcctcttagatttgtgattctcactatgaaagtaaaaaacatatagctacttgttttgaatatatatatatatatatatatatattttgggccaacaaaaaattatgtgtaatcaattttaactaacaaggcaccaatgagcaatctcgtctaatttttttattcgtgataaattctatttcgatttggtttaaccgtatttacaatgttacagagaaggcatgttatttaatttcttgtgatggcaggttccatttctatgctgacgacatggcacgacaagtagaggctcaccatttctgcagtcacgtgaacgaagagatgcgtcagtgtttgatctacgacggtccggatgcaaacgctcgtctaattggattggagtacatagtgtcagagaagctgttcatgactttgcctgacgaagagaagaagctttggcactcgcacgagtgggaagtgaaaggagggttcttgttcatgcctggtgttccaggtgccattcagcgtaaagatcttgataaagtcgctaagacttatgggaaagttttccatttttggcaagttgatttgggccatgagcttcccattggtttacctaatgtcatgatggctgttacacgcgatggccagcttttccacgagatgattcagggtacgtaagaaaattcgtatattagttatatcatgtcttatattaatgtgagatttcttgtggttttacattttaattttcttagaaaaaacaatagacagtgtttagtttaatgttgaaaaaacggtctaggtagttatgactattattttttaggcattgaaattaagcgtttttgtcataaaacaattataggctgtctatatttaactcttaaccaattatcgtttaattgtcaattatttgctcgttgacttttcaatttatatttatgtagaacggcgtctagacatgtttagctaatgctccttttatttatggcataatgtagtaaagactaaagatcattggtaggttatgcttggatttgggtatggattcagagacagataagcggtttagggtatcaatagagaaacaacctagaccggtttagctagcaatggcattgatatggcacactgtagttagtatatatcatttgtagttgatcggatttggatttgatgatggatgcagaggcagagaagcggtttggggtatcggtagagggggagagggactcacgggcgtatatgtctggacctgagctcgggatccatccattggcgaatggaggaggcaaagggatgaaactagagctacgagaggtcgatatcaagccggttgagtctgtcggcagcgtctttgtctgagtttacttaaaacctctaataatgccctcaaagcaagcaatgtatgttttggtaaacacaaaacgtacggaactagacaacaagattacttaaaatagtttggattatttctttgtggatcttatttataattagtaataagataagaaataatatctataagaaaaggttaactaattcacatgaattaaattaagtaaccatgaaaagcaatgtagtaaacaatttagttagaaaggttgatatatactattatataattcagctccgagcaataggaatcagactcgagagccatactactctgacttgatttttggaaataaaaatcacaagaagaagtttctaaccaccctacgtatgtatatgattataaaattgagattatgaaacatcatgacttttattccccaatcaaaaaattcctctgtaagacaccacaccaaaatatttattaataatatattatttgcgtgtgactttctgacatttttctctctaaactttgacatg

SEQ ID NO: 13070 - DNA, 3000 bp, Unknown
  misc_feature (1)..( 3000): cDNA_ID_2710386_gDNA_ID_2214595_Annot_ID_135469 3000 nt of promoter + ATG
ccttaacgattttgtgcttcttggtcataaactcataaaatatccctattttaaaattttgattagtagtatttcattttcatatgaatcgtcttaaaaatatgctacttgttcatgttttagtgatttctttattttcatcactcacaacattgataatttttttttacgtttttgataaatgattattttgaaaatatgtatatttcgtatttgtatttcttgtcgtatatccttgtatacatgcttagggcaatgttttatataggcctacatctcttataatataaatcattggaaatccacagaaatttccatatgtacttccattttcttataaaacatcttgtctaggttaataatacactattatattttaatttttaaataatgattctgaacaaaatataaaagcaatagtaattatgtttgatgtgattataaaactaatactaaataactaataaatttattttgaattaactccttcataatcaacttaagaatatgagtgatgctagggaatcgagaggtctgtgtctgtgtctttgtatcattaataggtcgaagaaaacctataaggtaacaagatcatgacggatattaaatcattagaccaaacacacacgcaaattaacaatcattttgaaagttttcagtttgtaaatgctaaacgatgtgatcaacgtctataaccaaatgagcattacatagccttccattcaacaacaactatagaaaagaggattaattccacacaactatacacaagcataaagcaattaactaattatataatactcacatatatatatatatatatatatatatatacatgtgtgtgtgaactgtgaaatgaattgtaaaacatgatgaatcttgtttgcttttgactgcctcgtaaatgttgaaattttaaggatattaaagggagtcttccaaatcattttggattaggaaggagcaaaaagttaatcattatatagtattatagaatcaactaatgatgcataatactacactattataaatttataatatagcaaagtttttctatagtcatgcttttaccgtttttgttacttacatacttcttgtagaaaacatctatttgccattcaactgcttaacaaacgtgtaattttatctgaaaaagacgcccacgtttaatttcgttggatgacaatgactgtatacatgtatacactattttaatctacgattggtttatataagtatacatatattgtatagtatatgcatggatagtcattgtagttataatatcgaaacggattcttttgctttaaaaaagacaaaaataattaaatatttggataggatgggttttggcttttagaaggccagatgccaaacatgccttcatcatttcgtctttcccattccaagtccctgcctcacaatgttggtctttttctgctttgatttttcgtacgtccaccttaaattattttcttggtaaaccatattaattatattactttatatcatagtataaactgtttatggtctatgccgttagggttcactttgatgcgaatctatgcaaatatgtataactgtataaggatcaccaagtagttctatcgtttttttgctaatcacttaccaaataacagaagttcactactgtaatatatgttgaattaaaaaacataaaagggtatcataagataaacaaattaaaatatgagataaaaaaacaaactaaacaaaacaaaactacagtggttggttttctacatgatatatccatatagaaataatttgccgccacatcaataaacgatcttcccacgagtcgtttcttcgtcagtccactatcacacacacgttgtcatttattctgagttgtatttaacacactttgagtttttgacctgacttttcgattttcttatatattcaaaacgaaattatactacaaaaagtagaagactattcacaacattgtcaacagaatttctcaaaataaactgttgtactcgtacgcgataatggatatatgatatatccaacgtttcaaagatatcatcaaaaatattagggtttgtttcaaaggaagaaacactttttgtcaacaaaggctcaaagctcgctcacatctgtacacatatgatgatatgatctagtatttgtatcatatatatgagcatgcatgtgtatgcactgatgcacataacacagactttagtagagtatcctagtatcttatgctcaaacaattgtgctccaagaaaagaataatgatatagtttttaaaacttggaaatttcacagaatctataacttaataagtatagcaaaatataaaaagaaacaaaaaaagccgaaaaaagaaaacatattgaaagggaaagatgatatgtcactacaacaagacacattaccctttattgtttgctttttactttgtctggtagaccaaaatctaggactaggagggatgggaaatgtaaattttagtcagtattaaatgtttggattgtgatatcgtctttacttatcgagcatgatttttgccaaatatatctcctatatatgaatggacacgatcaaattcaaagaaaccttttgattacatcgcatgttattaaaaaagcttagcaaatcctatttttattcgtttacgattttaaagtaaataatataaactcaatctactctacctttttcggatatttaaatgtaaatcacacatacacaacttactctattaaacaagagaaatacgatttatggattcaaggaattttgttgggaatttgttcaattttacggtatacaaaagaaccaaaccgaaaccaaaccgaattttaagatgtatactaaacgatgccgtttaatatataggaaaaaagcggtgtatagtcgtcgtttctcgtttaagctgattttagtttccgtcgccggctaaaaagctcattcgacgccgcctgagctttgagttttgacccgattctgacgtcttcttcaatg

SEQ ID NO: 13071 - DNA, 3000 bp, Unknown
  misc_feature (1)..( 3000): cDNA_ID_2710390_gDNA_ID_2214595_Annot_ID_135470 3000 nt of promoter + ATG
aaaatcaaagcagaaaaagaccaacattgtgaggcagggacttggaatgggaaagacgaaatgatgaaggcatgtttggcatctggccttctaaaagccaaaacccatcctatccaaatatttaattatttttgtcttttttaaagcaaaagaatccgtttcgatattataactacaatgactatccatgcatatactatacaatatatgtatacttatataaaccaatcgtagattaaaatagtgtatacatgtatacagtcattgtcatccaacgaaattaaacgtgggcgtctttttcagataaaattacacgtttgttaagcagttgaatggcaaatagatgttttctacaagaagtatgtaagtaacaaaaacggtaaaagcatgactatagaaaaactttgctatattataaatttataatagtgtagtattatgcatcattagttgattctataatactatataatgattaactttttgctccttcctaatccaaaatgatttggaagactccctttaatatccttaaaatttcaacatttacgaggcagtcaaaagcaaacaagattcatcatgttttacaattcatttcacagttcacacacacatgtatatatatatatatatatatatatatatgtgagtattatataattagttaattgctttatgcttgtgtatagttgtgtggaattaatcctcttttctatagttgttgttgaatggaaggctatgtaatgctcatttggttatagacgttgatcacatcgtttagcatttacaaactgaaaactttcaaaatgattgttaatttgcgtgtgtgtttggtctaatgatttaatatccgtcatgatcttgttaccttataggttttcttcgacctattaatgatacaaagacacagacacagacctctcgattccctagcatcactcatattcttaagttgattatgaaggagttaattcaaaataaatttattagttatttagtattagttttataatcacatcaaacataattactattgcttttatattttgttcagaatcattatttaaaaattaaaatataatagtgtattattaacctagacaagatgttttataagaaaatggaagtacatatggaaatttctgtggatttccaatgatttatattataagagatgtaggcctatataaaacattgccctaagcatgtatacaaggatatacgacaagaaatacaaatacgaaatatacatattttcaaaataatcatttatcaaaaacgtaaaaaaaaattatcaatgttgtgagtgatgaaaataaagaaatcactaaaacatgaacaagtagcatatttttaagacgattcatatgaaaatgaaatactactaatcaaaattttaaaatagggatattttatgagtttatgaccaagaagcacaaaatcgttaaggacaatatttaattattcaaaccattaccaataggaaagacaacaaaaacaattgaataagcctcccttaatttcttctaatcaaatcaaaaaactttttttgactaattaatattttagactcagccaaaaaaaaaaaaagtgattactgattaatctaagaattgaaggttccttataataagctcattctcattctctctctctctctctgcgctttattctgttcaaaatcctctgcttttactttgccgtttcactgagaacgaggctcgctcactcactctctctctttctctttctctttctctttctctttcatagaagaagaagaagattcaggacctaagtagaaaagcttaaaccaccactctctcttcaaatcacacttttgtttgtttcctctctctccaaaatctttctcattgtcttctttgcctcctccttcaagaactcttgtctcttccaacaacttttttccttcttattctgaaaaccaatcttcacttctcatttgtctcaaaacactatacccatttcctaattcctgtccctgagagcattagtagagagacacaaaacactttaatcctaatccaacttgtctttactttagcttctgtctgattcaatcaaaggacaagaaagaagccaaatcttgtcaattctttttaaacagtgattcaactaaaaaccccaaattagttgatttgatctctattgtcttcttttttttggatggattgagtctcaagaacaaacagtgaatcaaataagagcaagaatgagagacgataaaaccaagaaaagcaaggtttgtttttatgtttcttcaattctttgccatctttcatgaattttacagatgaacagtttcatttaccttctttttttttatgcttcaatgaagttgtcatggtccaagaagatggtgaggaaatggttcaacatcaaaagcaaaactgaaaagtttcaagcagatgtttctcttcctcaaggtaaccaaaagtctacttcttgtcaaaattttgtttctttgttctgttctgcagagctttaatttgtaatattttgtcttttctgagaaaacaaaacatctcagtttcactttctttcttttcttttggggtcaattgacagttactgtttcttttgctttaaccactcttctctgtggaaattaaagaattagcaattggcttgttatgtactgatttcaaattctgatcttttattcaataaggagttgaagttgagcacagaaacagcttctcagagagagagccctgcacaatcaagaagagcaaaactggtatataatcatttaccaatatgatcaaattctctatgagagagttttcttctttggtctcatgatttctgagtttcacagaaaaactcaataagaactgggagcagcaagctagacaaaggaaaatgaactatgaaaatcccagaatcattgatgtccaaaaccacaggtaacatatatatgaacacaatcacacacacacacacacacacatatgtgacttattttagtagaatctc

SEQ ID NO: 13072 - DNA, 3000 bp, Unknown
  misc_feature (1)..( 3000): cDNA_ID_1029586_gDNA_ID_2214595_Annot_ID_135473 3000 nt of promoter + ATG
aatttcgacatcaaacaaacttaatatatatatttgatatttgttaattcaaatcagatcagtgcaacgaatcagaaggcaagaaactaaacatgaccatatctctaacatttcctttaagatacataaatttcctcatcacaccttctttcacaaacccaactttttcaagaaccttttgagatccaacattgtcaacgtcaacaagtgcctcaagcctctgcatctctggcttctccttgaatatctcccccgccacaagcctcaccgcttcagtggcgatccctttcccccaatacttgcttccgaggacataaccaatctctcctctgatctcatcgactggcgttacggagatcgagccaatcggacggtcgttatctaagcatatagctctaagccaagggtgtggcaaaagagcgtcgtttaagtacgcgatcgcggcttctcggctagtgtaaggctcccacgtgcaaaagcgtgtgacgtttgagtcagtggcccaaaccatgaaatcgtcgacgtcggaaagagtcattggccggagatggattttctccggaggtgaggaactcacggtggatagggtctccggtttgatcgtagtagttgagtccatctccattgactttttcttggttactttcctttttgagtctttgaagcttctttgggattctttaaaataaattatctctctcaattcttacagatttgtgtagaggcattatgataatacttcttctacaaatcacgatttaaatactgatttttttttaacaaaaaagaaaataaacagaacgttccttcttgcttcgatcggtcaaatacgcaacaattagttcttgttgaatggaaggtgtgaaaaagacggtttataatgggtatgggtgaaccgtatatttaccatccattcatcgtttttgatttaaaagaggtatattcaatctagtatttaaagtgactttcgtaaattttacaagtatatgttatttaattatggattttgaaaattctaatgaaatctagtgttattaaaataataatttaaaaatctacctttaaattcactgttattaaaaataatttatggatttgatttttataagaatgtattcaatctaatattttaagtgatttgtgtaaaatttataaattctatgttgttcgattatggatttgaaaaactttaatgaaatctagtattattgaactaaagatttaaaattctatcttaaaatctattgttattgaaaataattggtagatttgattcttattaattttgaaggatttgagaaagttctttagttaaaaataacaaaatcgaaattcatggtcttatatagaattttaaaatattttataataaatcacatcaattttcctaaaatcatcaaactcatataaaaactagctaaaactcaaattgtaaggtccaaattaatgagtcaactcaactcaactcaactcaatccatgaaccctaatgagttgaaaattttgactcaaatgagttgatgagtcaaatgagttgatgagtcaattggtttgatgagtaaaatgagttgggttgtaatggttaatggtttcaatggtttatccaattaacccatcaaattttgtaaaattgaattaaaccaactaaaatctctaaaccaatgccaatttaagtctaaccaacacatctaaaccaatttaataaaattaatatttttccaaatttcttaaatatacaagcgatgaaattgagaaaaagtaaacccgtaatttttccgccaaaaacgtaaatccgtgattttcccgccaaaaacgtaaatccatgattttcccgccaaaaacgtaaacccgagattttcccgccaaaaacgtaaacccgtaaaaagtggaatccgtaaatatattaagttttgatgataatgaattaataatgataattatttattattattttataataataattaattaaattattacttaaatgggttaacccatttaacaactcaacccattaaattaaatgagttatgggttgacttaacccatttaacaaaatgagttggatcaacccataactcatttaaccctaaactcatttgattatgagttgagttgagttgtgttacccattttgacacacttagatctaatacacctctttattaattttaaaggatttgagaaaatttaaaaagatttatttagttacatatataaaaattcaaatctcatatttttactggaatttgattttttttttttacaataaatcacataaaaagacattaaaactcaaaattatttaaaatataaggttcaatacatattttgtcaataaaaatttaataagctgctaatatagttcatgagaaaaatcaaaaattaatttatcaatcgaaaaaaaagacgaagaaaaattaatttatctacgtagcgcaagagacggagtgttgtttatttaaagaaaagaaagaaaaaaaaaagaacgaatattaaaatggcgagtcgctctcttttctctatctcaatctcaccttctcaatttacagttttgccatccatcaacaacgagagacgacgccttgctatcgccgctcgatctcaccgactatcacgccggaagattcgtaagagacctcctgatagagatatgtcctccatagtttcaatcccggagcttcctcgccggcgggattctgaggaaagcctgcttttagattctcgaatcagtaagttcttaaagcaacagaatcctcagaaattggcatttgggattaggttttgcaagtatcgaagctccattaactgaatcctcagaaatgtgtgtatatgaataggtgtagctgaaggagatacatcgaatacagatgtagaaggagacagagatactacttctagtattagaacacagcctccccctcgtaaaggaagaaatcttagtagcagcagaatcaaattctacggtgttgaattatcaccagataatgttgctgtagca

SEQ ID NO: 13073 - DNA, 3000 bp, Unknown
  misc_feature (1)..( 3000): cDNA_ID_1031052_gDNA_ID_2214595_Annot_ID_135475 3000 nt of promoter + ATG
cataatgtggatcgaacaattgactcgccaggccaggaagaaaccggaatgactggtgtttctaaagtaatcagagctgaccagaaacggttcttctttgatcttgggaacaataacaggggccatttcttaaggatatctgaggtaatcttggaagaacaatcttttgctggcttatctcttgagagcttgtatttaccatggttttaacattaaagcatttctcaatataggtggcaggttctgacaggtcttccatcattctaccgttatcgggtcttaagcagtttcacgaagtaattggtcactttgtggagatcaccaaagataaaattgaaggtatgacaggtgcaaatgtcaggacagttgatcctcctcagagataagtattgattctcttagaggatggaaattttcaatcctctaaccatttgaatctggcaacttcaagtcgactgcctgatcgcggtgtgcaatagtttcacgtaatatctctcgccccttcacatcttctaaaaataattcagcaggatcatcatttgccttaatagtagataaaacaaactttggagtctgcaactgggaataagctgaaaatcatccaccatgtgtatctctctctctctctctctctctccctccctccctcatttgcttctgttctgttttaactttttttgtttttgttcagtttgggtcattgggtgtatatctgttgacggcttgatgcatttcaattgtaaaagaatattggggtttatatgtttgggctaatgcctgttggaataaaagatgaagtgtaagttctatacatgagttacgaattctttttggttttgtctgaaaatgatttagttctactaccagaggttctaagagcagttgcgaattgtatatactgtcctaagcatgctttggttagacaaaaatttcgatttttaggttaatcgaaaatgcctcaataataaaaaaaaaagaaaaagaaatcaacgttgcgtataaaacaagggagaagataaaaaaacagcgtttgtaaataaaaaacaaaaaccctaaaaaaaggagcaactttgggcacagtccgagagagagaaaaaaataaaaaataatctgtcggtgatttataacctcctctctaataaaccaccacatcctctgaaaccctagcctgaacaactcgccgtcttctcgagaaacatctttcttacttcgcttcattacaaggttcgaatccagctgtctctcttagtatttgtctatgtatctgtcgagtttctctgttttcattgatttatgtaaaatcagaaggttttggtttttgtaagtgattcatttgttttgtgttaaatctattgcagatctgatgaaaccagatcggatcttgctctagatccagatgctccttaacttatttactcgaattcatcatcatcgttatcatcaccatgtcactgtttctaaaagacgattcgattcaaatccgtgaagtatggaacgacaatctcgaatcagagatggctctgattcgagaagtcgtagacgatttcccattcgtagcgatggacacagagttcccaggaatcgtgtgtagaccagtgggaacattcaaaaccaacacagagtaccactacgaaactctcaaaacaaacgtcaacatactcaagatgattcagcttggactcactttctctgatgagaaaggtaacctcccaacttgtggaacagacaacaagtattgcatctggcagttcaatttccgcgaattcgacctcgaatccgatatctacgctaccgattcgatcgagcttcttcgtcaatcaggcatcgatttcgtgaaaaacaacgaattcggtatcgattcgaagcggttcgctgagcttttgatgtcttcagggattgtgttgaatgaaaacgttcattgggttacattccacagcggatacgatttcggttacttgttgaagctattgacttgtcagaatcttcccgagacgcaaacagggttcttcgagatgatcagtgtgtatttcccgagggtttatgatatcaaacacttgatgaagttctgtaatagtcttcatggaggtctgaataaattggcggagctgcttgatgttgagagagttgggatttgtcaccaggccggatcggatagcttgttaacgtcgtgtacattcaggaagctgcaggagaatttcttcattggttcaatggagaagtattctggtgttttgtatggtttaggtgttgagaatggtcagattgttcattgataaaagcttaaagttttaaacaggttatgttatttattttagattattacatcataggttgttttaagaagtgtatgatcacaagaactaaactctgattttggtttggtattgtgctctcttacttgtttaaagatagcatctcacttaatttatgaaaaaaaaagtttgatatatgtcctttttcatcatatcttaaagatattatcaaaggtatacgtatttggcctattaataaaatttcacaatgtgttaaaagacttaaaggacaacataaattgtggattctgtgaagtgtttaaacattaaagatgaaaattgggaaagattaaacaaacgacagcgttttttaaaaggacccagatattgaaggaatggcccagtaaagcccattaaagtagagcccaggttcgtgacaaatctgttaaaatcgtataattcagggttcgtaaaaccctaatatataacttcgctactcattttttgctcttcgttgcagcctctctctctttaaggttagtctcttactcacttttgcgtagttcctcactgaaaattgatctgtgttcatgtatgtgattgtcttactttgttcatcttcctccgatttggttgtgtaatttcgatttatgtatttattgagactgatttgcttcatttccttggcagatttggaaaagacctttgcttctcttcgttcggaaaaccagctcaaagattcaatatg

SEQ ID NO: 13074 - DNA, 3000 bp, Unknown; identical to SEQ ID NO: 13067
  misc_feature (1)..( 3000): cDNA_ID_2710400_gDNA_ID_2214595_Annot_ID_135482 3000 nt of promoter + ATG

SEQ ID NO: 13075 - DNA, 3000 bp, Unknown
  misc_feature (1)..( 3000): cDNA_ID_2713056_gDNA_ID_2214595_Annot_ID_135483 3000 nt of promoter + ATG
cctcatcgtcgacgtcgaaactctattacatgtaaaacatatgttatacggacgatcatttgattattttgttacccttatattattcatatcatatacgagtgaatgaaactgtagtatgagaaatggtctaattaatgttttaactatatgaaaaaaagctcttactctggtgtatcgtacatatcggtagtgagtttcctttcagaaaccacgaaacagtcgtcaatttcttctctatctccatttctttctctggagatatttgacagggctttcttaacttccttgatgattgaccttatgaaatccttctcagatttatcactttgatgtgtaaaagaaaagaagattaatgggtttagtagctttcctttacacttacttggtatcttgtgctacaagaaacagacaatttttatgattgaaaaatcgtaacctgtgttctggtaagcacaatgcaaacgttcgggaaacagaagtcaaagcttccgtccatttctggtatctttctggttcatgatgatatctctcaatcagatccctgaatttatcgccgaattttcctttaagacccttcaccactgcgggatcaagcttgtagaagatgggaatcgctatgattttcttttgatcaacgcatttcttgatctgtaccagctcgtccaaacaccattttgactcggtgtatccctcagagaagattaccaacgcgatttttgactcacctatcctcctaaacaggctgattaggtcttttcccctcacctcgtgctcatctataaagacgttgatgttttttttcttcaaggcaggcacaagaaaactgatgaagcctttgcgtagctcttttcccctaaaactgatgaacacttgaggtcccgttgggatcactgatacattagaagaagaagaaggagaagaagaagctattgccatccgatctcgagttctttcttagaaacaaaaggagtttgatcgattcttgtttgaaagaaaagaagaatctggaagacgcaatgaaggaacttgttctgggacagcaaaatctgtatgtcttttttttttttttggttggaattgaaattacctacatcctatcgtcgttaataattaatattcagacaaaagaaactttttggtatatttcctggaaacttcggtgcctaaacacggaagttgcaaaggaagaacacgacataagccccaataattgaatggagaaaagaattttctaagaatctctggaaaacaagtgactacttctctgaccacgcatagggggaaaggaatttcgtcctgaatttcagaaaaatttcgacgtaatttctttgcaattcaaggaaaatttgcctcaaatatgttgtctcaggttttgtactacactactcaaatatgtttaagacaagttactaatactcaaagttacatgaaataaatagttagattgtattgcagaatccaatttgtaaaattagaattggttttaaaatatttagataaaaaaaatataaattattattagaacttaaaatattctattaaaaattttatatattttttacaacttatttaggtgagtcttatctagttacatacgatgatgaaagttgttgttgctagactccagatgaagagaacaaatgtgatgatttggactagaaatattaattgtcattcttctctggctccaatggttattcaaataagtatatgataattgaaattttaataaatgaataatgaaagcagaaaataataagagtatcatgttggaatctttcacgatagaagatgaagaagttgtagaaaatgtccaaccaataacgcaacatattggtgacatcttttgatggggaagtgctgatgtttgggagaggtccacagacaactcaacaactatcaattaataagtatactattttatttaaaaaaatcagaacattatcactagcaatatcgtatttcttatgtgtgaaaagaacacgattcctaatttctgctggttagatagattcatggcatttttttcttctttttttcgtggtttttaggaatttgtaatgctaatcagtagtacatgagatttttgctaatcattctccaataatctggtgtagcatgtgaaacacgtacaactgaacgaagcatattctgtcaacgcgtagtagcctactaggaattgatattattttttgtgtgaaacacacgtgttttgtgtgcacaaacttaattaggctagtgagtcgatcgtgacatcatatttgaatttcacataaaggcgatgttgttaagaaaacatctaaaagctaaaagttaaaacctaatgatggacatttcatatgatacttcatcgatgtttagtacaaactatagcgacgcgttgcctaatttttctgtaacttttcttgtgatggcattgaaaaactaaattctattaagttaaaatattggaacgttatagtaacatttactatcaaccatggacgaagtttaagtttaacattaaaaaaaaaaaaaaaaaaaacatggacgaagttccatgctcgctgaagacatcgaataagtaatatttcatagcgttttaatacaagttaattagaacatttttagagacttaacacgttaggttaattaaaaagtggtttaacattgtttaattaagatagaaagcggccattgcaagtttgaaacacaaatgaggatagaatatgatccgagtaaatatcaaatcatattttataatgtaatggatgttcaaagaaaatgtataaccagataaaatagacgaaagggatttgaaccatgagtcagcagtcagtatccattattaaaaaatagagaaaaacaaacactaaaaagaaaagactcgtcttcctataaataccttcaaacatctccctttcttcacgcctcttattgttgtttgctatataaatcctccaatttctcaatattctaaacaaattatatattttcttacttacttgttctcttgta

SEQ ID NO: 13076 - DNA, 3000 bp, Unknown
  misc_feature (1)..( 3000): cDNA_ID_3027983_gDNA_ID_2214595_Annot_ID_186893 3000 nt of promoter + ATG
aaggatttcataaggtcaatcatcaaggaagttaagaaagccctgtcaaatatctccagagaaagaaatggagatagagaagaaattgacgactgtttcgtggtttctgaaaggaaactcactaccgatatgtacgatacaccagagtaagagctttttttcatatagttaaaacattaattagaccatttctcatactacagtttcattcactcgtatatgatatgaataatataagggtaacaaaataatcaaatgatcgtccgtataacatatgttttacatgtaatagagtttcgacgtcgacgatgaggaaggtctcctccaacaatggagtcggagtcggtacgtttaagtcacagaaaccaaatttcgacgatgaagatgacgacggagactcccttttaaaagcgttggttgcgaagctcgtcgctagtacaacttccattgtagctgcttacgcagagcttcagagggcgcatagcgacgctatacaagcggcggaaacggtggtagttgatgttaaaactttatcggagcttatacggagtagtaacggaggaggtggtggaagtggcagtggaagcggtagctcccttgagaatcagccgaggagatcaaaggtgaggaagcaagtgtgggctgaagttctcggcatctcatccgactccaccatcatattagagtgtatatagttggtttagttatggtttagattcgttagtattttgatttagtttacttgtatttaagtttaattatatatcatttttacacttaactagatattgacccgcgatacaccacagattgatattttcattacaaggtgtatcatatattaaaaaaacaatagcctatatattaagggtaacaaaataatcaaatgatcgtccgtataacatatgttttacatgtaatagagtttcgacgtcgacgatgaggaaggtctcctccaacaatggagtcggagtcggtacgtttaagtcacagaatccaaatttcgacgatgaagatgacgacggagactgcctttttaaagcggtggttgcgaagatcttcgctagtacaacttccattaaagctgcttacgcagagcttcagagggctcaaagtccgtacgatagcgacgctatacaagcggcggatacggtggtagttaatgaactaaaaactttatcggagcttaaacggagttttatgaggaaggaattgaatctttcaccaaaagttgcgattatgttagctgagatccatgaacagcagagtttgatgaggacttatgaaatcgcgatgaagagacttgaatttgaagttacggagaagaaagtgaagatcgatgagttgaagatgaatcttgaagagaatttggtgatgaataaatcgttggagaagaaactcacagctacttgactcatcgcttgaattgaaaattattgtattttcactaacttgttggactttagatatgagccgagcttgcttttaagttgacattgaacgaatttttgtagaaattttgcaaaataactattcaacgtccgtgaccaagaaatttaaaaagttaagtgagacaaccctattaattatcatgctaatattgttattttatacaccaaaaaaccagcattgttgccttgttggccacataaacatcaaccaagaatataaacacattatgcaattttttgaaagtaaaagtctccaacaatattaaaaaccaaagctaaacaaatgatcatttaccatactgtatataatttggaactctagcgagaagcacacttgatttcatggctttccgagagcctatacttcataatgactatgccacatatatagcgcaattcttgattaaatcgaatgactatggtatattggtataaatttaggtttgagcctttatgaccagatgaacattctagatacttcttagcacaatcatgtacatataaatcgataaactggaaattgttgagagctcacgtcttaaagcatatgttggccaaaaacgccaatcacgtaagatgcataatttatgcatctcttaacgttgattactttgaaatctcatcttgtgatgatgaaatttaatcccttaaggcgaagagaaataagcacaatgaccaagaaaatcctcttcttaaacttctttgacgattggagtttctgatgctaattctttgatattctgtatatgcattggccaattttcatatatgtaattaataaacacactgattgatatactaattcattgaaaaatttagaggaaaagaactaattgaaacaaatattataatttatgatctagagttgggccagtactattctacaggcccatatgatttgttaaaattaatatatatatacaagtttacttcaaatgggcccattttttagagaaaaatagtaaagtaaattattttcttgggtcggcaaattaatttagcgagaaaaaaaaaggaactccctcctcttttctctggcaaactctagaagaccaaggaagcacagtaacaatctctctctcgcaccttcttaaaagctgctctatttcttcgcttccctcttctcttcactcacaaaacattttgttctaatcccgcaactgctaaaaacaaacccttttgtcaaaaatctctcctttcggtggtgacaggtttgttctttccgagtcctctctttttgaataatactttgtttggttttagctcagttcttgtacttattgaaattgcaattgttagattttctgattactagtctaatccttaatttgatttcaagtttatttgtcaattttgaatctttatctgggtggaatcgtacgactgtaaaatcctgataaaatcctacaagacactttgaaattagtttcagtttgtggtagaattggttcttaatttgttttgaatgttgagtgatgaactcaaggataaatctttgattgtgttgataaatcttgaatcctgaatcagaaatctatggcaggaaatg

SEQ ID NO: 13077 - DNA, 3000 bp, Unknown; identical to SEQ ID NO: 13073
  misc_feature (1)..( 3000): cDNA_ID_1031052_gDNA_ID_2214595_Annot_ID_186888 3000 nt of promoter + ATG

SEQ ID NO: 13078 - DNA, 3000 bp, Unknown
  misc_feature (1)..( 3000): cDNA_ID_1029586_gDNA_ID_2214595_Annot_ID_186886 3000 nt of promoter + ATG
aatggattaaatattttaatactgttaatatttgtggtgcaaatgatcgtaatcgtttgttatatactgtcaaaatcaactcaagaatcaagtcactcaacatgttgtatgattaagtaatttagctaaagattaattaatcgaatgttatcagaattccattcatctatcgctgtaaaactagctatcacactatctttttattgtataaaatatttcatgtttagattcaaaaagaaaatatatatatatatatcatgtttcattttgtacttttaattttcaatataaacttacattttttctgagatagtgaagctttgttttatttggtgaagtgaacatggtaaatagtaaatacattactctcaaattataaaaaataacttttgtatgaaatagttaatatataaggttacaactaacaattacataagaagaagaaagatagagcatcacatcaaattatacatgtgatttttacaaactaagcaaaatataaatttcgacatcaaacaaacttaatatatatatttgatatttgttaattcaaatcagatcagtgcaacgaatcagaaggcaagaaactaaacatgaccatatctctaacatttcctttaagatacataaatttcctcatcacaccttctttcacaaacccaactttttcaagaaccttttgagatccaacattgtcaacgtcaacaagtgcctcaagcctctgcatctctggcttctccttgaatatctcccccgccacaagcctcaccgcttcagtggcgatccctttcccccaatacttgcttccgaggacataaccaatctctcctctgatctcatcgactggcgttacggagatcgagccaatcggacggtcgttatctaagcatatagctctaagccaagggtgtggcaaaagagcgtcgtttaagtacgcgatcgcggcttctcggctagtgtaaggctcccacgtgcaaaagcgtgtgacgtttgagtcagtggcccaaaccatgaaatcgtcgacgtcggaaagagtcattggccggagatggattttctccggaggtgaggaactcacggtggatagggtctccggtttgatcgtagtagttgagtccatctccattgactttttcttggttactttcctttttgagtctttgaagcttctttgggattctttaaaataaattatctctctcaattcttacagatttgtgtagaggcattatgataatacttcttctacaaatcacgatttaaatactgatttttttttaacaaaaaagaaaataaacagaacgttccttcttgcttcgatcggtcaaatacgcaacaattagttcttgttgaatggaaggtgtgaaaaagacggtttataatgggtatgggtgaaccgtatatttaccatccattcatcgtttttgatttaaaagaggtatattcaatctagtatttaaagtgactttcgtaaattttacaagtatatgttatttaattatggattttgaaaattctaatgaaatctagtgttattaaaataataatttaaaaatctacctttaaattcactgttattaaaaataatttatggatttgatttttataagaatgtattcaatctaatattttaagtgatttgtgtaaaatttataaattctatgttgttcgattatggatttgaaaaactttaatgaaatctagtattattgaactaaagatttaaaattctatcttaaaatctattgttattgaaaataattggtagatttgattcttattaattttgaaggatttgagaaagttctttagttaaaaataacaaaatcgaaattcatggtcttatatagaattttaaaatattttataataaatcacatcaattttcctaaaatcatcaaactcatataaaaactagctaaaactcaaattgtaaggtccaaattaatgagtcaactcaactcaactcaactcaatccatgaaccctaatgagttgaaaattttgactcaaatgagttgatgagtcaaatgagttgatgagtcaattggtttgatgagtaaaatgagttgggttgtaatggttaatggtttcaatggtttatccaattaacccatcaaattttgtaaaattgaattaaaccaactaaaatctctaaaccaatgccaatttaagtctaaccaacacatctaaaccaatttaataaaattaatatttttccaaatttcttaaatatacaagcgatgaaattgagaaaaagtaaacccgtaatttttccgccaaaaacgtaaatccgtgattttcccgccaaaaacgtaaatccatgattttcccgccaaaaacgtaaacccgagattttcccgccaaaaacgtaaacccgtaaaaagtggaatccgtaaatatattaagttttgatgataatgaattaataatgataattatttattattattttataataataattaattaaattattacttaaatgggttaacccatttaacaactcaacccattaaattaaatgagttatgggttgacttaacccatttaacaaaatgagttggatcaacccataactcatttaaccctaaactcatttgattatgagttgagttgagttgtgttacccattttgacacacttagatctaatacacctctttattaattttaaaggatttgagaaaatttaaaaagatttatttagttacatatataaaaattcaaatctcatatttttactggaatttgattttttttttttacaataaatcacataaaaagacattaaaactcaaaattatttaaaatataaggttcaatacatattttgtcaataaaaatttaataagctgctaatatagttcatgagaaaaatcaaaaattaatttatcaatcgaaaaaaaagacgaagaaaaattaatttatctacgtagcgcaagagacggagtgttgtttatttaaagaaaagaaagaaaaaaaaaagaacgaatattaaa

SEQ ID NO: 13079 - DNA, 3000 bp, Unknown; identical to SEQ ID NO: 13070
  misc_feature (1)..( 3000): cDNA_ID_3028000_gDNA_ID_2214595_Annot_ID_186882 3000 nt of promoter + ATG

SEQ ID NO: 13080 - DNA, 3000 bp, Unknown
  misc_feature (1)..( 3000): cDNA_ID_3028004_gDNA_ID_2214595_Annot_ID_186881 3000 nt of promoter + ATG
ttgttaattctgtttttaatgttgggattagagctttgccattgcttagtcttgttcacgagttcaaaggtcaataaaagctacttttatgcgaattactctcctgatcgagcataacattagtggttacacaggttgcttcaagtgctctagggtttgggcctcagacggctatgcatcttgcagagcgattgtatactcaaggtttcatcaggttcgattgctccattctccagattattatttttgtcatttaactcctctttaccagcgtataattggctaattttggtaaatcccaattcgttattgaatggtagttttgtttgtttaattaagaactggtagataggaaatggaaaaaaccgtcgctgacgagaacatacatacatcacaattttcgctgtataatttatttaaacatttaaagtgacggaaacttttgactcaaagtcctttgttttgtgctagctatccccgcacagaaagcacagcctatccttcttcattcgacttcacagacacactcagagcacaagttagtaatccagtatggggtggttacgtacagagactgctctcagacggatttcatatgccaaagtcaggaactgacgctggagaccatcctcctatcaccccaatgagagcagcaaccgaggtcatggtcggaggagatgcttggcgactctatcagtatgtctgtcaacattttcttggcactgtttcacctaactgcaaatacataaggtaaataaagccttgtttgtagcttaatccatgtcagttacagcttattctttgcacattttaaatgtggtattctcttggatgggtatctcaggactaaagtggaattgtcaattggtggagaaactttccattgtacggggcagcgtgtgacagaaaaggggtttacagctataatgccatggtctgcagtagatgagaaaaaactcccttcttttctcaaaggagagaggattgaagttttaagagtggagctttacgaggtcacattcttctccagtttttgttactgctctctttgctttgtactaggacacaaattactataatgtttccacttttagtttattttttctgtttgtatttgaatgttgtaaaatctacaggggaacactgcgcctccggactaccttactgagagtgagctgatatctctcatggagaagcatggcataggcacagatgcatcaatagctgtacatataaacaacattggtgaacgtaattatgttcaggtgggttaacctacccaaaggcggtgtgcttttcttcactgttacaatgttactctctcaggaagatccttttttgttttctgaaaaatctcattactcttgtttggtgcttacacacttttgcaggtccaatctgggaggaaaatggttccaacggcgttaggaatcacgctaataagaggctatcagtgtattgatccagacctttgcttaccagacatccggagttttatcgagcaacaaatcactcttgttgccaagggccaagctgatcattcacacgttgtgcagcatgtgattcagcaattccggcgtaaattcagttattttgttcaacaggttgggaaaacctggctgatattatgttttcttcggaggcatttactgatattgtcttcgatttaatctgttcctccttaacatctttcgtatattgtcctttcagatcgaacacatggatgccctctttgaagcacagttctctcctctggctgattctggtcgtgctttaagcaaatgtggaaaatgcttgcgttacatgaaacatatcacagcagtcccaccacgtctcttctgcggcacatgcgaagaagtttattatcttcctcaaaagggcacagtcaaggtaaaaccctttcgtcaccttaacccttgagctgaaacctcagtgaatctctagtttttcttatcctttgctaacggattttctcacagctatacaaggaactcacatgtcctttagacaactttgagctcgtgatctattcagttccaggacctgaggggaagtcatttccactatgcccatactgctacaactctcctccatttgaaggcatagacacactttttggagcctctaagacgcccaatgctcctgccaaaaccaaaaccggtgcaggcatgccatgttctctctgtcctcatcccacatgccaacactctgtcagaaaccaaggagtctgcgcttgtccagagtgtgaaggcacgctcgtcttggacccggttagcttccccaagtggaaactcaactgcaacttgtgtagttgtatcgttttgcttccggaaggtgctcatcgcatcaccaccactagtaaccgctgtcccgagtgtgattcagccatcatagagatcgatttcaacaagaaaactactcctctggagaacggagccactctgcatcaaggatgtgttctatgtgacgagttgcttctctcacttgtagaagtgaaacatgggaggtcctttgtgaggcgtggaggaaggggaaggggacgagggagaggccgaggcagaggagggagaagaggctcaaaatctgtcgacccaaaaatgagtttcagagacttttgaaactctaaactttgtgtttatgtctttgcgttacttgcatatcattggaaattcaaaattctgaaatactgcctgcgtttcaaggaacagtttataatctttttagctttacttcgattttttccacatacacttatctaaaacagctccccaaaacttttaaacatttgactaattcttgtttatgccctaaagaaaagctaaaaaacccaagtgtaatcttttgggcttgtcacgtgtcacatgtcatgcatacaatctttccttttttagatcataacaacatagttgaatgcatgatctattctctttgcaattactctgttttttgcttgtttaaaagtttttgaagaggaagagcaaatcattgattaggaaaatg

SEQ ID NO: 13081 - DNA, 3000 bp, Unknown; identical to SEQ ID NO: 13069
  misc_feature (1)..( 3000): cDNA_ID_2710382_gDNA_ID_2214595_Annot_ID_186880 3000 nt of promoter + ATG

SEQ ID NO: 13082 - DNA, 3000 bp, Unknown; identical to SEQ ID NO: 13062
  misc_feature (1)..( 3000): cDNA_ID_1580388_gDNA_ID_2214595_Annot_ID_186879 3000 nt of promoter + ATG

SEQ ID NO: 13083 - DNA, 3000 bp, Unknown
  misc_feature (1)..( 3000): cDNA_ID_3028012_gDNA_ID_2214595_Annot_ID_186877 3000 nt of promoter + ATG
aaaatataatcaaaagtgagagaaggaggaagaaaagagatgacctttggtaaacggagagagtctttgttcaaaataaacgactacgttgagaaaatggagacggcactctcaagtagagagagagagagagactagagagagtttggctaaaagcctaaacaaaaaaaaaaaaaacatgaaactctttcgtcttttctgatgatatctgtcggtctcgccggttaccggttataggcaatcaaaccgacctcaattggtaaatttactggtccgagtgaaattcagattgcatctggatcggatatgtcattagaataataatttattaactgtgcttacatcattgtttaatgtaataaactattaaattttacaatctgcgaattatgtaacaaccaaactccaaacatttgtactaaattttttatttctctgtatattgatattatgttaaaactttatagataaccaaatttatgattgattgattaaaacgatggtttcctatctaagcaagttagtgataatgtaatctaaagttaattttaggctgtgtgactggctttgatcaattttgtacgtaactttgttttattggataaagatataaactcaaaagtcaaaacacaccaaaatctaaactacaaatatatcattataaaggaattttttttggaagaacttatggaggaatggttttttgcatatctgtctagcttcacattagtctaaattcatctatgatattactaccactttgtaattttcttaacactctatagtctatacgttcattgtatcagtcccctcggcccactttaactatgttgattcaatctcttctcttatggtagattgtctattcatagtggttaaagaaagaaaaaatcattagcatatatctttaaccagtacagtacagtactagagatatatataaacaacaaaatattctcgtatgtgtatttgcagatatttttcgtcaagatcagattcttttccacatattcctattgttcttcattatcgtatgcatacgttgatataccaaaaaagctttgtgcacatgtttactataaatgcgacattctcacgctaattttcaatatcaacaattctccccacgtattcatatcgcttaactagttagtaggaaataaaatgaagagctctactacctctatgcagttaattccaacacttttcttcttaaccattcttcttgcttcaccaggtatgcaaatctagtttctcacaaactcacaatattaaaaagttactaaaacatataatatacgcttatattttaatatttaatgcatggggttttacgcatctacttgaataatttaatatttgatgatattgaagaataagtcaattattgattgtttatatgattataattatattattattcaattatttattgaataatgataatgtattatattatagatatagagatggttgaaggacaacaaatgtgtgaagcaaagagcttggactggaagggtatgtgtctgaaatggaggaattgtcgccaagtatgcattagcgaaggtttcactgacggtcgttgcaaaggattcacccgcaaatgcatttgtagcaaaccttgttttgtccttcctaattaagttcttgtttctcattattttgatattaaaattttaaaataataacacaattcattattgattgattaaaaagattatggttttttaatttatatgtaagctgatataaaaaaaaaactcagttttaagcaatgattttctctaagtttgttctaaaatatcatttttcaatacatgaaatactaaaaaagaaagtttggattcatttcctacacaaatttatggttttataaatgtacaaagaatattgaactaatatttcatgttccgattatatataagttcccattttcaatcgatgagattaataaagaaactttctggagtatatatttaacattttcgattttatattatgaagctaaagtatgtacagtatgttggtgaaaaaacatggatcgttaaataaaaaaacatattaaggaggagaacgaccgagcatcttctaaagaagattaaagcataagaacattggaataaggaaggtgaagtattgtcgtggacattcctgagtgggaagactcaccattacatacataattaattagtaacaaagacattggcgcctgtcttgttcccgttgcttttccccatctttatctccaattctctctctctctgtctctcttgttctactactttggggaagatgatagcttcttcttcttctccctccatcacttgttcttgattctacttgtggtcctccgcttctcttttcaggtgattggtcattgatctctggtttttttattttgcaaacttatgggttttgcttttcgtttttttctctgtcttactaatccgaatctgattcaaagtttacaactttaactaggggtttttctcactgaactcttatgagtgagacatagattcgtcttctaggtctgtttccggagggaattaattaataatagtatcaattttcgattatttttctttggttgattctctatcgaagattgtcgatgcttccaaagttgaagcctttgttacttctgaactcaggattgtcttgtgcctcgctgtagattatcgaagatagttgtggttctgggtaattagcttttggtgataaaggtttgtgctttacacatcttctgctactttttgggtatggcctaactaaaaaaagtaacttttagtatctctttccgatgatatcgattttataggagtgaatctctcatcttgcttcggagtgaaacaaatcatgtttttgttttgtcggaatgcttatctgattgcagtgcatatagttgtcaaagtttgttcttgatggtgatgtagaagctcttttatttgacatatttggttctttgtttagtttatttttagtaggatctagaagatc

SEQ ID NO: 13084 - DNA, 3000 bp, Unknown
  misc_feature (1)..( 3000): cDNA_ID_2710406_gDNA_ID_2214595_Annot_ID_135485 3000 nt of promoter + ATG
cttacttgtttctccttaggaaatgtcgattgagctaagtttggaggatgtaaagagagttgcttcacattatgggtttgagatggaggtaaatctacacaatataatgacaatgacatttgcctgtcagaaataaaacatctcatgatgcatgttcttcctcacttatatgagtggttgtcctaacaatatttgcagaaagaaaaaacaatagaaacaacgtactctacaaacccccggtctatgatgaaggtcagatttttttccatgtctttggatttgtggttgacttttggatccagagatgggtttaatttgtgcatgatgttgtgtgtgtctgttgcagaaccgatactatcctgtcttctggacaatgaggaagaagtgtgctataacaacaacttaaccaaatattcctcaaaactatatatgttttattctgttgcatttgtttttaaggaattaacgggtccaatctaaaacacatactatttcttttgttgttgcaaaataatgaaactgtgtttttcggttgatgtttgaaaaccaagtaaccaacactcaaagctaaacaaaacctttggcctgtgggcacaaagctaaaattttattattttctcggcactactacgcaaataggctaactaaggcccattaaataatatgaggcccaacttgaaaaagactcgtttcttgttactaataacctttccgatgaaatcaactccaaaaccgaagagccaccaccatggtttcgccgtcagagatgacggagacggcaccggcaattatgacaacggaaagcgaaaggatagagagttcgagggaactcgtggataatgaagaggaggagaaaatacgccgtcagaagaagctcgaagaagctctcgaagccaaatctcttcgccgcattatcagtgcttacctcaagtatctcacttttctcagtccttttaaacactcatccttctctggattttacatcatttcataggcactgtgttttctgattctaaagataattctactgattgggaatttcaaatcacaattctagtttctagattttactttttatctttttctttagcattttggtattggttctgcatcgttgacctttggaaatgtttacagttacccagaggcttcggaagaggatttgaaaagatgggaaagatcatatcggaagctgtctcctgcacacaaggttattttttgcctcatttctagcattgagaatagtagtagcatgttctgtaacagttaagagattaccaaacgatttcaagtcaagttgattttttgtcgaatcttctttgtttgcttatataatagaactaatggtttcagtgatgaatttttgtcctttgtgtaggcattggtaccccattaccctatgaagtttcagagattaagaaggtgaaatctttagtcagttaaatatttcacttatcatcttgtagtcttattaaatgtcgcgattcacttggatgatattcagaattttttatttccatcatagttgcttcgaggtttgcatttgattgcctaaattttgtgttcgggtgtcatttttatgatatccatgcttcttataattcttctttctcatgcttgcatactaaactcgatagtatgcaagattgaacttgactcatttctatcctgtctgtacttgtcccagacaccctgcacatagtgtttgttgaagtgttagtaagttgttggattttgtttgttgcaggtgtatatcggcgaattcatatttcatatttaatatgcttcaggtcagttgcagacatttctttttctaattcccttggtgtttcatttgcttcaacttatttgattatgtgattcgtaacttgacttgaaatgctagaaaatctacagttcatgtcaattgtcatgtaaaaatgtaattcataattacttggcaggcttttgagcctcctatagacttgagtcaggaacttgatggttgtgaagactcaaatcttgactgcgctccacatgagagatacactctagatgaaaggcacgactcttcttgtcagccggccttgaccaatagttgtacatataaggaagaaagcaaacacattcgtgacccaataacaggagtgtctatcgaggtcagatcaagacattggaactttatccttgtcatttaaaatctttaatttatttgtataaatacaggagcttcagaggaaagaagctcatgatcattctcccaaggatgactctgcagacacaagaatcaacgataagacatgtgattgtcatgaaggccagttaaatcatgaccatggcagtgtaatgccaactcatatactcttatacctcagttccgcccagaaaacgtttttgactatgttagctttgcgcagattctttagttattgtatcagttaagatctttggtgggatcatatgagtatttcctggcattctagatcaaatgaattttaactgttagtctatattaagaaagcattcaactgtcaagcataggcttgttgtatatatttttgcattatacttcatttatgactataaaattgtcataattcatgtgatttttctaattctaatgttcctcttttctttcttaggtatcattttcatcccatgattggttggattcatcgttacagacacatgttcctctggttgatgtagataaggtatggtttttcaaatttactatggctggtgatattcattttcctcagtcctagcctcctaggtaatcataattgtataagagctcttgtagcgtgagacaaagatcattatgtgtcatgttagaacttattctcaatctctattagttccattaggcagtttggtaagttatgagggttggtttgctcatgtagctttgcatggggaggtaaatcctgttgagcttaagtgcaccttcttacacgtatgcatatgcacatgatagaggtgacacacacaccagtacaattgcatatatttgttgcg

SEQ ID NO: 13085 - DNA, 3000 bp, Unknown; identical to SEQ ID NO: 13064
  misc_feature (1)..( 3000): cDNA_ID_2713048_gDNA_ID_2214595_Annot_ID_135487 3000 nt of promoter + ATG

SEQ ID NO: 13086 - DNA, 3000 bp, Unknown
  misc_feature (1)..( 3000): cDNA_ID_2710429_gDNA_ID_2214596_Annot_ID_135492 3000 nt of promoter + ATG
acctaaatgatctcataattagtcagtacccactccacttaacatttttctcacgagaaagtaaaatagatggaatgattagtaaaatagtccaagaaaaaaagtttggtcgactcgacaaagttatttgatctcgtgactaatatacattttctgaaaacttttaataattaacttagcaaatacaatgttgtttttcgagtttatttgccatgacaatttctcaccgccttaacaaattcatttttaaaaagttctagaatcattttggctattggttatttatatatcaaacaaaatataaaggacagaaatccttagaagatgtataaaacgacggcaaggagaaataaactatcaaagaaggtacaggcgataacttagccaggatttagctcctgtgccaaatgggaaagtgacccatttgatctatataacattcaaagtcctgattttgactgttgaatattatcataaaaactcattataaaaaaaccaaagtaataaaagttgccacaacaatatcagtacgcatccaatcttctcgggaagagaaacaaaatcaaattaagaaaggttttcaaagaaggaagagagtcaaaggaacataatatccaaattttcaacttcataaactttttctaaatttattcaacatgaaaaaggagggaaacattgaatggtatcaatcagtatcaggtttctaaaaagggaatgttcatacttacaacaaagaaaatttaaacaacaatcaaaattagaaagacagcaagaaaagtagaaaactttggcattttgatttacatttatgaatttccacatttatcatgaggtcggtggaagcggcggagcaacagttattttaaccgccgcaacaagtcttcaattctccttcctctccgccgccaatctgccgacaagtttcttttcgtcttaagaaaatatattgggtctcgtttcgtacaacaaagtgtagtgtttgggctttactcagaagcccataagtattttattattatttttagacagtaaggcccaatagtattttattgttactgtctgcgctgaaacaatttatgtttttcagcaaagtaatatcttactaatcagtaattacatacaccgtaacaccatcacgaattttcagtacacgacagagtataggtatgattgactgacaacaatataaaaaggctaaattagttagactgtcttattaattaaaaagtaatattgtactattactatactacttcacttaaatatttattcgacacacaaaaataaaccattcgtgtgaatgtttcccaaacacatttggggccgaagcattcgagcgggcgtaccactccaattacctggtacacataattgaagactatagtatgaaaattaatgttttatgtttttgtcacctaaatttttaataaaatgcagttgcagtttggttgtcattgttctgttgatccgttcattccgcgtcctgtatttggctatcacaatttcaatctatgaaaatttgaaatccgtatggtcaaaattatattttaaaaccacattgctagagaataattaaaaaaataataatcttcatgtggaatttatagaaattaatgatatacatttcaggaaaacttagcatgaagtatattattttaatgtgatgattttagaaatacaaaccgagacgcggtatgggatatggtccattacaagtaggcacaatggtccactaataattgttattacgacaacagaattaattgcctatttaaaacgaaatgaatcatcgaagaacatactagatctttttccaatttacaaccaaaaaaaacattattaggtgagtagtaaaaagattaaggttatcagaaactaactgtagtagtatgttgtgtgaaattcttttgtatttcttattaagccaagggtgccctttcaatgcaacgtgataaacgccaaaaacgatgatatgaacaattataaactcgttgagagcattgaactcggataataaatcatcttttatatacatcgtagataacaaacaaacacgtaattaaatttgacgtatagcaaaagacttgaagaataaaacgtcaagttaaagataattttggtatatatgagaaaggtatcgacaaaaaccataacgctatagatgattgtgatttgacaaaaacaccctcaaatcattgttttcagagtttttttagataaggtacagataagaaaccacctctaaaaatcaagcaatagatctcatcgcttaaaagaagagagagatcttcacttgtatgtgtcccactgattccaacacaatgtcccagaacttgccacgtgtcgttcatttcaaaagattgcagtactgttgtccctagagaatcattatctccctcgctgtaatatctttatgctcctgtcactttctgtctgtacccaaaagaagtaatgaacctctctcatcttcttcttctctgtttctttcatgttttgtgagttgtttctcaacaattttctggtctcttagagtgagaggagagagatagagagttgtgttgggcgtggaacttggactagttccacatatcaggttatatagatcttctctttcaacttctgattcgtccagaagctttcctaatctggtcagtagtactctttttatacgggtttttggttttataagatgtggctatatttggaaataactattttgcaagctttcctagattgccagaatataaaaaaagatgtttaacaagagaacggactcatggacttgctttaaattttaattattttaaaatcattctataatgattagagtaaataaactattaggactctgaattataaaattcgattttatatatgctcctccttgtatctcttaatcataagttatcattagctctgttcactagtgctataaaatatattctgaggttaataaaacttttttttctttttattttgaaatgtctccagagatctgac

SEQ ID NO: 13087 - DNA, 3000 bp, Unknown
  misc_feature (1)..( 3000): cDNA_ID_2713083_gDNA_ID_2214596_Annot_ID_135493 3000 nt of promoter + ATG
cgttattttctgtatatgtgagtttatgtatgtcaaaatgacatgatgagattttttgtaaacaacatcttaaaaacaggacatgtgatttttgtaatcgtaaaaactttgggatgcagtttattttctaatcaaaacaaggatatatctaagtaatcgaaatttttttcgaaaatagaactagatgacacttatagattatagatcacacctaattttgaagatgtatctaaaagtccattcaatttttctctgttcccctaataagaaatcatatgttcatattcaaaaaataagaaacacaaaaaaaaactttaagaaaaacacagatgatcaaccgtctggctagagtttggtaaaatattaatatcttatgatttcatattgttccataaataaataaaaaatcataacataagcttttcttgctgattgtctaaaattatgtatagatggaaaaagccaaatcacatgtgatggagccagatttgagtgagagtcatgtgtcaattgtcaaaaacatcgacattataagtctttaagccatgtgcatactggtcagaatctatttagcaataattgagttaaatatcttagatatttttgcatactgttttcatatataaatttattccaaagtttgaaatagtcgatcgaaaacacttaacaatagtaaaagttgaaccgatcaaaggttggatacatacattcagacagagacacccatatcatcaatcatgtttcaatcttcgtggaacatccacataacattattttagtggcaaaataaaaaatgtgttaaatatcactagaaatacaaaaaaataaaaataatatataatatatgcttcatcaataggtgtctggtcttcaaatcatgtaaatcatatactattaaattaaaatgctaagatgagtttcttccatttcattcaagatttggtttggagcaggagtagttcacggatatgattttagtggattgtttataatcgtgacttttgttttgtgtttgatcgacttgatcgacccggccaacttatgatcttccgtaaactaaagtcaaaagcaataatatttctttctttttttgtatgaaaaaagcaatgatatttcactgatctctacggagtaaaatctctttcttggacttcatttggcatagattcttttagttcgtttcacattctctttcagtaccagagatttcttctgtatgttttaaatcttggtcataccgtctttacagcactagcctctagtatcacaatagataatgattttctaataccaaaaccatatagtcactcatctggactagatagattttgaagtcctctagtttctatgtagtgagatcctccattcatttctcttgactttcgtgaggtttgagaatccagtcatgtaacccatagcaaatgattcgacaactgtattacccaatgtcaccatctcaaataaagaagagaaataggattataggaatactgatcttccatgtgatctaattttgtatatatcgcacacttatcaaaatccattgtaaattgtagttttttgcttgaaaagaaacgcaaatagtatcagcagaaaaaagctacacaaatagtaccaccacttttttgtttatctttagaaaaacatttttattactatccacacaaaaaactactaagaaagttataacatcatgtcaataattcaaaatcattatcaatgtcaaaaaaatattagctttaacaataactaaactcagccatcaagcccagataattgtatttaagtatttgagtttttaaattgcatttgagtaatttactcgtaaatcatagctcatggaattaaactaaaaatttcttaaaaaaaggataaaaatccagtaaacgttggaattttatggtaaaagttcgtcttcaattcttacgaaactcatcatagctatcaatatcatacctattaaaatcattagaatcgtctagaaaccttttttaaaagaatttacatcgtcaggtcttaagaaacaaaatatttattatttaccagatacagacataaaagctgacgtgttgacattttaatttgatggaaaacgtataaatgcacgacacgtgctcctactggaccacttgataagttacgtaacttatcaagcttaccgaaacgaacacgtgataacagagaactaaattcacaatttttgttattgataaaagaaaatatttaaattttgaaaaagtaatattaacatatactagaagctatataattagcaaataatatagaaatgaactacttatctaattttagttctaaattatttaccaataatttgttcatatcttgaaattgttaattgtatatcttaaatctttgactgaatttaactcttttaatattaaaataattaaataattaatcttaaggtatttaataaataaaaattactaaaaaaactacaataaaagatctatatccaataagaaaattaataattatattgataattagggagcatatgcgttattataaattacaacctaacctactttaccgacccaaagcctaaaaaatccgacctttttttgttttctctctctagaagtctctctgttttcatctttctctctctctctctagctcttcttcctcgtttctggcttttctgggaattttgatcctttggcccccattgctcgcttgaattacgaatcagatatcgccgatcgtcgtagatctgcgttgatactgtccggctgagtaaacagggtgaacaaaaaccaaaaacagagagggggtttaaaaatcctgaagaaaatcgcatgaatttgtttggaagcctgattttttcatcttcgatttcgagccacttcacgacttgtcttctcatctttattcttcatttctctccccagcttaatagtaataataataataataatagtaatcgtaattccaataatctcgagagtaatcgtttgatcaattgaaaaaaaaatc

SEQ ID NO: 13088 - DNA, 3000 bp, Unknown
  misc_feature (1)..( 3000): cDNA_ID_3028027_gDNA_ID_2214596_Annot_ID_186925 3000 nt of promoter + ATG
ctttaaaatggaaaaaaaaactcacaacgcaatgatacttttatacttaaaatgcgacttatatacttaaaatgtatcgaggtgaacaagctagcaaaatgtatcgaggagacaaacaaaatgtatgtaaatgcgacttatctacttaaaatgtatcgaggatcggagaacaagttagcaaaaaacaaaagatgaatggcaacaaaagaaaataaccaaaacttttttttacaaaatatgtacctgcttaatttaacgttacattatttcttggaaaatatgtttcatcgttaattattatggaaaattaattataaaaaaagttgcgtgattttgatttgtgcatggataatgataccgccaaacttaaaacggacaaacaaaatgggatccatcttgtttgtttgtagtttgtactgctcaaagaaaattcaacgacgcgacgtcactactcctcacccacttggcagcctcggggtcaaagaaaaacatttgtgtattctgttcctttaaaagttaaaacactgttattgctagaatctccaaattaatacttatgctgttatgcagtatgagtcgagtgtctgacttgtatgagttagggcctagtatgaataaataaacattattaatattaagatagttgttttcgataattgtttgataaggatgccactaaactcatacctcttagcttatacgaattgacttaattagacattaatacattatatctatatattatctagatttataattgctaagccaataggtcaaggtcttgtctaataaatgcatgcacaactaattcagtcaataatgtacctgtataatactacaaataattcaagctaattgatctatattgaagaacaaataagtaatctatttcggatttagtcttatcatgtgtctaaataaacacataactcttaagtcttaatgatttatttttgatagatatcaattataattatacaattacaaatgatttgatgattgactatacgtaagaactaactttgataattttgaattgggacaaatcattgaaggccttacgtttaagctttagatgtttcccaacgccaaaggagaatgaaaaggacagaccatcagtgatttgagtactcaatcaacatatttattatgtactttgagttaattaattttctattaataacaaaaatcaagcttgcacatttcaatgtgataagtatatgaataataatccaagctaatttttaagaaaagaggaatattgaaagcttgcaaattattcgaatgctagaggtccttaccttgcatgcaccttttgtaacaattacctatgggtgtggggaaatctagctagctacatattttcaattatttttccctattaaattgagattattgttataaaagaaaatgcccaaacttaattttcggggtttaaaattttgtttaaaaataaataaaatataagaaaagaaagaaaagtataatttgggttaaggggtttgaatatgattgatttgaatcgtcgtcgaaatgtatacgtcacctaacgcttttgttgctatactagtatcattaagtggaaattttaaagtcattaaaactcttctcatttttgtatttctaaaagagtcttaaggggtttgaatatgatttaaattatcttacaagtgtaaatgccatctaacgcttttgttgttatactagtattatttagtaataagatgctaaagtcactcaaactccagaatcaataatactccaagctatacatattagaattttaaaatagtatgaacactttcgataataaaaataccaaacttatttgggacactaaataagtttgggccgaaaatatttaaaagcccaatttaaactaaaattcatttaggctcttctcttctactaccttcttctatcgagccacaccgaatgaaattagtgaaactgctattggcttgtgaattgtgtgtgatggcgttaaagcctcttttagttcgtaaccgatgaaatgacagtaatagccttgagaaacactgaaaattacagaaagagagtttgaactttgaagacaaaacaggtgtttctatttctctccccgttcacgttctgcaacatcggaagcacgtacggctcctaagactccgttttgcttctttttttttaaaacacattcttattataaatataaaaaaaacaaagagagatcaaaaacaaaaagtttcctctctttttctaattttttaaagtttctttcatcttcttcagatccgaattgtcgccgcgaaattcgtcagtgcagcttcttcttcttcgcgtactttattcgatcggctgtctgaagaacatgaagccgatgatcgtaggtacgttagattcatttttccgaaattggctttttgatttttctgatcgaaacgatgcgaggttcaatttcatcattgttttgaaatctatgacttacaaaagtaatggcgttgacagatttgttcttaataaggacccacatttttgctgaattttggaacaaacattgttcttctttgatttcaaaacaagaattagaaaattcatttatcatgtaatctatttagctgatgtgacgatgaacagatcaaaggaatgtagtctcgaattgtttaaggttataatgattcctctaagtgaaaaaaaaaaaaaaagcagaaaaaaaagttagaaagatgacaaagttgaagatttctttttgtctttgaagcttctatttttttggtgggtcctttttaagacaatgatttcaattcttggattttgtctgaagaaaaatgttgctgttcttctctttacaatgtttttgattgtgagcttgcgttgacttaaatcatgtcatatattttggtttctcacggttttatttattgtgccaagtgatgcagttgctgctagttacggtggattgatgtttggatggacgcagaaattttgatgtgggtttagtctaaaaggtgaagaacaatg

SEQ ID NO: 13089 - DNA, 3000 bp, Unknown
  misc_feature (1)..( 3000): cDNA_ID_2710422_gDNA_ID_2214596_Annot_ID_186926 3000 nt of promoter + ATG
ttcatcggttacgaactaaaagaggctttaacgccatcacacacaattcacaagccaatagcagtttcactaatttcattcggtgtggctcgatagaagaaggtagtagaagagaagagcctaaatgaattttagtttaaattgggcttttaaatattttcggcccaaacttatttagtgtcccaaataagtttggtatttttattatcgaaagtgttcatactattttaaaattctaatatgtatagcttggagtattattgattctggagtttgagtgactttagcatcttattactaaataatactagtataacaacaaaagcgttagatggcatttacacttgtaagataatttaaatcatattcaaaccccttaagactcttttagaaatacaaaaatgagaagagttttaatgactttaaaatttccacttaatgatactagtatagcaacaaaagcgttaggtgacgtatacatttcgacgacgattcaaatcaatcatattcaaaccccttaacccaaattatacttttctttcttttcttatattttatttatttttaaacaaaattttaaaccccgaaaattaagtttgggcattttcttttataacaataatctcaatttaatagggaaaaataattgaaaatatgtagctagctagatttccccacacccataggtaattgttacaaaaggtgcatgcaaggtaaggacctctagcattcgaataatttgcaagctttcaatattcctcttttcttaaaaattagcttggattattattcatatacttatcacattgaaatgtgcaagcttgatttttgttattaatagaaaattaattaactcaaagtacataataaatatgttgattgagtactcaaatcactgatggtctgtccttttcattctcctttggcgttgggaaacatctaaagcttaaacgtaaggccttcaatgatttgtcccaattcaaaattatcaaagttagttcttacgtatagtcaatcatcaaatcatttgtaattgtataattataattgatatctatcaaaaataaatcattaagacttaagagttatgtgtttatttagacacatgataagactaaatccgaaatagattacttatttgttcttcaatatagatcaattagcttgaattatttgtagtattatacaggtacattattgactgaattagttgtgcatgcatttattagacaagaccttgacctattggcttagcaattataaatctagataatatatagatataatgtattaatgtctaattaagtcaattcgtataagctaagaggtatgagtttagtggcatccttatcaaacaattatcgaaaacaactatcttaatattaataatgtttatttattcatactaggccctaactcatacaagtcagacactcgactcatactgcataacagcataagtattaatttggagattctagcaataacagtgttttaacttttaaaggaacagaatacacaaatgtttttctttgaccccgaggctgccaagtgggtgaggagtagtgacgtcgcgtcgttgaattttctttgagcagtacaaactacaaacaaacaagatggatcccattttgtttgtccgttttaagtttggcggtatcattatccatgcacaaatcaaaatcacgcaactttttttataattaattttccataataattaacgatgaaacatattttccaagaaataatgtaacgttaaattaagcaggtacatattttgtaaaaaaaagttttggttattttcttttgttgccattcatcttttgttttttgctaacttgttctccgatcctcgatacattttaagtagataagtcgcatttacatacattttgtttgtctcctcgatacattttgctagcttgttcacctcgatacattttaagtatataagtcgcattttaagtataaaagtatcattgcgttgtgagtttttttttccattttaaaggctgggagctggagacgtacgtgtgattttatttttatggtaaataaatttaatacgaaaacaaatttactagtacttattaaattgttaatacgtaacttcgtactttatactatggttaaattgtttgggaaaagttttttttgtttgttaagttccaagaatttgtttagaaaaagttatgaacttatacgcggtttgctttaaaatgtttcactttttgttggtcaataaataaatgaacttcactttgcatgaatacagattgactatatcatacatacattaaatatactaatatacgtatattcgcaaaaataaagtacatacaatatatatacgtagctctatgattaaaaagcagcaaatgattgtaaatgttacgcacagtctggcaatttaaagccttctttgcattgcttcacccttaaggtttacgtttagtgaactaacttacatacattgtgtggaacatgtaatccatataaattgaccacaaaatagagttgtgaaatgtttagtttcattgcatcaaagagaatatattttttcaaataaaagatagtacttgtcacttcctatatctcttacctgttaactagaaataaataaacaaatccaaaaaaaatgtgtcctacttacttactaatgcttcaagcttggtaacacatcaaattaatattctgatatatcatatatcacctatcttacaaagtcattaattttcaggatggaagagattagattaggcactgcttattatacgataaagattgatatggatgcatcatatttccgaaataaagtacaagtatttacggtatgtgattttgctcgaaacttaagagtcgtttcttagtaagaaattaattaacatcgacacaaatcaaaaatagtaacgaacataaaaatgtaactatatatacatgtatccttaagctgctgctactacaacaactcgctaatcattaagtttcataactata

SEQ ID NO: 13090 - DNA, 3000 bp, Unknown; identical to SEQ ID NO: 13087
  misc_feature (1)..( 3000): cDNA_ID_2713083_gDNA_ID_2214596_Annot_ID_186923 3000 nt of promoter + ATG

SEQ ID NO: 13091 - DNA, 3000 bp, Unknown; identical to SEQ ID NO: 13088
  misc_feature (1)..( 3000): cDNA_ID_2710433_gDNA_ID_2214596_Annot_ID_135495 3000 nt of promoter + ATG

SEQ ID NO: 13092 - DNA, 3000 bp, Unknown; identical to SEQ ID NO: 13089
  misc_feature (1)..( 3000): cDNA_ID_2710422_gDNA_ID_2214596_Annot_ID_135496 3000 nt of promoter + ATG

SEQ ID NO: 13093 - DNA, 3000 bp, Unknown
  misc_feature (1)..( 3000): cDNA_ID_2710440_gDNA_ID_2214597_Annot_ID_135498 3000 nt of promoter + ATG
gtcaaaagtatttatgggtccggcgcataggcagacacaaagaagattaaaggaggtcagctggtctttttagaattctacatttgcattgtaaccctttaaaattcatgatattatttatatatatttttttatttttactcttttaaaattacaaattcatatgtaaaccttctaagttttattgtatttttcttctactttgtggtttgacactatttctaacatgttttttactttttttgtttgattcacccataaacattgaaccatattttatctattttttaaatgaagttttttgagttttaaattttttggttacttattatttcgaagttatattttgatactttataaattatttatgggtccgccgcataggcagacccaaaaaagattaaagcaggtcaactggtctctctagaattttatattcgcattgtaacccattaaaatttatgatattatttatatttctattgtttttacctttaaaatcactaattcttatgtaaacatttaaagatttatcgtgtttttcttctactttgtgttttgatactatttctttgttttcaacttttttgtttgattcacccataaatattgaaccaaattttggtgtttttaaaagaaatgaagatttttttagttttttaattacttattattcaagttataatttgatcctataaaaagtattttggatccttgacttgaaatgtaaaattaacgggtacaatgtgatagttaatatcctaaacattatatgacacatgcctttgatacgggtaaatagatataaatataggtgttgttatatccatataatatatattttttaatttcgtaaatgtctctaacttatcactctaaattatgattgattcaagaagatactcattttaaatttttttggtcgaatttcaaaaattttggtatgcttgatctttaaaatttaaatttaattttaaaaaaacaaattttggtcgcgcaaggcgcgggtggctcacttagtctcatattattccttcacgaatctggacttattacattttcgtttataaaaggaacgttaatacccggttcattccagtttacagactcaatcatagttattctaaaccatactctaataaaaaccaaattagtcaaactgacccaaatcagaaacaaaacgaaccataaataaatcgaaatgcacatcactagcaacttttctataaaagtgaaagtgggtggacagacacttgggtagaaaacccaagagatgagtggcttccacgtcatcctttacagtgatcctcgcacgcatgtataacacttatatcagtcaaagtcattattttaatcaatggaccatttccaacttaactttaactttaatgatgccagctttgtgtcacaccacttactaataaacgtagaaatatatccaaaaatgaactaaaacactactctggaaatattaaatatagaaaaccaaagaattggaacagttcatcgggaagggttttgggaccctagagaatccatggctatcactctcactaatttcactgtaagtacactatttctttactttctctatggtttgttgatgatgaaaaatttatcaatctttgtctcagtttctctatatggatgcaaacctgaaacgtttaggcgacatatatccttccttgaacttcatgggtttataggagtttgcgtatgtatatagatacatgaatgctcaattttggattgttgttccttaagaatgattacagttttagggtttggagcaaatgtagttactcttcttctgattctgattctcaccataacgagaagaaatggtagatgtaacagaagggtaagagtaagcctaattttctactttggttttggtaaaaaaaaagaactgattcgtcctcatttgattttctttattagaaaagctacattgagaagtgtttgttgtatgtaacacctgcacttggagcttgtttgtcatgtgtggacttggtgttacttgtgagaacaaaccgtaggagagaagtcattctctgttttgtccccttgtctggtttcgtaatgtgggtaagcttcttgttaccaaacacgaacagaactctgtctttgtctttctcttttgtttctgctttgaaggttttttttaccttgtagattgccgtcatcctctcattgaagtttgcttgttgtgcgtgccacgttttcactagccagattctatgtttctggtggatctttagattcctaacagatgcccttcatcttaacatgattttcacattacaggtaattaagttgtctttatgaatctgtcacattctccatataagtagagttggttaaccgaatttggagcgtgtacaggagatttgcctcatcatgttggacattgcttttggtatctctattaatgtcctcaggataaagcaggcacatcccaaaatcatgtatatgctttaatatggttctcttatttaatatttttttccttttcatttcttgtttaattccttattctccttgtagtcctttggaagatccacttattgaagacgacgatgatcaaaagcgcattgtacgacgtctcttccttgtaactaactagtttaaagagtagttaaagaccaatagatttgttcattctttgaaggagaaaaatggaagctggtgggacttattcacttttgggtacattggttcaataatgaaacatggctcggtgaagcagctagaattggaaaatctacttacactaccacctgaaatggatccttttacatgttgtgagaatttattgagatgttggcaacttcaagagtgtaataattactcaactccatcactaatttggtcaatatatggtgtatatggatggccatattttcgtcttggactgttaaaggtacgttgcttatttgactttcttatataatctttgttaatattgctactacaaaacatgaattttgcaggtgttca

SEQ ID NO: 13094 - DNA, 3000 bp, Unknown
  misc_feature (1)..( 3000): cDNA_ID_3028047_gDNA_ID_2214597_Annot_ID_186941 3000 nt of promoter + ATG
cgtcctggaaaagcgcccttcatatctttgcgaggacagaactcaaaatgaaatcgaaaagctaggaccaaactcttgattagggatcatcatccgcttttaagctcgacaacggcagaatacgtattggaaacctttcccatagaaaggcttgaagacctccaaactcaagtattcccaaggtgcacactcaatgcaaggtttccagcagacaaatgataggaagcactttcactcgattgcattggtctaaaatgctagcttgaaaaggaagtcccttacacgagtccaattcttttttggttattagcaagctttgaagaacattttctcgatcttcacttcaactggccggatgtggatggaacgtatgctacgagtgctttagttgcgacgtgggtaccggttgtattctaagttgattcaacaacagcctaagtttccttatttcatcaaatttcctgttagcaggatcgggtaggatagtgagtgtcaggagaaagaaaagaattagaagcgtctctcataggttcaccaatttattgactcttgccaggtagcccgatgtctcatcgtaagatgttggtgagtcttagaccaattggggccaaggagggtttggttaataaataagtattaaaggcacgacgagcgcaggcatgtgattgtaagggatttccagtccctggctagcgatgatagcgatgtaagcccggcaagcaaggaaggttgtaaggggtttcaagcccctggctagcggtcaagtaagtaaagagatgtcggttgcttgaggtaggatttggaagtcctaccgagaccggttccctgtcctataaatgtaataagtaagtcggctctgttgtgtgaaaatggtaccggtggttgcttcgaaagcgtagatcaatagggcggtgtagcggaatacatggctaaaacctattattatttggttgtgtatgtcggttgaatgtcccaccaaggccaagtccccacgtgatgtgggctttctagatgtctttgttcctgctttgagccgagtttgggtggttctgccggtattggtttatacggctactctcgaatttcggggtgaaaaaggaccggactgttttccttccctggaacctatgccatcgagaaataaggaaatcatggttttgataatatcggggttattaaataaaggaccaatgtttattctccttaaagatgatctctgtcatcgagaaatgtataaataatggtttcgagactcatatataggggttctaaagtctccctcgaaccccgggattgatgaatccccgtccctgggtcgccaaagagatatgtctatagttgaattcgcgcgtaaatccttttgaagtggaatccggacctttgtctatagttgaattcgcgcgtaaatccttttgaagtggaatccggacctttatgccgatgcgattgagatcatctctgtactgtgggcgaaacccgttgttggtgatatgatataaaagtccgctgatcgtctagttcaataaaataaatagtaggtatccggttcaagtgcaggcgatggactttgaaagggaggtcttctctcagtgctggcttctccgtcgcgctaagataggagcagaggagaagtccagttttattaataggagagaaagaaagatagaacgaattttgttgctttagatagaccgatgtgttttctttcttcatgaataaaagggcaacgattcgagaatattgttctaatagagggagttgctcttttcctctttgccctacttctgtttcccgtaaatagtatgcgagctgatggtatccttagctgtattcctatgaaatggaagggatgcaaataaagtcctattttcaattccgagatactcagatcttaaagggtttctcaaacgggaaatcttaacagaagaatgtcaatataaacaggatagtactgttccgaatcctcgatctagtaggtattcctactgtaacactatacagtaaagctcctttttaagatcacaacccagcacagaggagtttgttgcgtgggattaaacgcataattcgtgcatccgagaatgggatgtcaaaccctactttcctcaaatacgaggaatggataagccaggctagtatgttctgctaactacggaaggaataagaaggtaaggactcaaccttagctgtgatcttttatagcacacccctgatacacgctggtgtgcttgtgctgcagtttagaatgctgattcctgggtgggtagttcctactcttgcttcccttggttttagcaggtatttgtttctagcttcggtagttaaccaactattcccttttcagcacactctttggcgtgcgataatagtacacttttaggaatcccacaccaagtgaacagagttatcggctgatactttccttgttcctagggttgagcagaagttggttgactagctactacttgaagtcagcacactcctctgcttttccgatgctttgaccagctacttgttttcctaacccgagctaatcctctgtgctgtaatggaggagtgtgctgaataggacaggtaatctacaatcctacaccggacgagttccttgtgatagcacacccgaggattagaccgaagtttccttatttagcacactcttacacgtgagcacgcatgcaataatagtagtagctctcttctgtgctgccgaggtttgctttcttttgactgtagatgaaacttttcaaaaaaagattgctctttcccttagaaatggggttgctaacttttacagctatatgaaatgaaagttggcgattccttctgccatagtagagctaaagccgccgtagcagttcagtgtatcataaggtaggaaaggtcgtcccctcttgctctagcagtcaacgacagaaaaaagcagggacgtgttatggttaccagaaagggaataaggaaaggaatctacatattaaatcctctatcggcacaaagaaaatg

SEQ ID NO: 13095 - DNA, 3000 bp, Unknown
  misc_feature (1)..( 3000): cDNA_ID_3028040_gDNA_ID_2214597_Annot_ID_186944 3000 nt of promoter + ATG
cttaaccttcaattattccagaaaaagtagtcaaagaaacataggtcgaataattaaatgaaaagatattttgaaaattcttataacaaatataatgctggaaacaaagttgatagagttatttaaggataagttttaagggctgcaagctcttcatccatatttttctggttattatcgatgagttaaatttttatttgtgggagtattgaaaacgtatattcgaagggaaaaaatgattttgtgagctaaatttgttgccgtctacagcatcccagcgtactgtgtgagccgacatgtagaatttacaatttaaaactgttattttaataagtagttctcttacgttcaatatatttttaaatataaaaataaaataaatcatctaagagccaatttcacgaaagaaaaacaacaaaaagtttatcttaaaagagaattaatttcattctctattttagatgagtgttagagtatatatgtatatagcgtcatacatctagactaagttaaatattggtgttatttggtagggcttaagatatagtgtttaacatttagatgaagttaattatataggtttgggtttataaagtaggaactagggtttagtgttataaattcagatgaatttgaataactaatttgggtttataaggtagggttagggtttaaggaataactgatggaagcacatacaataatgtaaacttatatctttagttcatatctaactaaaaatatttgaacaatttgaaacctcattcgattatatttaaaattatttatgacttaaagttcattgtaattgtgtttatttggtatagtgtttaacatttagataaagttaaatataggttcggatttataaggtattaggtaggatttagtattattcatgtagacgaattgaaataactaatctgggtttataaggtacaggttagggtttaaggtttagaagtctcatgaatattaaaaaggggtgctaagtaatttgcaaggattaggcacttatggggcttggagttattcctcttctcctccgttgggaataagtttttttagtgaaagttgtccagaaaacgagagggaagaactcaactatttctcaatttgaagaagcttccggtggatcctttttttgttcttgagacctttgaagttaatcagtaggggtcctaggcgctagaatgtctagattgaaaaagtagcatatataagcttttttatttcaagagagtaaagtttaccctgttttagtgtaccaaaagataagagactgtgtttttgtgtgtaagaaatctcaagagacaagctaaagtagtcgaaactttgtgtaaaaccaattaagagagttacaagttctttataagattttttgatgaatttataagctcattgttgctgaattttttaaatttttttagttacttattattttgaagttagattttgatattgtcaaaagtatttatgggtccggcgcataggcagacacaaagaagattaaaggaggtcagctggtctttttagaattctacatttgcattgtaaccctttaaaattcatgatattatttatatatatttttttatttttactcttttaaaattacaaattcatatgtaaaccttctaagttttattgtatttttcttctactttgtggtttgacactatttctaacatgttttttactttttttgtttgattcacccataaacattgaaccatattttatctattttttaaatgaagttttttgagttttaaattttttggttacttattatttcgaagttatattttgatactttataaattatttatgggtccgccgcataggcagacccaaaaaagattaaagcaggtcaactggtctctctagaattttatattcgcattgtaacccattaaaatttatgatattatttatatttctattgtttttacctttaaaatcactaattcttatgtaaacatttaaagatttatcgtgtttttcttctactttgtgttttgatactatttctttgttttcaacttttttgtttgattcacccataaatattgaaccaaattttggtgtttttaaaagaaatgaagatttttttagttttttaattacttattattcaagttataatttgatcctataaaaagtattttggatccttgacttgaaatgtaaaattaacgggtacaatgtgatagttaatatcctaaacattatatgacacatgcctttgatacgggtaaatagatataaatataggtgttgttatatccatataatatatattttttaatttcgtaaatgtctctaacttatcactctaaattatgattgattcaagaagatactcattttaaatttttttggtcgaatttcaaaaattttggtatgcttgatctttaaaatttaaatttaattttaaaaaaacaaattttggtcgcgcaaggcgcgggtggctcacttagtctcatattattccttcacgaatctggacttattacattttcgtttataaaaggaacgttaatacccggttcattccagtttacagactcaatcatagttattctaaaccatactctaataaaaaccaaattagtcaaactgacccaaatcagaaacaaaacgaaccataaataaatcgaaatgcacatcactagcaacttttctataaaagtgaaagtgggtggacagacacttgggtagaaaacccaagagatgagtggcttccacgtcatcctttacagtgatcctcgcacgcatgtataacacttatatcagtcaaagtcattattttaatcaatggaccatttccaacttaactttaactttaatgatgccagctttgtgtcacaccacttactaataaacgtagaaatatatccaaaaatgaactaaaacactactctggaaatattaaatatagaaaaccaaagaattggaacagttcatcgggaagggttttgggaccctagagaatcc

SEQ ID NO: 13096 - DNA, 3000 bp, Unknown
  misc_feature (1)..( 3000): cDNA_ID_3028063_gDNA_ID_2214597_Annot_ID_186933 3000 nt of promoter + ATG
tctggaagtaaccttacctagtggatcaagggtttctacagctcagatcctccccagcacactccaatggtttgtgttgccgatcgcagcttcgttgtctcagattcaccagataatgtttctagcccttattatcttcggtgatcatccgggtctggctcaactcttaatggatctaactatgctggactttgtatatgttgactgaagcgctcttttattgatggtagtctgcctcgtcctagcctagatgatcttattataagttataagatctgggtaaggtgtaagagtatggcgaaatcctggattatgaatactagagatatctcgatcttatatatgcaagatacggcaacggaagaaattaaggaaaaaaggttatagctctcaagttccagtctgagctactgaatgatccaaaatgaaaagaaatatttttagctttaaccaaagaatagacgaaaaaagaggtccgaaggtgctttagcaacgagactgatacctccgtcaaacctacgtcggggaggaagcagcaaatcacttgagggagatccttcttcagccactaggtcaggtgcagaagtctaagtggagtaccggcaattcgttttcaaacgtaggaaaggtgctgtccagcacactgcttttctttttacctttattcctaagagcaaaagaaggtaaacgagaaatcacactcctatgctttgcttgcattaattcttggaattgctggggtggcatgaccagagtaatctatgccctcgctctactgcttatgttcagattcctaagctggcagaattctatcctgaaaattgcttcaccaggaagtaaagttctttccgttcctgctttttcttcgagttgaagaagcctttggtttcaccgttttacgctttgaacctggacctgctttctttcttcagcataagcgcacactcccagcgaagtagcccccgcagcctcccgcagccccgtagcctcccgcagcctcccgcagccccgtagcctcccgcagcctcctttgacggaggtttgacggaggtggcgaagcaacctactttgacgtaggtctttgacgaggggctttgacgcgggtttgacggaggtgacgaagtaaccccttgagggtgtgggcttgagtaaagcagcaaatttgtttcactagcaaagcaattgtccgaatgaagcgtctcatctttatcacaaatgctacgaatccagagacttcctctgcatcatcatcctcgtctgtttcgctctcgctccaagcaaaccaataagggagtattcacacattcagcttttgtgtgcccctagcgaagcaacctttgcattaaaaacatttgaagtctcttctctaaaaaaaggcagtgctcagctttgccatatccctacactgttgttctcccttctttgacacacgatcacgatttgttgttgtgttctgtgtaaaagggtttttcctactttgtccattcttctttactactttgccaaagtttctagcaagcagtgtgctgccgattgaatcttcaatatctctcttgttgtcttagtgtgtgctgcagcaatgctttttctcggacttctcagtctccatttcatacgcttgtaggtgacctacaacaacatcaaacgcaagggtatctatgtcattcatggcttgcgaagggctgcttcgccgggagtgtgctacagaacagaagctttttgacttttgtctttgtctttcattttgagcagcattggcaaagcacagatgaattgttcaatggtctctctttcctccgtgaagccagcagcatatcaatacgagatctctttacacttgtcaacccttctgtaggatatcccaagcatctttggatgattcacccttgaatgtgtcacttgcgattgctgacagtgctttgctgttatactttcgacttcttcttctcagcgtctgtccatttatcactatccttttcttgccctgccgcttctactcctttcacccctttctccacagcataccatgcgtcttcataaatgcctcggtgcatcttcaccttcttttatagttccctttctgagattggtcgatgcacagcaatcaattccttagattcccgcagtgtgctgatcctcaccacctgttgtaagtagtcttggtatttggtcggtaagtaaaggtacggaaagagcggacaactaattaaaatctctgaacgtgatacgtaaatgggagaaaaatatggatgaaaccccttatctatctttccttcggcaaaaaaagtttatgaagccatcctcgcctcggggataagagatctttcgattctggagagtaagcttcaagctcaagatctcatttgtgatcttcttcttcgcgaacctaatctcaagtgaacatttattattgaattctcaattttcgtataaaaatacctgcctttcattttattgaagagaaaacctccccccatttgaacgaagtctctggccttccccgttatgactttagagtatctctcacgtcttataagtcacttaaaaatgaatgggcggataggaccactcctgcttgctcttggccttggctgcttagagacatccctttagttcgtcttagaggtctcgattggtattgcgcggtcggtaacgttggtgaattaggtaaaggtacggaaagagagggattcgaaccctcggtaaacaaaagcctacatagcagttccaatgctacgccttaaaccactcggccatctctcctacattatgacccagaaacctcgagtgaatagcgagtcatttatattcttgcagtaaaggtacaaccacaaacaatctattaaaaatggaaacctttttagtcaaagaaagatcttccttcgaagaaaaaaaaacaataagaattgttaccattaaaaaaaaagcactctttctattcatctttgtcaagacgacgatctcgttatattattatatttataccggattttgccaatg

SEQ ID NO: 13097 - DNA, 3000 bp, Unknown
  misc_feature (1)..( 3000): cDNA_ID_3074477_gDNA_ID_2214597_Annot_ID_186936 3000 nt of promoter + ATG
cgattaccagctcggaatcaacccgctaacggaatcctctggctgggttacctaacctccacttactcctaccctaagacaccaaaagattcaccagggtttatttcaactagggctctttacacgtcagtttggtttgagcctacagctgtctcaacttaatgaactcgaccttatctatacgcaattcatgccctatcatgatgagtcaacaatcccaatcccaagccaagctttctcaccctatttagatttaagtgcaccgcctgctttctttcatgttggaatttctcctgctgtaatatatagagtagttccccttattctagttgtcttctttctattccttccggagaagaagggtaaaagctagaaaggtaagcattgtcgtgtcgacgcacgcgaaaaaggtacaagtccacttcgatagccaagcaatgagggagtctgaagagacttccagttcgctggacttagttttagatactccaagccttgttatcttaattctcttctgtaacagtaacggatttcgatattgaatgtactggtcggttgggaccctataagaagacaagccaagcgcttagcttagttcgcggccctttacaagagtgaataccgaaacagacaattccagatgccactaaacaagtaaaggacaacagacagtattcgtggatcgggaagacctactctcattcaaggaagcggaccggttgacgactgcaggctagggtcccgttgaatttgacctggtaaatcccgccacagaggtcgttttctaccgggaaggcatagagtcgcattttagtctgagtctgagcaaacaaacactcacttaatcgaaagctaaataattaactttggaatggtaacgaagatcgaagatcgaaatccttccttccatcgtctgatctcctcctgagacttctgagcctcctaggatacttcgtaagccgcagccacaggattaatatgtggaaatggcaagtacacactgtgcaccacgatctttacgttgcggatgacgtccgacaccttaatcctcacatagttaatcctcatcggcgccgaggtcaaacctccaccggcaccagaggttgtgataagcagcggttggcctcgttccaatgtcggcggagcagtccccaccgaatgatcatttatttgactttgactcttcaaatcccattttttattttttctattgtttgtttgttctttatgcggggacaggattcgaacctgtaatcttcaggtcatgagcctgatgagttgaccaattcctctaccccgcttcttctcttctacaagtaggcttctttcttctagagacaaacgaccgattgaactacaatcacaggagacaaattattcttcttgtcaaccttcttctcttacgatatttcaaaagaaagaagaagagtcgttggaccaacaaccgccaggataaaagtcttctttagtcatcaggaagctgatttgaatgaaaagtaaacatagaattaggtctcacctgcgctagggactttcattgaatcaatctcggtatgtcaatcggaagctcaagaagagatagtatcttcctttcagtagcctctggtcttgcagttgggtttccccgcccaaagccttctaatgattccgttaaggcaaatatcccataataagatatacgaataagacggatcagaccgaactgtcaatgcattcattccatctccaccggaatcacccctatgcatagctccttccctcttctatgaagttgaagtgaagcaagcgagcctctcgattgagggagaccgatctgagtcagtttatccagtattttaggaaatgttcgggatagattcacgttttcccggtcttttttatataaattagcgcttttgtggtacgggtggagggctatgagctcgttcactcaatcccgtggaaacaactcccttagccttagttggaagctaaaccaaagtgaagcttgtaggctcgtagagaaagctattttgcaggtatacccatagatccatgttcctgaacagtctcggagaaggccaccagcacccgacttaccagaatgtcccgttgcagcaccatgcaagaaaaggttcctcttggaagcaccatccgtattgaattttaaccagccaatggaaggaaattcccaaaactcaagaacctgagcttataagaccaaaacaacttggacctgccgaatagactagaagacgatatcatagttctgaatggcgcgcactacctgatgatagggagtgctctgtcgcgttccattcgtttcgatttcatttcaatatagggcaagtcctttttccgacagaaggagtggtcgttttgggtgacagaataagattccccggatctccctcaatctcaaatcgacgacgagagattctaccacgctcacttttacgtagcttcacttcttcttgatcctgctccattggagttggttcattcagtgtgtcgctcccacttgccccaggaggctgagtaccttcgttcctcttcctcaactggttgattaggtgctccaagatctggatcttctatttcataaaactggaagtcttgactcgcccttctcggtggtcgttagcagctgctatttgaaatccattcccgctgctgtcgtcaacggtagaactcttcgggcatccgtccgttcttgcttctggagttcaggagtggattcgattcgatccgatgagagagatcagtaggggtcatccccgagtggacgagcataaagagatcccccggatgacaggcctggggcgaaaactcttcaaaagttctggcgctttcaaccctcgaacgaaaatttgattgatgaaatagtggatttcgcctttttttgggggctatttcgtgcctctcaattctgaaacaacaaagcaggggaagtgtggaaacaaagttaaagaagagacttttaggaacaacagcaccaaagataccttcggggtagacatg

SEQ ID NO: 13098 - DNA, 3000 bp, Unknown
  misc_feature (1)..( 3000): cDNA_ID_2710454_gDNA_ID_2214598_Annot_ID_135501 3000 nt of promoter + ATG
gatacacatatgaacaattctaacttaattattatacctataggtttataaggtgataatgttgcctttatgtaacactcaatattgaccaaatttaaatcagtgagggaaagaagggcacgtgagggaaacgtcaagggtacttcataaaggcaaattagatgctacggcaggatccactattttagttataattatttatcgcattagtttcaaaatcaaacactcttaaaaagagaaaaacaaaatgaatatcggttgacgaaaagaaattgaagagtatggtgaatgaagaaaattaggcatatcatcacctttagtcaaaagaatgaaaatcggtaaaaaatcactctagtggataattttgtcaacagatgacttatgatcttatgttatatattcaaaaattccaatatatgttttgcaactatatttcacactaatttaaatattctaaagtcaaagataaatgaaacaaaaagacagatgatatatctattatacacctaagttgtaagttgtaaacactatttttgaacatcttggaaaattcgaatgtagccaaagacataaatccaatatatttttttggtataaccgtaaatccaataagatcaatcacctttggataaagctaaaaatgcaagttgatttaaaaatcaatctaatctaaatgattgtaaagcaagagacaagactgtaatttgacaattaccatacacaccaagaacaaaaccaaagactaaacaagaacatataacaaatatttaacattttcttcattgttttctcgtaaattagacaaaaaataataataaatacacatgcatcgatatttatgaattttgatttatcagtgaaataatttgataaaattactaaaatttataattgaaaaattaaaagaacttacgtgtaggttccatgagaaagctgaataagagcattgacggcagctttctgatggccggaaacatcggaagcgaccatagaaacaagaatttgaataacacctagctcagccatgagcttccgagtcttcttatcttctcgggcaagtttctcgatctctatggcagctttctccttctcttcccagcttccgaagtggatcttctttacagttttttgtaacacaacctcctcattctcatcttctggtggctttgatacaatttcttccggaagcgccgccaccttctcgaaatcttgataggttcttgatttctctggtaacgcttgaagattacttttgcggaaggatgctttggatttcaaaaggcatcgaatctttgtgaagaagttgagcttcatgtattgaagttgccaaactgaagaagaagaggattgtgttcgagaggaagacataatggatagatgatttgatgttctgtttcttttagtggacttcgctcgtcatatatatatcgacctattgatatttgtccaactttaggtatttatggggccaataaggtataggcctaatgccggtaagatttttagaaaaatataattttaaagtaaacaaatgatgtacgttttgtatcgcataactaataatcttttactatatacttcatgtgtcctaaaactcaggcaaggcctaagcttctttatcttttcattttttcaatcaccaccataaaaagcatttggttatatagatccactacttaataaaaatggtgtttcgacgaaaaaaaaaaatgtagatccaatccgtcgataattcaatttataaccattttaccaacatcctaaatttcgttggtatactatattatccatcgtagataatttcaaaactatttaccaatgtcactttgccggtaatagatgttggtaatacgtcaaaatatgtttggatgtactattgctaacatttaaatgtaacgtcaatagtcgttgcatgccacatatttgctaatcctagttccatcggtaactcgttactaaatatcagttgtatactgtctagaattggatatcagtacaatccaacagattagcgacgaatattttttctatcaatatgatgtcgagaaattaccaacggatgatcttttcaggaaatatgtcggtaatttccctatttacatatatatagtgaatgtatgatgtagcattctattgaatgattctaagtccgcctaacatccacaaagcatagtatatgatatgactcaagaaaatgctgaaatggtttgcatatttttatgtgaattgtttttttccctatttactaaatctctttttgtttatgtatttcatgtagtataaatataattatgtatattatttgattatggaaaatttattgacagtcgattatgtgtcgactatacatgttatagatgcacgacgtttgatcatcgtctgactaacacatctatatcactttaaaatgttgtaaagaattttagttttcaacaaaagattccaataaaatgaataaaaataaacacctttcatcggccctcgtggtcatttgaaaagaaactacaagagtttagatccagctatatatataatgggtttaaacaatgaattctgatcttaaaatagttatcgatttaattaggattaagttaagtaaagaaggaataatatggaggagaagaaggggacaagcgaggaggcaagctaatgcacatgcaagagaacagttttgtctcttctaaatctcaccataaggttacagcagagagatcattgaaacactaaaactaatactctcttttaaattctcttgtttcattaattaacacgttcgtgtgtgtcagttccaacttaacctcggtacgaccaaagatggccacatttcttgtttagaaaaccacatcaattaaaagtgtttaggaaattggcaaagatgaccattgaaatgatttttgccacgattaatttccattttttagttgcaatttggtttatgaaattatattgttaattttttatttttttgatcaaactgtaaacttcattgctagaaattaa

SEQ ID NO: 13099 - DNA, 3000 bp, Unknown
  misc_feature (1)..( 3000): cDNA_ID_2710454_gDNA_ID_2214598_Annot_ID_186950 3000 nt of promoter + ATG
cgaagtggatcttctttacagttttttgtaacacaacctcctcattctcatcttctggtggctttgatacaatttcttccggaagcgccgccaccttctcgaaatcttgataggttcttgatttctctggtaacgcttgaagattacttttgcggaaggatgctttggatttcaaaaggcatcgaatctttgtgaagaagttgagcttcatgtattgaagttgccaaactgaagaagaagaggattgtgttcgagaggaagacataatggatagatgatttgatgttctgtttcttttagtggacttcgctcgtcatatatatatcgacctattgatatttgtccaactttaggtatttatggggccaataaggtataggcctaatgccggtaagatttttagaaaaatataattttaaagtaaacaaatgatgtacgttttgtatcgcataactaataatcttttactatatacttcatgtgtcctaaaactcaggcaaggcctaagcttctttatcttttcattttttcaatcaccaccataaaaagcatttggttatatagatccactacttaataaaaatggtgtttcgacgaaaaaaaaaaatgtagatccaatccgtcgataattcaatttataaccattttaccaacatcctaaatttcgttggtatactatattatccatcgtagataatttcaaaactatttaccaatgtcactttgccggtaatagatgttggtaatacgtcaaaatatgtttggatgtactattgctaacatttaaatgtaacgtcaatagtcgttgcatgccacatatttgctaatcctagttccatcggtaactcgttactaaatatcagttgtatactgtctagaattggatatcagtacaatccaacagattagcgacgaatattttttctatcaatatgatgtcgagaaattaccaacggatgatcttttcaggaaatatgtcggtaatttccctatttacatatatatagtgaatgtatgatgtagcattctattgaatgattctaagtccgcctaacatccacaaagcatagtatatgatatgactcaagaaaatgctgaaatggtttgcatatttttatgtgaattgtttttttccctatttactaaatctctttttgtttatgtatttcatgtagtataaatataattatgtatattatttgattatggaaaatttattgacagtcgattatgtgtcgactatacatgttatagatgcacgacgtttgatcatcgtctgactaacacatctatatcactttaaaatgttgtaaagaattttagttttcaacaaaagattccaataaaatgaataaaaataaacacctttcatcggccctcgtggtcatttgaaaagaaactacaagagtttagatccagctatatatataatgggtttaaacaatgaattctgatcttaaaatagttatcgatttaattaggattaagttaagtaaagaaggaataatatggaggagaagaaggggacaagcgaggaggcaagctaatgcacatgcaagagaacagttttgtctcttctaaatctcaccataaggttacagcagagagatcattgaaacactaaaactaatactctcttttaaattctcttgtttcattaattaacacgttcgtgtgtgtcagttccaacttaacctcggtacgaccaaagatggccacatttcttgtttagaaaaccacatcaattaaaagtgtttaggaaattggcaaagatgaccattgaaatgatttttgccacgattaatttccattttttagttgcaatttggtttatgaaattatattgttaattttttatttttttgatcaaactgtaaacttcattgctagaaattaaatggtttttacatcagagaagtccaaagaaaacagagcctctttggctaaagcatccgctgagagatttggtaaacgaaaaatacaacagaatttgaaagatagaagtgaacgacacaaacaggtgatgtcatgaagacatctaacagaatttctttatataggccaatttaaaagtgtttggcaatttctttattgcgtataaaggcaactaggtacgttactcgtatttcggaggtgcttaaagtaaactagggtcaagtcagtgaccttgatacttcgtttttatgagaaatgttgatgtccaacattgtaatgatataaagtcctacaatcttcagcataaagatctatgtaaggctcgtgttctatagtatgaacacctagacagtttgtttcgaagaaaattggatcatgatcaaagaattgcaaatgaatgagtagactatataaactagtcatagggtacccgaggattcgaattctatatcaacaagctcatcactcacgaggagcggacttaacttgtttggactcaacagcgttgtgattctttaaatatcctaatatcatgtgattttttaaaatgtcttccaaattgtttagaagcaaactatgtacttgtgtaaattaaacgcgttagaaacatatgttatcgatatcaatttctagttcaagataaataaattgtagaaccgtggttggaatcgtatcatcagaaggaaaaagaaacatagatacattaataagtctttcaagtagtgattcccacgtcctacattactctttaaccatttttcttcaccgccacacaatttctccacaacatcttgtgaacgtgtaaacccgtttcgtcgctggcaatgaaaatcacattcccatcccttgcttattacgcattgacattgccgagtaaataccccaatcagaagagaagaaggaagaagaagaagaaagtgtgtttagaattttgggtgacgtggctgtgaaggagagatagcgcgagtgagaagacgcggaaagcccgaactctcgcggttcggcagctccgcgtcagttggtcgaatcgtcttcgagctatctcgttgcttttcgagagatata

SEQ ID NO: 13100 - DNA, 3000 bp, Unknown
  misc_feature (1)..( 3000): cDNA_ID_3028093_gDNA_ID_2214598_Annot_ID_186948 3000 nt of promoter + ATG
caatgtcataataatcttaaacttcaaatgcaaacacaaacccaaaaataatcatggcaaaggtttcaacccaattcacggtttacattagaaagaagaagaagctgaaccttgcactagggggcttcttgggtacgtcaggctcgaattcagaaggaagaccaagaaaaccatcgaagcgatcgtatgttacatgagccacatgagagatattggttgggcgactaatgtccatggcatgccgttcgttttcctccgccattatatctctcgaaaagcaacgagatagctcgaagacgattcgaccaactgacgcggagctgccgaaccgcgagagttcgggctttccgcgtcttctcactcgcgctatctctccttcacagccacgtcacccaaaattctaaacacactttcttcttcttcttccttcttctcttctgattggggtatttactcggcaatgtcaatgcgtaataagcaagggatgggaatgtgattttcattgccagcgacgaaacgggtttacacgttcacaagatgttgtggagaaattgtgtggcggtgaagaaaaatggttaaagagtaatgtaggacgtgggaatcactacttgaaagacttattaatgtatctatgtttctttttccttctgatgatacgattccaaccacggttctacaatttatttatcttgaactagaaattgatatcgataacatatgtttctaacgcgtttaatttacacaagtacatagtttgcttctaaacaatttggaagacattttaaaaaatcacatgatattaggatatttaaagaatcacaacgctgttgagtccaaacaagttaagtccgctcctcgtgagtgatgagcttgttgatatagaattcgaatcctcgggtaccctatgactagtttatatagtctactcattcatttgcaattctttgatcatgatccaattttcttcgaaacaaactgtctaggtgttcatactatagaacacgagccttacatagatctttatgctgaagattgtaggactttatatcattacaatgttggacatcaacatttctcataaaaacgaagtatcaaggtcactgacttgaccctagtttactttaagcacctccgaaatacgagtaacgtacctagttgcctttatacgcaataaagaaattgccaaacacttttaaattggcctatataaagaaattctgttagatgtcttcatgacatcacctgtttgtgtcgttcacttctatctttcaaattctgttgtatttttcgtttaccaaatctctcagcggatgctttagccaaagaggctctgttttctttggacttctctgatgtaaaaaccatttaatttctagcaatgaagtttacagtttgatcaaaaaaataaaaaattaacaatataatttcataaaccaaattgcaactaaaaaatggaaattaatcgtggcaaaaatcatttcaatggtcatctttgccaatttcctaaacacttttaattgatgtggttttctaaacaagaaatgtggccatctttggtcgtaccgaggttaagttggaactgacacacacgaacgtgttaattaatgaaacaagagaatttaaaagagagtattagttttagtgtttcaatgatctctctgctgtaaccttatggtgagatttagaagagacaaaactgttctcttgcatgtgcattagcttgcctcctcgcttgtccccttcttctcctccatattattccttctttacttaacttaatcctaattaaatcgataactattttaagatcagaattcattgtttaaacccattatatatatagctggatctaaactcttgtagtttcttttcaaatgaccacgagggccgatgaaaggtgtttatttttattcattttattggaatcttttgttgaaaactaaaattctttacaacattttaaagtgatatagatgtgttagtcagacgatgatcaaacgtcgtgcatctataacatgtatagtcgacacataatcgactgtcaataaattttccataatcaaataatatacataattatatttatactacatgaaatacataaacaaaaagagatttagtaaatagggaaaaaaacaattcacataaaaatatgcaaaccatttcagcattttcttgagtcatatcatatactatgctttgtggatgttaggcggacttagaatcattcaatagaatgctacatcatacattcactatatatatgtaaatagggaaattaccgacatatttcctgaaaagatcatccgttggtaatttctcgacatcatattgatagaaaaaatattcgtcgctaatctgttggattgtactgatatccaattctagacagtatacaactgatatttagtaacgagttaccgatggaactaggattagcaaatatgtggcatgcaacgactattgacgttacatttaaatgttagcaatagtacatccaaacatattttgacgtattaccaacatctattaccggcaaagtgacattggtaaatagttttgaaattatctacgatggataatatagtataccaacgaaatttaggatgttggtaaaatggttataaattgaattatcgacggattggatctacatttttttttttcgtcgaaacaccatttttattaagtagtggatctatataaccaaatgctttttatggtggtgattgaaaaaatgaaaagataaagaagcttaggccttgcctgagttttaggacacatgaagtatatagtaaaagattattagttatgcgatacaaaacgtacatcatttgtttactttaaaattatatttttctaaaaatcttaccggcattaggcctataccttattggccccataaatacctaaagttggacaaatatcaataggtcgatatatatatgacgagcgaagtccactaaaagaaacagaacatcaaatcatctatccattatg

SEQ ID NO: 13101 - DNA, 3000 bp, Unknown
  misc_feature (1)..( 3000): cDNA_ID_1025971_gDNA_ID_2214598_Annot_ID_135502 3000 nt of promoter + ATG
ttgcaagtttctacctgcaggaagtacagaaagagaacttagtctgtcaacaggtattccaagccatgtgatccgacaatcaatttgaatgaccaaggaagtaggaaacaggaaacaagatgttaaaaaatgaccataccggagccaaaaattgtaacaagggcatgacatcctcaagttctagcgataagctgctctccccatcagggggaatgaatacattctttacaactggtataggtccttgaacatcatacagtcctattttgtgactgaacgtaacaagaccaaaaagagcccctggacttagagctgcatatacgaaaaaacgagagaattgttttcctcaggacacagtcacacagaagaaaaagtaaatccttgctttaaatttggtatgaaacgaccttccagagcggctagcaatgcactttttgtaagctccaaaaattcctcagaagctgcagataacaaaaataatcatgagcaaaaagtgcaacatttgaacaaaattcgaaacaaatttactgctaccacaccctatctccaaagtcatgacaaaatcacaacataagcaagccaaaaatcgataagaacaacaaaaaagcatacaaacccaagctagaatcataatccatagcaaaatgacacacacattgctttcaaaattcacaatccaaagttcactaacacacaattcaagtacaatctacactgatcacaatgagcttcgaacacaatatagaagaaataagccttacaagagatatcaatcgccgcaacatacacaggtcgtgcttgcgtcatctcttcctccgatccatccactagaaaaacaaacaattaatcagaaattagaaccaattccaacaaaaaaaacaaaagaatcagtatagagatgacgtaagacatacgaggcatctcaagatcaatgaaggaggaagtcatttcaggtatagagtgaggattagagtaacgagcaatagcatcagaaggaagtccattgagagttccacaaagcgagcaattccaagcccattgatcaagctcacaataggtattgaagtaagcgtagcagttttcgcaacgaggaagaagatgaccgttagatccgcacgctggtccgattccgttctcgtctttggccgcgaatggtgttactgtcagtccccaaggaagtcctgacgcctcttgagcgtctgaatcgatcggaaaacgcgacaccgttgctctcactgccattgtttcagatcagatccttccaaatgtgaaaattttgattctggttttaaggttttcggagatttggtgaaattggatgagcacggtggaaattaggcgcacgttagcttttccagtaaaattcgtctccagcgcacgttagcttttgtgaacgtcttttttttttggaagtttttttttccaacatcaaagaggccaatgatttaaaggtggaagtagtgatggtactacatatgtataaacatggagtgatgcaacaactcaagtataagaccatcatcgcgaagattaaagacctgaggaaattcactatattttgttcttctagagagctcgaacttaaaagatatattatactctatgtttactcgggggataacgtcaatatggtgtcaatgtagacatcaaagagtttgaagatcaagtacaagactcctcaattaagtatcttgttggatcactgaatattgttataccttctagttttctaggtaagagattgtttagtcgaatacagattttattgatgaagaaaagaaagtgattatgtattgtgggagatgcgaggatttcacggagaacatgatgtacattattggaaggcatggttgcagaaaattcgattattgtacaaaccaattgaaatattgtccctggtttctcttcagttattatgtctctggtttctcttcagttattatgttctaagtgattatgttccaagtttagttattttaaatccaccaatgtaacttttacccaccaacacttattttgtatcaacttgtttatgtcttgtgcatatagtagataagtgtagaagaatctaaaataagaccatacaaggattaggatccctcattcataaaacatctaaaatgttccaactcaatttggggttttacgtctgcgtttgcgtttgcgtttgcgtttgtgaacgcctttattcgattttggaaaagaaaaaatgttctgttctattttgttctctctgctagtcacagtcaaatgagtcagctaccttatattcgattttgagcgtccttaaattccttcactgtgagaaaaaacacagagaaagagagagaaacaatggaaacggaaggaagaagacgagaagtggttgtttcatctctccaattcgcttgctccgacgatatctccaccaatgtcgccgccgctgagcggttcgtctctctctcttcctccctccctctctctaattatcaatctctcccatcttcctcctccttcaaatttccatatgcgtataagcttctcgagcaatttattgtgatcacggacctttggaatcgaactattcaatttcaagctctgatatagattcccccgttcgaatccgatttcagtatctgagaatggaattgtttacattttacgcagattagtcagagaagctcacgctaaaggagctaatatcattcttattcaggtcattgttgctcttcgaaattgtttctcagatttataagtgtttttgattgatctagtatccaatcgtcttagctagtcttatgtagtttagtttctgtataacaggaactttttgaaggatattacttctgtcaagcacaaagagaagacttctttaagcgagccaagccttacaagaaccatcctaccattgcaaggtgtgacattgcttatccgatttctaacgcagtaaagtggaatctcgatgtatctatgtactatctagtgttttaatggttggatggtttaatttaacacaggatg

SEQ ID NO: 13102 - DNA, 3000 bp, Unknown
  misc_feature (1)..( 3000): cDNA_ID_2710444_gDNA_ID_2214598_Annot_ID_135505 3000 nt of promoter + ATG
aacagcacaatacaacgatgcctttaaccttgtccaatacaaaaacggaaataagtcaatgagttctcagattgatatcacgttttcacaatgtcctcaacttgagcctttgcctcgtttagtctttgccttactccgtaatccccttctccggtttcatgaagaaggtgttcatcctgattacagaatctacttgcaatgccttttcaggtaaccatcccaatgaactactaataaccaacctagagtcagcgtgaacaatattgtatatttagtgtattttttcgatcgtggatttatttggaaaaaataccttggtatctcatgtaaacagaccacaagcaaggctttagtctctaaatttcgtgtttgtgttcttctgttttgttttccttaaaactgcagtgtgttggacccgagctctcttcattgcggcatttacccagcactaatgtcatattcaacaccggatacactggcatatccgcgtcattcgttgagccgtgcagcattgataacaagtggtagtccgatatttttcctagatgcatataccactttgatagtcttctactcatcaacagcagacccgtcaatacctttccctccacctcaagactgtaagttttctcaccaaatgaaatccagttcaaccacctttagatctttgagactatgttgattcgaaaacttatatcttacaggtttattgaggcagaccataaataaagtgaagcaagaaaggagcatcacaccaaaactagtgtttatccgaggaggacgagacgatgctactgtctttgagaactatcttatagaagaacaagatgtggacggtaatggttttgctagcgccatgggtttcgtgtctttcctcgatgatatttcgcagcgtgtcactgaatacatgaagtgaaagccaaatgaccctctagtttattatacatccaaactcaaaattttcaactgtgtcagagttttactcttcttgttgtaacatttgctttagactagcatcccaacttttttgctctcttaatcaaaatgaataattaagctaaaattttgttgcaaaacttcattttctaaactttgacttacatatttggtaacactagagccaaagagcaaaaagatatgttagtctattacatgctcatggccacaaccactgcttcaagcttacaagctaatctccaacataaacctgaaaacatgttcttagcaaaaatataaccttgagttcattcatcttcttcatcactctctacctcttcaccacttccacttacgctcccgtcctcgttctcattatcttcaccaaccccgctcccattttcttccatgctatggtcctcattcccgctctcttcgctctcattcccattctcttccatgctgttttcctcatcctccttctcgttctcctcatcattcccattctcttccgtattttcatcgtcgttctcctcatcattcccattctcttctgtattttcatcgtcattctcatcttcctcatcgtttccattctcatcctcctcatcgtttccattctcttcttccgtgttgtcattctcagtctcctcgtcattcctcttagtttcctcatctattttgcttttccttgcacccttttgcgtagatggttcttcctgtttcctcttcttcgtctctttgggcttcgaagcagttccacttgaagatttcaaagcagctccaccagcaggatacgaagcagctgcagcacccgcctttttccccgcattcttcttcttaaaatctgaaaaccagtcatgtggattacactaggattgacatcataagctcaaagtgcacacacctaggccagtgtccataacaagacaaatcacaacctaagccatttctactaacactccatgaaagtaacaacagatagtgacaataggatcttcatccgaacaaaacacttaccttcaagagaagatttaagcggctccaaaaattctgaaaaatccatttcttctaatgccttaaacacatcatcagccttcatagtttgtcttcttgcatctttacaaaaatcatttgccctatatcattcacccccaaattaaactaaatccatcaattcgatcgatcacaattcacaaacactaacattcatcaattgaatcacattaacataaacccaaacttggaacattccaaatcattcactatcatagtgcagaaattcgaaaaaaagttagggtttgtgaagtgtacatacgtggcggagaggtagtggatgaagatcctcgcactctctgagaatgcgagcaaagcttccttgtgaatactgacgtcataatccggcgaacactccgacagcttcttcttcaccacccggcgcacaatagctagcggcagctcgtccaccaccactttctccgactccattcttctctcctctctctcagtcgccgtctttcccgcctttatgttaataatacaacaaaacacatcggcccagtaagctgatcagcctattaaaatatttaaaagcccatattcaagtttataagcactaaagagttatgaccacgccgctcaatattacccgttggattgattgacaaaatcctagccgtcaaatcgtactagcaaatcggcccattattcaaattgataagcactaaagagttatgagcacgttgtcaatctcaccgttggataacctttattaaatcttcaccgtccaatcgtaatactaataaattcgatcaaaacacgaataagaatcggagtcgtcttcaacctctggaatttgagacatcttcgaataaccagattctccgaattcgagccatttctaagaatttcatactctgattaatgtcttactcaaacgcctacgcaccgtcggcaccggagctaccagaatcgttcgttcagcagcagcacgatggtgaaagtagatacacttacgcgtatccatcatatcaaccaactcagcaattcagctcttactccggg

SEQ ID NO: 13103 - DNA, 3000 bp, Unknown
  misc_feature (1)..( 3000): cDNA_ID_2710462_gDNA_ID_2214598_Annot_ID_135507 3000 nt of promoter + ATG
cattagccagagaaattcccatctcttcgacaaaacgctcgtcttaacggaatcgcctgtcggaagtttaaggtatgagagtatccgagctaccatgaatgcatcagaatctaatcaaaattcatcactcttgattctccacctttgacataagcatcctgttctttgagtgctctccaagtaatttcctgacttcgattaggtcagatccttcgcgaacaagtcaataaagcatgtcttatatgcaatcaatgaaaaatacaactcacatttaagactatattagattagcatataaaagttacaaaatggagcacaagctttaatatatatagaaggcattagcgatttttttttgcaacaaaattgtaaattattttaagcaattttagtggagctcatatagattattttcagtggaacgcgtggtcatgactagatgattccctcttgcccataatagttcaccacatatctcatcatgtccatcaaaatcatactaattttagattttatatgtatttttaaatattagttcgtatgaaactatctgttaaattctttacattgagtgaaattataaacacatctttactacacacaaaaaaaaatcaattgaaacacatgaatatattcgattatttgagatagaaatttaaaaagcacgtgagtggatcaggcgttgaaggcggcgaggttaggaagggcaggtgacagtaacagagaaaggcggtgatcgagacatggccggtctctgtggttcacgcttccttaacgaatcacgacgctacatgttaaattcctcatattttagttaactttctgatttttttattatgaataatttctaacccaaaaaaactgtttactagattttttaataattaaatgtgataaaaaatgttggtgaaagatataagtgggcagtaccgaatattggacaaataatatcagagtgctaaaggacaaccacatttttttttttttttttttttttttgatttagagctggtacgtcgacatagaaatatatgattttgaaaagtaactttttaaaattatgtttttaccaaataaagatagtttcatagttaattttgaaactggaaaaagtaatctgataaccctaataaagatattaaatgttacaagtcactataacactatcgtttaattagttcattttctttccaatcacctcaaaactctaaaaaatgtattttgaactaaactttagaaagttaaaagacagtatactgatgttttttttttttctcttttggtgagaagtatatactgatgttttaagtaacctcgattgtgttttctttggtagatgtttatttactcctcgcaactgatcttcaaggatgtatataaataagaaaaagcaaaaacagagaattatggatgcttaaaattttttgacgaagaacaaagtagagttaaataaagaattaaaaaaaaaaaaagagaattataatccttgattagagaaaagattgatccaacatgcaaaacaccatacacgtaaaaatctggtggagagggtccacacgtttgacaactcaagttctaaagagacgtacgtgtgctatttcattacttgtaaactttagaaacattgacgatcaaagtaaagaatcctaacaatcatacatactacatgatacaagaaaacaaatattgcataacttgtctctttctgtcttcgatctaatatgcaaattgcaacttgataaacttataaaactagaatatgatttgtgcgtgtgaatcgtgaaatttgcttttgtttgaagccgccagtggtcatggagtgtttgaattgaagaccagttggggaagagtttaaaagttgaccattctcactcccaatatttaaccatcgttgttcatattttaataatgtttcgtcacacgtccacatgtgaaccaaaagggaacgttactttccatgtcggtaaatctcctgatattttttagaaaataaaatatctaaatgtcacgtaggaattgaaatcatattatataacccacttgtatattaatgactgcaataactgaaatgacgaaaaatcaacttcccgtatcagttttttatttctccaaaagagaggtcaaaaattgtaacgtaaattgacgtaaggaaaacaatcattacaagtgacgtttcgttgtaggtgaaatttaatagtatataaactatttgacattagaatattcaaggtatggaaggtagagaagtagaacagcttggatttacattatttgtatccataaatctaactaaacctactacttattcctcctctttgattaacatacatgtaatttaaagaaaccagccaaattcgttatatatagttgagctgtaaagggcataaagtaaaatcaaaatcatacatatttaactacacttttaggcaattgataaagcacattattttatatctataataagtttataaccaaaaataatagtaaaactcgatgtcgatagtttaacgacttacgggtgtactaagtaaacatccaaaaaaaaaaaaagtttttatttcattaaatgatcgattgaaaaaaaaaaaataaatagattctagattaaaaacttttttgttagaaaaaaaattcctaatgaattaccaattactattgggttatcttcttattggattctctttatttatttttcttgtaccaaaaaagaaatatgtcaaacttgataccaaaaaaggaagaaaaaaacaaataaaatatgtaatgtatgtaatataggaatataagtttaggcataggtatatgcattaatgagagacacctggttagagctatttgacgaacgcggaaagcaagaaacgaagaaagaacagttgaaactttccaaattccaccgtctcttatatattcttaataccaaaaactaaaactcaaaaggaaaaaagaaaaagaagaagaggagctaaaaaaacgacgtcgtagaaggagattcttgccatg

SEQ ID NO: 13104 - DNA, 3000 bp, Unknown
  misc_feature (1)..( 3000): cDNA_ID_2710515_gDNA_ID_2214599_Annot_ID_135513 3000 nt of promoter + ATG
ttcagctttactttaaagataagcctacatgaaccctagatttttcctttgcattaacatgaaccccatattttttaaatttgaacaaaagggaaaaacaaaaagaggaaaaagaataatgaaaagcttatggttatttattttaaatggctgttttatcaaaaagttgagctttaatgggccggtatgggcctttttcccaattagaaattcggtcgagctttgatgggccgatatatgggccctttcccaacgcttaacgccacagttgcaatatataatgtttgctagggtttcaaaggaagaagaagatataaacaaactcttggtggcggtgagaaaaaaccatcagggctcatgatcgatattctctgaactagagaagccagtgagcgattcagtttccattattactatcaaagcttcgtactttttgttttcgtcgcatgatgtcttgtagttttcttgttaattgatagaattctattcattgaattaagtaaagttgtgcttttttagctttttctctttgtgctttgcaaagtcttaacctttcttatgttttgttagtatttgtgaacttgggtttagataaagagccagtgatgattgaaaaagattgtctacattgtttgatgtaccactgaaatgaattctttaattagtctgaggctcattgctccttcaattttcctgtctgagatttgtatctctctttgccattgttgcagctttaaggcctatgatgattcaaattttgcctacattgtttgataaaccaatgatataacttgtacaaaatgttttctgaggcctttagtgttgtttacttagagaatttgattatgatttttgacggtgtgaggctggtgatgatgtttcatatctttgcctacattgcctgatcaaagctatttttggctttgaacaagtgagtgaatgataaacttctgaagcctcatgagtttactattgttaattttgcctaggaggagtgctagttttgttgtagtgtagagattttatatgctctatgttgttgtctccaacgaaatccgtgaacttgtttaaatcttaccatcttagttatttcgtagtcgtttggttgtcatacctgaaatctgtagcaatatctataataaacgaactcgtatgtcaaatcatggaaaatggtttagaatgaatcttttgcttgtggaaatactggatttggtttcgaccacacaaagaaactctaattccttgttcatgatttggtaatacttccatctctttgtcttaacaatatgtagaggaagaaggatcacaactgagaattcaagccttggcctctcctctcctactggaattttatttggatgtgtcatgtttccatttaacttgtattgtatgttgggtaaatttcttgtatttagaagagccacaagaaaatttggttctgactaatgattgtatgctattttgaacttgttccaaccacattgtaatttggggctcagttccatgatttccctatcattttacttggaacattatctgcttttcccactatttaacaaatgtcttgagtgttgttgaccatacgccatttctcacatccaaaacacaatgacataaacatgacagacggggctctagcagtgaatcaatctataagattagctcacgttctctaagcccaataacatacaaatcaaggcccaatctaataagtgtaatccaacgtgactcagaagtcagaacatccttgctagttactatagttgctacttgctgcgtgtccatttgtcatttgtaaaattgtccttgtacgccaagctaacctttatttgcttaacaagtaggaagatagattttagcttgacctccaaggcagttctacaaatgacaaatggaaaggaagagtcaaacttggtggtttatgatcaactttgttatctttcgtttactttgaatacatgcaacataatccataaaatcgataaaattttcatggtaatatactaatattggaagttagagtttactgatgtataaacaaagagtgtttaatatgtgtgtttagaaattttatttatgcatgatagccataacaatataatttatacaagatactagacgtaagagaattactaatttactaagttgaagatttgatagtaaaaactgagccgccatcatcatccccttgtcgtttgaagtctcttgcccataaacgacaaagactttttgttactcctcgtgtgattttatctttaaaacattggaaaaaaatgctgaattgtgaaatcgaatcaccggtttaagcactcattaaagacattaaaccaaggaactaattgtaccggagtcggttaaacagtttcaagtgtttgttataaaaagccgtgttcggtgattctgtattcatgagattataaacatggcgttttacctctcttcttagtcctctatctttctctgcttcttgttgcattcttgttcttgcgtagtaacacgatcattcatatattcatattcatctacgaagtttttcgattgtgtcagttgtgtgttttgttgattattgtgtgtagttttttcattttgatcttgctgcataaagaaagggcctatgatggattcaaattagctgacatcgtttgagaaacccaatgatgacgaacttcttacaataatatattctgaggcctatagttttttttgtttttccttataaaatcatattcgtatttgagaaggctttgtgttcataatcttttttgcttacaatatttccattgtacatgtttaattgcatttacttatatgaattatggattaatcaaagactggtaagtacgtttaatttttttttgtagtgggagactcaaaccggatttctctaattcgaatccggttaagtgtcgtcgtatagtggacttggacagagacagagaagacctagggtttgttttgtcgtgtgtctgggaattgtggtctctctttggcttgagcatg

SEQ ID NO: 13105 - DNA, 3000 bp, Unknown
  misc_feature (1)..( 3000): cDNA_ID_2710527_gDNA_ID_2214599_Annot_ID_135519 3000 nt of promoter + ATG
taaccgaagaagatgatgatgatgatgatgaaaggaacattctctggcctattgctctgcataccaaagcgctttactctatcctcgtcttgcctttggttgagccaaaggagatgaaggattacgtcaagctttgtaggagatctgattgtggaccagctgttggtgaagatttgagtttatcatctctcttgcttaacatttcatccattacagggtacttatagctccttaagggcaatgcttttgatttaagagtgatgttcaactccttgatggatgcacttgtcttgtcactcatgttgtagggcttttatggtggctcatgcatttggtgacatcatttctggtgatacagtggaacctgaggttgttgtaagtgtgtcaccatcagttggggggttgtttgattcactaactggaagcattggtatctcatcgagggctaaacctgtagctgcacctgttgcatcatctaacccgtctggagctgcaataactggagctacagcatcggatgctcccaaagcagggtcaagattactggatagagatttacttagaaactttattgctactgctatgccgtttggttagtattttccctctttcatatatggtatattctgttacctggtagactttgtttcctgattgatgtgctatcaaaccctgaaatcttttgatcacttctgcaggtaccccattagacctcagcttgtctaatatatctgctatgaaagcgaatggtttttcctctgctgatcctcctccccaagaacttaagcaaccagcatggaagccatacctgtacaaaggaaagcaaaggctattgttcacaattcatgagaccgttagcgctgcaatgtacgaccgcgatgagattcctgataatgtatctgttgcgggacagataaactgtcgggcagaactagaagggctgcctgatgtgtcgtttcctctagcagggctgagtacagcccatatcgaagctatatctttccatccatgtgcccaagttccagcacatgggattgacaagcagaacattgttttccagcctcccttgggtaactttgttctcatgcgataccaggcaggttgtggactcggaccaccagtgaaagggttctatcagctatcaatggtttcagaagacgagggtgcattcctcttcaaggtgcacctcatggaaggttacaaggctcctctgtcaatggaattttgcactattactatgccctttccacggagacggatagtggcatttgatgggactccgtcagctgggactgttttaaccacagaacactctgttgagtggaggattctgggcagcggacgtagtctttctgggaaaagccttgaggcaactttccctgggacaatcaagtttagtccattgcagagcagaagaaaaggggatggggatgatgaagagagtgaggatgagagcgctgagaatgtggtgaacgtggaggacttcttggtgcagaaaatgaacaaggatctcccagcagctgagttggaggaaccgttctgctggcaagcctatgactatgccaaggtatgtatgtctttggcttccttttgaaatcttttggacttggttgttgttcaaatctatcttctggtttacaggtctcgttcaagattgtcggggcatctgtatctcgaatgtcaatcgacacaaaatcagtaagctttcgcaacttgcaatgattagttaacagtgttagcccatattatcgacttattatggcctccttttgttttactaggtcaatatctacccaaccacaaagtcaccggttgagttttctgctcaggtaagacactgccaacaatatatagtgtataaatattgaagtgcacaggaaacgtttgaaccggattggataaaactctaaaggcgctctacatgatatgtgcgtaaacaggtgacttcaggggattatatattgtggaacacattggggaaagctccatcagcagccgtcgtgtgatttccccaagtcgcagcctcactggtattgtattttcccatcccaaggaagtgatttatttgtttgagtttgaaagcattaaacgtatgaatgagcagtttgatttttacagcggaagtgtatctgtacattattgttgtttcttgagagataaagaaagatgaatgttgttttagttgcaaatctgtctggaatggaacatgtgataataaaactcgtaaggtggttgtgttcatgaagttgccactgtttcataattagtctacaagcctaagaaagaaattgctctatatagagaatgctatctagatatagtatatatccagctcataaaggagattataatccaaggtttgcagcaatatgaggtctgtattttatgaaattacaaaattagaagaaaaatatcaatcaatttaaagattgttgttgccacgtcaatgacactgtctctgtagttccaatgagcttggaataaccaccgacagatctcattcatagggagcaagctgccattggaggttaattccatttttttcataataaaggttaactgtccaaactcgaaaccctgatttatttagttttcaataaatgttttcatgccttttaagagtgtgtgctaagctaacagatgagctgttattaccttgaaaactctaatctatcttaatttaataagttcttaaatatctttccaactttttttacgctttaagaaaagaaaaaaaatcctatttcttgaaacgtaatgttaatggaaggagtcaagttgtcttttgaaaattggattacctcattagaaaattccaccaatttggtcaaatagagacgatgagatttctaagaagtctctccggttcagatctggtcatctaaagcccttcttccgagatctacgactttcttcctcaagtcgttgtctgaattctctttttttccgaaaacagacaccacctgagtctgctgtctgaagcctcggcggagggagatg

SEQ ID NO: 13106 - DNA, 3000 bp, Unknown
  misc_feature (1)..( 3000): cDNA_ID_3028184_gDNA_ID_2214599_Annot_ID_135520 3000 nt of promoter + ATG
actttttcctcttcactcctctcttgccaagtgtcaccaatggtactgtcgaagcccgtagcattgttgaacccattcgtggtcttatgcgcaagaaaggatttgagtacaaagaagcagagtgtgtcaagattgatgcatcgaacaagaaaatccactgccggtccaaggaagggtcaagtcttaagggcacaacagagtttgacatggattatgacattctcatcttagctgttggtgctaagcctaacacattcaacacccctggagttgaggaacatgcctatttcctcaaagaagcagaggatgctctaaacattcgtcattcagtcatcgactgtttcgagagagcctctcttccgaatctaactgaagaagagaggaaaaagattctgcatttcgttgtggttggtggaggaccaactggagtcgagttctctgcagagcttcatgatttcctagtccaggatgtggctaagatttacccaaaggtccaagagttcacaaaaatcactcttcttgaagcaggcgaccacattctcaacatgtaagttccacccatcaagcttcattaactttggctaaatctactgcttttccaatgttggttcaattctacttcaggtttgacaagagaatcactgcttttgctgaggaaaagttccagcgagatggtattgatctgaagacaggttcaatggttgtgggagtgactgctgatgagatatccacaaaggaaagagaaactggcaagattgtctccgaaccttatggtatggttgtgtggtcaacaggaattggttcacgtcctgtcatcaaagactttatgcagcagattggtcaggttagattacacttgatcacatgaagaaatcatttgactaaccaaatcatttgctagtgtcccacctaactagattgagtatggttacagggacagagacgtgtcttggctaccgacgaatggcttagagtagagggatgtgacggtgtctatgctttaggtgacactgcaacgatcaaccaacgcagagtcatggtatcatctctcttgacattgttcctttgtgtcacatctcagttgatgaatgaatctttaaccttctgttttgtcttgatgttgttgaacaaacaggaagatatagctgcgattttcaacaaagcagacaagggaaacacaggaactttgaagaagaaagatttcaatagtgtggttaaagacatttgccagaggtaccctcaggtggagctctacttgaagaagaataagctgaagaacattgcaaacttgctcaagagtgcaaatggtgaggacacacaagtgaatatcgaaaagtttaagcaagctctctctgaggttgattcacagatgaagaaccttccagcaactgcacaggtaagcttgttatagatcaaaacaagatgaaatcaatccaccacacagattttgatgttttgattcttatacaggttgcatcacaacaagggaagtaccttgcaaagtgcttcaacaaaatggagaaatgtgagaagaagccagagggaccattgaggttcagaggagagggtcgacatcggttccagccattcaggtacagacattttggatcgtttgctccactgggaggggaacagacagcagctgaactgccaggagattgggtctccattggacacagcagccagtggctttggtactctgtctacgccagcaaactggtgagctggcgcacaaggatgctcgtcatctctgattggactcgacgctttgtctttggccgtgactctagcagcatctaagccattcttctccatcatttttttgttctccttttttctacggtttcctttaaatcttcccgctagtttgttgtcttttaaaatcagatgatgatgactatacatgtcattcctatattttctcaatcacatgaacttttgattcttgaacaaggacaagcatatttctaatttaattcataacaaagagttcccttctcatacatgactcttcctctcccctcgatcgctacatcttcgatctcaacttcttcgatcgataagccttaaaaggatttctatggtaaatttaagctcaagtcagagcgattcaccaaaacccctagaagaagcaatttgaaaagtagggttgaaggatttgaccgttggtggaatccaggccattagatttggggactcttggaccttttctcagtcgtaaaacatatggcccattaaacttttaagaagacccaaacattcggcccatcatcgtttagatactccgtcggagtcttcttcttcgtcatcgtcccaaaaccaaccagaacggctctgtgatcggaaccgccgtatacatcaattcaactacgtatgtgccttcgtcccttagcttagccagattcatcactggggatttcatcagcagccgtacaattatgccctctggttgcagtatcagagctctctggatcatcaacaatcaagacactgttgttttctccaggtttcaaatttcttctataaacccaaatctcactcattccaatttctactcttaatttgtatgcaaaatcaggaggtttccggtcgtcgagaagcaatggtgctccgcttacaagacggagaacgaaaacactggattagatcttcctagacttcccactgatcaacaaatctccgattcttttactcgaagaaagagacggtacaacactttctcttgtttagcttaattagattttctggaaatgtaaaattgaatttcgaatccgaattagggaaggctctactcgtggatatggtatacgtgttgctcaatccaccaaaggatcggattcttgggttgatgatcccatcactcgtcatattatcagcctttgcttaaccgaagaagatgatgatgatgatgatgaaaggaacattctctggcctattgctctgcataccaaagcgctttactctatcctcgtcttgcctttggttgagccaaaggagatg

SEQ ID NO: 13107 - DNA, 3000 bp, Unknown
  misc_feature (1)..( 3000): cDNA_ID_2710531_gDNA_ID_2214599_Annot_ID_135521 3000 nt of promoter + ATG
cacagaaatggtagagactgttatccgtgagtttcgaatcaacacgactcctttccttaagagttctctgtaagtctaaattctgaaaccattcggtagtgagacgaacaccaagacagtaaagactcttaggcacttcctcagcagcaatctgtccatacttggaactcttctcgctaacggaactcatttgttcttcaagagcctgaatcgaggccttaagcctcataatcatagtagcactatcatagtgaagctgctgagcttgatataacaaaacagccatgtcacgaatagtagactcagattccaagacagtcaagggacttctcctagtagcagcactcgataaaagcaactgagagttacggatctgagcacttaagtcccaagcaaactgaagattcttactttctttagcaatgacaacaaaagctttagcaagagcaatctgatcattaacttgacgagcaacggaagtaggactcaacatttcctcagtcatattcataccctctacaaatttgtcattacggtaacgtcgctgcacaaaagaaagggttcgaatttagcaattgaaatcgaacaaaagaagagatctttgagattgaatataccttaggaatagagggtctaggttcaatatgaccagctttggagagaatgagaaagaagagcaggagggcaataccagagagaacccaccataccacattcgagatcttcctccgtccagctctccggaaactatcccctcctctccttctcatagttactgtactcgcagagctgtgtaaaacccagatcttataaatgaatgatgatggtggaagtattcggatctgagaattttgtcgggagaagcaaaaatagctcaaccgaccatcttctttctcttcgctgcaaaaaacctcgaattcacccttctttgagaatcaagtaactatttttttttgtaagagagtgttaaaagacatatctaccctcttttggctttcaatttctctaagctagtttggactttggaactatataaattttggtcttcaagccaaaaaactacataacaaagccaaaaacttcatccacactaatccgagccaattttccccactttggagtagctctgggcatgtcggtattcaggtcaggttcggatcaaatttttcggattggagtttttcgggtttagaaattttggattttttttctttccatatttagaaattttggatatgttgggttatacgtacaattttgaattgggttcggtttgggttcacttctaatacaagtaattcgggtattggttaaaaacccatacataaccaaaattattttgggtttgagtattacttacccaaacattgtccaattatacccaaacatatattaaaatatccataaaaccccaaagatctaaaattataacaaatttttccttaagaaaataatataaaacaagaagtaaaccttgttttgagctcgttccataactcaaatcattaaacaagtcacaaattcaagttattagtgcatatatgtcctcatatgtatatatatgttcaaataataaaaagtactcacatgtatcgggttcggttcggataatacccgatacccacatttatttgaaaacagaatatgatcgggtaattagccgaaaccgaagtataacaagtttggatatttcaggtcgggttcagttcggttctacggattcggatattacgcccagacctaccctggaacatattaaatgtaatattttttccttttttagtgtttaacataatagctcttttattcatgcttaatcttggagctattttgtactatttttgacatttgcttcgtaatcacaatcatcaaattttattttcataagtaagaagctttttcgagacttaaaactcttaagtttttgatcgaagtgcttcaatcatctttgctaacacttcatgaagaaaaccactttttcgcgaatagaactcgaattctataacctgcaaagctttccaactgctcctcgaatatcttcttatcctctaagtcaaggctactcaatccttgttgaggagtaagttcatcaacaccaaaacgctctagtgatctaacaagagaagaattgggaaaagtatctttgtttttaccaagctcaaggttcatagacataactttcttcgatttcacaggtgattcttcaatatctccccaaacaaacttagacaattgaaaagccctgagatcatgaagtctgatatgttcatcaccattcttggctttcacaagattgttctcatactttctctttaaactcgcaagcattttcataaattgaaccttaattaaagacatcaaactaatagttttcttgttaaaaactattaatatcttcaaaagcacttacctcaatatcgtttttgtaatcgataagagtttgtaaaggcacaatctcatagtcttcatgcatatataacataaaaagtttagttatgaattttatgaattgtaacatgcatgtatagaagtgaatgaggtatttattccattcttcttattagctttatcatatacagtattccaaataaaatcagaaatgaaaatcaaaatcgaatccaacagttgttcgaattccaaatatatataataataaaaaatctccagggaacgcggaacataatgtcgcttaaagtctcgagttttgagagaaagtcaaaccctaaacaaatctgctgtttatttactttaaaaaaaaaaaaaaaagaatatacctaaatttacttgggcgttactccaatttcctaaatacctcactgtcttttctttttttcttttttctttaaattttgttttgtgtgtcgccgacctctctctcacgtaccctaaagtagctttgatagtttccatattgcatattctttcacattcgcagcctctcttccaaagctctcagctttgttttcttttggatctgaggtttgagaaatcatcaacatg

SEQ ID NO: 13108 - DNA, 3000 bp, Unknown
  misc_feature (1)..( 3000): cDNA_ID_3028162_gDNA_ID_2214599_Annot_ID_186985 3000 nt of promoter + ATG
tctgatttctcacattcctgttgtaacgtgtacgtagtgttactcgcaattcttgggaatgacttttcggtttcaatgcacaaggaagaaacgtagttgatcgattgattgatttacgcatacttttacgctttcttgtgttcgtatgattgttgggctttgtgaagtgagtgtctctgggaagggtgataacaagtttcagtatgtaattgctttatgttttcgctcattctatgtaatgctttccaattacccagggatctataccctaatttcaattggtcatagcctcaattgtttattaatctcacttacatctttttccatttccagtttagtgcttacatgtggccattgatactttttactgatcttggatatggtgtaatggtttacttacttgtgtttgaaccttcagaatcctacaagtgtcccagctgcaacgtcaaagctttctcctcttccccctgagccgtacgaccgtggtgccacaatggatattcctcttgactctggaaaggtactttccacatccacagaagcctacgtaccaagtatcttctcagaataatccctgagacaactttatgattgccaacttctaggatctgaaagctaaggagaaggaactccgggaaaaggaggctgaattgaagaggcgggagcaggtaagctgtgattggatttgaaaccaactaatgtcacataccctgatgtcatttctcaaatggttagcagtaggtttttcattttatccgaaccaacaatagttaattttcatctgattgcatatcatttgtaagtattatatgggtatttagtctgtcgcctcactctcttattatctattctggaaagtttagccacagtggtttgtagctacagcctttcaaacatatgtctttcggttttctgaaatctgttgtgttattttccaggaaatcaagcggaaagaagatgctatagcacagggtatctttgtcaatattatcttttgtagaaacctgacatttcgttccatgtgaaatgctcatgctgtcatctttattttggtagccggaattgtgatagaagagaaaaactggccaccgttttttcctctcatccatcatgacatttcaaatgagatacccatccatctgcagagaatccaatatgttgctttcacatcaatgctgggtatgtgttttctctttcaaatgatcaacgcatctgcagttgcaacagaggtggatttcttgatatattagtaaacaatcttaatctctgtttggtaggtcttgtggtgtgcctgttatggaacattgtcgcagttactactgcgtggattaagggagaaggtaagtcttggaacagttaaaatttaccaagtagactgaacctgtatgatgctaatctgctgacttatgtattttggctgtaggtccaacaatatggtttctagctattatctatttcatatcaggggttcctggagcgtatgttatgtggtatcgccctctttatcgtgccatgaggtattcatgccacttaagatttttcctttaaaatatcttatctgctactgcgtcgtgtgttcctttatttagagggaaaacaaaaagagtattccagatagcatcgtagttaagagtcaaaactttcattgagatgtgtgttgatttggttgtgtgcaggactgatagtgctctgaagtttgggtggtttttcttcacgtatctggtgagttttccatttggtttcagtgaactttttttaatggctttgacacatcaaaaggtggaagtgagtaaaagcttaaaatatgattgcagtttcacatagcgttttgtgtgtttgcggcggtggctcctccaattatcttcaagggaaaatcgctgacgtaagtaacaaattagtttctaaatcacacaaaaggaaagaggtggaatcatcatatgttgttgtgttatgcagaggaatattgccggcgatcgacgtattgagtgggaatatcttggtcggggtaagttgaaagcttaggtagcgaataacttaaacagttgtggactttgagtaaggctaacttttggtgaggtggtggcagatattttacttcattgggtttgggttcttctgtctggagtcactcgtcagcatctgggttattcaggttccctcctttgctgaatcatttattcatgtagataagttaaaaaggaagaagtggttaacaagttgttgttgttgttgtgtgtgtgtgtgggaacagcaagtgtacatgtacttcagggggagcgggaaagcagcagagatgaagcaggaggccacaagacgagcaatgatggcagctctctgaccaatgaccacatacacacaccttttaacccatctccaattttttcccatttaacatacaaacaaacagtgaacgttagatcctcttgaaggggattgattatactccgctactcacttcatttttgttttcctcccgatttcatttaactaagattccagtgaactcaacttcttacttttttttggtaaaaggtgaagtcaacttcttacttactttttcttattaatcatctttcaaagaagctccaaattgtgaaatcctaaatatgcaagtaaacagtccactcagagacgccgcttccaacgcatacgtgacaactaacgtatgggtgaccttaacaataggcatcatttcgttgttaaaataatggctacgaacgagaaagtcaatgggtgtagttaatgaagaaatgggcttctgtagcaataaatagtcaaacagttgagagtgataagaagatgttgcacaagtggtgattataattcaatgtcgaatttgaatactcaaaagtcaatgcaagtcagctgtatctgtgtgtgacacgcggccccgatccgaacggttagataacgcccaaactgctatttaagacacaccactaggcctctttgttccaacaagacctcaaataaaaacacaacaacaacattcaagaaatg

SEQ ID NO: 13109 - DNA, 3000 bp, Unknown
  misc_feature (1)..( 3000): cDNA_ID_1008109_gDNA_ID_2214599_Annot_ID_186983 3000 nt of promoter + ATG
caacaactcctaaggttttttcaggtgaacttggaatcagctgtcagtataattaagaatgcagaagcagtcactgatgctatcatttcaactgtggatgattatgctcccacggtaggtttttctggctctgcgacaaatgtgacatgatagtcgtgtatctaagcggtgtaataacctataatgttccagtagcagatggagggtattgttccacttgcttcccaactagcggaagtggttgtacaagagaagttgatgctcgagaaatgccatgaccttttgagaatgatttccgagttagaggtataaagattgtgtgtgtattaacatttaaagacctgatctgatatgtttctgttctctgatcatattttgggatgtacacagatgcaggagaggagcttgaaatgctgcttcctgattcaacacaaacagactttcgatacaaatcttcttaaacactaggactgtgtcttcccctgtcaaagctttgcgactcagttttttaaaagcaaaaattacagtattttgaggcttaataaatgttgcgactctcgtaagagtcttaggttctctgtatcagatggaacaagatggtaataaccagtacacataagcacttttgatggtaatttccacttgtttctttcttggatattgggtttagttatctctttttcaatatgctttgattgcaagaaacagagtcaagaagtgtgtagtgtcctcctctcccgagtggatttgaccatatcttctatatgaccgaaaccacacttccttgcagctctcatggacttgttaaaactcaatcatgtcacattgcaagataagtactcttcgtccgctctagaaacatttattgatgacatggactaggaatacaagaaaagagagtaatgcacaagttcaaaacagcgagagactacatgaacattaaagacatgaaacagtaatttcaaacctgatattattactcagccaaagcgtggcccagttatttgaacgactttggaaacagtaatatcatttatatactactattaagatttaagaataagcgtttaccaagaaagagaatattcagtcctctcaaatgggaaatcgaaacgtcatgaaaaaaagaggaaaataaatgaaaagagagagacgctttgttctatatataaaggaaccctaaacaagtggtaaagagcaaagcaaaaccttttagtttcaatgtctaaattctattcataaaccctaaatcgatccatgtcttagaaacgatagaaattccgctgaagatatcttcaagcgacgaagatgaaatggagactccaattagagaagaaggtgaagaagactcttcgtcggaagaagaagatgatgatatgtcttctaataacccatcagctgcaacagagaagcaaaagagagtttattgagtaaaaacgaaatttataggagataatttttccttcgtcatttcaaccataaagccaaaccacaaaaaaaaatctcttcatctccctcaaaacttgaaatatggtgaaaacaactactcaaggtacatcacgtaagatattgacaattttttatttttatcattgcatgaaaattcgttttgtcataatcttaatctctatttgatctatgtgtgtagcgaaaaccaatgacaacgttaattgactcatacactgcacaatgttgaaagtgtttcaaagtgagatatagagagtcacaagaagagtacgaaaagaatcaaagtaaaactccgaaaaaagtcttttgaatgcaagagatgtgaaaaatctagagatgtggttgtgaactttgattcccctattgtgcgttggtttcaggatggacatggtatacccaacacccctcaaggtttgaagagggttttgatcgtcagaacaagctgcgagaaagccgatgtttaatatgaaacattagctcctaaacgaaagagactaaatactgtgaagaaagtcactaagtttattgaagacaatgaacaattcaaagacatgaagattgaagaggtttcttttaccgcacccaaacagctgaaaaggaaaaagttctaaataatgatgttatagttgttgatattaaaacttgaaaaatcaacaagttaaggaaactaaagagacagaataaaccttaacttgttgatcttttcaagttttgttatcggtaactacaacatccttacttatatttttttcttttcagccgtttgggtgcgacaaaagaaacctcttcaatcttcatgtctttaaattgtttattgtcttcaataaacttagcaacttccttcacagtctttagtctctttcgtttaggagatactgtttcataataaacatcggctttctcgtagcttgttctgacgattaaaaccttttataaactttgaagggttttgggtattaccatgcccatcccgaaaccaacgcacagtatggaatcaaagttcaaacacatctccaggttcttcacatctcttgcattcaaaagactttttcggtgttttacttcgaatctctttgcattggatcttaataatgtttgagccgaccatgttctacatatgatgaacaaaactcaagcactagcgattattaaggcttttttttttatttctatcgatctttttttttttacctattgataatgttgatgttgaaatactcaaacatggaagtggaattcaaaaatacaactaaagatctgttttcttagtacatacagaattgagaaacagagagatgaaaaatgccaagagtgtgaacaaaagtccacaaaacaaaagcctctgacggagaaggaggcttttaggtgttacccaaacaaaacgcacacaatacggcgtcgtttagaatcagaaaagacatttctttatggtcacttgattctctcttccttcatcaatcaatctcgtctcctggaaaacattagggagcctctcagatcctcaagaaaaccctaaatcaaaagtcgagatcg

SEQ ID NO: 13110 - DNA, 3000 bp, Unknown
  misc_feature (1)..( 3000): cDNA_ID_3028180_gDNA_ID_2214599_Annot_ID_186979 3000 nt of promoter + ATG
gctgctgtgtccaatggagacccaatctcctggcagttcagctgctgtctgttcccctcccagtggagcaaacgatccaaaatgtctgtacctgaatggctggaaccgatgtcgaccctctcctctgaacctcaatggtccctctggcttcttctcacatttctccattttgttgaagcactttgcaaggtacttcccttgttgtgatgcaacctgtataagaatcaaaacatcaaaatctgtgtggtggattgatttcatcttgttttgatctataacaagcttacctgtgcagttgctggaaggttcttcatctgtgaatcaacctcagagagagcttgcttaaacttttcgatattcacttgtgtgtcctcaccatttgcactcttgagcaagtttgcaatgttcttcagcttattcttcttcaagtagagctccacctgagggtacctctggcaaatgtctttaaccacactattgaaatctttcttcttcaaagttcctgtgtttcccttgtctgctttgttgaaaatcgcagctatatcttcctgtttgttcaacaacatcaagacaaaacagaaggttaaagattcattcatcaactgagatgtgacacaaaggaacaatgtcaagagagatgataccatgactctgcgttggttgatcgttgcagtgtcacctaaagcatagacaccgtcacatccctctactctaagccattcgtcggtagccaagacacgtctctgtccctgtaaccatactcaatctagttaggtgggacactagcaaatgatttggttagtcaaatgatttcttcatgtgatcaagtgtaatctaacctgaccaatctgctgcataaagtctttgatgacaggacgtgaaccaattcctgttgaccacacaaccataccataaggttcggagacaatcttgccagtttctctttcctttgtggatatctcatcagcagtcactcccacaaccattgaacctgtcttcagatcaataccatctcgctggaacttttcctcagcaaaagcagtgattctcttgtcaaacctgaagtagaattgaaccaacattggaaaagcagtagatttagccaaagttaatgaagcttgatgggtggaacttacatgttgagaatgtggtcgcctgcttcaagaagagtgatttttgtgaactcttggacctttgggtaaatcttagccacatcctggactaggaaatcatgaagctctgcagagaactcgactccagttggtcctccaccaaccacaacgaaatgcagaatctttttcctctcttcttcagttagattcggaagagaggctctctcgaaacagtcgatgactgaatgacgaatgtttagagcatcctctgcttctttgaggaaataggcatgttcctcaactccaggggtgttgaatgtgttaggcttagcaccaacagctaagatgagaatgtcataatccatgtcaaactctgttgtgcccttaagacttgacccttccttggaccggcagtggattttcttgttcgatgcatcaatcttgacacactctgcttctttgtactcaaatcctttcttgcgcataagaccacgaatgggttcaacaatgctacgggcttcgacagtaccattggtgacacttggcaagagaggagtgaagaggaaaaagttacgaggagagacaacttgaacatcatagttagggttgttcaagtaactcaagaagctgtagccgctccatccactgccaagaacgaccaccttcttcttccttattgggttgccatctgagtcaagagtagcgtctgcgtgtaatatacgtttcaatggattcgagtctgaatacaccagtacaccaccaccaccactggacaacaatacataaaaagacacaaaccaaaataattgttagacccacgttacttaaaaaaaacatagatctgagtcgaaaaaggtatgaagcttatagagatggtatgcattatatcatgcatcacagctagggaagaggccaaaagaggacaagcgaaaaattcggacacgtgcataggagtggtcaaaaacatcacaagactaaaaatactaagaaaacagtcaaagcatctataaagagaattggaaacaaaagagttatatagattctacagctaaaagaagaataagaagaagaagaagaagaagaagaagtgtagaatggtgaaggagatctaaaggagaataaggagagacctgaaagtgctgagaagaagaatcttggaagtagaagggtaagccttgaataagctagaagctctctggtaaaagctatggaaactcatgttgatgatttctcaaacctcagatccaaaagaaaacaaagctgagagctttggaagagaggctgcgaatgtgaaagaatatgcaatatggaaactatcaaagctactttagggtacgtgagagagaggtcggcgacacacaaaacaaaatttaaagaaaaaagaaaaaaagaaaagacagtgaggtatttaggaaattggagtaacgcccaagtaaatttaggtatattcttttttttttttttttaaagtaaataaacagcagatttgtttagggtttgactttctctcaaaactcgagactttaagcgacattatgttccgcgttccctggagattttttattattatatatatttggaattcgaacaactgttggattcgattttgattttcatttctgattttatttggaatactgtatatgataaagctaataagaagaatggaataaatacctcattcacttctatacatgcatgttacaattcataaaattcataactaaactttttatgttatatatgcatgaagactatgagattgtgcctttacaaactcttatcgattacaaaaacgatattgaggtaagtgcttttgaagatattaatagtttttaacaagaaaactattagtttgatgtctttaattaaggttcaatttatgaaa

SEQ ID NO: 13111 - DNA, 3000 bp, Unknown; identical to SEQ ID NO: 13107
  misc_feature (1)..( 3000): cDNA_ID_2710531_gDNA_ID_2214599_Annot_ID_186978 3000 nt of promoter + ATG

SEQ ID NO: 13112 - DNA, 3000 bp, Unknown
  misc_feature (1)..( 3000): cDNA_ID_3028184_gDNA_ID_2214599_Annot_ID_186977 3000 nt of promoter + ATG
gtctctccttattctcctttagatctccttcaccattctacacttcttcttcttcttcttcttcttcttattcttcttttagctgtagaatctatataactcttttgtttccaattctctttatagatgctttgactgttttcttagtatttttagtcttgtgatgtttttgaccactcctatgcacgtgtccgaatttttcgcttgtcctcttttggcctcttccctagctgtgatgcatgatataatgcataccatctctataagcttcatacctttttcgactcagatctatgttttttttaagtaacgtgggtctaacaattattttggtttgtgtctttttatgtattgttgtccagtggtggtggtggtgtactggtgtattcagactcgaatccattgaaacgtatattacacgcagacgctactcttgactcagatggcaacccaataaggaagaagaaggtggtcgttcttggcagtggatggagcggctacagcttcttgagttacttgaacaaccctaactatgatgttcaagttgtctctcctcgtaactttttcctcttcactcctctcttgccaagtgtcaccaatggtactgtcgaagcccgtagcattgttgaacccattcgtggtcttatgcgcaagaaaggatttgagtacaaagaagcagagtgtgtcaagattgatgcatcgaacaagaaaatccactgccggtccaaggaagggtcaagtcttaagggcacaacagagtttgacatggattatgacattctcatcttagctgttggtgctaagcctaacacattcaacacccctggagttgaggaacatgcctatttcctcaaagaagcagaggatgctctaaacattcgtcattcagtcatcgactgtttcgagagagcctctcttccgaatctaactgaagaagagaggaaaaagattctgcatttcgttgtggttggtggaggaccaactggagtcgagttctctgcagagcttcatgatttcctagtccaggatgtggctaagatttacccaaaggtccaagagttcacaaaaatcactcttcttgaagcaggcgaccacattctcaacatgtaagttccacccatcaagcttcattaactttggctaaatctactgcttttccaatgttggttcaattctacttcaggtttgacaagagaatcactgcttttgctgaggaaaagttccagcgagatggtattgatctgaagacaggttcaatggttgtgggagtgactgctgatgagatatccacaaaggaaagagaaactggcaagattgtctccgaaccttatggtatggttgtgtggtcaacaggaattggttcacgtcctgtcatcaaagactttatgcagcagattggtcaggttagattacacttgatcacatgaagaaatcatttgactaaccaaatcatttgctagtgtcccacctaactagattgagtatggttacagggacagagacgtgtcttggctaccgacgaatggcttagagtagagggatgtgacggtgtctatgctttaggtgacactgcaacgatcaaccaacgcagagtcatggtatcatctctcttgacattgttcctttgtgtcacatctcagttgatgaatgaatctttaaccttctgttttgtcttgatgttgttgaacaaacaggaagatatagctgcgattttcaacaaagcagacaagggaaacacaggaactttgaagaagaaagatttcaatagtgtggttaaagacatttgccagaggtaccctcaggtggagctctacttgaagaagaataagctgaagaacattgcaaacttgctcaagagtgcaaatggtgaggacacacaagtgaatatcgaaaagtttaagcaagctctctctgaggttgattcacagatgaagaaccttccagcaactgcacaggtaagcttgttatagatcaaaacaagatgaaatcaatccaccacacagattttgatgttttgattcttatacaggttgcatcacaacaagggaagtaccttgcaaagtgcttcaacaaaatggagaaatgtgagaagaagccagagggaccattgaggttcagaggagagggtcgacatcggttccagccattcaggtacagacattttggatcgtttgctccactgggaggggaacagacagcagctgaactgccaggagattgggtctccattggacacagcagccagtggctttggtactctgtctacgccagcaaactggtgagctggcgcacaaggatgctcgtcatctctgattggactcgacgctttgtctttggccgtgactctagcagcatctaagccattcttctccatcatttttttgttctccttttttctacggtttcctttaaatcttcccgctagtttgttgtcttttaaaatcagatgatgatgactatacatgtcattcctatattttctcaatcacatgaacttttgattcttgaacaaggacaagcatatttctaatttaattcataacaaagagttcccttctcatacatgactcttcctctcccctcgatcgctacatcttcgatctcaacttcttcgatcgataagccttaaaaggatttctatggtaaatttaagctcaagtcagagcgattcaccaaaacccctagaagaagcaatttgaaaagtagggttgaaggatttgaccgttggtggaatccaggccattagatttggggactcttggaccttttctcagtcgtaaaacatatggcccattaaacttttaagaagacccaaacattcggcccatcatcgtttagatactccgtcggagtcttcttcttcgtcatcgtcccaaaaccaaccagaacggctctgtgatcggaaccgccgtatacatcaattcaactacgtatgtgccttcgtcccttagcttagccagattcatcactggggatttcatcagcagccgtacaattatg

SEQ ID NO: 13113 - DNA, 3000 bp, Unknown
  misc_feature (1)..( 3000): cDNA_ID_2710527_gDNA_ID_2214599_Annot_ID_186976 3000 nt of promoter + ATG
ccgaagaagatgatgatgatgatgatgaaaggaacattctctggcctattgctctgcataccaaagcgctttactctatcctcgtcttgcctttggttgagccaaaggagatgaaggattacgtcaagctttgtaggagatctgattgtggaccagctgttggtgaagatttgagtttatcatctctcttgcttaacatttcatccattacagggtacttatagctccttaagggcaatgcttttgatttaagagtgatgttcaactccttgatggatgcacttgtcttgtcactcatgttgtagggcttttatggtggctcatgcatttggtgacatcatttctggtgatacagtggaacctgaggttgttgtaagtgtgtcaccatcagttggggggttgtttgattcactaactggaagcattggtatctcatcgagggctaaacctgtagctgcacctgttgcatcatctaacccgtctggagctgcaataactggagctacagcatcggatgctcccaaagcagggtcaagattactggatagagatttacttagaaactttattgctactgctatgccgtttggttagtattttccctctttcatatatggtatattctgttacctggtagactttgtttcctgattgatgtgctatcaaaccctgaaatcttttgatcacttctgcaggtaccccattagacctcagcttgtctaatatatctgctatgaaagcgaatggtttttcctctgctgatcctcctccccaagaacttaagcaaccagcatggaagccatacctgtacaaaggaaagcaaaggctattgttcacaattcatgagaccgttagcgctgcaatgtacgaccgcgatgagattcctgataatgtatctgttgcgggacagataaactgtcgggcagaactagaagggctgcctgatgtgtcgtttcctctagcagggctgagtacagcccatatcgaagctatatctttccatccatgtgcccaagttccagcacatgggattgacaagcagaacattgttttccagcctcccttgggtaactttgttctcatgcgataccaggcaggttgtggactcggaccaccagtgaaagggttctatcagctatcaatggtttcagaagacgagggtgcattcctcttcaaggtgcacctcatggaaggttacaaggctcctctgtcaatggaattttgcactattactatgccctttccacggagacggatagtggcatttgatgggactccgtcagctgggactgttttaaccacagaacactctgttgagtggaggattctgggcagcggacgtagtctttctgggaaaagccttgaggcaactttccctgggacaatcaagtttagtccattgcagagcagaagaaaaggggatggggatgatgaagagagtgaggatgagagcgctgagaatgtggtgaacgtggaggacttcttggtgcagaaaatgaacaaggatctcccagcagctgagttggaggaaccgttctgctggcaagcctatgactatgccaaggtatgtatgtctttggcttccttttgaaatcttttggacttggttgttgttcaaatctatcttctggtttacaggtctcgttcaagattgtcggggcatctgtatctcgaatgtcaatcgacacaaaatcagtaagctttcgcaacttgcaatgattagttaacagtgttagcccatattatcgacttattatggcctccttttgttttactaggtcaatatctacccaaccacaaagtcaccggttgagttttctgctcaggtaagacactgccaacaatatatagtgtataaatattgaagtgcacaggaaacgtttgaaccggattggataaaactctaaaggcgctctacatgatatgtgcgtaaacaggtgacttcaggggattatatattgtggaacacattggggaaagctccatcagcagccgtcgtgtgatttccccaagtcgcagcctcactggtattgtattttcccatcccaaggaagtgatttatttgtttgagtttgaaagcattaaacgtatgaatgagcagtttgatttttacagcggaagtgtatctgtacattattgttgtttcttgagagataaagaaagatgaatgttgttttagttgcaaatctgtctggaatggaacatgtgataataaaactcgtaaggtggttgtgttcatgaagttgccactgtttcataattagtctacaagcctaagaaagaaattgctctatatagagaatgctatctagatatagtatatatccagctcataaaggagattataatccaaggtttgcagcaatatgaggtctgtattttatgaaattacaaaattagaagaaaaatatcaatcaatttaaagattgttgttgccacgtcaatgacactgtctctgtagttccaatgagcttggaataaccaccgacagatctcattcatagggagcaagctgccattggaggttaattccatttttttcataataaaggttaactgtccaaactcgaaaccctgatttatttagttttcaataaatgttttcatgccttttaagagtgtgtgctaagctaacagatgagctgttattaccttgaaaactctaatctatcttaatttaataagttcttaaatatctttccaactttttttacgctttaagaaaagaaaaaaaatcctatttcttgaaacgtaatgttaatggaaggagtcaagttgtcttttgaaaattggattacctcattagaaaattccaccaatttggtcaaatagagacgatgagatttctaagaagtctctccggttcagatctggtcatctaaagcccttcttccgagatctacgactttcttcctcaagtcgttgtctgaattctctttttttccgaaaacagacaccacctgagtctgctgtctgaagcctcggcggagggagatgatg

SEQ ID NO: 13114 - DNA, 3000 bp, Unknown
  misc_feature (1)..( 3000): cDNA_ID_3028196_gDNA_ID_2214599_Annot_ID_186971 3000 nt of promoter + ATG
agagagtttggtctaaatggggacatattcatttcaagttcatgaagctcttggtcaaaacctagccaatcatttggtttcaagatcatgttcacaaaaatccatggaatcagtgatataatgagagcaatatcgatcgtgttttcccaccattggatgatcaaaccttgcagttcaagggtcaagaaccgataaaccacattttatttcctataaacctaacaaattcataggaccctcatggagctgtagaatctaactaattttaataaggtaaaaatctatagataagcatcggagatgaatgtagatataatgtgaggcctgaattacacaaaatcaagtgaaatgtatttagttaactacttaataatcatcatgaatactggatacatgtgtgcattattaaagactagagaaatatattattgacaacttcaattaaaaaacagagaatagttattcaaatgagaatgctttagctaaaagtgtgaaagtcaaattgtattattgagaatgacaacaagcacaagatgttacgtaattcatgaaattacaaaatcacatgagagtatcaataaaaacagttcatatacgaatcttacagttcacaaatctcattacattctcaattaattccttccttcgtatatttacacaataagactttatccaatcttttcccatgtgccccgtaaagccaatacgattactcatcgaataccattggtgttccattattttatttgcttataacgaatttgtgatgatgagcagtgatgctatggttggttaacaattaaatagtagacgagttttgagattttttatatgtaattaaaggcaattccgaccaagatatgactaaccctgtcctgacagaactagaaccatttcataccaactagcctgcagaatataaatcttgataattttggtcaacaatagagtggagagagatttacatacatcacatagtctttaatatgtaagaacatcccaaatatatgtattcaacatttacaagagataaatagtgaaagaaagagatgcaataagaagccaaagtaaatgcacacatggaaagagcagactctgctttgccattttcttctacgagtttctttgttttcacctctcaccggtttgccctttcattaatctaactgtccaagctcccggtttggctccatacatgggttctccaacaacgtatggaggcggctgacgagcatcctgcaggagtgcaactgtgcttacattgtattcatcgtcactatcataatgtcggtgagggtgaggtccaagagctttgagcaacatggctattaaaactgatagaccctgccaataaacaaaggaacaatgtgaagcgttgaaaccaaacaatttagaagcaccgtaaagtagaatctttttgctattagttaagatacctggacacagacaatagagagacctatccacttgcaaatcttgaagtttgactcgatgaacttagagaactggtggaaagcaccacttggatcctctggaaagtcctgatgaaagcttctaaaagattagaatcttgggcgtgacaatagagagccactcaagatttttcaaaagaaaagagatagagaaactatacctttttccagtcacggtttagaaagatatcggcaactacaccgccttcaaccatagttagcaagactatgaatcccatatactgaacccagtcgatgagccaataaacagatgcattatacacataaaaaaagaaacacaagaaagaattcaggaaggaatgatgaaactaccaaagaaaaacaggctaacgtagtgatgctacaattcatcaatagagttgcaggaacaacttataaaaaaaacagaagtttaccaagtaaaggcaacatccattcacggtttcagcagctatgtgcccggcacaagtgacaacacagagaatggccccgagaccaagaaatgaataaatgaacctgaagctcataagaagattggttcagaaattttcatcagcaatggcatacttcatatttcataacaatgataacttccccctcacacaaaaacaagatatgccactttccagtgccatcttacaagaatcctgaagctatctcttccatagcctaactacttctagacacctcaagcttacagaatttatgatctttccacgggaaaaacatagtttcaccccaacaagatgtgtcactcatttccagtgccatcaaatttgaaagacaaatcttacaagaatcttaaaactgtctcttccaaagcctaacaacagcttctagcttccacacacctcaaatcttacagaaatctatgatcttgtctctgcctaaattgctcagtaccgttctccaaccactcggaatttaaacaaagatacaaacgcccaaaaagccagaaagtgatcaaacacacaaaaagatgaaactttcaacataccacggaacagggtgatcagaatcagcaaaaggaagatttcccatttgttcttgccattgcctaatcagccaaacagcgtagagaatcatagcaatcccaaccatcccaattagagaattcacgagctttaacatggactgtaaacaacttctcacgatcctcaccatctttaataacccaaaaaaaacctagacgaagagaccagagacaaccaacaacaaattctcttcgtctgttgggtctaggaagaagagaaatcgataaagataataacttttgtaaatcctgttgctccagatgtcttctcctttctaagcaaatcgtaaagttgtaatttttttgatacttgttttccttttttgagctaagaagatatctattgacaaaaaaaaaatcacacttgatgccaaaaaaagaaaaacaattattttggattaccacataattgaattggtccatggtagtaacttgaaaggtcaagtggcttggctatatgaagaagaggagactctctggtcagagacggcgatg

SEQ ID NO: 13115 - DNA, 3000 bp, Unknown; identical to SEQ ID NO: 13104
  misc_feature (1)..( 3000): cDNA_ID_2710515_gDNA_ID_2214599_Annot_ID_186968 3000 nt of promoter + ATG

SEQ ID NO: 13116 - DNA, 380 bp, Unknown
  misc_feature (1)..( 380): cDNA_ID_3028109_gDNA_ID_2214599_Annot_ID_186997 3000 nt of promoter + ATG
cattctccatgatttcttcacaagatgtctctgtatttggggatttgcagacaaaaaaacattttgcaggtcggttaagtgaaaaaatgaaagtagcttgagatgaatttttgacatgataccaagtacttgtctatgttggggacatctgataaattaggaaattagtgtatgtccttataaagaaataaggaattcgggatcagtttgaaacatattaaagttaggattacatgtgactaaaaagccaatagttattgataataaagcccagcccataaaacgacgactcttgagtctagacggtttttggaatctgaagtgaatcgtcggaaaaatttatcagtttcgagattcggagatctgcaagggagaagatg

SEQ ID NO: 13117 - DNA, 3000 bp, Unknown
  misc_feature (1)..( 3000): cDNA_ID_1985373_gDNA_ID_2214599_Annot_ID_186996 3000 nt of promoter + ATG
tctaaacgcttaaccaaaccagcctggcgatagatctgagcagcgatttcattgtgaaggagaccggcggcagaaaagaggggaattttctgtcctctagcaatggagttcatgacatcaatggttgaaatgccagtctgaatcatctcttcaggataggttctctcactaggattgatggaacttcctggagagaccaaagatcagaagcctctttagtgagagggaaaagaatgcgtcaagaggaggctaaagtgagtgctcaccagaaatatccaagtaagcctctggcaatataggtggaccattgtcaataggcttccctgaaccattaaagatacggccaagcatatccaatgagacaagggtttttaaaacctatattggcaaaagtgagtgagtaaaccaaatatatcacgcaacaagagaagagagtagtaacatacctcccctgtaaattgaacggtggtgtacttgttgtcaattccagatgttccctcaaagacctagacaagcaccacagtactataaagaaaaggccgtgttgcattattttgaatgaggaaaataatagttggaaacctgaacaacagccttctcgccatcaacttcaagaacttgaccacgtcgagtagttccatccccaagatgtatgttgactatttcttggtatttaggtccctgggaatcccaataaatcaataataatgcatcaagaaaacaagacatagaacaatttcttggtaaatataccttaactttctcaaggataacaagaggtccagcaacaccagagactgttctatactctgcagatgaaatatatatcaaaaagaagaggaagaagatttagcatcctcctacattgcaatgaatgaatgtattcaacaaccaaatagttgtttacccattccgatctccagggcaccttcctccatttcgacattgtttttagcagcacccatttgaagatcggagagactatctcttcttcttttttcttgagagccggctgagatctatcgtcgactatcacttctctgattcaattttattttgttttgtataaaatggacaacaatcagacttgttatgtatataataaaaacacccaaaatttgttgttagtctcttcctctttcaatttacttgtccaaaattgaaataaatattatccgacaatccatatttataaatagtgttgatcctagtatttggttctttgctagtctttgtctctggaagtttgttacttgtcgggttatgtctcccttcccttgtttgggctttagcctatgttgatatactcctatgtatgaagactcatgacattggttagctaggcagtaagatgaaggaaaatttagtcctattacaacttgcctgcagccattagaggaagaaaagatatcttgtctgctaaagagagccgagaaaactgcagaaataacaatggtaagaaatgggatcatgaagaatatttgagaaacaggggaaatatttgacttacttgagaatactactgtatagaagaagctcttgaaatacaggaaacttaaccttaaaacacataaacattttcatccttataggtttcttgcttcataagaaacagagaaaaaatatatgagtacctgtaaatcttcccaggttgtgaagggtttgagtccaagttgatcaaccaaggaaaatatgtttccattcggataccaaaacccttgttgcacagatcacatgtattagttgggtaacgtaaaactaaaaggtaattaaatgggttaccttggaacccaacatcaacaggaccatgaccatcgtcaagaactgtgacatcaaatggagttggagatgagaatatcaaagtgaaagtaaccttggttacaaagatgatgagcggcaccaaaagcagcccagctagaacccacgacaaccaccttcttcttcattttttttttggtttaaaacaaccttcttcttcttatctgaggtggctcctccatcgccttgggctatgatacatagtcttctccggcgcacgggaccttgtactattatcagattcaggctcccacaccacaacatctttactgcctcacaatctttcttcttttgtttccttgtgtttaacttgtgagtaagtgatgtgtgggtgccatggccacaaagacatcataaaccaaattttgtctgtatttttttggttacaaagatgatgagccgcaccaagagcagcccagctagaacccacgacaacaaccttcttcttcttatttgaggtggctcctccatcctccatccccttgggacctagtactattatcggattcaggctcccacaccacaacatctttactaccttacaatctttcttcttctgttttgtttccttgtgtttaacttgtgagtaagtgatgtgtgggtaatgccatagccacaaagacatcataaaccaaattttgtctgtatttttttttacctaaaatatattagcattcattctacaattatgcagttgtttctaatacagtatgcttatttttcagtattactcatagattaaaattaacatttacctcacaaacaattatagaaatagaaagacatggaaaaaaaaaaatagaaagacatggaccacaaaataaataatatgtcgaaaacaaaatatccatttgacatacttatcaaatatcaatttattatcaaagattcaaaagtaattgatgtaagtacaaaaaaattgccgaattcttttgcttccacgcttcgaattgtgtattggacccaaatttatgtgtgtgacacaagataatcgttagtataggtctatctaccgtccgccgtttcaatctgacggctatcgtacaagccgtacaatatagactcaatctaacggtggaaatagaaagatcataaatccctcaaatctcacagttacctcaagtttttttttttttttttgttggtggagacgaacaacaacaacaccaacagaagacagaa

SEQ ID NO: 13118 - DNA, 3000 bp, Unknown
  misc_feature (1)..( 3000): cDNA_ID_2713087_gDNA_ID_2214599_Annot_ID_186993 3000 nt of promoter + ATG
actttttcttctaacacgaaccttttcccttgtctttgttttctttttgttttgttttgttttggagtttgtttatctttatctgccgaaagtttaagacttcagcctcccaccttggcacctccttgcgtccacgtcatcttaatatgtaccaaggtttctaagttcttcatgtcaatagacattataacatatttggaatccatattatgcaaggagacatcggttttactaatgcgaattgaggggcttgtataaaatcggtctgcttcagaaaacattccatttttcaacccttgaaagtccattcagtttaccatccaagagtttttccttgttgtgaatgataagaaaatccataacatttatctaattttatcgtattggaaaaataatttaatatttctgaatacatttattaaaaatatagttaaaaacgatgtatttttagcgttttataattatttagcattatttagatgttttcgttattttgttattacatcattttaattattattcatgtgacttgaaattaattactttttaaggtcgaatctttttttacgcctgcctttacacttcttattagaaggttatgtatcgaaacagccatccaaaatttaaataaattctaaaagaagttatatatattatgaatgtatggtgatactgacatgggtagggtacattctttttctattgagttagttgatacgttaagttggatgagatataacttatactatcatataagctttttttaatttgtgtgtttcaagtttggtcggttttgtttatgtcttttgtaggtggggtatacagaaaaataagagaaaaaaaaacaaagtcaaagctgactttgacgacaaatcgctaaccttcgagagatgatgataacaagcctaattaaaatacacgttacgtcgcaatcaattgcttcaatctcattctcattgcatgtcatccttagccgcggttagccgaccatactatcaacgatgtgcatactatcaacaatgtatttgtaataattaagtagaaaaataaagaatgttccaccgtccaaaagaaacacaagtacggtcctgagagggcttgagatattttgcttagtgatatatgtcaacatcttagttaagccccaccggttctgatataaaagtggggaaaatatttcataaccacacaacaaatctctctgtttctcccgctcttgctctgttttctcaaagacaaaagaggacatcgtcgttgactcctcttctctatggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatttaggacctttgttagaatatagatatgcttagttgtatgactgatctagcttgtgttttttttttgggtggagacagtttttgtcatcttccacattttagattctattttcgaccatcatttttttcttgatcggtgactatgaatctaatggggtcaatcattttcacatataaaacttaagtatttggtgtttgtacttcatcagttcatcttattccatagaaagagagtgagaagtgatcaataacccttttaactgaaaaaaagaagaagatcaaaacctaaataagatttaagtacatatgtctaattcgacgtaagacatttttggaaacgatcaatgtactaacgagttgaattctgatgaatcttgagcatgaataaacggactttgtagtttgtacaattgataatgaaacagagagcaacattatgtacatgtgatatatgctgcatttatttatgggcttttattagatggaccgagctctagcaaaatccaaagtaaatgggcctaatcctaacgtggacagacaagggacacgtgtcacactaccgacatctcgtggagttggataagccactcgaaagtcgaaactcagaagatccaaccagagccatcatcatccttccaatggctattacttgagaactcttctgattaaacatagcaacaacaacaactcttcttctcctctctttctcacttcaatttagcg

SEQ ID NO: 13119 - DNA, 3000 bp, Unknown
  misc_feature (1)..( 3000): cDNA_ID_2710492_gDNA_ID_2214599_Annot_ID_186988 3000 nt of promoter + ATG
acaatattggcatgccgtattctatctatattattcactagctccaaaaatttgccttcttcttcatgattgggagacttcttatccaacttcctcacagcgaagagctatccaagaaagtaaactaacttatcagttgcggaaattgaatacacataaagaaagaatgaatgtaatgcatatatacctttccacctggaagctctgccctgtagacactcccaagcatgcctgttccaataaggttttcgtgggaaaagctatttgtgtgttgttgtagagatgcgaccgtgaaatgcttcacagctgtcaagggaccatgggatttactggttgtcctttttagagatgcttcagcaggttcagtcgcctttgcgatgacccttttgataggtggaattgatgagggatgcatcaaatccatagcattgccattcatgtctatctcatgactctcctgctttgattcacttcctacgcttctttctgccccaccatgcagcttcgaagcacctcctactctctcttttggtctagcctccttgtcttttgtttgaatttcattgaagaagagaaaacaaacatgtgactttcttgaaatctaaaagtgaagaaatcaagatatgagatttcacctttattgaatgtattggatggaggaagcatagaagcatttgagcgagaaccctcccttgccctcccgtattcactagttaggtgcggtttggatagttgttcactgtcttctctttttctgagacattttctcccacaaagtagacataccaaggccaaaaccacaaatgaaaaagccccaagaatggatatccaaataattcttttactggtaaatgagtcttctttcccttgaggagttggtcgggatgggtgatgatcagaagggggtgatctcacgtgtgcctgaccatgaccagctgatgcattgggagatggtggtccaaaaaatggccgcttaggtgatgttggacttggaggtgtttcaggtgaaggcgatggagcaatagtgacgttaaacagattaccgccttttctgcatcatagtttgtcacatcagcggactgatactttgacaagaaaaagtagcagaatttgtagatgtaaagttggaacgagcaatgaaaactgttgcagcttacatgaaatttggtatactcaacaacttttctggtataggtccattgaagaggttgttctcaacgttcctgtagagttaataagaatgagagtaagcaagtggcaagatatataacagttgacaggaaaagaagatgggatggcaaagaatttgtacaagtccttgaggggaagatcttgaagaacatcaagctctcctgaaagatgattgttctgcaaaagcctgaaaggatgagaaatcagaacaacgaactgaatgagacctactcaacacagactgatatgtatatggaatgcaaaggagaaactcacaaggatgtaagagtcgaaagattctgcatggaaggaggtaatggtccactcagattgttgctagacaaatctctacgcatatgtcgaatgttcggttacacatatatacagaaaacaatcttaacacagctgatttagaaagcagacctacatattgatcataaggccaaggtcttgaaagacatcgggtatcttgccagacaaaaggttattgttcaaggacctgtaagaccaaagaagtcttaaacgcttatcaccggtagagaatgaatgtgatgacagagagagcagagacttacatgacagacaaagattttaaggaggaaagagattctgggatggttcctgtaaagttgttacctgaaagaaacctgtgaaaatgtaaagattgtaatacaagatgttgaataagaaaaaagaggggatttgcgagttggaaaatgggaaacatacaagttctgcaatgaaacaggcaacgtggatgggatacttcctccaatgtgattgttgctaaaatccctgagacaaaacatcaaaaggtaaaaataaggagagaagcagattaaagaagcaaaagtcataaacgcaagagaggataaagtacattgctttaagagaggtaaacatgtttaagccaacaccaagctctcctccaagattggcactgatgagaattctgaaaaagggtgagagtgttgttagaagaatgataaagaaaagtaagaagaagaagatgggaggtgtcgttttttacattgtttctacttgggaagcattacatagaacaccttgccagctctcaccacatgggtcacctccagatgcaacccaaccggggagaagaggagactccagtgcaaggaagagactgttaatagccgcaactaaagcaaacaatcagggtacgattagctatactaacattaccattacacaaaagggaaaaacagagagaattaggggcttaccatcgtcaggattggtaagagcaagtgacaaggagggaagggagataagggcaaaggagagaaaacccaggaagcagatgttgttgtctctcccagatctcatcgatctcattccgaatccagtagacactaagagagatatgtgagtgaacagagtcgttgaaaattcaaaagcaaaacttagcagccaagaatatgattcgacagacgaaggaaaaaggtgagtaagagaactttatgttatcttaagagaaaagggaatgtttttttgcaagtgagtgagagagagcgtcactgtgtgaatgcgattcttcttagttcttacaagcaaatctaaacttgtgttttcaaaatttgacgggcagacgaaacagagaagacgacaaagaagcttttaatgggcctacatttatttatgataaggaatataatgggctttagtttataaacaataggcccaaatgagaccttcttgtagaagaagagggttcatcgtcaccttaaactcattaccgtcaccggtgagattcctccaaaatcgggactttttctcaggacgtttgag

SEQ ID NO: 13120 - DNA, 3000 bp, Unknown
  misc_feature (1)..( 3000): cDNA_ID_3028155_gDNA_ID_2214599_Annot_ID_186987 3000 nt of promoter + ATG
tcttgagtcttggttagataagtaacccgctactttactagccgtttcgtttgccatctctttttctctctgtgtctctctctatttgctacaaaaagagagaatcttgtttcatgtttttcagtttgtctttagatgaattcattttcacataccattatattaaaataaaggaaatgttccgcagtaacatgtaaagactcctccaattagcagtagatactagatactatactagtaatgacaattaaataaatgcagaaaaaaaagaagtaaaacactatcaaaagttgaagttttgatgaatataccaaatcagattgaatgtaaccaaatcgctcatgttcctcagacaaaactgtgtaccaatcatgaccatatcccacgctaaccaatttcttataagtcatcttagtagtagcagtaaaaatatagccatggaaaggtatcactgatgatgcaaggagacattgaaagaacaaaatataccgcctggtttagcattgcgtagcccactgatacgaatggtgcaaaagtttcacaccgacgatggatcagtagaccaaatcaacgcactcaatatcttgaggataatgaaaccacataaaggaaacgaaaagaaaagaaaatcaacaaaaccgaaaagccatggttctgggtcttcataaagtctgtgatgtctttgagttgttttgttaatggacaaagaggcaatggaggttgatagtgtcagtgttgatgccccggagggaatgtcccaacgttaactgtggattgataatcccagagtttaagagcagcaatttttagaaattaaaggcacaagaatagctcaatattaaaagatatgcaaaaacaattctaccgctattcattctacaatctactattaacacaagggttcatgagttggtgattagtcctcaccactactgtttcaagttcaacagtgtagccagacaaaaatcgacaatgctcctaaaagaacagagtgactggtatatatcagagaaagatgaaacattccacaagtacaatgatagtatgagaaagagagagagactagacacacatggaagattggacaataatagtattacattattcagaatgtggcggataagtgttgtgaatggcttacccgcagaagaaacaaagcaataaagtgaaagaattcacatattatagtgtgtaatctacggggatgtagaaggagaagccactcgatcggcttctatcatcgactttatgtagtactctcccgctttgtacgacgacctcaccattggtcctgatgctacgtatctgaatccctgtttacaagattccatattagcctactttcccattgcaattctcagctaataaaacttgaaaacaaggaagagaccattaccatttccatgccaagaaggcgatacctctcgaaggcatctggtgtcacgtactcagctactggcatgtggcgtttagatggtcgcatatattggccaaatgtcataacgtcaacccctgctgctctcaccttctccattgtcttaaccacttgatcaggggtctctccacatcccagcattacagaagtctttgttaaggtgcctgcaggtgcatactccttagccatcctaagcacatccaatgactgcttaaagttagcacgatggtcccgcacaaaactctgaagctcttcaactgtctcaatgttgtgagctaagacatcaagccctgacttggaaaccttctcaacacatccaccatctccgcggaaatcaggaactacatcatcaaacaacaaaacaaattaaaaaccaaaactcatgatgatcaatcccaccagatcattatattacctagtgcttcaatcaacatctccggcttcaagaatttcaatctctgaacagtttcagcaaaatgaccactcccttgatcaggtaaatcatctcgatctacactggtgatcacaacataatcaaccccccaggaagcaattgcttcagccacattgttaggttcatttggatcaggcggtggaggtgtacgcgatgtcttcacattacaaaacctaaaatagaagccctttcagagaaaagagagaatcaagctgggcaaattcggtagatgatgatacctgcagccgcgtgtacatgtatccccaaggatcataatcgtagcggtggcggttccagtttcaccaccagaccagcactcaccgagattgggacatttcgcttcctcgcagacggtgtgaagcttaaggtctctcaatttcttcttgatctggacatatctctcgccgccgggaattgattccttcatccatttaggtttcgggagaggtttctttttggttccaacttccaccgaataggtatcgccgtggatgaaatcggttagggaaggcgactcattcgccagccgagctcgaagagcctcgagactcttgggagattgcgttacggtgaccggagttacagccgaggaagaggagaagcatctcgacgccggacggaggaatctatagagcaaggcggagcgcgaatgcatctcaaacgtcctgagaaaaagtcccgattttggaggaatctcaccggtgacggtaatgagtttaaggtgacgatgaaccctcttcttctacaagaaggtctcatttgggcctattgtttataaactaaagcccattatattccttatcataaataaatgtaggcccattaaaagcttctttgtcgtcttctctgtttcgtctgcccgtcaaattttgaaaacacaagtttagatttgcttgtaagaactaagaagaatcgcattcacacagtgacgctctctctcactcacttgcaaaaaaacattcccttttctcttaagataacataaagttctcttactcacctttttccttcgtctgtcgaatcatattcttggctgctaagttttgcttttgaattttcaacgactctgttcactcacatatctctcttagtgtctactggattcggaatg

SEQ ID NO: 13121 - DNA, 3000 bp, Unknown
  misc_feature (1)..( 3000): cDNA_ID_2710535_gDNA_ID_2214599_Annot_ID_135522 3000 nt of promoter + ATG
tctgcgtgtaatatacgtttcaatggattcgagtctgaatacaccagtacaccaccaccaccactggacaacaatacataaaaagacacaaaccaaaataattgttagacccacgttacttaaaaaaaacatagatctgagtcgaaaaaggtatgaagcttatagagatggtatgcattatatcatgcatcacagctagggaagaggccaaaagaggacaagcgaaaaattcggacacgtgcataggagtggtcaaaaacatcacaagactaaaaatactaagaaaacagtcaaagcatctataaagagaattggaaacaaaagagttatatagattctacagctaaaagaagaataagaagaagaagaagaagaagaagaagtgtagaatggtgaaggagatctaaaggagaataaggagagacctgaaagtgctgagaagaagaatcttggaagtagaagggtaagccttgaataagctagaagctctctggtaaaagctatggaaactcatgttgatgatttctcaaacctcagatccaaaagaaaacaaagctgagagctttggaagagaggctgcgaatgtgaaagaatatgcaatatggaaactatcaaagctactttagggtacgtgagagagaggtcggcgacacacaaaacaaaatttaaagaaaaaagaaaaaaagaaaagacagtgaggtatttaggaaattggagtaacgcccaagtaaatttaggtatattcttttttttttttttttaaagtaaataaacagcagatttgtttagggtttgactttctctcaaaactcgagactttaagcgacattatgttccgcgttccctggagattttttattattatatatatttggaattcgaacaactgttggattcgattttgattttcatttctgattttatttggaatactgtatatgataaagctaataagaagaatggaataaatacctcattcacttctatacatgcatgttacaattcataaaattcataactaaactttttatgttatatatgcatgaagactatgagattgtgcctttacaaactcttatcgattacaaaaacgatattgaggtaagtgcttttgaagatattaatagtttttaacaagaaaactattagtttgatgtctttaattaaggttcaatttatgaaaatgcttgcgagtttaaagagaaagtatgagaacaatcttgtgaaagccaagaatggtgatgaacatatcagacttcatgatctcagggcttttcaattgtctaagtttgtttggggagatattgaagaatcacctgtgaaatcgaagaaagttatgtctatgaaccttgagcttggtaaaaacaaagatacttttcccaattcttctcttgttagatcactagagcgttttggtgttgatgaacttactcctcaacaaggattgagtagccttgacttagaggataagaagatattcgaggagcagttggaaagctttgcaggttatagaattcgagttctattcgcgaaaaagtggttttcttcatgaagtgttagcaaagatgattgaagcacttcgatcaaaaacttaagagttttaagtctcgaaaaagcttcttacttatgaaaataaaatttgatgattgtgattacgaagcaaatgtcaaaaatagtacaaaatagctccaagattaagcatgaataaaagagctattatgttaaacactaaaaaaggaaaaaatattacatttaatatgttccagggtaggtctgggcgtaatatccgaatccgtagaaccgaactgaacccgacctgaaatatccaaacttgttatacttcggtttcggctaattacccgatcatattctgttttcaaataaatgtgggtatcgggtattatccgaaccgaacccgatacatgtgagtactttttattatttgaacatatatatacatatgaggacatatatgcactaataacttgaatttgtgacttgtttaatgatttgagttatggaacgagctcaaaacaaggtttacttcttgttttatattattttcttaaggaaaaatttgttataattttagatctttggggttttatggatattttaatatatgtttgggtataattggacaatgtttgggtaagtaatactcaaacccaaaataattttggttatgtatgggtttttaaccaatacccgaattacttgtattagaagtgaacccaaaccgaacccaattcaaaattgtacgtataacccaacatatccaaaatttctaaatatggaaagaaaaaaaatccaaaatttctaaacccgaaaaactccaatccgaaaaatttgatccgaacctgacctgaataccgacatgcccagagctactccaaagtggggaaaattggctcggattagtgtggatgaagtttttggctttgttatgtagttttttggcttgaagaccaaaatttatatagttccaaagtccaaactagcttagagaaattgaaagccaaaagagggtagatatgtcttttaacactctcttacaaaaaaaaatagttacttgattctcaaagaagggtgaattcgaggttttttgcagcgaagagaaagaagatggtcggttgagctatttttgcttctcccgacaaaattctcagatccgaatacttccaccatcatcattcatttataagatctgggttttacacagctctgcgagtacagtaactatgagaaggagaggaggggatagtttccggagagctggacggaggaagatctcgaatgtggtatggtgggttctctctggtattgccctcctgctcttctttctcattctctccaaagctggtcatattgaacctagaccctctattcctaaggtatattcaatctcaaagatctcttcttttgttcgatttcaattgctaaattcgaaccctttcttttgtgcagcgacgttaccgtaatgacaaatttgtagagggt

SEQ ID NO: 13122 - DNA, 3000 bp, Unknown; identical to SEQ ID NO: 13109
  misc_feature (1)..( 3000): cDNA_ID_2710489_gDNA_ID_2214599_Annot_ID_135523 3000 nt of promoter + ATG

SEQ ID NO: 13123 - DNA, 3000 bp, Unknown
  misc_feature (1)..( 3000): cDNA_ID_2992094_gDNA_ID_2214599_Annot_ID_135524 3000 nt of promoter + ATG
tgcatatcatttgtaagtattatatgggtatttagtctgtcgcctcactctcttattatctattctggaaagtttagccacagtggtttgtagctacagcctttcaaacatatgtctttcggttttctgaaatctgttgtgttattttccaggaaatcaagcggaaagaagatgctatagcacagggtatctttgtcaatattatcttttgtagaaacctgacatttcgttccatgtgaaatgctcatgctgtcatctttattttggtagccggaattgtgatagaagagaaaaactggccaccgttttttcctctcatccatcatgacatttcaaatgagatacccatccatctgcagagaatccaatatgttgctttcacatcaatgctgggtatgtgttttctctttcaaatgatcaacgcatctgcagttgcaacagaggtggatttcttgatatattagtaaacaatcttaatctctgtttggtaggtcttgtggtgtgcctgttatggaacattgtcgcagttactactgcgtggattaagggagaaggtaagtcttggaacagttaaaatttaccaagtagactgaacctgtatgatgctaatctgctgacttatgtattttggctgtaggtccaacaatatggtttctagctattatctatttcatatcaggggttcctggagcgtatgttatgtggtatcgccctctttatcgtgccatgaggtattcatgccacttaagatttttcctttaaaatatcttatctgctactgcgtcgtgtgttcctttatttagagggaaaacaaaaagagtattccagatagcatcgtagttaagagtcaaaactttcattgagatgtgtgttgatttggttgtgtgcaggactgatagtgctctgaagtttgggtggtttttcttcacgtatctggtgagttttccatttggtttcagtgaactttttttaatggctttgacacatcaaaaggtggaagtgagtaaaagcttaaaatatgattgcagtttcacatagcgttttgtgtgtttgcggcggtggctcctccaattatcttcaagggaaaatcgctgacgtaagtaacaaattagtttctaaatcacacaaaaggaaagaggtggaatcatcatatgttgttgtgttatgcagaggaatattgccggcgatcgacgtattgagtgggaatatcttggtcggggtaagttgaaagcttaggtagcgaataacttaaacagttgtggactttgagtaaggctaacttttggtgaggtggtggcagatattttacttcattgggtttgggttcttctgtctggagtcactcgtcagcatctgggttattcaggttccctcctttgctgaatcatttattcatgtagataagttaaaaaggaagaagtggttaacaagttgttgttgttgttgtgtgtgtgtgtgggaacagcaagtgtacatgtacttcagggggagcgggaaagcagcagagatgaagcaggaggccacaagacgagcaatgatggcagctctctgaccaatgaccacatacacacaccttttaacccatctccaattttttcccatttaacatacaaacaaacagtgaacgttagatcctcttgaaggggattgattatactccgctactcacttcatttttgttttcctcccgatttcatttaactaagattccagtgaactcaacttcttacttttttttggtaaaaggtgaagtcaacttcttacttactttttcttattaatcatctttcaaagaagctccaaattgtgaaatcctaaatatgcaagtaaacagtccactcagagacgccgcttccaacgcatacgtgacaactaacgtatgggtgaccttaacaataggcatcatttcgttgttaaaataatggctacgaacgagaaagtcaatgggtgtagttaatgaagaaatgggcttctgtagcaataaatagtcaaacagttgagagtgataagaagatgttgcacaagtggtgattataattcaatgtcgaatttgaatactcaaaagtcaatgcaagtcagctgtatctgtgtgtgacacgcggccccgatccgaacggttagataacgcccaaactgctatttaagacacaccactaggcctctttgttccaacaagacctcaaataaaaacacaacaacaacattcaagaaatggccatcttctgtttccttgtagaccagagaaagaaagtccgggggaggaagccagcggccgggttgtgctcaagatgcggaggaggagcagttgttgccgacatgagaacctccacaagattctgtggggtccctttttaccgcaaagcttggaaagctatcgtctgtcatatctgcggtgctgtcctcaaatcataccactgagtctgatgaaccaacaacgttttttgttttaattcattcgttttttttttccaacaagctacttgccattgtatgtcgcttgattgcctactttagactcttaagtcttagctaatgtttttgtttttcatttatctctctgtttctgactaatgcaagtgatccttttacttacaagtctcttcaaaacatgtttggtaagaacaccacttaataggaaaaagcagaaaggcacatgaacgtgatcccccaacttgctatacagctttcaccattcaatgctcttctctctctcccgttctttagatccctcaggacagttatattgggcccaagtttatgatccaagaaggcccaagttttgtattcattgtccattatcaaatagtataccctaaaattattttacaactttcatcacctccattaattctgctgctgcaaattctatcgaactggtgagttttgttaatctctttcctcgttcgtccttgtctgtatatcagatcgatctctattaccgttttagcttgttcttgatctttgtcaacataaaaacaatcaaacaaagtttcttctatg

SEQ ID NO: 13124 - DNA, 3000 bp, Unknown; identical to SEQ ID NO: 13120
  misc_feature (1)..( 3000): cDNA_ID_2710539_gDNA_ID_2214599_Annot_ID_135526 3000 nt of promoter + ATG

SEQ ID NO: 13125 - DNA, 3000 bp, Unknown; identical to SEQ ID NO: 13119
  misc_feature (1)..( 3000): cDNA_ID_2710492_gDNA_ID_2214599_Annot_ID_135527 3000 nt of promoter + ATG

SEQ ID NO: 13126 - DNA, 3000 bp, Unknown; identical to SEQ ID NO: 13118
  misc_feature (1)..( 3000): cDNA_ID_2713087_gDNA_ID_2214599_Annot_ID_135530 3000 nt of promoter + ATG

SEQ ID NO: 13127 - DNA, 3000 bp, Unknown; identical to SEQ ID NO: 13117
  misc_feature (1)..( 3000): cDNA_ID_1985373_gDNA_ID_2214599_Annot_ID_135532 3000 nt of promoter + ATG

SEQ ID NO: 13128 - DNA, 3000 bp, Unknown
  misc_feature (1)..( 3000): cDNA_ID_2710604_gDNA_ID_2214600_Annot_ID_135536 3000 nt of promoter + ATG
gggagagtctcacgttcaaatccaaaacctcaagttaaagaacatatatggaacatcgaagaacaaagtagcaatgaatctgcaatgtagcaaaatctttccatgcaaaaatgtggagctaattgacattaatataaaacagaatggagtcaaagatggttcttccacttcggtgtgcgagaatgttgatggttttgctcgcggtaaaatgtttcctcaacattgtctaaattaattcgacggtccatcaaaacaatgacgatattttgtatatgttatttttatttactaaataattgcttaagtgtatatatggcttatgttttttttttatagccaaaaattccaaaccatatcgtaaatatgtatatatatgctttttgataagtttacatcaatattctacaataaattgcattttctgaatttattagtgtataaacatggattaacaattggatataaagagctaagaaatccaatcccattggtgtacactccgctttgtgttgcattttttggaaaaccgttttttgtgaaaaaaaattatatttatacaaaaaagtagaaataagtataatgcattttttttctttttcttaaatagtctttgtttaaatataatttggcttcatctgttccatataacttgaaccgagttcttgaagtaaaagaactgatttgtgattcttctggtgatcagaacaacaactgaacaaactgtcttattgttttcaaagaaaaaaaatatactaaaaaaggcagtgagttcaatgtaatataatgtggtagcacacactaataaccagaaaaaagattcttgaatgtggtagtgatcgttcagagaagagagaaaagtatattagtttttttttacttgtcaccaattcacaatgattaaagctccagactaaccgattctgtgattttatcattcctttattcaatcatgacaatcattagatcattacacatcttatacactttcttatattcatcacattaaaacacctctactggattcaaaggtacttacatcttctttgtagattatggagagaaagacgattgtcctcgtcaatttctctgtatactgtagggataaacatgcaaacataaaaagtcatggctctaccaaaatcgtaagctttagcttattttctttcaaacataaacagttgctaaatcagctaaacttagatgtcacttgcacatgatgtcagtgaaaagatggaggtgaatccatgcatagatgcaccggcttcctctgatacaacgatagctttcaggaattgccatcacatcttcattcttttaatcaatgttctaacactctgctcgagtttctcggcaagccataataaaaatagctgcagtctcagacctctcatctagccatatatatatatatatatatataatttattaattataatactaatgagaccatatatatataaaaaattatgactttattattttgtcaatatttttttttaaaaatgttatagtgggtcgtcccaagtgggcttaagcctaattcatatacaaatccaccgttacaaaatagaacgaaattaggtcaaattttatgatgtactgattcattttttttttttggtcgtttataagtgttcatttttagttataggctccgattggtaaccacttttgaggtaaatgaatgagtaggaaagtcgtgttcctctttgttcttcagtttttttaccaattgcaaggtatttttgttccattttcagatatgtgggtcctacatttttcctcatcattcctaaaaaaaaaatgataaaacaaaattctttcaccccaaaattgtaaaagaaccaagaggaacaaaaaaataaaattcgtttttatttattaaataaatttaaaatagattttatgataatatttatatttctatatataatattttccatatctttagtatatattgatatataaatttttttttatcaagctttcaatttaatgaatgttataaatttattttaaattagtataaataaatgttttaaagtgaaacttattttaaatttgtaatataatttaattttttattataaaataaataaatgttttgaagagaaatttataatataatttattttaaatttatgcagaactttaattttaaatgaaattaataaacaaaattcaaataaatgattttttactaattattatgttaaatactattaattcacctttttgattactattacaataatcattttgttcaattcctatgttactcttggttcctacttattgttattttcctttttttcttattttcttttattctctttcattcatattcctattgttctttttgttatcaccaatcagagccagttcaaattaattttgtcaaaaccttagaattcacaaaaaaaaattaccaatcagagagaaccgttttgatactttgatttatcaaaatagtagtaagtgggattaattactctattttatttattgtagaaatgctaaagacatatctattaagaaagaaaaaaatcaaggcttagtcgtcatcactaaagtaagaagtcaaagtttggttctacgagacacatcacatatatattcgattcccaatttatagccaaccaaagaagactcggtcctaaacgaaccagaataaggcaacacaaaaagtactaaaacatgacgtgagcaaagacgttagattcgcctccattaattcatctgatcttcttccactgtcttcttcaacgtgcacacgtgtctgtgtatatatatcttgaatgtctgaatctggaagaacaattcaagaccgcgtacaaaactaaatccaatccagacaagaaaccgtcgttgttttgtctgatcacataacacatttcagtttatagatctgcagaatttgttttttgtatttttgttctgttttcttttgattttcttcttcatcctgtaaaacctagaattttgtttcttcaaccaaaa

SEQ ID NO: 13129 - DNA, 3000 bp, Unknown; identical to SEQ ID NO: 13128
  misc_feature (1)..( 3000): cDNA_ID_2710604_gDNA_ID_2214600_Annot_ID_187021 3000 nt of promoter + ATG

SEQ ID NO: 13130 - DNA, 3000 bp, Unknown
  misc_feature (1)..( 3000): cDNA_ID_2710600_gDNA_ID_2214600_Annot_ID_135537 3000 nt of promoter + ATG
cagagaagtctctgagagaattcatattttgttcttccccttcatggctcaaggccacatgattccaattttggacatggccaagcttttctcgaggagaggagccaagtcaacccttctcacaaccccaatcaacgctaagatcttcgagaaacctattgaagcattcaaaaatcaaaaccctgatctcgaaatcggaatcaagatcttcaatttcccttgtgtagagcttggattgcctgaaggatgcgagaacgctgactttatcaactcataccaaaaatctgactcaggtgacttgttcttgaagtttcttttctctaccaagtatatgaaacaacagttggagagtttcattgaaacaaccaaaccaagtgctcttgttgccgatatgttcttcccttgggcgacagaatctgctgagaagctcggtgtaccaagacttgtgttccacggtacatctttcttttctttgtgttgttcgtataacatgaggattcataagccacacaagaaagtcgctacgagttctactccttttgtaatccctggtctcccaggagacatagttattacagaagaccaagccaatgttgccaaagaagaaacgccaatgggaaagtttatgaaagaggttagggaatcagagaccaatagctttggtgtattggttaatagcttctacgagctggaatcagcttatgctgatttttatcgtagttttgtggcgaaaagagcttggcatatcggtccgctttcgctatctaacagagagttaggagagaaagccagaagagggaaaaaggctaacattgatgagcaagaatgcctaaaatggctggactctaagacacctggttcagtagtttacttgtcctttgggagcggaactaatttcaccaacgaccagctgttagagatcgcttttggtcttgaaggttctggacaaagtttcatctgggtggttaggaaaaatgaaaaccaaggtaaattgtttctccccagccattattaaccaacatagtaatgttaatatttgtgtatatattcgtattgccaaatatgctctgataccatggcaagtaatagattggctcatgtattttatttgtgatcatgtagaattttcttaacagttatgacttggtgttggtatggttgggacaggtgacaatgaagagtggttgcctgaagggtttaaagagaggacaacagggaaagggctaataatacctggatgggcgccgcaagtgctgatacttgaccataaagcaattggaggatttgtgactcattgcggatggaactcggctatagagggcattgccgcggggctgcctatggtaacatggccaatgggggcagaacagttctacaatgagaagctattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctatgggctaagaagctgggcgagatggctaaagccgctgtggaagaaggagggtcctcttataatgatgtgaacaagtttatggaagagctgaatggtagaaagtagaggaagagaatatgtttaatgttctgagatagattattgactttgtgttcctctttggagttgttctttatgtcatcttagcttttgctactgtttagtaagagaaagtccattgtgtgtttctatataataaagaatagacctgaagataggcattttcaagtttctgctttaagataccaaatcttcgttgtgcatactttttacttcttgtgatcttactatgtgatttatatggcatggattatataggtcggattttctttgaattttaagtatataaatttgaagtaacaaagtatgtgtagtaatgatgcgatgaaaaattggtaatgaatctagggcctaaactagtatagtttcaggtttattccaccaaactcttagcgtatgtcacttggatccaccaaacttgatccaagcgttttacaaaattgtataccgagctaaaaataaaacattctttgttgtttccacaaaccttattttctaacatagcctacatgtctttctccttaagcactcattcttttggcctctcgactctttgaaaatctctcacattaagacttaatgttacccaaacctaattaaactactcgagaaccccatgttcgtgtccatgagaattctcactcaagtcttccctttagccacttacaaaactacttgtagaactatggctatgaatgatgacataactcgcacccaaaaccgcatcgtaacagtgttgtaatagtatcaaaatctttacatatacatatatatctatgtatttttgttactatttaaaccgcaccgcacttctcccacaccacaaaacgcagtcactattcggacaatatgttttaaaaacgctattttgccattccccataggctcatggctttaaatgcaaagccttcgaaatttatggctcatagcttgcacaatactcatcgctaagtgagaagtcaaagtttgcttctacgagaaacagaacacatgtgctgactcgattcccggtttgtagccaaccaaagatgacgaaccagaatacggcaacacaaaagtaaaatatgacgtatgcaaacacgtaagtgatcttcgttaattaattttttatctgatcttcctccactgtcttcttttaagtgcacacgtgcgtgtatatatctcgatatggccgaaactggaagaaacaattcagacaaagtcccaagctaagaaaagagactctctttgttttgtctggcagaatattttccattcttgttctgttttcttttcatttttcttcttaatcctaaaaccaaacatgaacagagagcaaattcatattttgttcttccccttcatggctcatggccacatgattccactcttagac

SEQ ID NO: 13131 - DNA, 3000 bp, Unknown
  misc_feature (1)..( 3000): cDNA_ID_2710584_gDNA_ID_2214600_Annot_ID_135541 3000 nt of promoter + ATG
aggctgagagtcttctatcctctcaggagacgagttgaggttgattctgccactttgactcgaagaaccttcttgatcaaagctaaagaccacacctttttcctttgacagatcatggtgaacaattggaagagattccaatcgcagaactgttttttgagtaaaagggtccttttctgcttcactaactgattgaataactctatccactcttacagatcgttcttcagcatttgcgacccgaaggtattgacgcataccttctaacacttccggagcaattctcggccttcccgtgtttggatccactcccacctggctttctttcaacacaccaaataaagggtctgattccttcagaatcggaggagtagtagcttttggaatgataatgcctttccttctggctgtagctaggtcctgtctagcttttactaggatagggcaaacatctttttcgtgcgtaagccgttgacactcataacacctcttctgaatcctctcataatgaaagttaacagtcgctgaccctccatttctgaaattcacaacttttgatctccttaagggtcttgagacatcaaacagcaccttcactctaacgaactcccgaatttgtttcaattctgggttaaagacgacttctttaacttcaccaatgagatcacccagcttagtgatcgccttggccgtgttgtaattgactgggatattccaaatttgaacccacagtagcatgtaacgaagatagtcatccggaggattttcataccacctatctaccacgattgaccaatcattgaaggtatgaactcctttcgctagcacttcctctaaatcatgttcagagtcgaaaatgaactggaatctctcattattgagagctattcctttgacctttccttctttctgccacttccttggcatatttcttaagagattcttcatcggttgacaagccgggttcaggacccttccaatgagactgaatttgtttctctcactagacagatactcaggaagatctggcatttcaaacggttcttccttttcttccaacgacatctccatcaatgccctatccatggcggatgacatcttcaagctaagaggaaaacagacaccgtagaactaagactatcgagctgaactaactccaccaacttcttcagaaaaaacagagatatggaacccagatctgagaaaacgaaagcagtagagcatggctgagaggatatgataatgaacacgaagggttagaatagttaatttcggctgaaaagaaagatggtttccggtcaaaagctttattttaaacctagtgaaagacactaaaagagaaagagggttctaagcccaaaagatagatttctaaaaaataatcacttgttaggattggatacttcgacgtcaactgctaacgacatgatatacagttattgaaaattggtaattatgaagttaaagaagtctaaacatctcaattgaaaaatctcaaattattcttacggtgacagttgtctttagtatgaagttattaccatagctagagcctaaaggacagcaccaagaccaccactaagacaagtgacgtcctgcaaaatctaacacttaaataaaattgtcagagaagattatttagcaccaaacttttattctattaatttccaaaagaaaaaaaaaaagtcatatctttccaaattttcattacataactaacattttgtcacatgaaatctgtacgtctctgaatcttctcttcttctccctcatccattgcttatgtgcttcttcttctgattaccaaattttcattcctcttcttctttctgataaaaaagtttgcattttttttctttgttgtgataatcgaaaaagagactaaaacctaagaatcgtgcagaggagaggataccacaccacacccagaaattgaaactaccaaaaagtttatgaatttgatttcaatttcaactttttatgagacccatttgattctttagggattttgaaggtaccatttgtctcaatcttataaaaaatttcacctttttttttttttttttgttaccactatgtgtctttaatctgtgttcattgttcagatcgttgtgaaatttggttcgtgattcgttgcattgcaatagctagacggatcgggattgacccactttaggtttctcatctcaaagattgcgaaattttctaatttggcatcggattgtttggatttgattgcttatgtaagtaacttgatttggttggtaacttggtattgcaatcagaaaatgtgctattcagtgttcctttgtgattaggtaattaagtatattagaaccgcatggtctttgttctcaatgctagtttagttgttttggtttcatgaagtagaagaagttttgacaatatttactctctgttgtgttaaaaattagcatagctttatgtaacatgtaccttgttttctctgtactttcatcttttgaatggattctatgttaaagaatccattgatgaagtttacaagtggtagtttgttacttgcttatatgttagttattacactagtttgacaaggttttggtacttacttgctcaattgctacactcacactgtgaaattcatgatttatacttatttcagttatgcaagaaacttttgattacataggaatgatgtttttgatatatgatagataatttgacatttattagtgaaagtttctgatcttgcctttttgtggtatcaattggaaacataatgcagaagctatagttggagcatgagtgtagcctgaagctagattgctggctggtatgtggtgatcgtaatggtaaatagggtgcgcttatttcagttttttaattttccctcattcatggatttcttatgcatatttattttcttgtttgtttctgtttgtgtgactctaggtctcctcaaagttcttttaacttttgttctatttactggagagtccttgtgttctagtttaaggt

SEQ ID NO: 13132 - DNA, 3000 bp, Unknown
  misc_feature (1)..( 3000): cDNA_ID_2710580_gDNA_ID_2214600_Annot_ID_135542 3000 nt of promoter + ATG
gaaattgataaatccattacattgttgtaatgattttctgtagtttgattgctttcgtttcctctttgtaattgtgaacaagttgttgttaatatcatgaatcattcagacgaaaaaaaaaaaaaaaagagttagagaactacatctgtgttatctcgtttactccattttctcaatcacagccgacaaaatactttggtttagcttgattaaaattctctttgaactagcgttagttgttaagtttacgtgggaatgtgggcatagatacttttcagtactactactatactggacacttgcatctgttttgtgtcatttaaaacaaaaaccatgatttgctaactaaatatttgacaatatttgctaactaaataattacagtttcgccacatgacatattattgtgaaaaacgcaaaaatacaatatttgaatccacatagagagacggattatattataccaaaatgttatctttctttcttgactcttttctctttcaggcacagtctccgagataactgaaagaggcaaatgggttcaaaattagtagatctgaactaatttttttagctattttgggaaattttccctcttttcttgccggagtctcctttttctcttctcccctcatggttttcttctctgtttcttttagccacagactttgcttctcatctgctctctctcaagaattcttctgctgagcttttgtgaatgcaaagaaaggctctcatctcctctgaagtttctcctgcaatagcagagtttttgcttgtttctagcttttagctaagtctgtgtgtgttattacacatctctcctctgcttaccatgtcgaagagaattcgcccaagctggtacagagagtcccctccaaaacaacctccttttgcttttgaacctgaagaagaagatgatgttgtcattctccctcaagtggataattcagcgctccttgctcgtctccatctcagcctcgtggggagaatgttccaccaaggaggacgcagtactaaagcccttctctcttttctccctaaggaaaacatatgggatgtggagggtcgagtccgaggcgtttctctcggagatgctcgatttcaattcttttttgaatctgaagttgacctccaaaaagttctcaacaagagaccttgtcacttcaacaagtggtctttcgcattggagagatgggaaccccatgttggaacctccttcccaaacatcatgactttttgggttagaactgaaggcatccctgctgagttttgggatgaagaagtgttaagaaattttggtaactctcttggtttagttcggagagttgatccctctaaaggaagaattctaatctctgtgacagcagatgttcctctaagattcaacaagaatgcacaactcccctctggaacagttgtcaaagtgaaactttcttatgaaaagctctttcgctggtgctcgtattgtcgccgtatttgtcacgaactagagcagtgtcctttactcgatgcagaacaaaaagctgttctctcagctgaggaatctcaacgtaaccttcgactctctcttagagatggagatagttctcaagctcgacttcctctacaatcttttccagagtctaaccgttctagatctgagagaaatcacttacccttgctgaatggtcctccttcctcaagaccatatcactctcgtggagtcatcagaagggaagaaaacaacttagcttcaaggtctggtcgcaatcgatcccaccgacagccttaccctgcttccctcaatcagtaccctgctgagcatgcttccaagctgaatcgacctcatggtgctgtctcccacaaacgcccagcctcccctgttgtcactagaaacgccggtgttgatgacggaaggaaacgtcgttttggtgattctttctccaaggaaaaaagctctgcacctcctaacaaacaatcatcaccactcctctcggattcacaattgacgctttcagacacggtcttggctccctcaagggctaaacagataacctcttccccgacttatgtcagggaaagaccattccggttaaatctctctaagaaggcttccgctttagagaaaggtaaaggaaaggttgtggagcatcctactccgttgctaggtgaatcctctgttgttgggagctcggctaagaaatctcttaactttgaaccctctgaaccggctccgaagaaccttgatacgcccatctctgtaacaagcaagtcgctggagccacaactggaaaaacgaaagagttggtatgatatgactgtagaagaagatgaagctactgcgagaagtcttgagtccggtccggatacaatacttgcagccaaattctcgcaggtggtctctttcgcaagtccatctgtcgtctctccatctctctctgttcttccatctcctgctgctccggaggatgagtggaatgagtctctcaatccgctctcggaagctctaaatttggattggactgaagaagacgaggctgcttaccatcttgccgacgacctagatgtggatgctgacgatttgttgagtgaggagcttcaggagagtcttcaggatcaatccggtttggtgattccggggagccatgtagcacccatctctgagcttcagccggaaaaattgaagagcttgatcgtgagctcgcttcaatcggaggaggtggggccgtctattgctatccctaggaggaaggactcaaagaagaaagttgtgccccattccagaaaagcccaactaaattcgggcctttgtttgaacttggcttcaaaaaaaattcatcacatttagggtttatctcccgagaaaaggctatccaacaaatccggcccatctaggccgagatcctctaggagaaccacgacgggtaaaagaaatggagtgccgtctacttccaagactaagagtccggttttgagtgttgtttcggaagggatcccaccttccgacaacaaaacatg

SEQ ID NO: 13133 - DNA, 3000 bp, Unknown
  misc_feature (1)..( 3000): cDNA_ID_2713155_gDNA_ID_2214600_Annot_ID_135544 3000 nt of promoter + ATG
ttgattgcctatctttagttctggtttaagaatgataaatacttgtgtggtcaaatttgggaatgaaacttaaactttagttttttttggtaactttatgaaaaacctgttttcattttcttatgatcgagatcatatatgtaggtttagctgcttttctgctaatctagttttgaagctatgttaggtttggtcgaaagtgccttagaactcatagtttataagtaggcatgaattgtaactactagtgtctatatatacattaaaacatggtcttctgccttgtgtacggacacaaattcgtatgccggaacagtatacttaactgaaccgcataactgaaccgtatacagaacagtatgtcgtaacgctggtaaaggtaaaatagtcagattttggcataattgtcaaaatgtgagattcaaatctcactttgccaaaagctgagaccaaatcttgtttctagcataaacgtgaaaatttctttaagcttaacatgtgagccagtgtggttccaaatgcttttgattcccactttcatatcttttcataaattaatttgtaactttgggttaccttctgattgtatgacttgttgatacaacttggtctacttccattgtttattacaaaaccaaaaataatgtaaaatgagatgcttaggttgtcatgttgaagtatttcaacattttcagttacataggacactacttccagttctttgagattgtcttgttggttcgattattagaatatttgagttttgaaatcctccatcacgtctcattttctctatgagcagcagctgaagttacacaacgatcatgggaagactcagttctaaaaagcgaaaccccggtgttagtagaattctacacgagttggtgcggtccatgtcggatggtccacaggataatagacgaaatagcaggggactatgctggaaaactaaactgctatctccttaatgcagacaatgacttgccggtggctgaagagtacgagataaaggctgtgccggtagttctgctcttcaagaacggggagaaacgagagtcaatcatgggtacaatgcctaaagagttctatatttccgccattgaaagagtcttgaactcatgaagaaggtaacaatcgttgatgagaactctcactaccactttgattaaaaatattgttggaagattatcatcatcgctccattgcgatatggttgatgtctttgtttcttcttttattctctgtgaatataactgttgggtttgtggaaagatagctcaggaagtattgtgaatacataaatattccttcttcttattgatgattttagtgttctatattttcttttctttgaacttgtttttatagttactactgttgttgcctttaagaatttgtcaattccacctatgaaccttcggtcctcggatttcattagacgaaaagaagaagtttgatagaagtactgatttagtttggttttcgtttccacgagactcaatccagccggtttagtttctggggaattcgtttccaccgactcatgtcccttattcattctcgtcggtttatgtttataatattttgtgtgacattcaataaaggtttttcagtaaaaataaaataaaaaatacgagcaagagtaaacaatatttgtctattttgactatataaaatgggaaaaatatcgtttaatatatgaattttaaaaaaatagctatttaatatataaattttgtatataatcaattaatatatgtaaaaatcgttaattaattattttacacaaattaatcgttgaccaggttaaaattcacacgacgttatctgacgttaacagattgataacaaccgttaactaatcttcattagtttccaatacgatgtcattttgattatagcaaaaacgggaaaaatgtcatttaatattccaattttcaaattatatccattttaaccatcaacttcacatatgaccattttatacatgaaataaacgctaaccaacagtttaaaaaataagaatgtgttgaccaggccaaaaaaacatactgctatctaagcgtagatattcgaatttttgtttggatttggtttggatttattcagatttagataattcaggtaaagagtttattattcgttaaaattttatgactatttatttcggtttctgttagaatatgtatcatattttaatcgatttacataaaaaataaaataaaaaaattgtttaatatttttttgatatctaagttatttagaaaaaaatgtcgtttaatattttctatttaaatatatatatatatatatatatatatatttatttatttatttaagtgtttagaatcaatattttcatcagattttagtaaaattgatattttcaaaagaatttcttttaaaaaaaacattttctgcaaaaatctatttgccccaagcattacaatacgtaacagatcggattatcctttttcacatatatgcaactattctctttcaaaaagatcaaaacatttattattggatattcttttggcaaaataaaaactagttaataccaccgactctctctttatatgctttctctggacaaacgcaaaaacttttgtagaaccctaaaaattcccaaaatccgtcggagaagaagatcgagaagaatcaacaactaatctgaagaattttccaaattccgtcttcgtatcgtctacgagatccttatctctcccctgaatctggtaaaatttggtttcgaaatgacgaaatcaatagattctactttctcctacatcgcaatttctcgaacttcctttcataatcttcactgatctgtagctaattgtttatatgtgaatctctttgtttaatttccgtttccaggaacctttgatgatacaaaacgctatgtcaagttattataatccatcagcagcaacaactttagtctctattgattccgatgaacaaagaagaatcaaatacctagcggatttaaacatg

SEQ ID NO: 13134 - DNA, 3000 bp, Unknown
  misc_feature (1)..( 3000): cDNA_ID_2713153_gDNA_ID_2214600_Annot_ID_135545 3000 nt of promoter + ATG
aaatgcaaagaaataaatcgacaaatgttttgagtaaaaaggatattttgaaaatataaaaacacagtaaaaatgcttttaaaagtcatactacaataataataataaaaagtcatactacaatatttttaatacacgtaaatagtgtgagggtggcatagactagtaaagaaaacttattcgctttgtttcacgtttggtataaaaggttagaatcgtgtcagtttacgttacagtccaacatatttattaactacaaacaaaagtttttaacaaattaaaaagctatagtttttttagtatgccatatcactataatttatgtatttaatactcctccaatttctatatttgatgttacatatttttgcatgtaaattaaattattttttaaaaatattttcttatattaaacatcacataaatcatcaaaactaatacagaactaattaatctgcattaaaattttaaaatatcatctaatatgtcaagaacatattaatttagaaaatcactctacgattgatagcccattttggaggaaaatagtttacaaataagatttataaagtataaaatttagagtaacgaactagacaatctgcataaaaactacaagagcgaacaatattataaaacgagaaagaaagaaagaatcacgaagttggccaatctcatcaagtagattagagaaatcttgaaacatcagacgcctgcattatcaacactagctcgttactatcagttttgaacgcctgatcacaatcaatccttttaagatgatacttttcattgcccataaaagagtctccatttccgtgtgaagaagagagagactcgtccaatgacattttgctccaagtagtacagtttggttgtctctccgaaggcaccaccatctaaaacttatggttgaatccgattgtttccacgagccgtcaatccaacatcttactcactgttttgctaatttcttgtttcttctagatttgatagagcttctcccaacactaattgttcacttaagcgtaatttattatatctaaagattcggaatgtaaacatttaaagactttttcttcctattttttccataagaaccataaaatctatggaaaacaatgagatttttctttctcattcattaactggtaatctccaaaataagaagtctaaattcgaatataccaaaattaaaggaaaatatcttgctatggattttttttaagacagccatgagtcggctcccgtggctcactattgctagatccaaacatgagcaccaagtttagcgggttttgtggatggtcctcgaggttcatattctattaaattattattatttacgtaacaattcttttattttgttatgaaatcttgttcatcttcaaagtttaaactaagcttagacgcagacaatcaatatatcatcatcattcaattatagatggtggtctttgataaggattaaaaaatagtatgagtaagcaaagcatttcaaattaatccaaaacatagtaaaaattcatccgacatcatatttttaattgaaaatggctaaaacaatgtaaaataaaaaccaaatattgaaagaataataatagactttgtaaatgctttttttttttgaatgaatgtagaatctattcactacaaatcttgtgtgttccacatcttcatacgaatacatgtgggtaatctgtcatgcactgcacgccatgtaatcaaagcaaattttggtgtagcttcgacaaacccttagcccagctgcatgtaggttgttgtgctctcaaaagtttccaagtttcatttgaggagaatttccttttaaaacttgtcttccatcgccaatggttcacatcttcctcccatgtttttcatctcaatcgcatttctttgatttcagcttcaactttatttaagttctccactcgatgacgtctttctctgtgagtatcatccattatatcagcttttggtatcctaaggtctatacatcccctatcaccaaagatgtccaataatttccccacggaggaccatttttcatgccaaaaggatgttcctcaaccacttttaactttaacctgatgaaaactcttggccagtgccctgatctttagaattttcttctccatccaagacccttgaggtgagttgctttcacagcccaaaaaaactttttatggattagaaaactttttttggattagataggtatgaacacacttattctacaatgatgtcgaaacaaagagtagatattagcttcagctcgcaaaccttatttgttttcttgagtggtcttatacccaaccctccttaacttcgttgtaaatggttttctccacgcttgcttcacaaatcatgatcatccttacttacaatcattctcaatttcaccaccttcttctatatatatcacacacgaactaacataaatatattaaaacttaacaaattgactagaaaaaactttaataaaaatactttatattaccattttcatatgcttcaaatcctaataaccaactgtgactgtaaattaatgtttagcatttttgggaacaagacaacgtctcaaaactcgagctccaaccataatatgaatgctaaatcaccaaaaacttcaaaattatctaaattttaaagtgagtttttgtttttgtccggctcacccacataaccatatatatatatatatatataataaccattaaccaatatatatggttatgtgggtaagattaagaataaccattaaccaatatatcagaaacaggattggaagccaaattggatcatggtttactatcattaactcgattggttcgaccgaattctataattattattaaaataaaataaataaacaaataaataaataattcatctggacaagtggaagttcggttagtgggacccacttttctccgtttacgtttttcatctctctcagatctgagaaatgtcttcttcttctcaaatcactcttcaatg

SEQ ID NO: 13135 - DNA, 3000 bp, Unknown
  misc_feature (1)..( 3000): cDNA_ID_2713146_gDNA_ID_2214600_Annot_ID_135547 3000 nt of promoter + ATG
ttcaagctatggttgttttcgatatatttgaccagaattgtcatttcttcattttaaatatatgattacaaattgcagaatatgctagtatttttttttccaccataagtgaattatcttgggttgagcaaatagaaaatgtgtgttagatactttagatgtaggctggatcttgtaccagataacgaaaactggtttgcatggtattgcgacacgtatgtggaataacaaaacctttgtgtgtcggatcattctatcaaaatcaaaaagaagttgaaatatacgatacggtaaaacaaggtgcactagactaaagaactaaattttcgaaaagcagatgagaaatgagcccaataacttcaacaagaggtaacgtcctgccaccaccatctccttagtccaaacgtccacatgtacaacatttatttgcatatgggccaatgttttaaaaatatattaattttgaaaagcctaaagctgaaccgattgtaccgaatccgaaccgaagcaaaaaaaaccaaccgaattaaaaatttgaaaattgaaaataattgaatggatactaaacactataatccgaagagccgaaatcgaatcagtaccgaaccgaaatattttggataaccgaaaatatccgaaatacaattatatattcagaaattattagttatttgtagaccaaataataaaaaatacttgaatatatataaaaaataataaaaatactcagagataactgaatatctaaaaatatctaaaaatactcgtagcaaaataccaaattgatattaaattttaaaatcaaaagaactaaactttaaaaccgaaagtattgaaaccgaatagaatcgaaccgataaccgaagaggtaaccgaatgccaatgactacctaaaggtcttaaaataggcccagtcatctcaaaatcacgagaaagaacaaaatgataacatgtaggaacggtttatgtttcttctttagtatctgcgtaatttataaagtacttcttcttgcgtaagatacaactactaggtaggggggacgaaatatattcgtgatagataaatacatttaataattggatagggagatgatagaatagagttaatcacgatttctccgttagcgatcaaattctattactcgagttcagtttttcacttgtaaattttttttttacatctgagcttggaaaatcttgtttacatggatgaatcaatatagattgaaggttacatgtttaactgtgtgtttgtttttgttggaagaggaatgctaatctcgttgaataaaaagtgaaaattcataaactgaaaacttttcgctaaactcgaagtttggtatgaaactttttgggaatgcactgaagaattttctggatgaaaattagaagaaacagaaccaaaggtgtacagcttgtgttagatatcacataaatcatatctataaccaaacttatagacatgtttagaaataaatcatgttgaggtagatagtacgcacacggcacacttccttaagtgttcatttcaagctagtagataaacgatagggaaccaatgattcaggcatattaattagatgaggtaagtatacagttccaatgcaatattaattttaattaattaatttaacttcattgtgggtggtaacacaataatatgatttaatgaaataagtcatggttacaaaagttgttgctctatatccaccagtgaaccataatagtatattcatggctcttatccaattaaccaaataaaattttctaatcaaacggtttgaggacataaacaagtttaaaacaagagatagtggatgtgttttgtcacagccagatttctatagctttttctaataacagaggacaaacaaatagacgttagacttcccttcatcagatacatggtttcacaatgagatgtgacttgtgagtgttgcatgtgaagattcacaatgaaagtaatatgataaaaattggcaaaataacatggtccatggtttgagggaaacattgttggaatatcaatcatgccagaaattgcccaaaattagaaaataattgtttcatatataaatcatgccagaaattgcccaaaattagaaaataactgtttcatatgtatatcatgccagaaagtgcccaaaattaagcttaaaataattgtttgagagacattacagaaaagagagggtcttgtaaaaacaaaagacaatataatctcacgtagtttggtcgtttgcagagagattaagatccaatatttaaagacaaatcagcacaagcccgacaattacgagtttttggtcgcaatgaccaatttttcctcatttccaacaattagaactctcattaattagtcataacccacttctcaaaagaatagaaatcatattcataacttattttaagatagataatttttttgaaatatgttcttatagatttgttttctggtcaacaaaacattttcttatttattaagaatgcattcatcttttacaatcctaaaaaggtctgaaaaaaaaacttttgtcctaaagttaattataagttataacttaactttaaaagctgttaatttctacaatatccttctatttaaataattgctaacacgtcatcctgttattcaaacaaaatctattgaaatttaatattttccttatatactaacattttagagattttatcccaaaaaaaaacattttggagatagaggttttccattaaaggtaattaaaactggagatagagtttatacagtggaatatgctggccaatataatccttattaatactaaaacaaccccaaaatatggatcaatatatggctttacctcccaaaagagaagtaaaaactaatataaaattttaggagccttctcattccgaaaacattcacttttttctactacattaacacttttgtgtagatattattattcgtgttacatagcagaaatggttcttacacaatcaaaagaaacctagtcacta

SEQ ID NO: 13136 - DNA, 3000 bp, Unknown
  misc_feature (1)..( 3000): cDNA_ID_1807666_gDNA_ID_2214600_Annot_ID_135550 3000 nt of promoter + ATG
aatattattttctccgaatataatttagttaacattattttcctgaaaaaaaaaaaaccaaaattaagcccaactatacaatcgtaagaccaaacgaccaaatacataactatatcgtctaacaacaagtatataagatttgctatgagcagcttattctattttgcaattggacttctttaaaatgacattcatttcagattgtaaagagttggtattggattggatctaacaaaggagactaattggaccttcacggccttcctaagaagtaagaacggtgatacaaaatttcaccatgcttgaagacatgacaacaaaaagtccaaaagacaagttatccaaatcagaaaaacaaaacccaaaagacatgacaaccctttaattattttaaatcacaaatgtttgtggaataaaatcaatcatatgtaaaatcatacaaaattagctaattactgttttgggtttggatgcacaagtataagattttctattggctgcttactattttgaaactggacttcttcaaattggcattcatttcatattgtaaagagttgttattggatctaacaaaggaaactaatttgaccttcctttgttaatagtaaaaaaaattaattaatctaaacgccaaatagaacacaaaaacaatatataaatacaaaagtaaattagaattaattgttgattctatatagaataagaataaataaatatatatatacataataaaaagtttggaactcttggttctagaaccggccaaatagttggttttcaacattgaccggaaaagaacgaattcataaaattttgggattttaaactctacccaaactaataaaatagcatgtttaccagttcaattagtcggacaaaaaccggtaatgaaacaccaatagagtagggatgtgtcgtgtgtgaaatatttcaggttgtagtttttgttagtttgtcaagttgatttatggatatattaattcacgtggtcaattatttacgtcgaagatgtgatagatatttagtaagccggactataggaacaggagtgtggaagccacacgtggaatagcggtggagaataatttggatggatggcggtttaggccgaaccggggaaggttttgtttcttagacatcgtgagaagtcatacgttatgtccttaagattttaaaagctacaagagccactagctatttttcaattccaatatgataaattaattctttgtaagctaaattttattttaatttctaaataaatgttaaattttggataattaaccctaaagccataaacaattcagaaaaaaataacaaaattataacaagcctattcattgaaattcatatatgtacaaaaaagctataaatgttcatagtataaatgttttatgtactataatatgtatggatatgcaaattcatataaacataaaaaatagcagtgattaatatgagatatttagttcataatttgaatgtttatagtataaattttgttaattttttatataattaaaaatgacaatatatgaattttaataaccaaacataatgttgtcacctcgatgtatactaaattgcaggaagatgatacatataagttgaaaacgattgtgcgaataatctatagaaaagaaatataaattagaaaaaaaaagacaatgctaacgttttggtgtggacaagaaagaagacgttgcgacttgcgatgatgtttgaacctgcaggtagtttgattcatgtctctagaataacgctaaagaacacctatggctctgataacatattattaatatttacatttattttatttaaagtagtccattcataattgcacacgactaaatgctacacaacttgtcttagttgtttaatcaagatatttttaccttatgatattttgtgaaaaatgatacctataaaatccctaatgagcacatcaaccttttttaccttattatattttgtgaaaaatgatatctataaaatccctaatgaccacatcaaccttgaatcttctctaataaaccttttttccaaacacgcactaaaccaaaaattaacatctcaagaggaaaccatttaaaaaaaaaacagagttagattaagatcaacaaatatagttgaaaagaacatatgttaagcaacattaccataaattcataattagtagtgattaaaacttaagaatactaaagtatgaatatgaaaattgttgtatttttttgtagtatgtaatatgcggaaacttggatgttatcctattcattgaaattcatatatgtatgtagttatcattttttaaatatattaaaaaattaaaaagtaataatactataaacattcaaattatgaaataaatatctcatactaatcactgctaattttttttccaatgtttctctttagtatttctctttagtatgggagtgacaaacttaatatgaaatctatctccctacatgcaaaaatcgaatctcttttattattaatgaagtgtatggtcggtgtcaataactaatatgtcatattttttacagactgttcagatatgataaaaatagtttttttccaaccaaatggttggtcttctgagtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 13137 - DNA, 3000 bp, Unknown
  misc_feature (1)..( 3000): cDNA_ID_3028243_gDNA_ID_2214600_Annot_ID_187045 3000 nt of promoter + ATG
ctttgggtggtagtgaatataaccagagtcatagcgagaataaagcagcttggagaacacttccatggctaacacgaagaggtagggagacaagggatcaccttgccttagacctttagtactgttgaaaaaacctcccgagaccccattaatagagattgagaaggaaggcattgagatgcactgataaatccagttgatgaaccgatcagggattgcaagcgccctcaaagctgcaatgacaaactcctatttgacggagtcaaaagcctttctcaaatccaccttgagcattccccaaggtgagatatgcaacctgttataaccatgaaccatctccgtggtaaagagaacattctcagctaaagatcttccaagcaagaaagccgactgagattgaccaatcacttctgaaaataagccctgcaacctgccagtcaaaaacttagatataattttgtacagcgtattaaggtaggagatgggcctaaaatctgatatgaaagaggcgttagaggttttagggattaagacaagggtggtagcattccactgcttaaggagctgcctagagataaagaactcgtgaatggcagcagtaacctccgacccaataacgctccaggaatctctaaaaaattcaaccggatacccgtcaggcccactaaatttgttccgcgggagagatttgaaagctgctttgatctcatcatcactaaacagcctttacatctcagtagactgcgcctgagagcacctataggtaagcagcaggttcatgtcatcttgctccaacgagaagggagtctcaacctcacccaacagcctctcataataggccatacaatgatcaataataccttgttgggagtcaatcaccaccccattgcagtcaacaagggactttatggggttaaaacactttctggaatccgccattctatggaaataggaagtattgctatcaccctcagcaaaccaagaaaccctggatctttgatggaagaaactctcctcagcagaggaaagcaaaagccacttacgctgagcctccagttccaaggctgcattgagatcggaggcattggcaagagtcaggtcttggcgccttaaaaaccactcatgagcctcttttgtacgcagctctataccagaataattgagcctactgaagtctttaataggcttcttgagggctttcagctttttagaaaccctgaacatgtgagacccaaccacgttagttgaataccaattttctataacaacattcaaaaactcctcattattcaacagaaaattatagaacttgaagggacgcttaacactaataccatcagcctccaacacaaccccacaagacacatgatctgagaagtccaaattaccaaagacaccaaagacggaggcgacaccggaagacccatcccgaacaccagaagagacagaggatgcagcacgagcacagactgctgcgaacttagaagagcttgtgaccaccccacgaagaagcttctttttctttttctttggcattagaacagaaatttccgaccaccgacgtgaggccgacgttggggaaaaagaagcgaaacgaagaaaagaaaggtttttaaaagatactttgaatatagagatcgaatttaatgttgtttctgtcaccaaacgctcagcctaaatcgaagctctacctatctttaagatatctattatctaccatgcatcaactactaggactactctttttttgcgttttattaattatctttttacttatttaattttctataatgtaatcttgtttttcttaacctagctagtatattttattttggtgtggtgaacatccaaattaatatataagaatgtttgaaaaaataatatattaatatcaacgctcattgtgttcttataacaaaaaagtaaataaaaaagtagttgctttcgtttattaacattgcttttctatatagagtttatattatgttgcataatatgaaaggtctgttatccaaataattaaaaaagatgcactgctcggagccttctaattaaaatactttatacactagacgtatgctaaaaacaccgtattgtcttttacatagagatcatataacaaaaaaatgtatatataattttttcagtatatatgaatatataattataatgatacaataacaaaaaaagccataaaattgatatgggtcaactttccaattttcagtttgtaaaaatatgattatctaacaattttcagttttttgtttttgtttttttcagttgttttgtaacacctccgaaatccgaactatacaaaactaagagtatgccaattgttcggttgtcgaataacgtttcacaattacgcaacttgagaaaaactaaacgtaggtgaaaaacaagaaagctaactacagtatgtggattcagtcaaaacttaaacccaaaaaaatccgaagaatccaaaaactaaaagagcaaaacataagtcaaacctaaaaaaatggaatgggtcacacgttattaactaatatactacctgatgcttaatgcttctgaaatgaacacataaaaaaaattgaataaaataaataaattagataaataaaaataaaaagatgtcggaatcatcaaaacgtcaccgtttcatagctcaagagctccgtcctcgaactttgcgcttcaattcccaaaaagtttcttaattttttattttttctcctgtgtaagtgcaaacatctaaattcccaagaaccaaaactaaagatccgtaaattcgaagcaacatcaacgttctcgagcctctctaattattgttttatagaccaaaaattcttcgtttttcttttttccaggaatttttaatttgtatgggctgatcagaaaaaagccactttgtgttttcttttttagctggacggtgtctgaatcattcaatgcctttctcttctctacctttctaaatctctctctctctatctctccatcgaagcagcc

SEQ ID NO: 13138 - DNA, 3000 bp, Unknown
  misc_feature (1)..( 3000): cDNA_ID_3028259_gDNA_ID_2214600_Annot_ID_187041 3000 nt of promoter + ATG
tggagtagaaggagatcccgagagatcagaatgtatataatctaatatacctttagtagtgtgcttagcagttgggaaactttgtttgtgagattttccaagtacgcaactctcacaaaattccagcttgtctacttcttttcctgacaagtaaccttcttcaaccagcacattcatgttcttcaagctcatatgacccagcctagaatgccataagctagtcatgtcaatgtctggtcttgccactgcaacttctccttttactacttttccttctagatagtacagcccatcttgatattttccagaaatgactttctgtccatctttgtagaaagtgactataaagtcttttccttcatacttgcagccgctcttctccaattgtaggtatgtaccgcacatttgttaatatgaccacataatcatctggatttaagatcttaatcttaccaatccctttcacttcactgtgagtcatattacccatcaaaactttgcctccatcaaattcttgtaggtcaaacagagaatccttgtctagtgtaatgtgaaaactacatccagaatccataacccattcttccttagtgtcttgagggctagctgttaatactagtggctgttttggctccgttgcaatgtttgctgaacttgaaggcttgtgaagacttttcaggacactccctcttccaatgtccttctttaccacagatgaaacaacccttgttgtttttattgtactttggccttgattttgatctgcctttgctcttagaacgtcctctccatggtttgccttttcctttttcaaacctcttctctgatctgcctcttgttccacatacagaccttcactttgagagctttccactttctgtgagttctctttcctttgattttgcagctccaatgacttcattcaagctcaaagtgtctctgccatactttaacgtctctttgagctgatcataccggtcatataatgaactcaacaatagtatagcttgaacctcctctgtcacatctactcctatgttgtttagatcagtaactagcttaaggaaatcatccacattcccatctatacttctagaatcagtcatcttataagtatagaacttaagctgtaagtagattcgattaggtagagaagtctccatgtataacctctttaatgtggaccacatggctgcagctgtctcacagtttttgatctttcttagtacttgatttcccacgtttagtactataagatcttttgccttctctgacttttcaaactttataagatcaacattggaaggcagctcaaaatctccgacgtgatagtctcttccagctactgcagcttcctcttctataacaggtggatctcttagcagctgctcatcgttcaagataccttttagccctaaaacaccataatgagccaacattctgaccttccacaaagagaagtcaccggttccatcaaatctgtcaacctcaacccgagcgttactactcatcttttaaaacttcttgtaacccctgatctgaaactccttagctgaaactccttaacaaccctatacaagcctggagctctgataccacttgtggagaaaagagtgatagagattgcttggtaaagaaataaacagacacagaaaattgataaccgagttcacggcctcaaccgctacgtctcgggggagatgtcttgctcccaagcttcactatatcaaagggattacaaacacaccactaacttgtgatgttgtcttttggtttttacagatttacactcaagaagaacaaaaattcaaaaacaacaaagaggaagaagaaaggttgctttagaagctcttttatctctcttctctataactctctttagattcttttttcacctacctccactatacgtcgcacgttgtaatgcatttataggtgacgtaaatggggcacagacttttgcccacacttttgttcttcttcaccttgccaatttcgttggcctattaaggcccaataattgtattatgtcaaatccaaacaacaagtttgcttttgttagatcatcttgaaaaatgtgaggcttctatgtgttgcacaatattgtgaagtttttgaagaacatcattgacagaaaaaaaaagtaagaggatcatatccattataaatgaaattgtgtggatcatgcgagaaggaaattgattaatttgtataaacgatatgaacgggtcattacaattgtatataattaacaaaatttaagttgactgggactctaatattctataaatatttagggaattttagacattcctctttgtacgaatgaatgttgtatctaaaaaaattgtcctcgatcaaaagtatatatatgtagatagaatcatataaccggaccagtttttatgtttgaaaatcagtgtctttgggtgaaatctactgatttaaaaaattgctgcggtaaatttatcatgatagtcaaacaatttaacctaccacgacaaattacattttcacgaaagaacatgtaatcagttggagatgtgacatagaaagagtctatctaagccatgcgtcgtatattttacgagttaaacgagcatcaacttgaacctatcgttgttaaattggactttgttaatctccatactccaattttggaggaatgataggaaccctttatattaaaaaaaagagaccttttgcatttcttacagaagtcgtggatgaagcaaacatgtcttgtttatagtatttgaccattacttacacggtaaactaatgacgtggcaaacaaacaacgtcgttaaaaaaaaaggcgcattataaccgaaataactaaactacgccaagaggtaaaattaaacacaaggatctgacgtgggtgatgataacaaccacggacccgtatcccaaagatctcatctttcgtcgagtggttcataaccaaaatcaaaacttgagtgaatcataatcgtcgtctcgtcgccggagaaaatg

SEQ ID NO: 13139 - DNA, 3000 bp, Unknown
  misc_feature (1)..( 3000): cDNA_ID_3028267_gDNA_ID_2214600_Annot_ID_187036 3000 nt of promoter + ATG
tggatgcaaaaaaatctgatagttgaaaaattgttggtttcttgaaaagcttctgttatgaatctgttgttaatcatgtcacgagttagtgttatcctttagatcagacttatactttgacttgagctctgtgaattgggaacttacgtcagaatagccaaccgcaatataatgctatgttcaatgaatttaaggatatgaacatgttcttgttacaaggttcttttgataatgacacaaaagttacgagttgagaatgaatgtgcttcttcaatagagcataaacgcataaataagagtgacaattaaaaaacaaaaacgcatagaaaagagcacaaaatgaagttgcccattgctttcagcctttcacttaactccaatgatcgtctatgtccttcttctcgttgcccctcctagtctgattctgaatctggctcatccaccaatgggggatggactgacttgagttgtttaaagtcgtgaacattaagatcctctacgtggtttacaaaggtgcaaactctacaagttttctttaacacttcaccaaaaccttggatttcaacacgttggagagtgttcctttcgggattgaagtagaaaacataaaacggttgcttaggtgtatatttgagcatcgaaaacactatttcacccgaagcagtccctccagcgatggaaacacgacgacggaagaatctatcatcggtccaagtgtaggcatatttcgaccattgctgtttcttaacatcctctagaacccacacacgcaactcattaatgtcatcatcgttaatattatactccacatattcgtcgacatccgaataataaagcttataaatgtcgacatcatcctcccaataaatcacagctaattttcccttatagttgatcaatcgacaaaacctttctacgtcaataaacgtgaatttctcagacctaatatcaaagcaaactatcacataatcagatactatgccatgaccatccttaacacaatccgacgtgctacctaagtaatacaaaactccattgatgcatatcccttcactcttaatatcatgtctatcatatcgtaagggacaatttatctttctccacttcatatgtccagccccaaatgtaagaattttactatgaccaggaccagatggataaaatatggacaatgccttgtattgcttgtcaatcgggtcaaatccgaaaaagctatacgcctttctgtaagtataccgattaggtaagatggcataccgtcctgtagtggggttacatattagaggtgtagcctcgcctcgatcaccatataaatagatcaaccccgaggcgtagccaattgaaaaatattttaggtcataacaatgacagatatatagcttgtctggagagaacttaacatgaaattcagcggctgctacaagagtcgatgaggatttctcatatggattctcaagctgtggcgtcgagaagaacctccacacacagtttttctcttcgttgactttctctgccatggcgaataagaggcgcggcttagtggaggacctggtcaggaacaactccttgaaatatggactaccaaaaattgatccccattgcttcgacacgcaatgaaacctcgcgactgactttgcaggcaatctcgacaaaatctccacggtgagatcattcgttattgtacttggattcatgattgccgatcaaacgaagaaagagagatgtgataacttgtatataaagtaagacctagagaaaccaattaacaaaagacctaaagagtaaagagtaaagaccatatttatatatcgttaacgtccaagtgggccaccagctattggattttcttcagtaatcgctgctttataaggagacgaacaagatgagaatcaatcctgatgatgtgtgacatacaattgcttgatgaagaagattgggttggttcctaccagatttgcttgcatggagaacaatgttatggagtctatgttttgtatattaatatatactttgattcattaattcatctgatatggttatcatgacagctttgaatgaactctgtttctggtgaatactataactcgttttgagacacagatttgcaaaagaaactcgattgttgcgagttataatgcaacttgtgaatctggtttgcttcttagtcattttctcagggaaactataaaacacactacatactaaaattggtccaaagcctcaaacacattgagctagatagaatgatagacccatcagatagacaataagaaaagttcagataccaacttaaacataaacgaaagtgatagattgttgttactcttaactcgattccacacttagaaagcacaaattcaacttagagaactacaatcgaaagagaagatcaaattcaattatcaaagcaataatcaaacagatctgagaatcaaatcgttcgctaagtgttagctcacgatacaatgatcaacaatgatcaacattgtaacatctccagacaaattctctctctctctcaacaatctcagaaaatacataaagaaatgaaatgagctgcaacggctcctttaaagctgagttctctttatttccatcagcgtcttccatatcctttgactccagcttgttgaagaataatcaaatctcgtataagtcaaagtcacattcgtataagttagttattaagttacgagtcgtgtctgttaacacagttgtgtctttatcaagagtcatgtcttttacacaagacaatgtttcatttcatataaatagatcgagtctctgtttcctgtaacacaattgagttttgtaatacaatcaagtcaataagattgattacattcatactctgttttttcgttcttactctgttcttctttcataacaaaacattaacatggtatcagagcttatcgattgagaggacaagagaaaacactaaaaagagagagaggcaacaaaagtgagatcgtatacgtctcagcaaaaagcgagacg

SEQ ID NO: 13140 - DNA, 3000 bp, Unknown; identical to SEQ ID NO: 13136
  misc_feature (1)..( 3000): cDNA_ID_1807666_gDNA_ID_2214600_Annot_ID_187033 3000 nt of promoter + ATG

SEQ ID NO: 13141 - DNA, 3000 bp, Unknown; identical to SEQ ID NO: 13135
  misc_feature (1)..( 3000): cDNA_ID_2713146_gDNA_ID_2214600_Annot_ID_187030 3000 nt of promoter + ATG

SEQ ID NO: 13142 - DNA, 3000 bp, Unknown; identical to SEQ ID NO: 13134
  misc_feature (1)..( 3000): cDNA_ID_2713153_gDNA_ID_2214600_Annot_ID_187028 3000 nt of promoter + ATG

SEQ ID NO: 13143 - DNA, 3000 bp, Unknown
  misc_feature (1)..( 3000): cDNA_ID_2710584_gDNA_ID_2214600_Annot_ID_187024 3000 nt of promoter + ATG
gtcttctatcctctcaggagacgagttgaggttgattctgccactttgactcgaagaaccttcttgatcaaagctaaagaccacacctttttcctttgacagatcatggtgaacaattggaagagattccaatcgcagaactgttttttgagtaaaagggtccttttctgcttcactaactgattgaataactctatccactcttacagatcgttcttcagcatttgcgacccgaaggtattgacgcataccttctaacacttccggagcaattctcggccttcccgtgtttggatccactcccacctggctttctttcaacacaccaaataaagggtctgattccttcagaatcggaggagtagtagcttttggaatgataatgcctttccttctggctgtagctaggtcctgtctagcttttactaggatagggcaaacatctttttcgtgcgtaagccgttgacactcataacacctcttctgaatcctctcataatgaaagttaacagtcgctgaccctccatttctgaaattcacaacttttgatctccttaagggtcttgagacatcaaacagcaccttcactctaacgaactcccgaatttgtttcaattctgggttaaagacgacttctttaacttcaccaatgagatcacccagcttagtgatcgccttggccgtgttgtaattgactgggatattccaaatttgaacccacagtagcatgtaacgaagatagtcatccggaggattttcataccacctatctaccacgattgaccaatcattgaaggtatgaactcctttcgctagcacttcctctaaatcatgttcagagtcgaaaatgaactggaatctctcattattgagagctattcctttgacctttccttctttctgccacttccttggcatatttcttaagagattcttcatcggttgacaagccgggttcaggacccttccaatgagactgaatttgtttctctcactagacagatactcaggaagatctggcatttcaaacggttcttccttttcttccaacgacatctccatcaatgccctatccatggcggatgacatcttcaagctaagaggaaaacagacaccgtagaactaagactatcgagctgaactaactccaccaacttcttcagaaaaaacagagatatggaacccagatctgagaaaacgaaagcagtagagcatggctgagaggatatgataatgaacacgaagggttagaatagttaatttcggctgaaaagaaagatggtttccggtcaaaagctttattttaaacctagtgaaagacactaaaagagaaagagggttctaagcccaaaagatagatttctaaaaaataatcacttgttaggattggatacttcgacgtcaactgctaacgacatgatatacagttattgaaaattggtaattatgaagttaaagaagtctaaacatctcaattgaaaaatctcaaattattcttacggtgacagttgtctttagtatgaagttattaccatagctagagcctaaaggacagcaccaagaccaccactaagacaagtgacgtcctgcaaaatctaacacttaaataaaattgtcagagaagattatttagcaccaaacttttattctattaatttccaaaagaaaaaaaaaaagtcatatctttccaaattttcattacataactaacattttgtcacatgaaatctgtacgtctctgaatcttctcttcttctccctcatccattgcttatgtgcttcttcttctgattaccaaattttcattcctcttcttctttctgataaaaaagtttgcattttttttctttgttgtgataatcgaaaaagagactaaaacctaagaatcgtgcagaggagaggataccacaccacacccagaaattgaaactaccaaaaagtttatgaatttgatttcaatttcaactttttatgagacccatttgattctttagggattttgaaggtaccatttgtctcaatcttataaaaaatttcacctttttttttttttttttgttaccactatgtgtctttaatctgtgttcattgttcagatcgttgtgaaatttggttcgtgattcgttgcattgcaatagctagacggatcgggattgacccactttaggtttctcatctcaaagattgcgaaattttctaatttggcatcggattgtttggatttgattgcttatgtaagtaacttgatttggttggtaacttggtattgcaatcagaaaatgtgctattcagtgttcctttgtgattaggtaattaagtatattagaaccgcatggtctttgttctcaatgctagtttagttgttttggtttcatgaagtagaagaagttttgacaatatttactctctgttgtgttaaaaattagcatagctttatgtaacatgtaccttgttttctctgtactttcatcttttgaatggattctatgttaaagaatccattgatgaagtttacaagtggtagtttgttacttgcttatatgttagttattacactagtttgacaaggttttggtacttacttgctcaattgctacactcacactgtgaaattcatgatttatacttatttcagttatgcaagaaacttttgattacataggaatgatgtttttgatatatgatagataatttgacatttattagtgaaagtttctgatcttgcctttttgtggtatcaattggaaacataatgcagaagctatagttggagcatgagtgtagcctgaagctagattgctggctggtatgtggtgatcgtaatggtaaatagggtgcgcttatttcagttttttaattttccctcattcatggatttcttatgcatatttattttcttgtttgtttctgtttgtgtgactctaggtctcctcaaagttcttttaacttttgttctatttactggagagtccttgtgttctagtttaaggtatgaatcca

SEQ ID NO: 13144 - DNA, 3000 bp, Unknown
  misc_feature (1)..( 3000): cDNA_ID_3028290_gDNA_ID_2214600_Annot_ID_187022 3000 nt of promoter + ATG
tgttctgttttcttttgattttcttcttcatcctgtaaaacctagaattttgtttcttcaaccaaaaatgaacagagaagtctctgagagaattcatattttgttcttccccttcatggctcaaggccacatgattccaattttggacatggccaagcttttctcgaggagaggagccaagtcaacccttctcacaaccccaatcaacgctaagatcttcgagaaacctattgaagcattcaaaaatcaaaaccctgatctcgaaatcggaatcaagatcttcaatttcccttgtgtagagcttggattgcctgaaggatgcgagaacgctgactttatcaactcataccaaaaatctgactcaggtgacttgttcttgaagtttcttttctctaccaagtatatgaaacaacagttggagagtttcattgaaacaaccaaaccaagtgctcttgttgccgatatgttcttcccttgggcgacagaatctgctgagaagctcggtgtaccaagacttgtgttccacggtacatctttcttttctttgtgttgttcgtataacatgaggattcataagccacacaagaaagtcgctacgagttctactccttttgtaatccctggtctcccaggagacatagttattacagaagaccaagccaatgttgccaaagaagaaacgccaatgggaaagtttatgaaagaggttagggaatcagagaccaatagctttggtgtattggttaatagcttctacgagctggaatcagcttatgctgatttttatcgtagttttgtggcgaaaagagcttggcatatcggtccgctttcgctatctaacagagagttaggagagaaagccagaagagggaaaaaggctaacattgatgagcaagaatgcctaaaatggctggactctaagacacctggttcagtagtttacttgtcctttgggagcggaactaatttcaccaacgaccagctgttagagatcgcttttggtcttgaaggttctggacaaagtttcatctgggtggttaggaaaaatgaaaaccaaggtaaattgtttctccccagccattattaaccaacatagtaatgttaatatttgtgtatatattcgtattgccaaatatgctctgataccatggcaagtaatagattggctcatgtattttatttgtgatcatgtagaattttcttaacagttatgacttggtgttggtatggttgggacaggtgacaatgaagagtggttgcctgaagggtttaaagagaggacaacagggaaagggctaataatacctggatgggcgccgcaagtgctgatacttgaccataaagcaattggaggatttgtgactcattgcggatggaactcggctatagagggcattgccgcggggctgcctatggtaacatggccaatgggggcagaacagttctacaatgagaagctattgacaaaagtgttgagaataggagtgaacgttggagctaccgagttggtgaaaaaaggaaagttgattagtagagcacaagtggagaaggcagtaagggaagtgattggtggtgagaaggcagaggaaaggcggctatgggctaagaagctgggcgagatggctaaagccgctgtggaagaaggagggtcctcttataatgatgtgaacaagtttatggaagagctgaatggtagaaagtagaggaagagaatatgtttaatgttctgagatagattattgactttgtgttcctctttggagttgttctttatgtcatcttagcttttgctactgtttagtaagagaaagtccattgtgtgtttctatataataaagaatagacctgaagataggcattttcaagtttctgctttaagataccaaatcttcgttgtgcatactttttacttcttgtgatcttactatgtgatttatatggcatggattatataggtcggattttctttgaattttaagtatataaatttgaagtaacaaagtatgtgtagtaatgatgcgatgaaaaattggtaatgaatctagggcctaaactagtatagtttcaggtttattccaccaaactcttagcgtatgtcacttggatccaccaaacttgatccaagcgttttacaaaattgtataccgagctaaaaataaaacattctttgttgtttccacaaaccttattttctaacatagcctacatgtctttctccttaagcactcattcttttggcctctcgactctttgaaaatctctcacattaagacttaatgttacccaaacctaattaaactactcgagaaccccatgttcgtgtccatgagaattctcactcaagtcttccctttagccacttacaaaactacttgtagaactatggctatgaatgatgacataactcgcacccaaaaccgcatcgtaacagtgttgtaatagtatcaaaatctttacatatacatatatatctatgtatttttgttactatttaaaccgcaccgcacttctcccacaccacaaaacgcagtcactattcggacaatatgttttaaaaacgctattttgccattccccataggctcatggctttaaatgcaaagccttcgaaatttatggctcatagcttgcacaatactcatcgctaagtgagaagtcaaagtttgcttctacgagaaacagaacacatgtgctgactcgattcccggtttgtagccaaccaaagatgacgaaccagaatacggcaacacaaaagtaaaatatgacgtatgcaaacacgtaagtgatcttcgttaattaattttttatctgatcttcctccactgtcttcttttaagtgcacacgtgcgtgtatatatctcgatatggccgaaactggaagaaacaattcagacaaagtcccaagctaagaaaagagactctctttgttttgtctggcagaatattttccattcttgttctgttttcttttcatttttcttcttaatcctaaaaccaaac

SEQ ID NO: 13145 - DNA, 3000 bp, Unknown; identical to SEQ ID NO: 13139
  misc_feature (1)..( 3000): cDNA_ID_2713128_gDNA_ID_2214600_Annot_ID_135553 3000 nt of promoter + ATG

SEQ ID NO: 13146 - DNA, 3000 bp, Unknown
  misc_feature (1)..( 3000): cDNA_ID_2713124_gDNA_ID_2214600_Annot_ID_135554 3000 nt of promoter + ATG
caccaaaagtaatatgtttcattcttcttgaatcatgtctcttgttccactatatgttctcttgaatacacatcatcaccactacaattggtgtagagaggacattactgctttcaactacatacagctgaacgttgactctcattccatcccaacagtataatgtctgaacactcccaggtgtcttcaatactctggcatgtctctcggtattcccaacctgctcaataactgatatgtcttgaaacttgctgtactttctcttgctcgtgtacagaaacttgctgtacttgcctacacggcgatgtttgttcttcctcatatagctttctttgccgccttgtttctcactctcctcctcgaaaacaactctgattgtttctccggtcaacggcttcgccattacctccaccactgtctactttattctcttttgttgaaaacgtgtagcttctaaggtgcttacattcacattcttagaaataaagattcaaaccaaagttttcaagatatgacaatccaaattaccattgagttgataattggattttaaagtcattcatacatatacatttattacgctacaaagatacatccgatagacaagaagcaaagttcagatatccacttaaaccaaactaaactcataacatcaataaattaaacacaaattgttttacacattaacttcttctccaagacaccctgatcacttccatcatcattagggttggaaacaactagaagtagctcctttgtgattcatacgtgatcaaataacaaggctaaaggaagaggtattaaaagctatttggtcaaacctgctttaacgatcagttttggttcttcctatccaatatagattggtgttgaacatgttgttaagtttttgttcttattgtctcacgatcaaaactgaatctaggtgttattggtgttgaacatgatagtcccgtaattgatgcaactacacattgaggcttcagcctcttcttctttgagcttctacttcttttgttgatgttttgaatcttggggttattgggttttcttagtcggttttggttttgatttcttttatcttttctctcttgatgagcaaaaaggaagttttacattcttcttcttatttcattatgtactcagttcttatataaggattcaattgggtgtttgcaatattcagtttttgatcaataacgaataagggttttaccttttatcaaagtctacgaacttcctctgctttctttgcaagaaaccaagagttcatagcaacaagtctttcttgtaatccattgatctacagaaagttcttgttctctatcttcctctgtattaagtatacataaagatcaatagatactaagattttaatttatgtattcgattatcttgaattgagtttgcttagaaaattgatcttagtgaaaccttgtttgatgtcttttggatgtaaatgttgaattttggttttgatttaagatttaagattttcaatttttgtttctttccaaagaactccaccatagattctataccattggactatgatttttttttttttgaaacacaagctctctcatctaacaatttatcaaaatataagttaaaaaatggtgagagcccattggtctaagtctctgatcattctctattctggtgatattaatgaaactctagggttttgtaaccacaaatataccataagtagcatcatatgttttttcattcctaatctcatttttttcggaatagtgcaaaattgtaggaaagaactgtacaagaaagttatacaaaaaagttgagagtaaaacttttcggatttgaatggtaacccactatcaaaactgtatactttgtacaagtttgacaattaccaatcacaaaagctttataaaaagcgtttactaaaagctttaccctcagtttttttgtacagctttctggtacacctcttcttatagttttgtactattccgaagaatgcttatagctccatttaacaactaaattttttatagttttgtgttaccaatcagactcttaagaacgctttaaataaaaaaaaatatgattggtatatataaaagttgtacacaatataccactttcataatgtgttaccattcaaacccataaattcatttataatcttaatataacatttggtaagaaaacaaataaaatgaaaaatatataaaaaaacaaatataatgagtcaacttttccaatataaaaatattaaaatgacacttttgttggaatgtatagtcaacactttttcccaaaacatttgtaaacaataccaattaatatattgcacaataatgaaaataatgtggtcaatataattattaccattaactaatgatagaattatgtttggaagtaaattcaattttgatatgcaaagagttcaattccatggaacaagatgaccacaaaaagattataacatttcggtttaatttgggtttaaattttggtctattggtttaattttgaaatataatataaatataaaccaaatctaatatattagtttggtagcttttttttgtttgtttatatcgaattcttaagaaaatgatattaactctttttagaaaaatgttttatttttatttctatatttcattttggttcaaaatcgcataagatgtttgctgatatttgaaaaataactattttaaccaacaataaaggaaattttttaattgttggattgatatgtttgacttagtttagattgaaaagtttggtttatcttaatcgccacaataacctttcaacaatattaaacaaatagtaattaatcttacatcttaatcaatcatctaccttatctatttcttttgactggcaccagtgttaaactctatttatataaattcttacgttaatctttattcagatatccaacaaaaaactaaaactcaaaaacgagagatcaaatcaaagagtgagcatggcgataaacaaactaagacttgcatg

SEQ ID NO: 13147 - DNA, 3000 bp, Unknown; identical to SEQ ID NO: 13138
  misc_feature (1)..( 3000): cDNA_ID_1807721_gDNA_ID_2214600_Annot_ID_135557 3000 nt of promoter + ATG

SEQ ID NO: 13148 - DNA, 3000 bp, Unknown
  misc_feature (1)..( 3000): cDNA_ID_2710616_gDNA_ID_2214601_Annot_ID_135569 3000 nt of promoter + ATG
gtgaatgaaatgcaataaaagggtgaaggcaaataagcaaataaatctaagaagaatagaagtcctaaggatggattcattgatatgggcatatctagggtctataaggtggctaatagacgaaaggcaaatacctcataactttaccacttcctaatctcaactctcgttaatgaaacatagcaaagcaggcattaagcaacaatctattaaagtcaataagcagtctaaacatccaatctcttgggctagaatatacaaatctctggaattagtagaacaagcattccattcatcttttggatgctggaataccttggagagaattctaattgatcagaaagaaataaggattaggcccaactaatccaaaagggatctaacctaaccttaaccacctgacaaacctcgaatttaccctaatctaatccaccctcaataaccgtaatcaccactctagcaacataatcaagaacacaaacctagaaattactctaaacatatcaaaatgtagatctaaacaagataaacaacttgagagtacgagtaattaaggttcaaagattctaaaacacaaagaaaaactagaggataaaagcttggtcctttgggcaaaccccaaagtgacctatttataataaaatcccgaaaaccctaaattcactagaagacaagagacttgaggcagtttggatgaatgctcgacccttggggattgagtgatagggtgccacaaagattgcgcctttgcctctatgattcgagtgattaattggtcgagtagttgcttcttcctctcctcttcttatgctcaactgtctggttgagtggggaatgaggaggatctaaaggctctttgatcgctcaacaagtcagaggtagagtagaggatcgagtagagggtcgagtgattgtctactgcttcctctatagctgctttgatagagtgactggtcgagtagctgctctgctgcttcccttctggtaatgatagaatagtgggttgagtaaactgcttttacacctgaaaacacaccaaaacatgcaataagtatgcagactgatctcgtgttttcttgtagcgcaagatcgttggaaccatcatcgacgctgaaatggaagtgatggtcatggcgctgaaggaacccttcggtgtgaccaagaacaacactgtgttggtaggtgacaagtctaactcttgtgctgttttcttcttgctgtgccacctctagagctacaaggcatgtgatatgtctataatttgcatgttttcagtgttcattcatcatcgttttgagtccagtttatatcattcatcactattttatatcatttctcatcattcttgcatactttgcatgattatgatagctttgcatacatattgcatttctgagttgttttcaggtgatttgacctgtttgcgagcaaattggaagaagcgagccagaaccagaagacatacttgaccccctggtcgagtatcatcactcaccaccaacaccatcactcgaccaagcactcgatcacatcttcataatctactcaaatccgcactcaaccagacaagctaagcacaaggaagagaagaggagaagaagaagtgtttggaagcggcctggagctccaccggatcacgaagcccatctcggcccattatcactctatgggccgggcgattaggttactggcccgtctactatcattttatttcgttttctataaataggtgtcagagggttttgtcctgggacatctagtcgacattgagtttttgcttcagttttattttctgttttactctggttgcgccgctgttgcttctgcaacctgtaattcgagatttttccaagttattcagattccgcatttgattttacctgtcatcttgtttctctactctttatctctttacttatgcaatatacttgtttacatgcgtttatgtctttgagcatgttgtctgagtagtgacatagagttcttaaggatgggatagaatggttgtggaatccttagtctgtagaatggttaagttttagaattgattgaatcccttcaggactagttgtgtttactgcttatttctttctgatcaactagaattcgatccaaagcattcccgtacccagaaggtgttcgatggaatgcttgatctactagttcctgagatattcgtctctatcccaagggattggccgtttagagcgattattgactttatcagtctgttcttattgcctgcataattagattccgttaatgggaattagtctgggctagctttccttgaggatttctatcacgggagtgaatttatcttttgttgaacctgttgtctagggatagcttgattgcgcttgttaacctttcgaataggctaggataccactctatttgatttccccatccttaggaatttctcgtctatctgatttctctgttttattgttatcgcttaatcgttcttattgcatgtttcttagtttttgcaattactagaccaacttattcgaccacacccagtgtctggcaacagactgtgcagtcgagtacaattgtctcattttctgccagttactcgaccacatcctgcctctggcatcggccagttgtagtcgagtgattttagtaattctgatactatttctgttttctgcatgttcgcttagggctgttagaaacctcaaaaccgttattgcttggtttgacttagtgacttctgatcacatctcatctgtttgcatcacaactgattggattgacacctaaaatactacaacgacatgattggtgttttaggataattgattaaaaatctattatcaatttggcgtcgttgccaattgggtgtttgtttgctatatttgagatttcagaatatttaagatcaagttctttttcattttactgaaaattactaactttgtgtttttttctgtttgtttgttttgatttaggtactgcgaatcaccagcttcaccagttggtactcgttgt

SEQ ID NO: 13149 - DNA, 3000 bp, Unknown
  misc_feature (1)..( 3000): cDNA_ID_3028334_gDNA_ID_2214601_Annot_ID_187069 3000 nt of promoter + ATG
gcaggatgtggtcgagtaactggcagaaaatgagacaattgtactcgactgcacagtctgttgccagacactgggtgtggtcgaataagttggtctagtaattgcaaaaactaagaaacatgcaataagaacgattaagcgataacaataaaacagagaaatcagatagacgagaaattcctaaggatggggaaatcaaatagagtggtatcctagcctattcgaaaggttaacaagcgcaatcaagctatccctagacaacaggttcaacaaaagataaattcactcccgtgatagaaatcctcaaggaaagctagcccagactaattcccattaacggaatctaattatgcaggcaataagaacagactgataaagtcaataatcgctctaaacggccaatcccttgggatagagacgaatatctcaggaactagtagatcaagcattccatcgaacaccttctgggtacgggaatgctttggatcgaattctagttgatcagaaagaaataagcagtaaacacaactagtcctgaagggattcaatcaattctaaaacttaaccattctacagactaaggattccacaaccattctatcccatccttaagaactctatgtcactactcagacaacatgctcaaagacataaacgcatgtaaacaagtatattgcataagtaaagagataaagagtagagaaacaagatgacaggtaaaatcaaatgcggaatctgaataacttggaaaaatctcgaattacaggttgcagaagcaacagcggcgcaaccagagtaaaacagaaaataaaactgaagcaaaaactcaatgtcgactagatgtcccaggacaaaaccctctgacacctatttatagaaaacgaaataaaatgatagtagacgggccagtaacctaatcgcccggcccatagagtgataatgggccgagatgggcttcgtgatccggtggagctccaggccgcttccaaacacttcttcttctcctcttctcttccttgtgcttagcttgtctggttgagtgcggatttgagtagattatgaagatgtgatcgagtgcttggtcgagtgatggtgttggtggtgagtgatgatactcgaccagggggtcaagtatgtcttctggttctggctcgcttcttccaatttgctcgcaaacaggtcaaatcacctgaaaacaactcagaaatgcaatatgtatgcaaagctatcataatcatgcaaagtatgcaagaatgatgagaaatgatataaaatagtgatgaatgatataaactggactcaaaacgatgatgaatgaacactgaaaacatgcaaattatagacatatcacatgccttgtagctctagaggtggcacagcaagaagaaaacagcacaagagttagacttgtcacctaccaacacagtgttgttcttggtcacaccgaagggttccttcagcgccatgaccatcacttccatttcagcgtcgatgatggttccaacgatcttgcgctacaagaaaacacgagatcagtctgcatacttattgcatgttttggtgtgttttcaggtgtaaaagcagtttactcaacccactattctatcattaccagaagggaagcagcagagcagctactcgaccagtcactctatcaaagcagctatagaggaagcagtagacaatcactcgaccctctactcgatcctctactctacctctgacttgttgagcgatcaaagagcctttagatcctcctcattccccactcaaccagacagttgagcataagaagaggagaggaagaagcaactactcgaccaattaatcactcgaatcatagaggcaaaggcgcaatctttgtggcaccctatcactcaatccccaagggtcgagcattcatccaaactgcctcaagtctcttgtcttctagtgaatttagggttttcgggattttattataaataggtcactttggggtttgcccaaaggaccaagcttttatcctctagtttttctttgtgttttagaatctttgaaccttaattactcgtactctcaagttgtttatcttgtttagatctacattttgatatgtttagagtaatttctaggtttgtgttcttgattatgttgctagagtggtgattacggttattgagggtggattagattagggtaaattcgaggtttgtcaggtggttaaggttaggttagatcccttttggattagttgggcctaatccttatttctttctgatcaattagaattctctccaaggtattccagcatccaaaagatgaatggaatgcttgttctactaattccagagatttgtatattctagcccaagagattggatgtttagactgcttattgactttaatagattgttgcttaatgcctgctttgctatgtttcattaacgagagttgagattaggaagtggtaaagttatgaggtatttgcctttcgtctattagccaccttatagaccctagatatgcccatatcaatgaatccatccttaggacttctattcttcttagatttatttgcttatttgccttcacccttttattgcatttcattcacctcttatttactttcatccttttgagttacctgttagtacttgaatatgttgcatgcttggttctactcgaccctatgatcgagtagggcactttagttcacatttttatagtttgaaacttgatttcggattattactagaaacccaccttcattacacatctagcttgacttagttgcttatatacacatcttgactgcctagtgataacatcgtatttttgcccacttttactatgttttttttaggttttccatggagaaatcaagagttaaaggacactgatataacctgattttcactgcttttatctatgttttaggtataagattttgagtttttatgttatttctcgagtgtttttagtgtcttttcaggtattctatgcaatgggacaacaatg

SEQ ID NO: 13150 - DNA, 3000 bp, Unknown
  misc_feature (1)..( 3000): cDNA_ID_2995137_gDNA_ID_2214602_Annot_ID_135571 3000 nt of promoter + ATG
gtatatatccttaatgagatccaaggaagagagaattaacgtcccagacacctccagcacccacataatccatggactctacgtccacttttagtctttctatccattttcgttcgatggtcggtttactagttttgaaaaaaacctttaaaacttatttattggataattattaaaaacaaaatataaaatttattggctcatgatttttgcaaaaaaattctctatgttttgttctcatttctcatttatacgatattaaaaattacttttcaatatgtcggccatcattaaattgcttcactctaatcccgtggccgtaaacgtttttctttcaagctagactccataacaactacgtgcatttaatttctcaagtataaaattttcatgttttcaaatagtacgatgtatttagtgattttatttatgtactttgttcattaaattagtcataattgttctgatttttaggggttttgatcgaacccttagatcaaaagttaccttaattgtttttttagctaagtactttattaaaaatttaatgtttagttctgattgagtagtactataaaggagacatgtgtcaatcttgtcaattggttttgagttcaacaatatgcaatattgcacatgcattaacgaccaaaagaagatgcaatgcacttaaatcattgaaactgattttgtttttgtagtgtataaaatatctatttaattaccaacgaaagaagtgagcttttaaaaacaaagagtcagaagatatatataactacaaaacctacagaagataagctggatttcaaaagaagagaaagagtaaaccaataaattgaccaaagcaaaatcggatatttgacataagtttccattcacattgacccaaatccaccagcatttcaaataaagttacttaatataatttttgtgtttataatatattccgcccactcttgccttcatttggaccttatcctaaaagtcaaaacaggtgaaaaaaatgagaatacaattaacacgaaaaatgcaaaagactgttaaaccgaaatcgaattctagtgtaatcaatccttttcccaatgatacaactataaatcaaaaagaaaaaatgtactgataaacgaaactaaacgtataaattaatatatttcttgacataaataggaggcttttgcctgctagtctgctacgatggaaggaaaaatgcatgcacacatgacacatgcaaaatgtttcaatgaagacgcattgcccaattaaccaacacaccacttcttccattccacccatattatttatttctaccattttctttaatttattgttttttctttgattcatacactgtttatgactattacattttccctttcgactaatattaacgcgtttaaaccaaagaatggatttgataatgaaattttattttattagcatatagataatggatggcttcatgcttggtttccatgacaaggaatgacacaagataattattttgaataaaatcataaatatgataatactagttgtaaaaaaacttgagtgtttcgtgtgttatttttcggtttcttgactttttatatttctcgtttttgtaattttaggatggattatttagcttgcttttctcttttattactttctaaaattttatttataaactcatttttaatatattgacaatcaataaatgagttatcttttaattaataaaaaatttgtaaactcttgtaaacagatcatagtcactaaaagctattataagttatttgtagctatatttttttatttcatgaacttaggataagatacgaaaatggaggttatatttacataaatgtcaccacattgcctttgtcatgcaaacggcgtgttgcgtcactcgcctcctattgggaatcttataatcgcgtgaatattattagagtttgcgatatttccacgtaatagttatctttcacaaattttatactcaattacaaaatcaacgaaaatgtacatttgtatctttaactatttacgttttttttacgtatcaactttcagttatatgttttggataatatatttttttacttttgacttttcagttttcacctaatgattgggatatacatatgcatgcatagttcccattatttaaatgtaagctaagtgcatatgaactgttagtcaaaattacgaagtttatttgtacatatatatagttataacaaaatggtacagtaaattaaacagaacatcaagaaagtacaaaagactgaacacaataatttacatgaaaacaaaacacttaaaaaatcatccgataaaatcgaaatgatatcccaaatgacaaaaataacaatatagaaaatacaaaaacaaaaacaaaatatgaaagagtgttatggtggggacgttaattgactcaattacgttcatacattatacacacctactcccatcacaatgaaacgctttactccaaaaaaaaaaaaaaaaccactcttcaaaaaatctcgtagtctcaccaaccgcgaaatgcaactatcgtcagccaccagccacgaccacttttaccaccgtgacgttgacgaaaaccaaagaaattcaccaccgtgttaaaatcaaattaaaaataactctctttttgcgacttaaaccaaatccacgaattataatctccaccactaaaatccatcactcactctccatctaacggtcatcattaattctcaaccaactccttctttctcactaattttcattttttctataatctttatatggaagaaaaaaagaaactagctatctctatacgcttacctaccaacaaacactaccaccttatttaaaccacccttcattcatctaattttcctcaggaacaaatacaattccttaaccaacaatattacaaataagctcctatcttctttctttcttttagagatcttgtaatctcctcttagttaatcttctattgtaaaactaagatcaaaagtctaaatg

SEQ ID NO: 13151 - DNA, 3000 bp, Unknown
  misc_feature (1)..( 3000): cDNA_ID_2713196_gDNA_ID_2214602_Annot_ID_135572 3000 nt of promoter + ATG
ggccaggaaggatcactacatctccactggggtcaatcttttgagatgcattacattagattagaacgacctaaaaaaagtcgtcataaaggaaaaaagatagtaacgagaatattatctttctgagtacaaaaagttggagtctgctaaagtccatacattaggaggcgataaaggaattcgtcatttgtccatacataataagacccattattgatttgcccataatacagatcatcattcagatatatattatttaatcaatttctatatgacttgtatttcaacttttataaagtatttatccaagatgataatatcaaagttaaccttaataattatacgggaatgagatcatacctaataatcttgtcatgctgtttttgttacgtgacaaaatataaccttttttagtttgctaagtacaaaatataaagtttataaagattacagtttaagggaaaataaaataaacatttaaacatattgatactataactaggatacgaaagtaaacaaaaaaaaaacaagaaaatgccattggaaaaggcaaacgaagcattatatatccattataataaagcaatagaagaggaggagattgatttaaaagctcattagccgatgcaatgatgttttaggaagaagataaaacagttaaacactcagatctcaagtttgtctactactctcccaaaacccgataatattgttctcttctttacgtttgaccggtgtctcctatcttcggtcttcgcatgagttcaattttttaaataaagatattttggatattattagtttgatcattatttacattaagttattttaattaaagctatatatatctacaagatctttttaccactttgatcctccaccttctttcataacgtttatcagcaattttgaattatcaatttcccactatgagtatgataaatatacacttttttcttcttttttttttcacttcaacattgctaataagaaaaatgattacaagtatttattttctctaatctaaatatactaaatcagcagtcacttttccaataactaatgcattcagtgattgacacatcagcttagtactattttttattttttcatttttacgcatagtatgtgtcgtttttatttaactttgtttctttctcaaatgattttctctttcatccccacgatctccacatctccactttctctcttccaaaaactccatgactactgtgtaaaatctcaaaaatgggtttctcaacatcattaatcgattactcagaaatcaggtactttgttcatctcaatgaaccaatttaccatcttctatttctgtttgtaattttgttttatatatatagaaattttccatagatccgaaaatcatatatccttcttctagatttctatggtttttttttttttttgctttgtttctgctttatttgactgaattcgatttctctcatacatctccatttttccataggattattctttaatacaatcaatgcctatgattctcccgtctcacaaacactcaaggaacaacgacaaattttggcttctcatctgaacagttgccttaaaacaagggtgagtttaatatcttaatcgaagctcaagtgtttttttgatggtaaattaattctcatactttttactattcttctttcatctcttattttacttctttatatctgcaatttcttttttgtattaaactgcaattgtattttcacgcaagatttttgtattaatacaaatacttcaattttaaagtcatctcttattttacttctttatatctgcaatatctttgatattgtttcaaaggcagcgtctgcgtcatgtagttacttatttgtgcacattttacatttttttttagacttccaagctttgggtgtcaacgaatgtttgtaaactgaattactgatgatgagaagaagaacacattacaattggttggagctaatgatgaaataagcggacatgtatatacccagcataattttcgtacttatactctcttatatttctaaactcttgatttgttagttattgcctatcgcaattgattcattgggtagaaaagttgtaccttctttatatctttttcttaatctttgtatattcttcgatcaatgataataaatttgttgtatattaatactgtctgctttattttaaaatttttagttaaaagttgtaacagatataatctaaaacaatgttatccctaaataggggccaaatgctagttatattctaaatcagtaaataatagttactacatgcacactaaaacagacatagcgtacgtgggggacttattttgggaattgtcacatgtgtgtgagtcactcaccactaggttcgatttatatctaacgatttttcccggaaatatttatggacgaaaaagcaaacattataagattcatttgtttgttttatatagtacacaaataatagagaattaaatcactaattttaatgaaaattaaaaataaataatatatatatatatatatatatatatctgttgacgaaaataaaagcaagtatatccgaataaaattacgaatataatttagggatgaaaatagaatctcctatacagttaagatattataagaatattcatggttagactatcttagaattagataattaaggaaaattatcgtgatcatcaatttacaaatttcatacctgaattcattgtttaataaggtaacctgtttattttagttttaaaagtatatcaacaagagaactttgatcactaaaaaacaaaattcatacaaactttaatcacttccctatattgaaatgatctaatctggatgaaaaaaatattatttattaatttcccataaaacaataaacatgtggatgtagctcttaaatattcttagaggcagagaatgtcatttattcaaatccggaaatatattaaaaatgttgaacaaaaagaaaaagaaatatattaaa

SEQ ID NO: 13152 - DNA, 3000 bp, Unknown
  misc_feature (1)..( 3000): cDNA_ID_3028416_gDNA_ID_2214602_Annot_ID_135574 3000 nt of promoter + ATG
ggtgctgataaaagtgaaaacctaatctctcaatcgcagacgttgtcatctctcttcttttctcaagcgtccgatcaatctctcctcttctctcgatctctctccctctctgcctcctctcttcctccaatcaacaaacacctctctgtttcactcccgccctttttcgaattcttctggtaaatcaatcttctctctcaacttctctgattcattgcttcatttcaattttccccttttcatatcttattaggatgtgttttgtctctgattttcttcgttttctgttgatgggttttgtctattttgtgttaattgttgtaaagttagggtttttttttctttctgagatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgagtatgtcttttttaaccttttaacaatgctatgttgtgtttgctcttgctgaatgtttagaggcttgataggaactttgagttttagtttcaagtcttaaactttatagtgatttttgggtttttcttaactagtgaaagttgaggcctttttagtccttacattggttactctttcttgttgttcatctttgtttggctttgatgttgcatatttgatgatgcaatggtttttctatgacgttgatgagcagagcgagtgataaatgtcaaagagagaaaaggaagactattaatggagatgatttgctttgggcaatggctactttaggatttgaagactacatggaacctctcaaggtttacctgatgagatatagagaggtatgttctgagtacgatgtttattagttatgctgttgtgtgaagagagtttttgaatttcactaacttactctgtttctccttttccttttcttgctctactacgtgaactggaatatcacagatggaggtcagtggttcttcttattctatttcttgttcattcctaaaacttgcaacgatctatgatctttatggcttccgtgaatcatctctttttgtcaacttatgtatcaaactatttatgctttccttatccttttcaatgatcaatagggtgacacaaagggatcagcaaaaggtggggatccaaatgcaaagaaagatgggcaatcaagccaaaatggccaggtatatgtctcaaatctcatgcctttgaccattttttcgtcttcgcattcatctgcacgtattctctcttccgctttagctaagttagtctgacattcatggggtttgtttaccatttggcagttctcgcagcttgctcaccaaggtccttatgggaactctcaagtaacttttcctctcttctcttcacactcaagcaatacgcatcattctcttctaatttgttaagaattgaaaacttgtaaagcatcacttatgttataatctatgaatacctcaaaatctgtgaactaatttgacattggactcggtataattgtaggctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttcaacaccggtctaaagaatgaattctgattttaacaaagatttcatacaagaatgagaacaaatgaatacttatttggaaaatgttcaccatcgataacgtagtaagatccagaatctgttaaacaacccttacctaaaatagtaagaaccctagattttatgtttatatcgcctgcattatctttagtcttttagtagtaacgaaagcaaaattagatgcttattgttgtttatttggttacagttgttgtaatcgcggcgttatctgttaaaccaaattagagattcttttttaacatatcgtttctacaaaaaaaacgggaataatccaacggtcacaaatttacaaatcaacggatcacgttcatttcgggctcacttctgtcaaaagacttaagacaaaaaaaaaaactcaaaaattaacaaagaaaattgattaaatattaataaataagaaaccgccgatttgcttcgtttcaaattctttcatcttttatgcgataaagcttgtttgatttttcttcttattgaatctgtgtggtttgtctatgggagaagagaaggagaactggagaagcgagctcgacgatatcaatgggcttagtctgattgatttctccgccgaggatgataacctcctcctctcttcctttctcgatcccaccacctttgatttctcaggttatttcaatttccatctccaatttctggaaattgttagctgaagattttcctgggaaacttgtgaattgtgtgatttggttcatgattgttcattgtggggatttatagattttttaaagcttgattagatttttttatgatgatgatggattcagatactgataaggaagacagaggtctttgtttatttggagatacacataattgttgtgatgaagagactttgggctctactactttagaagagaaggagcctcataagatcatgaagactaacctacgcaaaagtcttgcttgggacaaagcctttttcaccaatgcaggcaagtatttttttagtggctgtgttctgtggatttgttatttagtagtagttagttttgctgagataagttggcgcatttaggtgttttggaaccggatgaactgtctagc

SEQ ID NO: 13153 - DNA, 3000 bp, Unknown
  misc_feature (1)..( 3000): cDNA_ID_2713189_gDNA_ID_2214602_Annot_ID_135575 3000 nt of promoter + ATG
aaacttttaggtgtttgtttcctccaacctaatattttaggttttaggagtccacggtttgtttttcaatggtagttatattatatgtggttgttaggtaagtggtagtatattttgactaattagtagtttgacattatattaggaggtcgactcatctttttcaatcgtgagataaaatggtttttgaaaagtggacttggatttgtacaaaatgaattcgcagactccatttatataatgtcatatgtgatgcatgaaaaatagatagtcccgtctaaactcggtgtcaataactcaacttgtgatactacagtttcctattataaatagaattttcataactttttccttttcatcatttttttttttcattattaggatttcgaataccggtaaattgagaaagaactactgtcttttttcatagagaaaaaactacatgatcaaatttgtaggaataaaaacagataatggattaaggtgtatctatataatatcttggttacataaataaataaatcgtatatggtgctatatgcgattactatgtaattcaaagaaactcttaagtaaattataagaaagaactgtactgagggattaggttaggtgcatctttacgcaaaaaaaaagtggagtatgggaattaaaatatagaaagtatacagagaaatgcatgcttagttttcatttattcaaacaataaaaagaaaataaattagaaaaacgaaagaaacatatattaccgttagcaattaagtagcaagcagcaaacatgaggccgaacaatggcacgtgactctggcgcctcaacaagcaacgcttctctttgtcttttatgtcttattcttgtttctattttacaaggatcctctcgtttttttcttcaacttgatgcaattatcagtcccacgaaaaattgtattctttcgaagtaaatatttaaagaaatactgtagaaggtcaagatgttaaaaatatttccctacatattttagacatattgtttggtatagtgtctataactgtttcttaggcaaattgtaacaacgcttagacgtctattgaatatatttttttctaatgttgttactctttagtctttaacttcttaagagtgtcaatgcatactagcacgtctcaagagcaaaaccgtaagaaactctctgtgttaatgtattaagacttttgtttgtttgtgtagtcttagtgagatggaattgaagaaagaggttgacgttacatttctttgaggctttgaatggtagttatatgttaaaactttaaacaattatggttatggagttactgatagtagtaacacgtacgtttatagtaaacaaattttggttggacacgtttatagttaattatgctacatatgtgttggcattaaactctactcctccaactcgcaagtgacaaatccgcaacacctaatctttagagtatttgcactaagtaaaagagaaaatagactagtagagcgttaatttgtccattgaacaatattgctcatctgtttctgtactcttttcataacatctttaaaaaaaaattgaattctacttcgttttaatttaccaagttaactcataattttaccatcaaaaacacagtctcaacctgtttcatgaggaacggtttatattttataccagacattaacgtattaaagcataattcatggacgaacatcacctgaccttttggtcggaaagagaaaagtaaataaaatatggactaaattgacataaaacaaaaagtatcggggcaaaatcatgatttcccaattcaatccttttttttcacacacactctcttttctctttctggatattaatgtgtaaacaaatagacagttcactggaacaaagaaaaaagaaaaaaaaaagacttgggaaacgagcagagtcagtgagagaacaacactagtcacaagggacaaagagagaggaagaagatgatatccatagctcaattggtctcaacccttccgtagtttagctctttcttcaatctctcatcttttcttcattacatttcgatctctctgttcttaaaacatttcggaccaaaagaggaaagctgcagccacagttgcaggtgaagaacatagaacactgtcccttctctctctctcttctttatctgtttgaaatacctaaaaattggttctttatctgtttctttcgttgatgagttcgaaatacctaaaattttgttctgtttttgagttactatgttgcagaaagttttaacctttgagggtttggtttagtttttatgtttactcttttctgggtttttcttgaagattcagctaaaagaaaagaaaaaaatttgttttcaagaaagtttttttttccttcaaattttgatttttttttttctgaaaaaatgttctcggttaggtttaaattgaaatttctagtttggttagtttcttttaagatctgttgtctattttagggaagatccacctaataaaaccagaacccacgttaaactaaatgacagaaattgttattatctcctctcctccttcaaaagattccaaattttttgaagagaaaacaaaactaaaattgatgacttgacaactacaaaaagattatgtggaatataaatgtactttctttgcttgtaatttggtttacctctgtgagattagattgaatcacactgagaaaaaatctatttcctttgactgtgaacagtttctttttaagtttgtcttgttgccttggtttggtggtagtggtagtggtttcaaatggagtctctttgaagccaatgtctctgtatagtttagtttgttagggttttgtttttgtacacttgcttaagctttgtacttctgttgagtttgttgtatatgcttgcttatgttaatcttataacaccgatttgtgtttcttgcttctttctcacacacagagtttatcttcaaaggacccaaaagagagtgttttagaactctaatctcaagcaatg

SEQ ID NO: 13154 - DNA, 3000 bp, Unknown
  misc_feature (1)..( 3000): cDNA_ID_3028400_gDNA_ID_2214602_Annot_ID_187096 3000 nt of promoter + ATG
cagaaaaaaaaaaaatctataatttccaaccaacatagtttactttcagtctgatagccaaatttcccaagtaaatatataagaaatcagtccatagtttcaagctctagtaccattacctttgtaacatgtacctaccatattatatacctcagatctcatgatatcataagcaaacaagtttttgtggacttaggctctgtgctgcaggaaagttcatgatgcttatacatgaaaaataaaccttaatagtacagatcttttagttcataagaaaaacttacatagaagagtttgtcaataacaacagacatacttcttttaaaccaaaagaaaagagaggcagaaaacaagcacggttgggaaactaagaagcctttgcatttaaagtatcactaaggttctcgactctccaaaccagagccatcaaaagtgaagagtaatacaaggagttcatcaaattacacactttcaaaaagtctatagaatttacagaaaagtctataggaaactgattaggaaatagaagaggatgaaagaataaggcacgatggcaaattatcatatactgtatccgcataaaagagcatcagagcaagttcatgcaaaataggtaacacttgatatcatcttttcagtttctatcaatgtactacttcttcgtttatattcaagtaaaggccttgtacatgtatttcactaaacttacaaccatagatgacatgagcaagaaaattacatggaaaatccaatagcaggacttaagcttaaaatatttttctgaaccgaaaccctcaaaagtgcacctgcaggcaaataatcctagaaggatataggtttagaaagtcctaaccacgaatacactacactacccaagtgataaagccgtcgtgcttgattgatcactgattcatcatttctgcacacctttaaagtagaccaacaggaagcaattaggcccttgacttcactaatacaatgagaacaccaaattctattccttctcctctgatccacaaattgaatacactacagtttccttagataaacggatttagtccacaaaagtactagcctgcaaaggcttactacctcatttactatttctgcgctcttattgtcttcaaacccaccagcacaccttaatagactcctgaattcgggcttgtgtgaaaggatgctttcttaaaattagcattatgtttcacatcattgtgcatccaaatcaaatgcttgtacgtgacagcatgtcactctagaaaccattatatgatagatgtagtttgttaggaagattgaagttccccactcatggataccgtacctcaagcatcttcaactgactaaacacactctggtacacatgtgatggcagagactagttatggttatttccttacccctatggatcagaataacttctagatgacttgagttcaagttcgctttgctttcccaatcaaccaagaaggtccacaacacaatccgcaaatcagaatacatcaaggataggccagccaccaatcctaatgggctaacatgaggaactaacatctgtttgaaatgtgttatcaatgcaatttctttaagaatgatgccataatttcaaagtttctaaaagttctcaaagaggaagatgaattctgacctgaaactatagccgtactagttctcaaatcttccaaacacttgaatcactgattaggcttttctccagtttctcaactaccagaggttcgtggtggagaaaggtatgatagaactagaaaccaccattgccactaaacctgcagcctgcaggatacaaaccagctaagcctaggttatgctaatacactatatcccaaactagcttacccgcatcgctgaagtagcagcctgaacaacattatcaacagctaaccaaaacacaaagcttacaacatctcctctaatcaccgagctggtctcttctcagtatcggaatcttaaaaagctaacaactacgtgaaagagaacaaattcgaagtctgaaattatcagaaccgactccggttaacggacatgatcgcgatcatacccgaagattgtgggaaaagtcaccgatgtagcagcaaaaccgggaataaaccggattaaaccgaaaaaaagaaacaatccatcatcacacaatcacaagagaaaaaaggaaacaacgatcggcttgtttatacataccaacacgaaataatcagctcaacggcgaaacaacaataatgatcggagaaatgagaaacattaccaaagcgttccggcgatgagaaaagaagaccgatcggagaaaagcaaagagacgtatggattcgtatagatgacgcaaccttttatgaaaaagaggttttagagagagaaatatgttttgaagacaaattgctttcttttttggtgatggttgagcgatgaagagtatcggtttatatttaagaaaaatcaaattaaagcggttgagttacgacgttgccgggacattaatcccttctctgaccaacttcaccggctaccggtaaaacccgttcactgtcttattgtcgactaaacaatttattaattaactatggttcttcagtaatgggcctatatttttggactgtacttgggcctcagctgtacgtatcaaaagggttcgagaaactcagagattaaagggatcttgaccgttgatcgagatgactttgattttatccattaatagtcaatttgattgatgagttaagaggatgattaagaaagcaataaaggaagcgaatcggaatccacattgtattaatctttttgatccagtagccattggcgaatccaggagtattaaagttccattttgattttggcgacgatgatgaacagagtttagagaaatttgcattgaagaagagaagatttttggattttgtgtagtgggagaagggtaaaccctagcttgggagggacatgatcggatgctctaagtagcttgtgaattagagaaagagcaagtgagcaaat

SEQ ID NO: 13155 - DNA, 3000 bp, Unknown
  misc_feature (1)..( 3000): cDNA_ID_3028404_gDNA_ID_2214602_Annot_ID_187095 3000 nt of promoter + ATG
ccaagctagggtttacccttctcccactacacaaaatccaaaaatcttctcttcttcaatgcaaatttctctaaactctgttcatcatcgtcgccaaaatcaaaatggaactttaatactcctggattcgccaatggctactggatcaaaaagattaatacaatgtggattccgattcgcttcctttattgctttcttaatcatcctcttaactcatcaatcaaattgactattaatggataaaatcaaagtcatctcgatcaacggtcaagatccctttaatctctgagtttctcgaacccttttgatacgtacagctgaggcccaagtacagtccaaaaatataggcccattactgaagaaccatagttaattaataaattgtttagtcgacaataagacagtgaacgggttttaccggtagccggtgaagttggtcagagaagggattaatgtcccggcaacgtcgtaactcaaccgctttaatttgatttttcttaaatataaaccgatactcttcatcgctcaaccatcaccaaaaaagaaagcaatttgtcttcaaaacatatttctctctctaaaacctctttttcataaaaggttgcgtcatctatacgaatccatacgtctctttgcttttctccgatcggtcttcttttctcatcgccggaacgctttggtaatgtttctcatttctccgatcattattgttgtttcgccgttgagctgattatttcgtgttggtatgtataaacaagccgatcgttgtttccttttttctcttgtgattgtgtgatgatggattgtttctttttttcggtttaatccggtttattcccggttttgctgctacatcggtgacttttcccacaatcttcgggtatgatcgcgatcatgtccgttaaccggagtcggttctgataatttcagacttcgaatttgttctctttcacgtagttgttagctttttaagattccgatactgagaagagaccagctcggtgattagaggagatgttgtaagctttgtgttttggttagctgttgataatgttgttcaggctgctacttcagcgatgcgggtaagctagtttgggatatagtgtattagcataacctaggcttagctggtttgtatcctgcaggctgcaggtttagtggcaatggtggtttctagttctatcatacctttctccaccacgaacctctggtagttgagaaactggagaaaagcctaatcagtgattcaagtgtttggaagatttgagaactagtacggctatagtttcaggtcagaattcatcttcctctttgagaacttttagaaactttgaaattatggcatcattcttaaagaaattgcattgataacacatttcaaacagatgttagttcctcatgttagcccattaggattggtggctggcctatccttgatgtattctgatttgcggattgtgttgtggaccttcttggttgattgggaaagcaaagcgaacttgaactcaagtcatctagaagttattctgatccataggggtaaggaaataaccataactagtctctgccatcacatgtgtaccagagtgtgtttagtcagttgaagatgcttgaggtacggtatccatgagtggggaacttcaatcttcctaacaaactacatctatcatataatggtttctagagtgacatgctgtcacgtacaagcatttgatttggatgcacaatgatgtgaaacataatgctaattttaagaaagcatcctttcacacaagcccgaattcaggagtctattaaggtgtgctggtgggtttgaagacaataagagcgcagaaatagtaaatgaggtagtaagcctttgcaggctagtacttttgtggactaaatccgtttatctaaggaaactgtagtgtattcaatttgtggatcagaggagaaggaatagaatttggtgttctcattgtattagtgaagtcaagggcctaattgcttcctgttggtctactttaaaggtgtgcagaaatgatgaatcagtgatcaatcaagcacgacggctttatcacttgggtagtgtagtgtattcgtggttaggactttctaaacctatatccttctaggattatttgcctgcaggtgcacttttgagggtttcggttcagaaaaatattttaagcttaagtcctgctattggattttccatgtaattttcttgctcatgtcatctatggttgtaagtttagtgaaatacatgtacaaggcctttacttgaatataaacgaagaagtagtacattgatagaaactgaaaagatgatatcaagtgttacctattttgcatgaacttgctctgatgctcttttatgcggatacagtatatgataatttgccatcgtgccttattctttcatcctcttctatttcctaatcagtttcctatagacttttctgtaaattctatagactttttgaaagtgtgtaatttgatgaactccttgtattactcttcacttttgatggctctggtttggagagtcgagaaccttagtgatactttaaatgcaaaggcttcttagtttcccaaccgtgcttgttttctgcctctcttttcttttggtttaaaagaagtatgtctgttgttattgacaaactcttctatgtaagtttttcttatgaactaaaagatctgtactattaaggtttatttttcatgtataagcatcatgaactttcctgcagcacagagcctaagtccacaaaaacttgtttgcttatgatatcatgagatctgaggtatataatatggtaggtacatgttacaaaggtaatggtactagagcttgaaactatggactgatttcttatatatttacttgggaaatttggctatcagactgaaagtaaactatgttggttggaaattatagattttttttttttctgagcttgcggatgttttcctgggattttgaatggtgagagaaatttttgtgcaggtttaatg

SEQ ID NO: 13156 - DNA, 3000 bp, Unknown
  misc_feature (1)..( 3000): cDNA_ID_3028408_gDNA_ID_2214602_Annot_ID_187093 3000 nt of promoter + ATG
taagatagttcttttttgctctattcgaaaacatcccaagcaagcttgaaaagacggttttcatcatataatctggtagtatgtatatgccatttggatcccatctacgcatacatagaatcagctttaatattatcataggtatgtattactcttgaaaacacacaaaatatcagatagcaatttacctttcaacgcaatgaacaagagttgaaacttcagaaataaaaaaaggaaaccaatgtttaaaatgtatttgcttgtgtacaaacaaacaaaaataagatatatattataaattcataaagacaaatatagccatacagattaagatttttttttttgtcggcatacagatttaaagatacttacgaatgtacgacacactccaaattaaatataataaaagtttttatgaaacggataaggcccttttagagatagttataaggtcaactcaaataagtcacattcatatttcgaagaaatataaaccaacttaaaaaaatatattatacttacaattatagagcaataatgcaattacatgttaacacagcccatattttattgacttttttagaacgaaacgataggaattttcagaattatttccgacacgcttgctttcaagtccagcatttcgcgggaagaagcaaaaggtgggtcaatatttttggatgccagaatccagatccaaattaatccacatgtatccgtagattttaagggatactataacatgtttttttctttctttctttagtaatagtatttgttttccgtttacactaaagatatttagtattgttattttttgtttaattggttagttcatttcacacacaaacatagctttacgattttcttcagaggccgtttcactattccaagtaaatcaacaattcattataacaaaattgtgttttagtcccaaagtattagagaatagggactttacatggctataaatgacgtcatcagtggataatatgtagctatgcatctaaatctgtagtcacgtcgtagctaatgactacaaaacttccgtagccatttcttctccagtgtgcctactgatattcatattagccaatcgtgtcttttaacaacgtttaagttatgataccatcaatcaccctttggctatgttattgatataatacatgtgacaaatcgaccaattaagtcgtctctctgatcaaaacaacttatacgaattcaaaatcaatctgacatattattatcacataattagttttacaaatcgaactaaccacacattaacctgaatatctatatagtaaaaattgttattggtgaaagtggatcatatactcgtatatataagcaactagataaaccacattaacttctagatgtagacttaaagaaaataagaatcattacatcaagaatattgaggataagtgaattggcaacaaagcattatgtctgcaagtgaatggattggacggtagttaatgcaattgtacatgtatttacagccgccataattaagaaagtgggattggttttattagtagtggtttgcgaatgcgcatgcgattactgaaatgtctaaaaggtcaaacttaatggctttcaattattcattatatacaccaaggaatctttttcttaattcttctttggattttcttcttaaaatattatattgttacatatctttattgctgacatataaaaatgtaacctttttgctttccaaactaactaaaactttacggtaactttaaaattcataaccaaattgctcatattcgtacgaaagaatgatagatgaacagctacttaaggatcttttcaaatttgatcagacttctatagtaacattctatcgaagatcggattcttatccccaattcccaacaatatatttgaatgattgctagatatatactgtattaataagtaaactttattaacggttgtacataatcttaaaaatttaaggtttttattcagtatttttgccaaatattttgatgagcagtctaattctttcgttctttttttgttaaaaattaacaactctaacagtactgaatatttctgaagtgagctaatgattccaaattggtaacaatatcttaaacggaaggtaaaatgcgggtaagtctggtagaatctgttaaattgaggtagcataaattttaccacaaaaaaaaaagcagaaaaggattataagattcaaaaaaaaaaaaagtaaattcacttaaccttcttttttttattgtcaactgattttgttattgataaacttgttggaaccaagataataggccaaaacttttttataatcatatatattaaataataattgtatttaagataataggccaatataagctataggttagcatagcgctgaaattaagagagttgggtatgtagacgttgacgtgtaatattcatgataatcattgcaagcaattttatttattttctatactaagaactatttcaaattgtatacatattactttttggtggaacatgaaaatgtttatagattgctgattaatatttgaaggaaaaaataacagaaaaatggatatatacttgaatcggtttgataatatattggaacaaaagtgaaaagctaaattaattaatgctactgtgctagtatattactatttttatcgaattaaattggacatcgagtctcactgaattcacaatttcacatgttcaacaactattgagttcagatagctagatagctagtggttttaaatttgagtattaatatgagtttagaacgattaagaaacccccgattattgaaaaataataattaattaatagtgacagcaaccactatgactaagaaataaagatgcttaattttatcatacacgattagagaggttctcaaactctatataaccctacattggaacacatatagagccacacaccaataattaattagacaaaagataagagagaatagagagagagagagcaatg

SEQ ID NO: 13157 - DNA, 3000 bp, Unknown
  misc_feature (1)..( 3000): cDNA_ID_3409327_gDNA_ID_2214602_Annot_ID_187090 3000 nt of promoter + ATG
gtacctaatgtggagattagtcttgaaaagtgtttgaaaaatatataataagaattaagaaactatccaatgttataaattgacagttttggtctcaagagtaaatatataaattgatgtttagatacagtatagattaattaattgagctattaataaatagatagaaactctaaataaatttacggagaccccactaatcaaacacttggaaattagtacgctcctaacgaaaaggaggttttgtcaaaagatcttaaaatcgagaatatataaagttattattcttaaacatatactgttgttcttaaaagcaggacccatttcgattgcttggagttggactagagatataatcccaatgaacaataatttgtgggcggtcaaatacattctaagatcatcatatacattctaagatcaaaaacatcatggatcttgcctcactcataagatccatatataccatataaagacattacaagcttttcaatgtaatgaaacaacaactaaaagatgagggaaaaaaaataacatattatagataattactgagtaaaccactcgtaagcagacaacgaagagttgaagataccacaaggagattcaagcttgattttgtcgacagccttttagtatttaagtaattaactctagactaagatacttgacaattagagaagcactagttaaaccaaaaaacatttgcagccaataatttgttgttttcaaaaaaaaagaatgagtagaactgaaagagatatcaacatgtgatatgcaaattagttggtcccaaagttattgccgtatcatatacgaaggcgaaactcatattttactggaagatatctagatttaaactaatattttcgttaacgagtccttcatatatatactcattgttctgcaagaaagttttgtatgatttccaccgttaaatctgaaagaaagctatgctaatacgttttctttatatacatacaaatctcagctcatttttttttcaatcttttatgctctgcaatgttctataaatgtcacgatgtaatttaccaatgactaatttaggaaaagaaataactacctcaatgtagttctcttaaaatacttttttagatcatgttgatataaactttctagcttcaaatacaaagcaatgtgtcccaaaaagtgaatctagcagcaagagatctcaacaaacaactagagagcatacagacaaaaagtacaaaatgttaaacttttctagtaaaaaggattagctaagtagaaccaccgatttcctcttatagaaaagatctcggccgtcaatttttctgaacccaacgtgtgaacataacaaaacattaaaaaatataaaaccacagtgttcgatctgaatcatatagagagggaccagaggaaccaaaaaaaagagtgagagtttcagtaccaaaaaatccttagacacaaaaagagatgaggttttcttcatctagacccgtttcgagtccgggtcgaaccgaaaacccgcctctactcatgcggttcttgcggaccaaaagcagaagcagaagccgttctcgttcaagaagacctatctttttccgtcggaaaaatgcttctgctgcggcggagacacaagaaccaacttcacctaaagtcacttgcatgggtcaagtaaggataaaccgatcaaagaaacccaaacccgaaactgctcgagtctccggaggtgcaacagaaaggcgacgccagagccgtcggtgcgggtgggtcaagaacgcttttccctgtcattctttcaccggaataatcaaacctacttgctttagccctgtgtggcgtaaatggaaatcattttctcatgctagtttctcgaaaaaatcagagaagagatcaagttcgtctagaagtgaacctatctttggccgctccacggtggagccagaggaaccagaagagactcgaaaagaagaaaaccaagaagaagaagcaagttcatgtaaatcattcacagctacaccaccgagaaacgcttttttactaactcgatgtagatctgcaccatatagatctccttcatcagctaatagcttatttgaagatcaagaagagacaaataaagctcctttccaacgacacgcttcgtcggaaaatgtatcagtttcggaagaaccgaagacaagcgttacagaaacaacagagagattagaggattcaagaagagaatcagcagcgagtgaagaaccaaaacgaagcgttttgggatcaccacgacagtgtctgatcctcacgcgctgtaactcggagccagcgagactcgttcccgagatgggttatcgacagaacccaaggttgggatttacgtgatgcgtttacattttttttctctttcttttgtattttttcgagaaatttacattgaaacgattactatattctttgctggatttacttggggaagtttcgctgaaatttagagctttaaaagctttctttatcgtagagaatcttgtggttccctgaccatgtaatatttttcaattgtcctatctatgacaatgtaactaaacaaacaatttcgttcgtacacttatacactaaacaaaaaaaagtctttgatatagttttatttttctgttatgccaactatgtttgtgttcttaaaattctacatctctaaaaacagatatattttccttatattacataaaaatggtttacccataaattgatgagttttatcaagagacttgcaaaatattgtggagatcacgaaaatgccttgaggcccagatattaatgggcttttaggcccatatgttaatgagatccaaatatttccaagttaagtaattggtaatgacggtgaaggtgcctttgactatcttaacgcgtacgggacggtcgataaatttagttaaagtctctttcttcttctttactttttcttcttcttttagatcaaagaaatcgttttgtgcagatttgatcttgcgttaattttctaagcaaaat

SEQ ID NO: 13158 - DNA, 3000 bp, Unknown
  misc_feature (1)..( 3000): cDNA_ID_2702176_gDNA_ID_2214602_Annot_ID_187088 3000 nt of promoter + ATG
ggacaattgaaaaatattacatggtcagggaaccacaagattctctacgataaagaaagcttttaaagctctaaatttcagcgaaacttccccaagtaaatccagcaaagaatatagtaatcgtttcaatgtaaatttctcgaaaaaatacaaaagaaagagaaaaaaaatgtaaacgcatcacgtaaatcccaaccttgggttctgtcgataacccatctcgggaacgagtctcgctggctccgagttacagcgcgtgaggatcagacactgtcgtggtgatcccaaaacgcttcgttttggttcttcactcgctgctgattctcttcttgaatcctctaatctctctgttgtttctgtaacgcttgtcttcggttcttccgaaactgatacattttccgacgaagcgtgtcgttggaaaggagctttatttgtctcttcttgatcttcaaataagctattagctgatgaaggagatctatatggtgcagatctacatcgagttagtaaaaaagcgtttctcggtggtgtagctgtgaatgatttacatgaacttgcttcttcttcttggttttcttcttttcgagtctcttctggttcctctggctccaccgtggagcggccaaagataggttcacttctagacgaacttgatctcttctctgattttttcgagaaactagcatgagaaaatgatttccatttacgccacacagggctaaagcaagtaggtttgattattccggtgaaagaatgacagggaaaagcgttcttgacccacccgcaccgacggctctggcgtcgcctttctgttgcacctccggagactcgagcagtttcgggtttgggtttctttgatcggtttatccttacttgacccatgcaagtgactttaggtgaagttggttcttgtgtctccgccgcagcagaagcatttttccgacggaaaaagataggtcttcttgaacgagaacggcttctgcttctgcttttggtccgcaagaaccgcatgagtagaggcgggttttcggttcgacccggactcgaaacgggtctagatgaagaaaacctcatctctttttgtgtctaaggattttttggtactgaaactctcactcttttttttggttcctctggtccctctctatatgattcagatcgaacactgtggttttatattttttaatgttttgttatgttcacacgttgggttcagaaaaattgacggccgagatcttttctataagaggaaatcggtggttctacttagctaatcctttttactagaaaagtttaacattttgtactttttgtctgtatgctctctagttgtttgttgagatctcttgctgctagattcactttttgggacacattgctttgtatttgaagctagaaagtttatatcaacatgatctaaaaaagtattttaagagaactacattgaggtagttatttcttttcctaaattagtcattggtaaattacatcgtgacatttatagaacattgcagagcataaaagattgaaaaaaaaatgagctgagatttgtatgtatataaagaaaacgtattagcatagctttctttcagatttaacggtggaaatcatacaaaactttcttgcagaacaatgagtatatatatgaaggactcgttaacgaaaatattagtttaaatctagatatcttccagtaaaatatgagtttcgccttcgtatatgatacggcaataactttgggaccaactaatttgcatatcacatgttgatatctctttcagttctactcattctttttttttgaaaacaacaaattattggctgcaaatgttttttggtttaactagtgcttctctaattgtcaagtatcttagtctagagttaattacttaaatactaaaaggctgtcgacaaaatcaagcttgaatctccttgtggtatcttcaactcttcgttgtctgcttacgagtggtttactcagtaattatctataatatgttattttttttccctcatcttttagttgttgtttcattacattgaaaagcttgtaatgtctttatatggtatatatggatcttatgagtgaggcaagatccatgatgtttttgatcttagaatgtatatgatgatcttagaatgtatttgaccgcccacaaattattgttcattgggattatatctctagtccaactccaagcaatcgaaatgggtcctgcttttaagaacaacagtatatgtttaagaataataactttatatattctcgattttaagatcttttgacaaaacctccttttcgttaggagcgtactaatttccaagtgtttgattagtggggtctccgtaaatttatttagagtttctatctatttattaatagctcaattaattaatctatactgtatctaaacatcaatttatatatttactcttgagaccaaaactgtcaatttataacattggatagtttcttaattcttattatatatttttcaaacacttttcaagactaatctccacattaggtactctctctagagataaaaatatttatcaaaaacatttttatttatttattaagtagtagataaactactgtggcaaaatcgtaaatgtctaaatgctgatgaattttttttgctgctccaatctggtttagtgctccatatacatccacggccaaaatgaatctatggcggcattaagattcattagtaagcaacgattatattaatataattgtttttagcaatgattttccgtaatttcccaaatatgtttcagttaatgtgttccaatcccaacaactggttgttgcaaaagaccaccaacgcaagcaatcatcaaacatcaaaataatcttaccttagcgaacaaacaataactacacaattctcataaagctcttatatatcactaacttcacacattttgttttccacaaaaataaaaacggaactcactcaagaaaccttcttccttgaagagagggttatg

SEQ ID NO: 13159 - DNA, 3000 bp, Unknown; identical to SEQ ID NO: 13153
  misc_feature (1)..( 3000): cDNA_ID_2713189_gDNA_ID_2214602_Annot_ID_187087 3000 nt of promoter + ATG

SEQ ID NO: 13160 - DNA, 3000 bp, Unknown
  misc_feature (1)..( 3000): cDNA_ID_3028416_gDNA_ID_2214602_Annot_ID_187086 3000 nt of promoter + ATG
gaagctggtaaagaagtgagaaaagaagactttagttattgccttaagtgtgtttgatatagatgcattttttacaaggaaaatagttatatttgaaagatatatgtacttagcttgtgtattaagaaactaaatattttaatatgactcagatacatttcctctctctaaattattgttttctgtttattttcataaaatagtagaagttttaaaaatattaaaatgatcacaaatattttcgtaattgtttatagattttacctatttcttgtattttaggaaaatttgtaaattttaaaatgtttatagttaattgaattcttaaataacttttaaaaccctaataagttttcgaaaaaaaaaaattactttccctactatacaataagaaaatgtatcaaaaatcaaaatttaataaaaatgaataaaagtaaacttatataaagggattgaataataataaagttccccttaatggttaaagataatgaatacacgtggcgtttctggatttggtagaatatgaaccagagagaaaataaataaagagattaaaaaaaaaacgaacggtgctgataaaagtgaaaacctaatctctcaatcgcagacgttgtcatctctcttcttttctcaagcgtccgatcaatctctcctcttctctcgatctctctccctctctgcctcctctcttcctccaatcaacaaacacctctctgtttcactcccgccctttttcgaattcttctggtaaatcaatcttctctctcaacttctctgattcattgcttcatttcaattttccccttttcatatcttattaggatgtgttttgtctctgattttcttcgttttctgttgatgggttttgtctattttgtgttaattgttgtaaagttagggtttttttttctttctgagatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgagtatgtcttttttaaccttttaacaatgctatgttgtgtttgctcttgctgaatgtttagaggcttgataggaactttgagttttagtttcaagtcttaaactttatagtgatttttgggtttttcttaactagtgaaagttgaggcctttttagtccttacattggttactctttcttgttgttcatctttgtttggctttgatgttgcatatttgatgatgcaatggtttttctatgacgttgatgagcagagcgagtgataaatgtcaaagagagaaaaggaagactattaatggagatgatttgctttgggcaatggctactttaggatttgaagactacatggaacctctcaaggtttacctgatgagatatagagaggtatgttctgagtacgatgtttattagttatgctgttgtgtgaagagagtttttgaatttcactaacttactctgtttctccttttccttttcttgctctactacgtgaactggaatatcacagatggaggtcagtggttcttcttattctatttcttgttcattcctaaaacttgcaacgatctatgatctttatggcttccgtgaatcatctctttttgtcaacttatgtatcaaactatttatgctttccttatccttttcaatgatcaatagggtgacacaaagggatcagcaaaaggtggggatccaaatgcaaagaaagatgggcaatcaagccaaaatggccaggtatatgtctcaaatctcatgcctttgaccattttttcgtcttcgcattcatctgcacgtattctctcttccgctttagctaagttagtctgacattcatggggtttgtttaccatttggcagttctcgcagcttgctcaccaaggtccttatgggaactctcaagtaacttttcctctcttctcttcacactcaagcaatacgcatcattctcttctaatttgttaagaattgaaaacttgtaaagcatcacttatgttataatctatgaatacctcaaaatctgtgaactaatttgacattggactcggtataattgtaggctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttcaacaccggtctaaagaatgaattctgattttaacaaagatttcatacaagaatgagaacaaatgaatacttatttggaaaatgttcaccatcgataacgtagtaagatccagaatctgttaaacaacccttacctaaaatagtaagaaccctagattttatgtttatatcgcctgcattatctttagtcttttagtagtaacgaaagcaaaattagatgcttattgttgtttatttggttacagttgttgtaatcgcggcgttatctgttaaaccaaattagagattcttttttaacatatcgtttctacaaaaaaaacgggaataatccaacggtcacaaatttacaaatcaacggatcacgttcatttcgggctcacttctgtcaaaagacttaagacaaaaaaaaaaactcaaaaattaacaaagaaaattgattaaatattaataaataagaaaccgccgatttgcttcgtttcaaattctttcatcttttatgcgataaagcttgtttgatttttcttcttattgaatctgtgtggtttgtct

SEQ ID NO: 13161 - DNA, 3000 bp, Unknown; identical to SEQ ID NO: 13151
  misc_feature (1)..( 3000): cDNA_ID_3028423_gDNA_ID_2214602_Annot_ID_187084 3000 nt of promoter + ATG

SEQ ID NO: 13162 - DNA, 3000 bp, Unknown
  misc_feature (1)..( 3000): cDNA_ID_2713179_gDNA_ID_2214602_Annot_ID_187098 3000 nt of promoter + ATG
cgtctttggccatttctataactttttttgttatatatgaaagttgtgttttgtattgtggatatgttgtgtttgtgaagactgaagagacgaatgaaagttgtttatatagagagactatagctatagtgagtgctctcattaattttgcttgtcaatatacgttaataattgtatacgtgttattgattgattatattacgataatgttttccttttggtaggcttatggttgtttttattattcgtttcaatgaaatgaatatagaattgtgtgtatgacgattatgattatttttgtggaaactttctttcactaattaattacctagctagctgtcatgatgatatataatctaaaccaatctaatcattgctacataatcaatagaaactgattttgcttaatatattcatgttccactgttttttttttgtttaagcagaatttccatatacattagtataattaactgatgatagtaagaattagctactgctaagagtttttcatctcaattagtgtttgtcataatatgatagttaaggtattgttttgttgacaaaattaactataactaaattattattattttggtttcaacttcaactattgatacaaatctgtaactaaagatgaacttatttgagattctgattatttaaaagaatgattgtggagctatcaataggaacagagaccttttaattctaaaattatggttgataatggagttttgtggttaatttaacttagcctcgccgccccatacctaaacgttgttttcatttggaccgaccctaatatactatatgcttctatatttttctttctcttgtcctatgtcatgagccttgtcctccccctagaataatatagactgtcactcttttacacataaaataaataaaaaatatgaagttatgaaccttatctatttgggcaatacttgaaagttgttacttgttaacgataaagctttttgaactacgagatagctagattgatcaatagtaaaatttctgattatctagattctatcatccttcatttaatttctagaaggagctccttatatagttatactagttcttatgcatgtaattagtaacgattaaattgacttcctatgctcttaacgttacaaatcaaatctattaggtggataaaaaagagtcttttgatagctctcagctaaccctaccatataacaaaaacataatttatcacatggacatgataaaagaaacggcgtcgcttcacgggttatgtttccactaaagtagaaaatatgatgaaagttgggtccactggaccggagaaaccgccccatatagaattgattagctccgtcaattgcatcggcaccgtccatacagattaagtccaactccagttcagccgtcccaaccactcctcttatgccacgttgtttagtccccatattcaacaatcatttgctctcactcctcaattccaaatttccaattgcaattttcttacgtatattattcagtattcactaatcactagtctgtctacaaaaataaattggaaaaataaaaagtgtacatagacaaaaggaatgtggtgtaatgtggtgttcatggccaatgttttgccacgtcacaatatccttatcgttgtagcgacatttctctgctcttattggattatatttccacgtcagaaaggtgctctctctctctcggtctctcccctggttttatttttgttttctttcatctttgtcgctttctgttttgttaaagaattgtctactcgatattggttacgaatggtattgttctctgtggaaaaatgggttaatttgttatgataaacattttttgttccaaacaaataaatgttctttcatttcatagtaaattttttagtcttctgaacacacgtatatatatgcttgctaacaatgaatccacaataacagatcataaaattacatctgactcatatgtaattctatcatgatatgttgagtcaatatatagtcgatggagtatatatagagttataatttgattgtagtgtcctatgacagatttaacactcagcttacaccgaaaaagttaagtctcaaataaattacgtatttatgcgttatttaacttattatacaaaatgacctaaaataccatttcattttcctatacaaatattcgcttactatatatactatatgtttaccaactatcatgaaaaagatgcacgaatgatccagaatgtgcttgaaacggcagaaaaacaaaagaatcgtgtgacacgatcgagacaaatactttactaatcatataaaatcattatttatcaaaaacttaaaaagcacctacagtatatgcaatgtggatacagctaaaagataaggtatgtatgttaacacacaagtatatatgatcatcattgtcaaatatgttcacttatataattgctcacgttttatcggtttttggttttttgtcaacggtcaaattttttgggtgatgcctaacaaaatttaatgacgtgactcttgggacggtgatctatcagtagcatttaacaatctagttatttggaaatgaattacagtatgagatttatactatttgtataaacttttcaggaaatgttaaattatatctttaggagattttttgtattggttctcactgatttagattatcaagttactgagataaaaaaaaaattaatacttgttttagatttcctttagttaccactgaccaacttctttagcaaaaaaaaaaaattaccactaaaccaacttatgcattcgttacaaaaaaaaataccataaaacaaaacatcaatgttgtaagttgtgacattaaatcaaaagtgtcaaaatcaacagtagcacaaaccaagagctcactctatataaagaacctttattcttcatctcacaaccacaagccctacaacaaccacaaagcaaaacacttacttagaaagtccagaaacatccattaacacat

SEQ ID NO: 13163 - DNA, 3000 bp, Unknown
  misc_feature (1)..( 3000): cDNA_ID_2713183_gDNA_ID_2214602_Annot_ID_187097 3000 nt of promoter + ATG
ctttagccatatgtgttaatggatgtttctggactttctaagtaagtgttttgctttgtggttgttgtagggcttgtggttgtgagatgaagaataaaggttctttatatagagtgagctcttggtttgtgctactgttgattttgacacttttgatttaatgtcacaacttacaacattgatgttttgttttatggtatttttttttgtaacgaatgcataagttggtttagtggtaattttttttttttgctaaagaagttggtcagtggtaactaaaggaaatctaaaacaagtattaattttttttttatctcagtaacttgataatctaaatcagtgagaaccaatacaaaaaatctcctaaagatataatttaacatttcctgaaaagtttatacaaatagtataaatctcatactgtaattcatttccaaataactagattgttaaatgctactgatagatcaccgtcccaagagtcacgtcattaaattttgttaggcatcacccaaaaaatttgaccgttgacaaaaaaccaaaaaccgataaaacgtgagcaattatataagtgaacatatttgacaatgatgatcatatatacttgtgtgttaacatacataccttatcttttagctgtatccacattgcatatactgtaggtgctttttaagtttttgataaataatgattttatatgattagtaaagtatttgtctcgatcgtgtcacacgattcttttgtttttctgccgtttcaagcacattctggatcattcgtgcatctttttcatgatagttggtaaacatatagtatatatagtaagcgaatatttgtataggaaaatgaaatggtattttaggtcattttgtataataagttaaataacgcataaatacgtaatttatttgagacttaactttttcggtgtaagctgagtgttaaatctgtcataggacactacaatcaaattataactctatatatactccatcgactatatattgactcaacatatcatgatagaattacatatgagtcagatgtaattttatgatctgttattgtggattcattgttagcaagcatatatatacgtgtgttcagaagactaaaaaatttactatgaaatgaaagaacatttatttgtttggaacaaaaaatgtttatcataacaaattaacccatttttccacagagaacaataccattcgtaaccaatatcgagtagacaattctttaacaaaacagaaagcgacaaagatgaaagaaaacaaaaataaaaccaggggagagaccgagagagagagagcacctttctgacgtggaaatataatccaataagagcagagaaatgtcgctacaacgataaggatattgtgacgtggcaaaacattggccatgaacaccacattacaccacattccttttgtctatgtacactttttatttttccaatttatttttgtagacagactagtgattagtgaatactgaataatatacgtaagaaaattgcaattggaaatttggaattgaggagtgagagcaaatgattgttgaatatggggactaaacaacgtggcataagaggagtggttgggacggctgaactggagttggacttaatctgtatggacggtgccgatgcaattgacggagctaatcaattctatatggggcggtttctccggtccagtggacccaactttcatcatattttctactttagtggaaacataacccgtgaagcgacgccgtttcttttatcatgtccatgtgataaattatgtttttgttatatggtagggttagctgagagctatcaaaagactcttttttatccacctaatagatttgatttgtaacgttaagagcataggaagtcaatttaatcgttactaattacatgcataagaactagtataactatataaggagctccttctagaaattaaatgaaggatgatagaatctagataatcagaaattttactattgatcaatctagctatctcgtagttcaaaaagctttatcgttaacaagtaacaactttcaagtattgcccaaatagataaggttcataacttcatattttttatttattttatgtgtaaaagagtgacagtctatattattctagggggaggacaaggctcatgacataggacaagagaaagaaaaatatagaagcatatagtatattagggtcggtccaaatgaaaacaacgtttaggtatggggcggcgaggctaagttaaattaaccacaaaactccattatcaaccataattttagaattaaaaggtctctgttcctattgatagctccacaatcattcttttaaataatcagaatctcaaataagttcatctttagttacagatttgtatcaatagttgaagttgaaaccaaaataataataatttagttatagttaattttgtcaacaaaacaataccttaactatcatattatgacaaacactaattgagatgaaaaactcttagcagtagctaattcttactatcatcagttaattatactaatgtatatggaaattctgcttaaacaaaaaaaaaacagtggaacatgaatatattaagcaaaatcagtttctattgattatgtagcaatgattagattggtttagattatatatcatcatgacagctagctaggtaattaattagtgaaagaaagtttccacaaaaataatcataatcgtcatacacacaattctatattcatttcattgaaacgaataataaaaacaaccataagcctaccaaaaggaaaacattatcgtaatataatcaatcaataacacgtatacaattattaacgtatattgacaagcaaaattaatgagagcactcactatagctatagtctctctatataaacaactttcattcgtctcttcagtcttcacaaacacaacatatccacaatacaaaacacaactttcatatataacaaaaaaagttatagaaatg

SEQ ID NO: 13164 - DNA, 3000 bp, Unknown; identical to SEQ ID NO: 13150
  misc_feature (1)..( 3000): cDNA_ID_2995137_gDNA_ID_2214602_Annot_ID_187082 3000 nt of promoter + ATG

SEQ ID NO: 13165 - DNA, 3000 bp, Unknown; identical to SEQ ID NO: 13158
  misc_feature (1)..( 3000): cDNA_ID_2702176_gDNA_ID_2214602_Annot_ID_135576 3000 nt of promoter + ATG

SEQ ID NO: 13166 - DNA, 3000 bp, Unknown; identical to SEQ ID NO: 13157
  misc_feature (1)..( 3000): cDNA_ID_3409327_gDNA_ID_2214602_Annot_ID_135578 3000 nt of promoter + ATG

SEQ ID NO: 13167 - DNA, 3000 bp, Unknown; identical to SEQ ID NO: 13156
  misc_feature (1)..( 3000): cDNA_ID_2685906_gDNA_ID_2214602_Annot_ID_135580 3000 nt of promoter + ATG

SEQ ID NO: 13168 - DNA, 3000 bp, Unknown
  misc_feature (1)..( 3000): cDNA_ID_2702188_gDNA_ID_2214602_Annot_ID_135582 3000 nt of promoter + ATG
aaaatcttctcttcttcaatgcaaatttctctaaactctgttcatcatcgtcgccaaaatcaaaatggaactttaatactcctggattcgccaatggctactggatcaaaaagattaatacaatgtggattccgattcgcttcctttattgctttcttaatcatcctcttaactcatcaatcaaattgactattaatggataaaatcaaagtcatctcgatcaacggtcaagatccctttaatctctgagtttctcgaacccttttgatacgtacagctgaggcccaagtacagtccaaaaatataggcccattactgaagaaccatagttaattaataaattgtttagtcgacaataagacagtgaacgggttttaccggtagccggtgaagttggtcagagaagggattaatgtcccggcaacgtcgtaactcaaccgctttaatttgatttttcttaaatataaaccgatactcttcatcgctcaaccatcaccaaaaaagaaagcaatttgtcttcaaaacatatttctctctctaaaacctctttttcataaaaggttgcgtcatctatacgaatccatacgtctctttgcttttctccgatcggtcttcttttctcatcgccggaacgctttggtaatgtttctcatttctccgatcattattgttgtttcgccgttgagctgattatttcgtgttggtatgtataaacaagccgatcgttgtttccttttttctcttgtgattgtgtgatgatggattgtttctttttttcggtttaatccggtttattcccggttttgctgctacatcggtgacttttcccacaatcttcgggtatgatcgcgatcatgtccgttaaccggagtcggttctgataatttcagacttcgaatttgttctctttcacgtagttgttagctttttaagattccgatactgagaagagaccagctcggtgattagaggagatgttgtaagctttgtgttttggttagctgttgataatgttgttcaggctgctacttcagcgatgcgggtaagctagtttgggatatagtgtattagcataacctaggcttagctggtttgtatcctgcaggctgcaggtttagtggcaatggtggtttctagttctatcatacctttctccaccacgaacctctggtagttgagaaactggagaaaagcctaatcagtgattcaagtgtttggaagatttgagaactagtacggctatagtttcaggtcagaattcatcttcctctttgagaacttttagaaactttgaaattatggcatcattcttaaagaaattgcattgataacacatttcaaacagatgttagttcctcatgttagcccattaggattggtggctggcctatccttgatgtattctgatttgcggattgtgttgtggaccttcttggttgattgggaaagcaaagcgaacttgaactcaagtcatctagaagttattctgatccataggggtaaggaaataaccataactagtctctgccatcacatgtgtaccagagtgtgtttagtcagttgaagatgcttgaggtacggtatccatgagtggggaacttcaatcttcctaacaaactacatctatcatataatggtttctagagtgacatgctgtcacgtacaagcatttgatttggatgcacaatgatgtgaaacataatgctaattttaagaaagcatcctttcacacaagcccgaattcaggagtctattaaggtgtgctggtgggtttgaagacaataagagcgcagaaatagtaaatgaggtagtaagcctttgcaggctagtacttttgtggactaaatccgtttatctaaggaaactgtagtgtattcaatttgtggatcagaggagaaggaatagaatttggtgttctcattgtattagtgaagtcaagggcctaattgcttcctgttggtctactttaaaggtgtgcagaaatgatgaatcagtgatcaatcaagcacgacggctttatcacttgggtagtgtagtgtattcgtggttaggactttctaaacctatatccttctaggattatttgcctgcaggtgcacttttgagggtttcggttcagaaaaatattttaagcttaagtcctgctattggattttccatgtaattttcttgctcatgtcatctatggttgtaagtttagtgaaatacatgtacaaggcctttacttgaatataaacgaagaagtagtacattgatagaaactgaaaagatgatatcaagtgttacctattttgcatgaacttgctctgatgctcttttatgcggatacagtatatgataatttgccatcgtgccttattctttcatcctcttctatttcctaatcagtttcctatagacttttctgtaaattctatagactttttgaaagtgtgtaatttgatgaactccttgtattactcttcacttttgatggctctggtttggagagtcgagaaccttagtgatactttaaatgcaaaggcttcttagtttcccaaccgtgcttgttttctgcctctcttttcttttggtttaaaagaagtatgtctgttgttattgacaaactcttctatgtaagtttttcttatgaactaaaagatctgtactattaaggtttatttttcatgtataagcatcatgaactttcctgcagcacagagcctaagtccacaaaaacttgtttgcttatgatatcatgagatctgaggtatataatatggtaggtacatgttacaaaggtaatggtactagagcttgaaactatggactgatttcttatatatttacttgggaaatttggctatcagactgaaagtaaactatgttggttggaaattatagattttttttttttctgagcttgcggatgttttcctgggattttgaatggtgagagaaatttttgtgcaggtttaatggggcacagacattttcttggttcatcccagttttttgatg

SEQ ID NO: 13169 - DNA, 3000 bp, Unknown; identical to SEQ ID NO: 13154
  misc_feature (1)..( 3000): cDNA_ID_2702192_gDNA_ID_2214602_Annot_ID_135583 3000 nt of promoter + ATG

SEQ ID NO: 13170 - DNA, 3000 bp, Unknown; identical to SEQ ID NO: 13163
  misc_feature (1)..( 3000): cDNA_ID_2713183_gDNA_ID_2214602_Annot_ID_135584 3000 nt of promoter + ATG

SEQ ID NO: 13171 - DNA, 3000 bp, Unknown; identical to SEQ ID NO: 13162
  misc_feature (1)..( 3000): cDNA_ID_2713179_gDNA_ID_2214602_Annot_ID_135585 3000 nt of promoter + ATG

SEQ ID NO: 13172 - DNA, 1462 bp, Unknown
  misc_feature (1)..( 1462): cDNA_ID_1837267_gDNA_ID_2214603_Annot_ID_135590 3000 nt of promoter + ATG
gaattccttatttctttataaggacatacactaatttcctaatttatcagatgtccccaacatagacaagtacttggtatcatgtcaaaaattcatctcaagctactttcattttttcacttaaccgacctgcaaaatgtttttttgtctgcaaatccccaaatacagagacatcttgtgaagaaatcatggagaatgatagataatgtaaagtccatttcaatattggtaaattctaaattcagaccttattataaggagagatgatcaacactatagtctgaaatacctctaacacaatatctcattctcttcctattaagaagcattacattcgaaattacgaacaaacaaaaacgcatggaaccaatacagatggtgagaaaacatagacaagaccccaaatgtgaaaatgtggagagaaatagtcattggccggttttgaggatcttcctctgcctgaggaatctagcgattggaggagtcaacgccatcgtgatcggaactctgatcggaaaaagcgccttattgcacaaaaccgccaacgctagggctccgccggccgatttcgcaagctgtttcgtcttgttatcgctcgtaacggaaccttgctcttccagctttaaatcgaggctagggttagggttttccttgctggagaaccatgggatttggtatttctccaagagcgattcgacatcgacgttgttcttgatcgcgatgtagaatccactaattgagacgccggagaccgagaaatggactccaagcgcgacttttccgtacttcttcacaatctccttgagccgagtcgccatcgaaatcggtgattttcagaatcttccagaagcgaagccgacgcacatgaggaaagaaggtttgttcagcttagggtttatcttcatttaaacccctcttgggcctatttcggtccatttcaaagcccgttagtattcttataaacaataattgtctacatttgcgcctattaaaaaataaagttgtcacctttttagtagccgaaggattgattcgttatgacgtttatggtcgtgtaaatgttaatttttcttagtagtttggtcttcatatttttcaaagatggttgccaaaattgaccaagtcagtgtcagtggctgctacagttggatagaagcctccatcatcaaatcaattatacaaatgacacaaatttaatatttgtcgtgattgtcattttcaggttattaacttgcatgaccacaccatgtcgtttctagcataataatataagagtaattgttggagacctttgtcttctcttgatcttctcagacggcagttcataacaaaactcctaattaagaatttggtagttggatcccaggtacttttttatatgcacacgattctattatacaatggactctggctgatcgaattgtccggtgtacacgcaggtttgcataccgatccggggatg

SEQ ID NO: 13173 - DNA, 3000 bp, Unknown
  misc_feature (1)..( 3000): cDNA_ID_2710549_gDNA_ID_2214603_Annot_ID_135591 3000 nt of promoter + ATG
atcttttgtaattgcagcatgaacgtggaagagactacagtagagaaagatatgaagctgaaggcaatgtaacttcccggaacagaccttcaagcccatttcatccatcccaaagccgctctccaccgccacacgcaagggttagtggattcaatcattcattctctgatataacgcctttgttaatcattcattctctgatatattggctctacttagttgcagactcagagatacaacaacggaaaagatcatttcgaggggatgtacgaggcagatgccgatatcacaccgcgtaacagccctcccatgagtcctgttcatcaacacacaagctactctccaccaccgccgttctactcatccagtgacgacgaagacgacaacaattccacctatctctttccagaaattgccactggacgtcgttccaggggagtttcaggaagcagcacggttcgtttttttctctcgcgggtctctatttaccaaagtgtgaagaaaatgcttaaattcaaattgctttggtttgtgcagccggttcactacaagtatcagatcacatcggtagagacttacgagcaggagaggcaattcgagccgccggagctgccggacgagtcacagagcttcacgatgcaggagatcgccagaatgcgcggacttcaaagctacggaaaggaagagatacaattagcgatatccgagacttacgtctccgtcgccaattacaaggtacggatgagcatcgccgccacgctcgaagcgatcattgacaaacacggtgacatcgccgcctcgtcgaagttacaatctacctcaacgaggtcgttttatctcgaatccctagccgcagcagtaatggaactgaaatcaacggcgttgagagatctgacgaagacgcgagtggcggaaatcgcggcggtcgtgaaggacatggattcggtgaaaatcgatgtatcgtggctcaaaacagcggtgacggagctagcggaggcggtggagtactacgggaagtacgacacggcgaagattgtgagggaggagtgcgatagggaaatgacggcggggaaaaaagagatggaggagatgagggaggagctgcggcggagagagaaggaaacgaaggaatgtagagagagagtgacggagttggcgggacggctggggcagctggagatgaaggatgtgagagtgaagaagaatctggagctctatgagagcaaggtccttaaattcgacggtcattcggttctcgttgactgaacccgaccttttggaaatttaattaaaccggtttagtggagtaaaccgctttggaaaatgcttatccaagcataatcactcggagaagtctttgtttgttggaaaagagggagggagaaggttcatgctcattttttaaaagtcctcctatctattctaaacgttgtccatgtcaacgtgtgatagttgaattggtaagcataaaatcatccccaacaattatagtccgctgttatcatcgcgtttttgcgttagtttacggaaaaggtatagacgtttgatactgaggttttgtggacgggcctctagttgggtttgttcgtggcaactaggatgagatttcagctccttagagttgtggaaattacgtaaatttctaaatttggcatctcggaatcggtgtttcttcttttatttccgttatatacatatgtttttctcctttgctgttttgtcattgtctgtttttctgtacattttgttatttttttgctactagtactctttgtaacttcaatcgaaatttcgaaaattgtataaatatttcatattttaccaaataaaaaaataaaataaaaattagtatataattcaatatttgtgattctgactctggaaaaccattttgtggtcctctcttgaccgctttcattgaaaaacagttggtaaggtcacttttactactgctttgatttcgattactacctggtttttgtatttgggctgacagaagaaactgggccttcgaaagggcatatgttgtctattcctttctaccgcctatataattagggaaacgcgtcaaacgttcaacaaaagctaaattacgtgagtgatagtagttttttttttgttaaaaagatattcaattttttgttgttaaaaattcccccaagaatttaagaaatgataaaatataaaaataaatgtttttcaattaaactttgtcaactgagattcaaatagagcatttaaatataaccaaaaaaaaaaagaagaagaaaggaggaagcaaatgataatggagtaatgagaacacaatgaagttagagatctcctaaaatctttgattcttttcttctgcttagttagactgaaacctcttcgatccattctaactttgacaaatacataaaatactaaaagaaaagaaaaagaaatagccaattgacgaagtctcggctgaaactataaaatgactcatttttttattgcggtcaaagtcaacccatgttagaacccaataagatattattatatatacacctataagcttcattggctatctctcttatgtacagacaagatgagataaatcattcatctcatttcttcaactggctttgcttctttctttcttcttcctcaattataattttttcacaggtatcatcaatctctattctctcttgacctttttttttatctagcaaaagcttttaattagctgattatgagagtttttgcaatttatcaacatcacaatccgttattgattagtaagaaaaccagtggaagattgtcaagtctctctctttggagaagaaacataattaagcaaagagaaaacatgaatcttttattgtagtttccatatatagaaaccgttgactctcttcttgtgtgatgatatctacttgttttgctgggtcaatggatctgacgcttttttttttctttttggaatggtcaggtttgagatcttatcatagagttttgttttaagtttgtgag

SEQ ID NO: 13174 - DNA, 3000 bp, Unknown
  misc_feature (1)..( 3000): cDNA_ID_2713225_gDNA_ID_2214603_Annot_ID_135594 3000 nt of promoter + ATG
ttatacatcagtacaactaaaaaaagtaacaactcaggaagatggtacctcttctctgtcgacttattcacagcttcagatttcttgtttacgttctttgatgccttttgtcctgtaatttcaagatcagtcacacatttcaccttataagctttatttgtattgtgtcaaatgagaaagaagaagcatactggccatctcgttcaagaaacgtattccttgtgagtgtacattaggggtcactttatccgcgccactgcataatcacaattggctttagaatctgagaagcgggttctgttcgttatgttaaaagtaaaaaacttgttgagagtttccaaccttagagcctttcggagaccttccactgatagcactcgaacaggctgagtggtctttttgtttccgcttctatctgctggtggctcaactgtgtaaatcccttgcgattttagatctctgaacgctgttctcaagttcctgaaatagaaaaacatcccaagaatcatgaaaatttccaactcgtggtatgaccaacctatgaacacgactaggtaggattagcataccctcctttgagttcagttctcattgtagcaaatttgtctgatgcattctgtgaaaaattcatagttagtgaaaaacatggttcattgcattgacgccagaaaacaagaccaaagtattaccaaaatgtaccagtttatgaatcttgcagaatgctccttggcgcctgaaaccaaattcaaagttgtaactcaacattcaggaaacaatacaaagagagatgcatcgctaaggtaaacttacttgtttacaacagatgtacaagttgttccatctttccgctttgctgtgcagactccataatcagctgaaacccccagtttaaccatttgtttagcagagttgacactcaatgagaactcacgtccctgccacaaacataaattttttaaaaagaagatttagttaagccatccggctactggaaaagctgatgctatatacttaccccattgtccttgcgaagtgagcaattaaacagaccgaaaaccgttcctgccttttctgtctcattctttttgtaagcatcaccaaacaagaacaaggagacattgttttcatttaagctaccgatcttccatataccataagcctgcccaatggagcttgttttgggttgtcctttctctgttatcactcccattgtcgcccagcagccagagagtttgtcacccattagcaagttcctacacagaaacttgttttaaatctcttctgcttcccaagagtagtaagtaatgtttatctatctaagaagtgaacaacttactttattgttggcaatcgaacgaaacggatatctgaaaacagatcacttatctctgcagggctaagtaattgattcctacaaatacatcaaaagattggctatttcagctatagattggaactgaaaaaacaatctacgactatagtagctgtgactcacattgctagagtgaaaagggtttagctttacctaatgcgcaagccagaaaacttctcaatgtcattggtattggagttgttggagcctttgggtttagtgtttttggcgattggtttaggattatagtcaatgcaatcttgaacaacacttctgaagtcagacaagtcagagtgacccctacgcttgggggattcatcatccgtgagatatcctgcacaaacgttacctcgcattaaggacaagaacaatccaactgagagaaaagcatcaaactttacagattcttgagcgaattagatggaaacaagacgcccccagatcaatattcgaatcataagatctattacgcaagtgattgatcgaatcagagatgcaaatcggaatcgcacactggatttaagaaagcaaaaaacaaaaccctacaaaagtgagagagaaactcaccgggtgcagcagaaggagaaccaggaggagtttcgagaaccctatcgtcaagagacagaagcaattcaagatcctcttggtcgttttccatttttcaatttcacgatccaatagcgatgcacaagaacacaaaacaacatctcgtgggcgggagactgaatttcgttgcccgccgaaacgcataagcgacgccgtttcgttgttaataaataatgtttcataccacccggttttaccggttcgtgagaaagatcaggatggtgaaataaaccggaaatttgagtgacgatagtgtcggcatggcatttttttttgtctcttaacgagagagagtaaataaaatagtcagatgtcttacgtggtccatcaacaaccacagggccctaattgccaccaacatccacttaaagtgtgccacctgtcttaatcatgggcttcttatcaacatgcgatggcccaatataagatacttacccttctctttcaataattatccaaatgtgcccaaatatagtttttagaacaaatgaacaattatatatgttttcgtaaacaaaatactaattttctttgaaaacatatacgtaaatttcaatattgatgtatgtagaaagttatgaaaaaggaataagattttcattaattaatttattatagtatcatcagaaagcaatgttattattcgaagagagaataaaaattaaaaaaattaaattaaattgctgatattttttatttttaaaagtaaaagacaaaaaaagaacaataaaataaattggtccgtgtctttagcagcgaagcgcacacaaagtttgcttgccttctgggcttcacgattctcacgacatctgtttatcttctccgatttccacgtccatggatctcagtcaatgttccttaatctctcttttcgattagtccaatctccactaatctctgacctcagatcgcttccgacgccgctgaactgtgtccgtcttgatctgtgtttaggagaaagcttctagggtttttgttttggttgctgagtagaatttgttggatctgaaacggaaatcaaa

SEQ ID NO: 13175 - DNA, 3000 bp, Unknown
  misc_feature (1)..( 3000): cDNA_ID_2713221_gDNA_ID_2214603_Annot_ID_135597 3000 nt of promoter + ATG
cacaccgactcctgacgaaccggctccttgacgaaccggctccttgacgaaccggctccctgacaaaccagctccctgacgaaccgcctcctgacgaaccagctccctgacgaaccgcctcctgacgaaccagctccctgacgaaccagctccctgacgaaccagcttcctaacgaaccgactccttgacgaaccgcctcctgacaaaccaagcttgtgacaatctacaccgaataaatggtctagccgaaccaagctctccatgccatgttaatctcttcgaaagactccctcaccattacgtgacaagtcaagactccctcgtcgtgatgagccaacattctcaccattactagccaacgtcttttcctctagctaaaccatcccgcacaacaaagtcgtctcgcaaagtataatcatcaagtaaaacatagccatcccgccaagtagagccatatctccaaacgaagtcgtatcgccaaaccctttactgcaagcggatccatcgctaaacaacttagctcctcgtctaactgtcgacgtcatcacttaactgcttggctccaaagcgcatagttccaaactacaagctttcacctatgtaacatgaactacgaacggcttgatcccttcaaagggtacgtaggcagcctctaccgaggcgcatctataaaataaataaacttttgtctgtcaaaagcacgaccgagttctcgagtattcaaaggaagaaattgtttaccctaaaaccctttaattacttattgttacaacctcagtacaaacactatcctggaagaggtgctaaacactttcacgtgcattttctcatggattggaggctcctccagcataaaggagaactcctcattccactttgggtctttgttcttctttacatgctttgtttttctctcctcccctttgaagtagatgtgcacgtaaggattggtatggtgctttccttcaacatcctcagccgaatgcactattaccacaaacattcctccagcagccggtgtgccttctggagctttctgaaccgcttgcatttcttccttcgtgaatgacttatacaagagttcaacttccagcttccccctacaagctgccgttcttgaccaccgtccaaagtcttacgtagttccaaagtgaatgctttatgttcgtcaagcaccatttctttcagatagagtttcgtatgtccgagaattttgaagtaaacaaacctaaccatgttatcacctagattgagatctataccttatttattgaatcatgacatcaggagaaacccccgatgacctaacgcttctcttatagtttatttaaaacttaaatcaataactcaattaaattatatgcaataaaataatatattcgatagacttataaaatctctaaatgagttaccgactgtcacgtcatcgatacacggaagagttatgttgtaggagatttttcagattgtggtttgacctatgctatatttatttgacatggaggtttatcttgcaaaaacaaaattacattgaaggtttttttgcacaaattcttatgttttctaatagagttatcgagtgccacgtcatcgatacacgtaaggattgtattgcaggtgattttagagatggtgaagttgacttgcataattctggaaaatagtcatatcacattcgcttctcttcccactggaggaaatgatctcaaacgcatccgcttcaggtattttaactactcaaaacaatctctatatcttcatgacattcaaagctggaacatgagataaaaactaaccattacttgtgtcttgttttgaaagccgagagatgtacaataagtggcaagctcaacggcggtggggtgagaactatgacaagatcgttgagctttacaatgtacagagatttaaccgccaagctctccaaacgcctgcaagatccgacgatcaggtaaaagacatatatcctagatcctttggtctttcttcagacaagaaccttgtgaatcttgtcctttgatccaaagaaggtaacacaagtttatttttcagtcacagagagattcaacatactcaaagatggattcagcaagagaaagcaaagactggactccaagacacaacttcagacctccaggatctgtcccgcatcacttttatggcggctctagcaactatggaccaggaagttatcatggaggaccaccgatggatgcagcaagaaccacaacttcttccagagatgatccaccttccatgagcaatgctagtgaaatgcaagctgagtggattgaagaggactagcccggtgtttacattactatcagacaattatcagatgtacgtcgagtcagattcaggtataacaaaacatcttaaactaagcattggctaatcatatacattttgaaagttgataatcataccgtgactaacaggaatctatgattttgtggtttaatcaacagccgggaacagtttggggaagtgcatgttaagacatggtgggagcagaacagagagagaatacaaacacagtacctctaaaaagaaacattatgagcttctctaccacaatctttaattaattaattaatctcattcacataacaacacaactatatacattttgcttatcttttgttcatcttaattagcttaacatcttatacataaatcaagtgttctgaagtatcatctctaatcaaagctgattacatataagtataattatcgttaaatgctctacacgttttcaagtaatgtaaaccatgtcttgtttttgtgacacaaagataaagaagtcaactatgaacctaactattctttaattctagctagatctttctcctctttgggggtttaaaaatatcaaatgttagttcttttatgatcaacatgtggtatagaatataaaaagtcaactttattatttgcttataaggaatacaaagtagagttgaccatttgaggttttagatgagcaaaccataaacatg

SEQ ID NO: 13176 - DNA, 3000 bp, Unknown
  misc_feature (1)..( 3000): cDNA_ID_2702224_gDNA_ID_2214603_Annot_ID_135602 3000 nt of promoter + ATG
taatgttcgagattgtattattttttccttttcgggaaactaaagggagcgatgggcccgctttgatctggacggttggggatgctttgcaggaggcttctcagccgttagattcaaatctaagagttgaaagttattcaaagcttatcttcttcttctcccgaaaagatctaacagagtgaagggtacaatgggaaaaagacaagtttatatatttaataatttaatattattctggttcagtcaacattaaagttgacggacgtaagcagatattttgactagtcgtcccatatttttgggaacgcaaactgcgtgccgtttctttttttatttttattttattacgctctcgtacaaataaatagtggattttcacagagtagccccaaagtttttttgtatgtatttattttggtcaaaatctcaaaagagtggtcaaaagcgtaacgtccatagtccaaatgacatgacgatgggacctgtcaatgcacatttacactttccaaacaaaaaaaatactacatgtatccaattttgaaatctttagttttacccaaaataattcaatgaaaagatgagtttggttactaatagtagtttggccactaagtttatctgtatcaattatgattctatctacctatatttaaagaagtgattgagctttaaatgtgcctcttttaaatttatgaaggtatgaatgatttgaatcccaagagtttgtaaagatgttttgactctgaataatgacaaaaccgcaaagtgtgatacagtttcgatagtaacgaaaattttgtatatatttatttaatttattattatttgaacctcaacgcaacttatcgaacaacacatttttattcggagttttagttatgggatcttcgagtttttatctaacatgaaggtcatggaatcaacgtttgtttcatgtaagtgtgtgataatgtttaactttttacttgcgaatggaaaaccatattgatattatgacattgtatattaaagatgtctaactcttttagaatcatctaaatgactcacatgtaaaaatttaattggtaggttctaaaggcatctccatcagtgagataccttattggtttttaaaaaaaaatatattagtattttaataaatattagttctataattaaattttaataataaaataatatttgaccaatagatgatatacaagtgttcttatgggtttttcagagtttttcacttgagagactaattttactctctctcttactttttgattatattttatttttatattaaacagtttttcaataaaaaatcattgatggagatggtttaataccttaattatcatctcggaataatagtagatcgcaaaccaaaaactaaaaaagaaaatatagtagaaaaatatctaatttttaacatttgctttcacactaatgatactagctaactcggctactaatttttattttgaaaaacaaccattgaaatatatagactgcaagcgtgggtttttcccatttttctaatttccaactaagaaatatggacaaactaaaacaaaaaaattaacagattttacagtcattgtcgaagaaaaagatggtatctctacacatatactttacacttttacagtcgttgctaaatcttttatgttggtaaattagctatataacttcaataattagaacctttttttttgtcatgagagttctcttcgaatattgattagttttagaaaataatcaataattcgtaaacacgtatactattaaaatacatttgatattgtagttgaagtgtgactttattaacttgaaagtatgtttcatcgagtaagaatgacattcatgctaaagtatacttaagctctggatgattttttttttcttgatacttattggctccatcttaataaaaaaaaacagaatggcagacgtaggattatataatttcgactaagcatcctctctgttctactatgtaaattcgaatacatgtccgaataattaggactttgaaaattctccacaactacatgatcataatgccaattctctttgatttaattaatttttatttttgataaatagactactttgttcaatcgatcatcgggtttggagacacaacttttttacttttttagtaatacattttttataagctcttgttaaaaacaaatacattttcgcttacttatcaaaaatgaataaacttattcctagtaatatttttttttttggatcataattcgtagtaatatatatgatggtgattacatgagacaatgatcttgagtcaacaagtcaataatttgtagactaatagaaaaaggttttaaaatgttttagcatacaaataaaatgataaatgaaaaaactaactgaatatacaaatgtaattggcttttaaaataaggtgctacttaaaataggatgaatctaacgaaaaaacctaactaaatcctttagagtttcagttagtgattcaacacttcaactttttgatgctattataaccaatcttgcgattcttttaggcgagttgggacgaaaaatttaataaaactattgatgagtagaattattttagtctttttaattatttattttggagcatgcacatgatagaagatttatcagtttcggattaaaccccgtttaagatttttccacatatcttataaaatattaatttttattttcacttctcacgaaaatatttatattatttttttattggttaattagttaatatagtgaagataaaaggaaactttaatatgaaaagaagattatcatatttgagccaaaagtaattaaaaataataattttgttgctcgaacgacgtcgctttgctgggagcgcaaataatctccggcttctgatcaaagccgctaactcaggcagaggctttaacatgccttcactccagttcaccgccgttgtcttctctctcaccgacggcttaagttttatctgtcggagtagtttca

SEQ ID NO: 13177 - DNA, 3000 bp, Unknown
  misc_feature (1)..( 3000): cDNA_ID_3028499_gDNA_ID_2214603_Annot_ID_135603 3000 nt of promoter + ATG
gataaaaggaaactttaatatgaaaagaagattatcatatttgagccaaaagtaattaaaaataataattttgttgctcgaacgacgtcgctttgctgggagcgcaaataatctccggcttctgatcaaagccgctaactcaggcagaggctttaacatgccttcactccagttcaccgccgttgtcttctctctcaccgacggcttaagttttatctgtcggagtagtttcaatgcggagtgggaagaagagagctcgctcagaacctggatccacaaagcaaccccgaagcaaatactccgacaacccaccggattttgcctcgttagcgtctctttacccatctttcaagccctttgttttcttctccggtagtcgagctcgcatcgactggaccgattacaacgcaacccgagagctcactcgtgtcctccttctacatgaccatggcgtcaactggtatgatttcaattgtacaaaggaactagcttttttgctctcaagaacagttagttatttaccaaagtcttatatatataggtggattcctgatggacagctttgcccaactgttcctaatagatcgaattacattcattggatcaatgatcttttgtcctctgggatcattcaaagtttgggtggtgatggaagtaaagtaaagggctttgacattggtactggggctaattgcatttatcctctccttggtgcatctctttttggttggagttttgttggctcaggtttttcttcttcttttattatacttcatctgcattatactagcttctttagtagttggctctatgttctcaatttggtgacaatgttgttttgtatgcagattttactgttgtagctctagaatgggcagagaagaatgttcaaagtaatccccatttttcagaccttatcgagatcagagactctaaagttcctccacagtgttcctctgtccctgaggttgaaaatacagagagggagaaaaccatacaggaggaagctgaaatttccgccacggttaagtctgattatcatgacaacaagagttttattgaaccagctgtactactcggtgttgtcaaggaaaacgaaacattcgacttctgtatgtccaatcctccattttttgagacctttgaagaagcggggctaaatcctaaaacttcatgcggtggaactcctgaagagatggtttgcaatggtggggagcaagcttttgtgtcacgtattatcaaagatagcgctgtactgaggcaaagattcaggtaaattgtacccaaataaacctttggatcttccacattctggttttccatccatcaggacttatcgttttgtgaacatgtttaatattaggtggtacacttcaatgcttggaaagaaggctaacctcaaactcttgatatctaagctttgggaagtgggagtgaccattgtgaagaccactgaatttgtccaaggtcaaacatcccgttggggcctcgcttggtcgtttatgccaatagctaggaagattatagcacctcctgtagtcaaaaagagcgttctttcttttatgcttgaggtattctatctataactttcgtcatcctttacttatatttgttctgtaactatataaaagtctcgggctttacaaaagccttacattctccatggtggatttgtgtgtttatagtgcattaaacggcagtacagtgccgtagatgtgctgcaatcagttgaagaattcttcaagagctgtggcgcctcgtgcaagttaaactcttctacattttctgttgacgtaagtgcactacctgtattgttttgtcttgccatccaatcttgtttctacagtatctcaagctcaatggagtttctttctattgttgtgcagattgttgcatctaatgaccagtgcaacacaatctcaaagaatgacattgcagatgtagatagtgtaagaagccatggatatgaaaaacagtcactggatggctccagtttgcaagtccctgaatataacctatctttccgcatcttggtatgtttggatttcatttgagaaatccctaacaattgccttcaccttttcgaattgtttatgatgaagaaacttcttttacaggtgttccaacagatgccaggaacgttgcttataaaaggatcattgcagcagaaagatagtcccctctcaggttagtcattttgctcggtttccctaagttgctggaaaaaatttcacttctttattcatgaatctgcaaaagctttggttctattcatttgatctcaccaaaatcgcgaagtaccaaaactttcgctgttagttaccaacgtgaagacaactgaattgtcggtttaattttgcatatgcaggattgttctccagggtcttcggttcgttggaagaaagtttgaagtccaaattttgccggtaacgagtcccagggtactgttctgacttgaagactggcatctgtcaaaaactaaatgaaaatgatgaatcttcaaatcttagacacatgacatgttcttacacacaaaaacaagccgtcttttgaattgattcctacataaactgagacaattactctcaacagaagcaagcaaacttttttcagctaatcttgttgtggatgaaaagtgttgcatagcagaccactcgtgtttctcaactgcatatataactagaatcaagacttgaaaagacttaccttacggggaaagatacacagagccaagttggattacccaaaagtagtaaaggagagagagagagagagggttcttcacttcacgtgactaagcaagttacttttgcctttctctccagtttctctttttgatcaaccatcgtttgtgatgaaaaatgtaagacctctaccacctatatatatcttgcattgcatgtgggtgtagttattttgaattgtcattttctcttttcgcagtgaccacctatatataactttggtgatccctcaaccctttgattcatttggaaagat

SEQ ID NO: 13178 - DNA, 3000 bp, Unknown
  misc_feature (1)..( 3000): cDNA_ID_2702200_gDNA_ID_2214603_Annot_ID_135605 3000 nt of promoter + ATG
caatgatactccatggcacaagagaagaggaacaacaacaagcttcttcaggtaaaaaaaaaaaaactcttgcattttccatcatcgatcatatctgtttattcttctgctgccattattaagcataatactggtctgatctttgggtgttcagaacatgtaagatggtacgactcgagaaagagcatgaacgaagaacatttggtaagcctgtacagtcctgaatactaggaagaagaagatgcaatatctctaggctctcaatagattgaatgaaatttgccaaaaacaagcctcatgagtcttaaaactggatcaatcaacaaatctgcggtcgggttcatttttgtattgttttatggtcactgtacagacaaaaaagtttgtctagttaaaaaaacttcacattctttagttttgatctttgtgtctctcttcttagtacagtacaggtcttcttcttatctggactcttttgtccaaatttacactgttatatatttatatatgtatctacatttttctaggatgaaatattccttcattgtatctcacttgaatgaaataataaggtaaaagtttgatcagaattgagagaaataacaagaatctctgtttcgtttctttataaatcgatcaacgagagagacagagaacatgaatattaccattttagagaatctgaatgatcgataagtccgttatacgaaggaagacaagacttcttagattcataacaagttagaaatctaccggtgaaatcattgtaggatactaaagtgatagaagtttgttcggtggtagcttgagactttgtctttctttaccaccagtcaccaaaactctatcattttaatctcggacattttagtgagcatctaacataagaaggaagaattgtcttctctttctcttggaaacgatgaagttaagagatatatagacaagtaatgatctactatcttatccaggaaggtgacacgaaagtaagccacatgtactcaccttacattgtctagatatatagacaagtaatgatctactttcttgtaatttaggtgtagaaatagataatttctattctcatacaaattatgaaaaacagactaaaaacatataaattacaacaaaaacaaatttcttgttcttggtattatatatttcttgtgatttggtactacaaataagtcataattactctctcatattagtattcattatagcaaaacataactagatgagaattaaataataatgatttctttcaaattctaatcatttgatttgtttcttactttattttaatataaactgtatgcatatggtaaagaaatgtaacatggatttgactccagatcagtctaaagcctgacctattgagtcactatcttcctattcaattgcaacctttggtcactcttttatattacaatacatgtaaaacctctaacaaaaaacattacaggtaaaccaaaagagattaatggggaagaatttaggattagtagttagtttttatctttgcatcacgttcgcactcggcgaatacttttcagaaactcgtccaatcacaccgaaacaactagtggtcacaaatctccatttcttctttcacgacactctcaccgctccaaacccatcagccatcctcattgccaagcctactcacacaagaggagacaacgactcttctccctcacctttcggttctctttttgctctcgacgaccctctcaccgttggaccagacccgaaatccgagaagatcgggaacgctagagggatgtacgtttcctctggaaaacatgtccccacgttgaccatgtacgtcgacttcgggttcacatcgggcaagtttaacggtagttctatagccgtgttttcgaggaatacgataacggagaaagagagggaggttgcagttgtgggaggccgaggaaggtttaggatggctagaggagtggctcaactcaatacatattacgttaacttgaccaatggggatgctatcgttgagtacaatgtcactctctatcattattaacaacactatatacataaaggtctttctaaatcttaatgtaatcacttcccttggaataatttaatgcatgttcatgatttttatatattaagctgttttggttgccatgccttttaaattgtaagaaataatacattccatgaaaacaaagttagtctatgaaatctccttaaaagcatcttcaactcttttacattttgcatacatattaacaagtgcactcccgtgcaacaaaaaaggtggtccgaatcaattttttttttttttggttgcccactttctatctattactcaaaatcttaatcagtattagtactaaaattgtgttaaatactttgttaaacaatttttattgaaactttttttttgactcttatgcacattacaataatttctcttcaaaaccaaagaatgcacttgcctaccaagatcaagcattttttcagaagcaatccatcaacagtacatccaaatcgtctcgtagatgtaaactactaaaaagcttgacggatcgggaatattatggattcaatttttctatttatctcatacatgtaaactactaaaaaccacacagtttaaaactataaattacatttgaccagaagatcctatcagcaccattacataatttacatagccgagttcggagttattagatccaccaatgcaataacatagagttctcttaagtagtctaattcaaacaattaaattattaggtgaaccattacaccaccacatactgactttgtcacatatgtcccagcatactttttcttttagttaaagatcattttgcagtttggttgaactaacttggactgggtgtgattcatgtatatgtaagttccctataaatagaattatatacgactgcaccaaaaactcattttactctcacaattacaaacactttgttacaatttagaccccaccagaaaaaagcgaaaatg

SEQ ID NO: 13179 - DNA, 3000 bp, Unknown
  misc_feature (1)..( 3000): cDNA_ID_2702234_gDNA_ID_2214603_Annot_ID_135607 3000 nt of promoter + ATG
cgtaatattctctttaattgaattgttcaattaatttgaattatacttggttaagcccgtattgttgtgagtgccaatttctgcatcaagagttggcataaaaaaagagaaggagaagatacaaagggcaagggtaagagtgcaaaagaaccttctttcttagtccaaaaatgtctattcttgtaaggcccaaaaatggttcctaaattaaaagattcagcccatttaaaccccaaatcaataataacctcctataatactatttttcctcttaccaaaaaataaaataatacaaattttttgttttattgagaatttctattttgtatttattcattcgatgcattgtttacattattattattattattatcatatatttaaatttgaaatttatgaatattcatttctatagatagtttacagttttatctatcttttactatttacattactttgatttttattagtataaattaaaattttaaaatgaacaatgtaaccattcttttttacacgttctcctttttacttgtcgttttcgacataatatttccgtttcttttgaatactttcctttttgtttgtcttttttaacataatattttcgtttctcttgaatacttctccttttacttgtttttttcgacataatatttccatttcaataccatacttcggtttttttccttcgaaaattccctttttacttgtcattttagacataatttttcagtttctatgtcatatttacgtccttttaattatcaaaatgtaggtaaaaattaagaatacactatattttcattttttaaaaaattcattgaaaatggaaataagtaaaaaagtaaattggggtttgcaacattacagagcaacaacacgtgtcgacctcgggatggacaattcgagagcatttaccgtggtcaaaaactcaacctaaccacggttcaagaaacaatggagatatcgacacgtgtctcaatctaaatacccgatgatattatctcacagatattcgcttcctctataaatatcttctcttcgtcctcaacagcttctccagaaaatctaggtcacacacttttaaaatcctcgttcccaaaatcgaacaacaacaatggcgtcgcatcctaaagttttcttcgacatgaccatcggcggtgcaccagcggggaagatcgtgatggagctttacaccgacaagacaccaaagacggcggagaatttcagagctctatgcaccggagagaaaggcgtcggacgtagcggaaagccacttcacttcaaaggatcttcgtttcaccgcgtgatcccaaatttcatgtgccaaggaggagatttcaccaaaggtaacggaactggtggcgaatcgatctacggagccaaatttgaggatgagaatttcgagaggaagcacacaggacctgggattttgtcgatggctaacgctggtgctaacactaatggatctcagtttttcatctgtacggtgaagactgattggcttgatggtaagcatgtggtgtttggtcaggtggttgaaggcttggacgttgttaaggctattgagaagatcggatcttcttctggaaagccgacgaagcctgttgtgatcgctgattgtggtgagatctcttcttagattccggttgtggtggtgacggtttcaatttctatgtttctagaagtttcttcttagctaattatggactgtgatctttgctctgtttctgcttttgcgtattttcctaattaagcaccattaataataagaaagttttaaggaattgtggcgtttttgtaatactgctattaaagatttttggcgttttgtccaatagaccataaatggatattttctataattagaaaagcattatatccatagggtaatgagatccaaattgttttatatatcgatgcaatacggctggggcctttaggcccaacaaaaattgagcttatgcaagacctaacgtattcacatacctgtaaagttgttatgggcttcattcgtaatctagaaatgtcttaagagtgttgttgttacaagttttctttttggatcttataagggtcaggactaatttattaaaagtagtcgtcgactatgtacaacaaaattcatagttaatcaaatttgactataaaaagtttagtaacatgttgataaattaattaattagcaacgttccgcgtaatgctgcagctagtaagatacgcaggcatgtgctgattttgaatgataaatatgacaatattaaaaaatagagagaggcaaaccaaagaccaaacgtgtcaaagtttatatgatccctcgattttttattattattctcgtttgaatcgttaagagtacagtatagtagttatataatttaaaagtgaaataattaggtgagaaatggttactatggttaccaaatgaaatcaactacacaagtagtctgcgatggtgtgtgatagaaaaattccaaaaataaaattgagcagccgacggcgatatagtgaatgaaagcaaagtgtttctaattgagtaatttctatcgaactaattgactaaaccaaaacgcgtaccggacccggttaagcatcggcaagacccacgaattttcctgagctgtcgtcttgccagaggcaaaaagacagagagaggagagacgagagctcgtcgaaccagatctctttctctttcttctctctaattttgatttttttgaattttcttctgcaaagcaaaatcgcagaagtcgtcgtgtgtccgcgttgcatcgaaccacttgttcgattctctttcgtcatcctctcttatatcatcagcaacaacaacccttgtttcaaatttcttcatttccgccggatttataatcgcagattgattctgatcgatagagatagggttattcaaggagagacctcgattgacttcaattgtcttcctgattcgatagataagatttagggttagcttgacgttgacgttgatataggggaatg

SEQ ID NO: 13180 - DNA, 3000 bp, Unknown
  misc_feature (1)..( 3000): cDNA_ID_3439595_gDNA_ID_2214603_Annot_ID_187140 3000 nt of promoter + ATG
ttattgttgttaaagattagtatgaacaggacatgtctttaaaattctgttctgatcgggtttgtgagagatatgagtgattggtggttaggacatgagaacaaggaagcttatctcagtagcctaccataaaaaagacactcacttcaccttgttccactcattgtatatataataattacatgttgtgcctaatgtatgtcgatttcagggattcataccattgttcttttttttttggtgagtataccattgttctttttgtacaaagacaacaatatatgtaaatccttttttaaaatttgatttgattcattttaattaagactcaaaatataatgtgcaattgattaaagagaatataatacattatgtttttaaaatatagacaagatgtttttgacccaaaaaatagaagaaaaatcttaacaaatatagcatattttggtatttttatttttatccttaccaaaaaaaaattagtttggtatttttatgatatataaaaagaaatcctaattaaaaaatggtaattcaagaaatatttattccaacaaaaaaaaaacagataaatactttcttatagggcctaaaacggtttttgtgacccggcccatttaatgtgagtcacaaatggagttatcttatagtttacctgtaaaaaaaaaacttttgtcgtcacttaaccgagaaagcaaaagagaagaagaagaaggaatcgaaaaatgaagactccgatccacgcggtttcgacatgggtgaggaggcagcctccaaaggtgaaagctttccttgccgtcgtatctggcatggcggctcttgttctcctcaaactcatcgttcacgatcacgacaatctcttcgttgccgccgaagctgttcattctattggaatctctgttcttatctataaactcatgaaggagaagacttgtgctggtataacctcatttcctgctttgacttcgttatctgtagggttcttagctttaactagagaatttcgatctgtgttgagatataaaaatgtaaactttattcaacttttgagtacccaaatctcccaaaggagttgatttagttgaatcagcattcttcttacagattaaaagtctatttacataccttttttggggggtatttgcaggattgtcattgaaatctcaggagcttacggcgatatttctagctgtgaggctttattgcagttttgtaatggaatatgatatacataccattctggacttggctactttgggaacaactctctgggttatatatatgatccgttttaacctcaaaactacttacatggaggaaaaagacaacttcgctctctattatgtggtaagtgagtcattctcggttttgatctttttacttagattctgttcatgctaggcatgttggttatataagcagcttaaagtcttttgtttttagttaagcgtaccctttaaggtcagatgaagatggtgcttattaatgttattcatttgaagcttagttataagttataaccagtgttcctttgtatttgccatcagtatcaaatttattttatctgcatattacatgccttttagaacatggtggcatctaactactggtgcaatagtttaaggattcatgaatattaagttttagttcttttggttttttgcagctggcgccctgtgttgtgctagctgtatggattcatccatcaacgtcacacaatatattgaatagaatatcctggggattctgtgtttacctcgaagctgtttcagtactgccacagttgagagtgatgcagaacacaaaggtatgtgttttctaaggttgttgctttcggaaacttgagtactgaaaaacaagtgtaatccctgatatttttggtgtgttcagattgtcgaacccttcacggctcattatgtttttgcacttggagtagcaagattttttagctgtgcacactgggttttacaggtaggttcttatcttcaacagagagttgtgattacatggttaagttgttctttccatctcttgcataaaccaatggctttacaaatatgtctaacatcctatgcttatggcactggagcaaatggtcaactccacaatatccccattagatatgatattttcgcaagtttgtttgtgtgatttttccaaactgaacgcataaatttggtttggtcttctgtgttgaaacagatgatggacacgcacggacgactgcttgtagtgctgggttatggactatggccatcgatggttataatctcagaaatagtccaaacattcatattggcagatttctgttactactacgttaaaaggtacttttactttcttcccccacacaagctcttcggtcttttcgcttcacctctttgatctatctttcttgtgcagtgttttcggtggccagcttgttctaaggcttccatctggggttgtgtaagttataaaggaaaaaagataagacacattatgacgaaatttgttacacgaagatagatctcagcttggtgtaatctgagtagcctctggttactctcaagttactccctcaggccaagtcctaattctattaactgtgttgtatatttttgtgtgggtcatcatcatagacagtcccttggatattattgacatgattttttccactgcatttgtgctaaattatccttggttcccacggtaaagttgctgcaaatttcaccaagcagagtaaaatattacacttcccacacaagttcataaagacattgtaatcgggcaatcgttgcaagccgcataatttgcaaagaacctgtaactacaaagaccacaaagaatttggtttgctgctagtcttaagattttacccgaaacactactgttcactgattgggctaaatttatgtctgtatacgtaaataggccggttaattacgaataggcccaatgcttatataatctgaaccgttctcttattttttttgttatcgacactattacaccaaagag

SEQ ID NO: 13181 - DNA, 3000 bp, Unknown
  misc_feature (1)..( 3000): cDNA_ID_3028473_gDNA_ID_2214603_Annot_ID_187139 3000 nt of promoter + ATG
atttttatgataaacatagaaaattctaaaaaaaggaaaaaacccgaaaaatacctcatttattttttatttggacgtttaatatctaattttttttggttggaagaaaaatacttcagttaattatattcggtcaaaaaataccttatttttaaattattggtagattcaaacctctgttttaacggtcgttaacggacgttacggtatctataaacaacgttaaattataacaagaaaaatagacgaaaaatactcaatctatttacttttggacttttaatacctcatttttttgttggaagaaaaatactccatttaaatatttttatctcgtgagttagtaacttttaaaatcgtactttatataataagatgtaaaatttctaacacgttatttcgaccaaatggttttatatcgactattatcaagccaaattctactattcaaaatatgtatatccaacgacatatttatatcggattaactattaataccatagtaaattcataggttttttactttgagttttttgcttagaaaataaaaaaataatgacataaatacataatgtatattagatatagtatagaaaccataaaaatgaactcagtttcttatgtataaagatcactatttcgtgtttattcttttatttgatccagttcttccatagaatatccaaattccaaaggattacaatatttcatttttcttagagatgtttttggaaatttgaaatgtaaaagatgagtgtattatacagataataaagctaacgtggatacagagaattggtcatttctaattaaatatgaagtgttatacgattgaaggtggaacgtcattatcaaatttccttattttcctttgcttcaactgtatcattaatcacatcttccataaaattcaacgatatggcgtaaaaggatttgaccttttaccctaagaaccttaactctaatctgcctaatctcaaaatgacataatttactctcttaattcacagcttctttcctaattacataattataaaaaatcgcagtaaactttactaattggttccgtagattttaattttcattattttggattccattattatgtatagtaaaatggaaatttaacttgttggaatacaagagaaagttttgccgtatgattgaagatagagcaagatcgatcatacaaatataacaaatcaaggttaaggttaaaattgaatattgtaaccaatcacgttcgtcagatccaccaaaatcggtgcttcacgtcacacatatttgcttcacgtaaacatcaagaatacctaaaaatatacgaaatcatttatttacataaacgcaaacccaacaacactaaccacgagatcagaactagtagtagcaaacgcatctccagcgaccgcagggacagtagtacgtatatctctttacctgaggagacagcaacttcgaattgaacgacggaggaaagggctaaaaggacgagagccaccgtgatcatgactattaccggcaacggagacgtcgatactctacaccgtgcgcagaagcaaccgtggtaatgcatcgctgatcgccttctcactgttttctttggtttgtttaatggtttctattactcggaagataatgaaacaaagaaagataaagagagtgataatggtttgttaggactataaatgatattattatgatcgatgatgataccactatttcgagaaaaatcataagtactagctagtggggtaacgaaggaaaatatgtggtaatttacttatgtatttcgtcaattagtgggtccataatttgtctaattttgactgaaatatttgtattaacactcaactaattaaacattggtttcttcatgtttattttgcgtttatgggtttgaatggtaacttttaatcaaaacgatagttctgtacaactttgatagctactgatcacaaaactttatcaaaagcgttattataagttttactttcagttttttttttacaactttctcgtacaactctatcttacagttttacattattccgaaaaaacttataactaaatttattgtactgttttgtattaccaatgagacctatatcatattcgctcatacaatttgtttttaggtgttgatttctttgctaagcactcgccactttcctatagtacacatttcaatcccacaaaaacaagtaaaatttgtagaaatgatactttaacaaatgaatgtaactattaaagatcgatttcttttctattcaccttattattgttgttaaagattagtatgaacaggacatgtctttaaaattctgttctgatcgggtttgtgagagatatgagtgattggtggttaggacatgagaacaaggaagcttatctcagtagcctaccataaaaaagacactcacttcaccttgttccactcattgtatatataataattacatgttgtgcctaatgtatgtcgatttcagggattcataccattgttcttttttttttggtgagtataccattgttctttttgtacaaagacaacaatatatgtaaatccttttttaaaatttgatttgattcattttaattaagactcaaaatataatgtgcaattgattaaagagaatataatacattatgtttttaaaatatagacaagatgtttttgacccaaaaaatagaagaaaaatcttaacaaatatagcatattttggtatttttatttttatccttaccaaaaaaaaattagtttggtatttttatgatatataaaaagaaatcctaattaaaaaatggtaattcaagaaatatttattccaacaaaaaaaaaacagataaatactttcttatagggcctaaaacggtttttgtgacccggcccatttaatgtgagtcacaaatggagttatcttatagtttacctgtaaaaaaaaaacttttgtcgtcacttaaccgagaaagcaaaagagaagaagaagaaggaatcgaaaa

SEQ ID NO: 13182 - DNA, 3000 bp, Unknown
  misc_feature (1)..( 3000): cDNA_ID_2991533_gDNA_ID_2214603_Annot_ID_187136 3000 nt of promoter + ATG
tacggaaccaattagtaaagtttactgcgattttttataattatgtaattaggaaagaagctgtgaattaagagagtaaattatgtcattttgagattaggcagattagagttaaggttcttagggtaaaaggtcaaatccttttacgccatatcgttgaattttatggaagatgtgattaatgatacagttgaagcaaaggaaaataaggaaatttgataatgacgttccaccttcaatcgtataacacttcatatttaattagaaatgaccaattctctgtatccacgttagctttattatctgtataatacactcatcttttacatttcaaatttccaaaaacatctctaagaaaaatgaaatattgtaatcctttggaatttggatattctatggaagaactggatcaaataaaagaataaacacgaaatagtgatctttatacataagaaactgagttcatttttatggtttctatactatatctaatatacattatgtatttatgtcattatttttttattttctaagcaaaaaactcaaagtaaaaaacctatgaatttactatggtattaatagttaatccgatataaatatgtcgttggatatacatattttgaatagtagaatttggcttgataatagtcgatataaaaccatttggtcgaaataacgtgttagaaattttacatcttattatataaagtacgattttaaaagttactaactcacgagataaaaatatttaaatggagtatttttcttccaacaaaaaaatgaggtattaaaagtccaaaagtaaatagattgagtatttttcgtctatttttcttgttataatttaacgttgtttatagataccgtaacgtccgttaacgaccgttaaaacagaggtttgaatctaccaataatttaaaaataaggtattttttgaccgaatataattaactgaagtatttttcttccaaccaaaaaaaattagatattaaacgtccaaataaaaaataaatgaggtatttttcgggttttttcctttttttagaattttctatgtttatcataaaaataccaaactatgctatatttgttaaaggtttttcttcttctttttttgggtcaaaaacatcttgtctatctttttaatcaaatgcacattatattttgagtctttattaaactgaatcaaatcaaattaaaaaaaaggattaatattgttgtctttgtacaaaaaaaaacaatggtatgaatccttggaaatgagtggaacaaagagaagtgagagtctttttcatggtaggccattaagataagcttccttgttctcatgtcctaaccaccaatcactcatatctctcacacacaaagccgacccgaattttaaagatctgtcctgtttttggatagagttcaagctaatcttttttttttttgcaattaacaacaataaggtgaataagaaagaaatcatttgttaaagtatcatttctacaaatttcacttgtcttttggttgaattgagaactccatgtgtattgtgtgtatgagacgatagctagcgaaagctaagcaaaggaagactaagaaaatacttaattaacaaagtgaagatgatataaacgcaaaataacattagaaatcgcttgagcactctaaggaaaggagaggtcgagaaatatgcgggtgggatcgatccaaatgtaatttgcatcgagacaacatcaaggatagaagatctttgtaatttgtcctaagaaaaacgcaaaataaatatgatgaaaccaaatacttaatcagcttagtatcaatacgaatatcccttgaaattagagaaactatggtctgactaatccacaaaacacatatgtaaattaccacataaattccttcgttaccccactagctagtacttatgtttttttctaaaaacagtgagtggtatcatcatcgaccataataatatcatttatagtgtacctaacaaaccattatctctcgctttatctttctttgtttcactatcttccgaggaataaaaagctagcatttgacaaatcaataagtaaaccattaaacaaaccaaagaaaacagtgagagggcgatgcattaccacggctgctgctgcggacggtgtagagtatcgacgtctccgttgccggtaatagtcatgatcacggtggccctcgtcctcttagccctttcctccgtcgttaaattcgaagttgctgtctcctcaggcgaagatgtgctgagttggctcctcctagccgcggttccattggctctgctcttcgccgtgagatgtctctcttgtcttgaaacgtcaaagcgatctacttactactgtccctgcggtcgctggagatgcgtttgctactactagttctgatctcgtggttagtgttgttgggtttgcgtttatgtaaataaatgatttcgtatatttttaggtattcttgatgtttacgtgaagcaaatatgtgtgacgtgaagcaccgatttaggtggatttgacgaacgtgattggttacaatattcaattttaaccttaaccttgatttattatatttgtatgatcgattatgctctatcttcaatcatacggcaaaactctcctgtgttccaaaaagttaaatttccattttactatacaaaataatggaatctaaaataatgaatatcaaaatctacggaaccgaatagtaaatgtttattgcgatattttataattatgtaattaggaaaggaaagaagctgtgaattaacagagtaaattatgtcaatttgagattaggcagattagagttaaggtgcttagggtaaaaggtcaaatccttttacgtcatcgttgaattttatggaagatgtggttaatgataacagttgaagcaaaggaaaataaggaaatttgataatgacgctccacctacaatcgtctaggtgtagcccattggccattacgaaagagagaagcaactaataatatttaattagaaatg

SEQ ID NO: 13183 - DNA, 3000 bp, Unknown
  misc_feature (1)..( 3000): cDNA_ID_3028480_gDNA_ID_2214603_Annot_ID_187135 3000 nt of promoter + ATG
agttgaagcaaaggaaaataaggaaatttgataatgacgctccacctacaatcgtctaggtgtagcccattggccattacgaaagagagaagcaactaataatatttaattagaaatgaccaattctctgtatccacgttagctttattatctgtatatacactcatcttttacatttcaaatttccaaaaacataactctgaaggaaaatgaaattatgtaactatttggaatttggatattttatggatgaactggatcaagtaaaagaataaacacgaaatagtaatctttgtacataagaaactgagttcatgtttatggtttctatactatatctaatatacattatggcactatattttattttctaagcaaagaactcgaagttaataacctactaatttgctatggtattaatgattaatccgagttggatatacgtatttttaatagaatttggcttagtcgatataaaactatttggtcgaaataacgtgttagaaattctacactttctataaaaagaaatttaaagtacatactgcttaagaaaatagaccaaactactaatctttaaattacagatggtattggtaatgaatttgaacaaaaacattaatataatctttcatctgtcggtcaaacatataatattataacctaaagtcggtttctataagtttccctcagcacataaaagaaccaagaagaccttctctcatcatcattattataggaagttaggaactatggcttatgaagagagaagatcatcgatcctggattcattctcgctatcgccactaccatacccagttcttttgatcctagccgttgcttcagtgttcttgttgagttcatggtacttcagcttggaagaagcagccgaatcagcggaagagcagataaattttgcgcttctcttgattcctctgtttcttatagtcttggtccggtggttatcttccatggagaaccctgatgcgcttctcgggatgttttcaagcagtcgtcggacaacttacgtgagtcccggagccggaggtgacggtggaagctcgccgtggggagtggcggcgttgatagttttgttgcttgtattgcttcagtatcaatcaagtttcttggagatgtggtctggttaatgatattgataggtttttttgattttcacgtgttttgttttgtcgtctagtagcacgatgatgtaaaaatttggtcattacttacgaattacgaggtttaaaatctcgtgacggtactacatgttatccaatatcggcttgtctcttggttacacgttgcccaatactttgataattcatactttgagcaagaagtatggcgttgatatttttcaaaaactgcattttcaagaatgcatttacgataaagtttttaaaagaccctatgaattgaattgtattgaatacatcctcaatcaatgcatgatattcatatagttgtcacctccattttacgaatcgtgattaatcgtcatacacaaatgatccaccaaaccgcatgtgatggcactatatggctcaagagcgtagcctcacaacagttttagttcgtgtttataaccttttagttcaaatgtttatatgttgaagaggaaaaaccatttgtgattttgagagagattcatcaggtgataaatttgagttctatatatgtctttggatttcgtattatgatattttgacaacttttgttttctaaacttttatgttcaaatttgtcttcagatatttgttttagacatttgtttaaataattatgcttaaacagtgtgctcaattctttttgtacctttttaaaaacatgttttattatgattaacggacatggttgttaatagacataatcactatttgttcacaatcgaaatggtcaatattggtctagtccattttgatagttttaggtttgattggtagcttcttatcaaaacagtaaaatatataccgtttaaaagatccaatgaaacttgatcggtggtgaaatcaatgtttggacaaaaaggagaaaataatggatcattctcacccaaactatggtggttaccagagagccactttgcgtgagctttcaaaacaaattttttctcgatatttaaacttttaactttaaacatatatatatatatatatatatatatattaataaatgaataacaaagatctctacaagagtaagagtagtattacaattaaccattagaagctattcttgttgcttgacaattggaatgaaatatttggaaccaaactgtaagataaaatgtctttaagatggaaagttcacagaaaagtggccatacggttcatgttgaaagctgaccgcaaagtgatcacttcatgtggaaagttggaggaagtgggctgcgacgttgttacacttgaaccctataggggaaagagtggactggtataaggctatttggtttaaaggaaggattctcaagcatgcttttattgcttgggttaataagagacacatgctccatactaaagacaggctgaacagctggatacttagtgttccatccctatgccttctccggcaagtatagtgactaattgttgaccacagaaaaatttatacctacaaattaggcccttaggaatacttttaccaaattattatatgttcaatcttagaaattagtagtactaattagttaaacgtctcgacggaaacagtgttaatgaaatgattattcatcgaccattttgggcacctgatcttaggattggactacagcgcgtggcaacgagacgtgacataggcgcgtgagaacgaggcttgatgataccatctgtgagtgcgagaaagacaaaattaccctcgagagtaagagagagagcacaaccaccaaccctctcatcgcctctatctcctctgctaccttaagctgagagagtcacagtctcgtctctatctctcctctttgcctttttccactcactacacgccaaacccgacgacatg

SEQ ID NO: 13184 - DNA, 3000 bp, Unknown
  misc_feature (1)..( 3000): cDNA_ID_2702206_gDNA_ID_2214603_Annot_ID_187132 3000 nt of promoter + ATG
aatgaattatgggttgtcccctaaaaagtatggaacaaatgataacctttaggacgattagacacaccatctacaaaatcatgctatttaataatgtatccatttgtctgttttaattagttaatcatatattcatatagatcttattacttagttttataaatgcgatcaatgtatacaaacagtcgaaagaccctgttccttaattctaagtaacccctatctatagtcattagttttgttgaaaagctagggatcgtcgggaaacattacaaaatataaaggtttgattacatagtttactttagtagctagctagaaataaatcggatcgatatgaaataatagatatgtttctcggatttgatcacacaatttaaaaactgatgatcatttagatttcgaatggttacaacataacgtatataatgtcgaatatatacaattcacatttgtctatatatgggttaatggttatatgtaaagtagttgagagaagaataacagattgtgtttgagctggcttttctgttaacaggaagtcaggaattgtggctgagggaccttgccagcttcaaaagtgtaatgacataaattagtatctctcttctaccttctaaccaataaccatatattataaatttatcacaaatttcctctctaaccaaattcaacaagacaacaacatacgtatatatacttttacaactatatttcggcataattgttgtaataaccttcgttacttagggcttgattggttctccctctgccacccgcaaacgctgcgtttgcgggtgatagcggttattagcggttgacaccaatcatagaaaccgctagataccgctttggaccgctcgaaatcgccagatttcaaaagctccttcccacaagcgtttgcggttgcgggcggtagcggttaggttaaaaaaaaaaaattaattaattaaaataattatgtcttccacccaaaccttatacttattcttatcagaaaaccctaatcaatgaaaccctattctctcaattatggcatccacccaaactaacaaaaatcaaagtcaaaatcaagaatcaaacgtaagtatgatctatcctttcatccattcattagctagtgtaattctcggaatatttcatggcatcgttgtttttttttattttgtttttttttgagttttttgattgaatacatgttttgatttgttttctcgattagaaaatcatttggtcaaacgagaccacatttgcgttacttcaacgggttattgtggagaaataaacggaagaatccaaagaccccaaaatcagatttctaagtgatgttcaaaaagaaaatattcttaagaatattaacgtttggaaaaaatttgagttggagatgtgttaaaaatcgtttggatatcttgaagaaactttatcatatgtatagaggcaatccggaaaacccgcgagttcaacgttatttacagtttatcacactacttgatgcaatttttggtgatgtaccaaatgcataaagtattaaactttttcttacaaaatttatttatttttgaatttttagttttatttatggttttaattattaagtatgtttaatttttcaaatattatcaatttatcataataatatattgtatttttttttcttttaatagtaatatattatatttattttggttattttttatttaattactatcgcatccgctggtttaccagtcataaaactcccgcaaacgcacccataaccaaacgctcaaccagtcgttcaaaacacttgataacgcttgaaaccgcaaccgcccgtttccgcaaactcccgcaaccgcaaccgcacccgctgcgtttaaaccagtcaggcccttagatcatgcgacttgcatgcatgccaacgccgtacttttagccatagtggtaaaaaacatgacttgttaattcaagccttttagatgtggacgtattaccaactacgttattcttatttcctattactatatatagaacttgtgataaggtatatactttacaattttgtgtcctctattaatgttgtcgaagttgttcaccgacttttcctaaaaatacacacatactagagttaccatcacacataatgtacgtgactactataaaactcgacacgaatatagttttttttttctttttttttgtgtgtgtgtcaaattatggacgtaaaaaaaaacaaattatggacgtatagctagtgattagtgactaggacttcatagtatcctcgggtgaagatcgttgtctcttttatgacacattgacaccaaatactcaaaccaagtcaatactttgtctatgttaaacggtataaaattgttaattgtctttaagaatttccacatatttaggtgatgatgatcaacgtgaactctccctatctgtttctttggcgcaaataaactaaagtttatcctctaaatgctctcatgtgagacgaattaatatggggtcggtggtgcgtagacatacgatttcaattattcatctgcatacgtttctatttatgattttttgtattaacgtgtttattccggatcaatgtattccaagttaaactgaaaaagcaattgactttaaaatttaacatgttttagttacttaaagaaaactgatgcaattgatatccgaaacaaattggaaacataaaatcctaaatctaaaattttcagtttgtttttaaggttaacaatgtttgaaactcgaattcaaactaaagaccaaatcaatgtaattgtatcaatatattcagtttatttaggttctcatcttcgtggcaatggtaccaccaagtatttgaatagtaacttttacaaacaaacacactaaattaattaattcatgaattgataaaataatagccctaacgaacctataaatatacacgtgaggcgatctcatcagtagaatcatatcttctttctcctctactagttacatatcttcaacaaagtgaatctcatg

SEQ ID NO: 13185 - DNA, 3000 bp, Unknown; identical to SEQ ID NO: 13179
  misc_feature (1)..( 3000): cDNA_ID_3028491_gDNA_ID_2214603_Annot_ID_187130 3000 nt of promoter + ATG

SEQ ID NO: 13186 - DNA, 3000 bp, Unknown; identical to SEQ ID NO: 13176
  misc_feature (1)..( 3000): cDNA_ID_3028499_gDNA_ID_2214603_Annot_ID_187127 3000 nt of promoter + ATG

SEQ ID NO: 13187 - DNA, 3000 bp, Unknown
  misc_feature (1)..( 3000): cDNA_ID_3028507_gDNA_ID_2214603_Annot_ID_187122 3000 nt of promoter + ATG
aaccggctccttgacgaaccggctccctgacaaaccagctccctgacgaaccgcctcctgacgaaccagctccctgacgaaccgcctcctgacgaaccagctccctgacgaaccagctccctgacgaaccagcttcctaacgaaccgactccttgacgaaccgcctcctgacaaaccaagcttgtgacaatctacaccgaataaatggtctagccgaaccaagctctccatgccatgttaatctcttcgaaagactccctcaccattacgtgacaagtcaagactccctcgtcgtgatgagccaacattctcaccattactagccaacgtcttttcctctagctaaaccatcccgcacaacaaagtcgtctcgcaaagtataatcatcaagtaaaacatagccatcccgccaagtagagccatatctccaaacgaagtcgtatcgccaaaccctttactgcaagcggatccatcgctaaacaacttagctcctcgtctaactgtcgacgtcatcacttaactgcttggctccaaagcgcatagttccaaactacaagctttcacctatgtaacatgaactacgaacggcttgatcccttcaaagggtacgtaggcagcctctaccgaggcgcatctataaaataaataaacttttgtctgtcaaaagcacgaccgagttctcgagtattcaaaggaagaaattgtttaccctaaaaccctttaattacttattgttacaacctcagtacaaacactatcctggaagaggtgctaaacactttcacgtgcattttctcatggattggaggctcctccagcataaaggagaactcctcattccactttgggtctttgttcttctttacatgctttgtttttctctcctcccctttgaagtagatgtgcacgtaaggattggtatggtgctttccttcaacatcctcagccgaatgcactattaccacaaacattcctccagcagccggtgtgccttctggagctttctgaaccgcttgcatttcttccttcgtgaatgacttatacaagagttcaacttccagcttccccctacaagctgccgttcttgaccaccgtccaaagtcttacgtagttccaaagtgaatgctttatgttcgtcaagcaccatttctttcagatagagtttcgtatgtccgagaattttgaagtaaacaaacctaaccatgttatcacctagattgagatctataccttatttattgaatcatgacatcaggagaaacccccgatgacctaacgcttctcttatagtttatttaaaacttaaatcaataactcaattaaattatatgcaataaaataatatattcgatagacttataaaatctctaaatgagttaccgactgtcacgtcatcgatacacggaagagttatgttgtaggagatttttcagattgtggtttgacctatgctatatttatttgacatggaggtttatcttgcaaaaacaaaattacattgaaggtttttttgcacaaattcttatgttttctaatagagttatcgagtgccacgtcatcgatacacgtaaggattgtattgcaggtgattttagagatggtgaagttgacttgcataattctggaaaatagtcatatcacattcgcttctcttcccactggaggaaatgatctcaaacgcatccgcttcaggtattttaactactcaaaacaatctctatatcttcatgacattcaaagctggaacatgagataaaaactaaccattacttgtgtcttgttttgaaagccgagagatgtacaataagtggcaagctcaacggcggtggggtgagaactatgacaagatcgttgagctttacaatgtacagagatttaaccgccaagctctccaaacgcctgcaagatccgacgatcaggtaaaagacatatatcctagatcctttggtctttcttcagacaagaaccttgtgaatcttgtcctttgatccaaagaaggtaacacaagtttatttttcagtcacagagagattcaacatactcaaagatggattcagcaagagaaagcaaagactggactccaagacacaacttcagacctccaggatctgtcccgcatcacttttatggcggctctagcaactatggaccaggaagttatcatggaggaccaccgatggatgcagcaagaaccacaacttcttccagagatgatccaccttccatgagcaatgctagtgaaatgcaagctgagtggattgaagaggactagcccggtgtttacattactatcagacaattatcagatgtacgtcgagtcagattcaggtataacaaaacatcttaaactaagcattggctaatcatatacattttgaaagttgataatcataccgtgactaacaggaatctatgattttgtggtttaatcaacagccgggaacagtttggggaagtgcatgttaagacatggtgggagcagaacagagagagaatacaaacacagtacctctaaaaagaaacattatgagcttctctaccacaatctttaattaattaattaatctcattcacataacaacacaactatatacattttgcttatcttttgttcatcttaattagcttaacatcttatacataaatcaagtgttctgaagtatcatctctaatcaaagctgattacatataagtataattatcgttaaatgctctacacgttttcaagtaatgtaaaccatgtcttgtttttgtgacacaaagataaagaagtcaactatgaacctaactattctttaattctagctagatctttctcctctttgggggtttaaaaatatcaaatgttagttcttttatgatcaacatgtggtatagaatataaaaagtcaactttattatttgcttataaggaatacaaagtagagttgaccatttgaggttttagatgagcaaaccataaacatgtttggagaaagagtcatcatagttccatcaatg

SEQ ID NO: 13188 - DNA, 3000 bp, Unknown; identical to SEQ ID NO: 13174
  misc_feature (1)..( 3000): cDNA_ID_3028511_gDNA_ID_2214603_Annot_ID_187121 3000 nt of promoter + ATG

SEQ ID NO: 13189 - DNA, 3000 bp, Unknown; identical to SEQ ID NO: 13173
  misc_feature (1)..( 3000): cDNA_ID_2710549_gDNA_ID_2214603_Annot_ID_187118 3000 nt of promoter + ATG

SEQ ID NO: 13190 - DNA, 1462 bp, Unknown; identical to SEQ ID NO: 13172
  misc_feature (1)..( 1462): cDNA_ID_1837267_gDNA_ID_2214603_Annot_ID_187117 3000 nt of promoter + ATG

SEQ ID NO: 13191 - DNA, 3000 bp, Unknown; identical to SEQ ID NO: 13184
  misc_feature (1)..( 3000): cDNA_ID_2702206_gDNA_ID_2214603_Annot_ID_135609 3000 nt of promoter + ATG

SEQ ID NO: 13192 - DNA, 3000 bp, Unknown; identical to SEQ ID NO: 13183
  misc_feature (1)..( 3000): cDNA_ID_2713210_gDNA_ID_2214603_Annot_ID_135612 3000 nt of promoter + ATG

SEQ ID NO: 13193 - DNA, 3000 bp, Unknown; identical to SEQ ID NO: 13181
  misc_feature (1)..( 3000): cDNA_ID_2713206_gDNA_ID_2214603_Annot_ID_135614 3000 nt of promoter + ATG

SEQ ID NO: 13194 - DNA, 3000 bp, Unknown
  misc_feature (1)..( 3000): cDNA_ID_2713236_gDNA_ID_2214604_Annot_ID_135621 3000 nt of promoter + ATG
aaacattgtcatttttctagtattctcacagctttcccttatctttccgagcatcatcatccatccgtccaacgtcgttgaatgtttgaccggtcatttgatccgacgccttcagtgaagtcgccaccttacccggctttgaatcctcgaccttgacttcaaccacagtcctacccgtccctccatgctcacgtgccgcgcgtgtttcctccacaatgtctgatggcattgtcagtttgctctttattgcttccgttacattccctaatgcaccaaaaatagtccctttcgcttcatttcccctgcatgatttaatcacatcaaaaaacaaaacaaagagtttcacagtcacctttaaacttgaagaacatgacaagatataactggcatttcatcatttacctcacggcagcagaatctttggtctcttcggctttttgagctcccgactcagtactctccctagtcttttgagatgcctcttgggcttttgctccagcttcttctttgagctctttaccttccaatctcatttcctccatcttttgtcttgttacttctccagctttctccatgttttcctatgttatcaaaacatcacattatatcaaaccatttgacatatgtaatcttcatttacatggaaacaaagttccaagaaattataccttggcagtatctttggtctccacagcttttcctttggcctcctctgtcttccccgacaagaaacccatagctctcttcgctgtctcaacggcactatccttcagctctcctagcttactcaccgtaacatctttcccctccgtcgccttctccaccgtatagtccttatactctccagtcttctcagctgtcttatcctttgcttcaatagccttctccgctgtgtaatccctagcttccacggccttgtccaccgtgtaatccttatactcaccaaccttctcagccgtcttgtccttagcctctttagccttatccgccgtataattcgcagtctccttcgccttctccgctgtcttatctttagcttctactgccttatccaccgcatagtctttgtactcaccaatcttctccgccgtcttatcctttgcttccaccgccttatccgcagtataattagcagtctccttcgccttctctgcagttgtgtccttagcctctttagctttatcaaccgtatagtctttatactcacccaccttctccgcagtataatcagcggtttccttagctttctcgacggttgcgtcctttgctccaaccgctttctctgaagctatctgagctccttctttggtagactcagccgcttcgtgggtttttccaactacagcgtctctcgcatgctcatacgttccttggacagccctgaacactgatcctatcacaccgggcctatcttgctccggtggatgttcagttgttctctccgtcaccttatacattgtgacatcagcaccaccggatttgttaatgtcatgcaagtcctcagccgctagcctcgccgcaacctcggctctctccgccttttgtttgtctgacgccattgcttttttctcgattgcttgaaaattgatgaaaaaccgctttagaactttacgattttagaattctttaacttgtgctatcagttgagctgcttttgttacttcttatagtaatgctctgtttctgttgagacgctacgtggtagatagagggacgcaacagctgccacgtacaatttacttagctttatcttctacggacgtggtatgacacgtggacttttcatgcatggatcatgattcttgagtgttcatggcatgacttaagagctaagacataagcaagcaagcatcgatggtcggtcgtatcaaatcttttgatatcataatttgtgttggtcgaggaaaatgttaggtgaagatcacattcgccatttcaaacttactgaggcacataacttggaaacaagcaatttagagatatgaaagattacttagttattgccacacagtttattggaagttattgcctcaacatcaaaaacttggaaacaagcattttagaaaaataaggacgcaagttaatcattggatagagccgtttattgatcaagtcggttatcaatataattttgagtttttgacggttcttgggagggtatacaaaaaagttcattgcaatagtttggatttatttccaaattttctctaatttgccagctaattcaggttagcacatgagtctattgtcttaaccgaatagacaactctcttttttgttaaacatctctattagtcaccttaactttttttttttatcaaaaataaataaatcacgttaatcatgttctcacatagattacttttatacttaattaggtacgtcctttttttattatttctccgacaactttgttgacgcgcatttgatgccgaatcatccaaatcggtcacgttttctacatgatttgtcgtaaatatgatatacactaacgtgagtaccttaagatctcaagtatatagttaagatcagatcaaatcagaaacacttagtttgagtttcgatttgatcaaccatataacaatatatggaacttctagctagcatcatggctttcataatgtgtaggtacgtgtgagtatgagtacacacgtacgtatgtcgtgtaagtggagaatccgatgcccaaacgagtaagcaagcaaaagcaatggtcaaaaagcaaccgatctcaattaattatcttattgtaaaaactcaataaaaagttaagggaaaagaataatcttacaagacatgtatcctccacaacaaaaagaggactgtataaaactatttttttcatgagaccaatgattcgtataaaccatttaaatttgatcaaaccctcacaagattgatcaatcaattctcgagtctctgtttcggtcacataaccgaaaggaaacttttttagtcagaaagaaagatttttggagttgaaagcaacataagagatta

SEQ ID NO: 13195 - DNA, 3000 bp, Unknown
  misc_feature (1)..( 3000): cDNA_ID_2702291_gDNA_ID_2214604_Annot_ID_135624 3000 nt of promoter + ATG
atgttatgtgctgttggccagaaagaaaaaacgatatgtcatgtgcagttttatctgtgcattatgggaacttgtcttaggttagaaaagaaaaaaccaaatcaaaaaaccaaaataacacattctaaatttatgttatcatcacgagcattcaaacaaaaacgatttagtaaaatgtttggtagttgtcaaattgctaggtggcaataaatttgattatacaaaaattattaagcgaataatatatagatggtgattgtcaacagatcatttgattattactaaatcactgtttaaccaaacatggatatctgttgtaaattttaccagtatctgaacattaattgttatatcattacgttccatcattttctaatttctatcatattttagtgtccctagtatcatagctcatatcccgaaacattcattgatagtgttcgaatgtggaattatgtatgttaagcaagacttagtcatcattaaattacgcggtgtttctacccaatcaaataaaactacgcggtgttaatgtttccaatcttaaagctgaccggcatggccgtgtttgtatctagaatccaaaaacgacgccgtgtatctctagaagtcaaagaattgaccgttaaaagccgacaaggtctcctgattcaatgggggcttttaaaggtctggccatgtccgtaaacggaaacagtactttcagatgtacttctggtcaacgatcaattaaaaccagatcaactaatcattcatttctttttcaaattcgcatttgcatttaatgtgagacatcacataatataacaaatgcatgcatgatctttgaattattgctcaattctaaccagtaaccactagttttttttatatttgatgattattgtccaacatttctatatatttatatttgtttacaacgtttgaaaaaatcatactatttttttttgttctcactactttttccacagttaggaataagagaagtgaaaaaacgacacccccagcacaaaaatctccgagcacagttgttacatatggtgtcaagacaagagatctaaagtctaaactaatcgaaaggaataagttaaacgattcacaatgtgttttccgcataaatagtattaagtattaacatagtttcattttctgttttctgtcccatgtaaaaaagtaccgcaaatcatttcaacaaaaacacacattttttttggaagaatggaagaaataatgggtagatcaccgtagatgtacatgtttaaagaacgtgaaaattgggctcacataaatagactaaacttttgtaattaaaacggacaagctacgctggcttgagctttatttgattttgatttttaaagaagtcaatcaagtcgagctaaaacaaaaatgtcacttatatctcccattgccaatttttttcttgggggagaataagaaagccattgtaatgtttgttctcaaacgggggcaaaaaaatcaaatggattgaatttaattctatggaaacctctgctggtcttttgcgaattgaatttagacctttcaagtactaagaaaaatggctagccttgacaaaacacctcgaaagtccactttaatatacatataatatttaagactacaaagatgtattatgtataaaatacaatttcgaaattcaactagtatgtcaatcaacaacaatagatcatttgatagggaaacacataaagtccaagctagcaaacacgtgaataaaagttttctactaaattatatttttcaaatgattttacataattttaaacatacttttttttttttttttgagcaaaaacttcaaacatactattccccaaaaatcttattatataaagtatggtttttaaaattactaactcataggattatgccatgtgtcaagtctatcgatcagatgttgacacgtgtaagaaaataattaacttttttcttcttaaagaaatagaaatactaaaaaagaaatcaattaacttttttcttcttaaagaaatagaaaactaaaaaataaatcattattaacatatactaattcatatgtctatatctaaaaaatattacattttatttttcttaaccaaaaggaaaattaaccaaaaatatttatatatgttattggtcaaatttttaatatgtatggtattaacaaattttttattattattaattatgttttgttaattgttaataatttttaatattaactaagatatagatttgatctcatatatatattattttgacatgaaatcattatcaagtaagatgaagtgtgtagaattaaaatcgagttttttatgaaatagataattaaattgtattacaaaattgaatatgtaagataaaaatttgttcttttcttctatataaatactaaattataataaagaaaaagtgtgtaggttactatttagacttcaaatatcatcaataagattgaatgagtataataaaataaaatgcataaaactactattttactattcaaaattatatatcaagaacaatgtatagattattattttactattcaaaatttaaatattatcgataaaaaattacagttacatcttacgcccgcctatttaggcgggccttatctagtgttatatatttgacaaaaaaaaaaagttatgttattgctcatttcagtcatttatgcaaagcatgtaaatttacgacgagttgcccaaaaaaaaaaaaaggaagtaaatttacgacgatagattaggctgacggcccgaccacccgttatgggtcaataataaaggcccattaacggtataacttagcaagataacaaacgaagaagaaaagtcgttgacaaaaagaaaaaaaaaacacgattttgagacaatttgccgattcctcgatcatttcatctgctgaataacaacagtgattggctcttctgattagcaagcttcttcttttcgaaatcgcatcactttggctgatcggtggattctacgaaccatg

SEQ ID NO: 13196 - DNA, 3000 bp, Unknown
  misc_feature (1)..( 3000): cDNA_ID_2702287_gDNA_ID_2214604_Annot_ID_135625 3000 nt of promoter + ATG
aataaacaaattttataatatttttttagaataaagcagaaatttgttttgttaagaattctacttctgtaaattatttttcaaatttaaaagatcatacgttataaatccttacgtatatctacatgtattcaaaggacatgtcacatgtgtattactaaatttatagaaatttgaaaattgtaaaaattatattttattatctgcgggatcgtatatacatgctggtcgatcggtccagacttgatatgtgacgaacacacaaaaataaaacttgaataggatgtaatcgaaagactgttatgaagtaaacatttaaacatatataaatagaatcactatttttaaggaaatttttatatttgcaattttgcaaaagtcaacatatatacaaagtcctattgagttgacccaatcccctcctcaacgggacccaagcaacgaagtttcgcgccaactagttccgtttcagtcaattgcttaaatatcatataacggatcttttatacaccactacgagtaattttatagaaaaattacactgaataaacgaaaaacataggcaacatgagccattttttcttattatgaatatgattttttttttttggggaatccgtttaaaaaaaaaagtagtcttgatcacgaaatttcttcttccacatgtttatgtatatatgatcacaaatgacggaatcaaagatacatcatttagacatttaccattaatttcaaaatatttattttcctcgctacaaaatattctgtattgacatattgtcatcaaatatgcatcatttaccatttcaacatgtttattttcctcactacaaaatattctgtgtcgacaagtagtagcatgattttccttaacaagaataatttctgaactgtcttcaaccacacattcaaatcttcacccgaatgcattccccataaaataatgttacttagatactgttataccgatacacatgatcttaaacttgttgactgttttttctttttcaaataccatacaaagtaaaaataaaataatctttactgatcctagctcttgatggctgctggaattaaacattcacgaaccctttaattccgctgtgaactcgacccgatatatatatatatatatatatatatatatattttacctactttgtagagatatatccatatacttaatcattttgtacatcctatatagcaatttttttcaacaatttgtttttctgccaattagtagtttttgtgatggttaccaacttcttgtgatggcttttaagatattgcgaacgaatttgttgtaacataaattttatgtctacttatcaaattgtcatatttcacattattttactgacttttagcaactactttgaaaattccctctccatatatataataatgcgatagagtatggaagtactggcaatagtcgtagctcagttgcaaacaatttgcgatgaattttttgcaacaatattttcgccagatactaatgaaacattatatttagttgtgaatttgtgactagctaaaaaatgagatgaaaccattgctaattcatgatatactggtattctcgtcccaataatatgcgacgacttcttttacagtcttttccatcacatagatgtttttgtacttgtaaagatgtttctattttcataatacactacagtcttttacagccttttccatcacatagatggttttttgtacttaaatacttttttgttaaagacgcttgagtccgtgactcgtgagtacggataccccacaaggccacaacagccgcaaacgaatccaaaatcagtatattcgaaatgcattacgtacttaccttttcgaacgaatctaaaacgtgtccagtttgagattgcatggctcatatcgttgttgtacatgcatgtacattgtttatgtaaaatacaataacttttaattatatacgtatatataatcatttttaaaatgtctattgtagcttcaattcaaatggttcgggagaaaaaatactctctaaacccatattaaaacttgcaaataattaatttagtatcttctaataataattaaatatatatacatcaaaactatcatttttatctggtaatgtttttcttatctggtaactataattaaaagttatcgaacaaactttcaaaatcattaatttttaatttataaattagaataaataaggataaatattttatatgatattctatcatctccatttagagctatgtgaatagctgttgcgcatttgtgaccaaaaggcgagagagctaaagatctcgttatggccatctattggtttactaaacgctaacattatctatgattttttttttcctttgtaaacaatatatcaaactttttttgttgtgaaaattcaggaggtggctcgtattattatattttaataaatctattctattttttctcataaactaggtagacttttattatttttattattattttctctatcattttcaattatatttaatattattgcgagctagaccctaccatctcgtgtcttatcgttcaaatactatagaataataatattaacaatatgtcaacggttttttggtaaggacgagttaagaagaagaagtcagtctccaagaatttgactcagaacaataccaaaactgctttaattcgtcaaaatatcaattctggactattcatttcaacgtctcctccaaaaacgtatgtatataaatacctacacccaccaacaccacaacttaccaagtctccaaacatagttcctcgcatttacatatatacatataataatatctctagaattttcaagagcatcaagatccatcaagatccaccaggtatatatatacgtgcttcgtacatacatacatctcctgagtttccgttctttgataagttctctatatttgctaattgattattgatgcatatgtacgtgacaatgtctcattaacagtgtaacggagaaga

SEQ ID NO: 13197 - DNA, 3000 bp, Unknown
  misc_feature (1)..( 3000): cDNA_ID_2702281_gDNA_ID_2214604_Annot_ID_135628 3000 nt of promoter + ATG
tacacacatgaaaactcatatcattatatgcgttagctaattaggtttaattgttgtgacctcgatatccttaccttgaaactaatgttgtaagctgtgaagttagctgcaaacactacaaaggagaagctatcagcagtgtttccggcggattttgctgtgtcgttccattcgatggatgtgttttgatatcctcttccttgaataacaaggtttgtcttgttttcattaaccgtaaccttttccctgcttgcttaaattgaactcaaacattactaaatatatatatcatattacactataaaagaaaattattgagcaatggagataggggaaaaagaacaagagcttggagttgaagataggacctataagaacccgaattaacgatgatgagagtcttggaagagcttaaatcagggacaacatcaatggcgctttgaacattgctgaagttaccacaaccatgcaaatcaacagtcaacacaagagaagtcttgtattggtgtctaagccttgacgtccatttctcacaacattttattggttcatggtggtgataatgatgatggtgatggtggtgatggtgatgatggtggtgtttgtgtccaaaaaatgttgaatattttgctaatgctccgatagttgtagctatagaagagagagatctagaggatggcaattggatcgtgtagagagcaagaatgatggataaaagagctattagggtggttaaaaccggtttgatgggcatgtttaagataatagtagatgggtttagtgtgtctcaactagttaaaagtaaaaagaggccaaatgttgtttggtatttatacatgtgtgaggaagagtggcgtgagagtaaagtgaaggatgggcttcgaagacagtgtggtacctttttcttcgtaaatcagatacgttttatctaaagtcatttctgaacaatttcgtgataattaaacaaaaaaagtatatacgtcgctttagaaacttagaaaaactgtggaataagttttctcataggcatcttcaatcgtttaagttagagacgcaataatggaataagatgatgaagtatttttacaaatatcagacgacaattatgaatatttttgacttactaagtattgtttttttttggttttgggttagaaaaatcgaaatcttgtttttttcttagacataacgtctgttttgcaagacttataacctgaaagtttataattttttttcttttaaagacatttttacatatgaaatattttatgattttgcttaatagatcattccttgttgtattaaccatcttgaaaacgaagtatcacggccagtcggctatcataacaaaaagaaaaagaaaaacttataatgaaatctagccaaaagcatattataaatttttatgtaacaatctataaaatttataagagttcaatttagaaatgggtgacttatatgatgttggaaaaaatagttgttgagattataagagaattttcaaatcaaccgacaggcgagcgagttgggggtggtacacgccaagatggttaatgatgcttaataaaaccatttcaaaagcaacttttactatattttaattttgcgttgtttaataaaattgtgagtgttttatctattttggtaaaaaacactgactcatttatttacagaaaccactgagtttgactcgtcgaaagaaaaataatttcatttacataaacaatgcttttctccataaactttctaactccaaatttggtatcggtatggttttaggagattacataacagtatgaattactttgaaaaatcttgaactattaacatcttaatgagtcggttgacgtactgtatatttattcaagcaatgatgcatggatccagaaactattttgagccgaggcaaaaataaacgtaaattaatagtattgaacaataaattaaacaagaaatgaaccgtgtaaatttggaaaaagaaaacatcatttttctacgtaatttatcaacattgatctattttaaaatttcaaagagtcttgcaaaacaaattcgagttcatcactttctttcaatatatatcgtctcgtgaatccaagtgaaataattgccatgaatcatgcaagatgcaccttataaaacagaataaatttatcattttttccaatgctaataacattaaggcgaaataaattgttttatagacttacgttgtatcatgtatggttaaagtcttaaagagatagagaataacaaatacacaaagtgtataaaacataaagaagagacttgagaaatgagttctcaaccaaatcaaaccgatcacacacgattagtaaaagaaaaatttagatttaactgcaatagttttataaattctaaaactactcataagaggttaaacaaagtttaaattttcaactcataattcctaacaatttaactataacgcacaacataaatgcagttgttaattctaggaaaaaaaacagattagtaagcgcaagttttcgaaatgggcattaggcccaattgatttatcttcaagaaatacccattaaaaaggttaatatttacgaaatctgccactgctctaaagactgtaatttactgcgtttttctctatcttccttcctctccagtggctgcaaaatcctaaatctcaccgaaaaggattttgtattgttacatcctcttcttcttcctccagatccatgtatgaaacctcccctgaaccctaatttagctatcgaatttgagattcgatccgatgtttacttccaaatcttcgtttcgtctctgataatataactccatcgtaatagaactgatttcaagacggttcgtttcgttttcctctatcccagattcggaaagctaccttgttttgaactccatagttttcccgaatctattcatcacttgctactatcagtttgcttcttctgttctgtgtagatttccttggagggggtttgttttgacgcagtttcgttgcaa

SEQ ID NO: 13198 - DNA, 1743 bp, Unknown
  misc_feature (1)..( 1743): cDNA_ID_3028536_gDNA_ID_2214604_Annot_ID_187183 3000 nt of promoter + ATG
tggctgctccagagcgcagctgcgattcgatgtcaaactgcagttgtacaagctccgcgtgagtcttcccatcaagaagttctctcacaccagcttcaacaccagcgtgtagtgctctttcttgagaagcaagcaattcctcatctcttctacgagctttagttaactcccattctctgatcctcttagtttaacagagaattcatctagagatgctccatgatgaacatctttttcaatcttcttccgccacacgaatgtctcggctatgttggaatcccaaaagggtttgaatcattggagtacccaataactgactgtctcttcagtttctttgaagcacttagtgcccttttggccatatactcgatttcgtctctctgcttcttccgccttccatgcctatctctcttactcttaccatgaaaattcatatttgtctagttggagacgacaatctgagatcagtgggacggtggtgaaaacttctcctctccgatccgacgataatggatcttgtgattgaaacagattttcagaatatcggattgtgttatgctcgagcctttacgtatatttagctaaaaggctaaacttagtccaaagcaaaaactgaaaaagggtatttaattttctccatttttttaaaccaacctctcctaattggtaattgcacaccacattctacctctttaaaagaaaaaaataatatattaaatttaactattacaaatataataattaggaaaaaattgaaagcattaataaaataattaaataaagaaaactcttgtaggttcaagcccttaattatcacactatggaaaaaaaaaatataggagaaagaaggcgagaagaagcaaacataagaaaacagctaagaagaagcaaagccaattgactagagaaatgtttccggggaaaatattgctaacatgtatcattagattcaagtcggtgtgtgaagtacaaaaattgctcatggaatcttcactcttccgccattatcctacctacgtgaagataatagatttataaattatcggttagaggaattggaactcgatctctatctacaagagtcatggtaaatacttgtctcttgaaagcagtgttttgcaaaacgaattttttacccacttgtgtaaattttttggtagtacacaaacaaatggaaatagaaaaatgaagccaaagtttataataattactcttatagatgatcatcatcctaattgtcacttattagtgttactactccaattttgctgcatccaacacttgcattcctccattcaaagccataatttacactctagttagtgttgaaagaaaaaaggaacaaagtgattcagagaacaccgctcaaattattgggccaataatttgagcattcttatcaatctatagaaacaaaagaatgatccaaaagcaacgggcttaaaaaaaccgctattatacccggacccgtcttgtcgggtatgggtccatcggttacaattggtttcatatatttgttttcttcccccaaactttttctttttaacattcaagtccctccgacaagaggcgacgcaaatttcataactaactaccgagctccgagagctggctctctctttcttctcacctctctcggtcggattcttctccgtctgaaaaaaatcttgatcgatcaaaacagtcgaatttttggtcttcgaaattctgggtttttgaaatagttgatcggtttttgaaatg

SEQ ID NO: 13199 - DNA, 3000 bp, Unknown
  misc_feature (1)..( 3000): cDNA_ID_2702261_gDNA_ID_2214604_Annot_ID_187177 3000 nt of promoter + ATG
atagctagaaatctagagtacacactttgatttagtttgaagacaaatgttgaggcttgtttgtccatacgacataaaaagaaggagagactgagatattccgaatttgatttttctttctttattcgtttatccaatactaatttttacggctataaacttttcactatcttttcgacgtacctctagctaaaagatattttctcttaaaattttgggcttatatgaatacaaaagaacatatgagtgcccgccacgatatgtactgtgaaccacttagtgtgttttgtaactattacgaataataagccaatttccttttgttctttcttacatcacatcttaatatatgtaggcacagagaaacacacacattatcggaaccaaagcaaaaaaaataaaccttagaagagagttcctcatggcatcggaatttcgtcctcctcttcattttgttctcttccctttcatggctcaaggccacatgatcccaatggtagatattgcaaggctcctggctcagcgcggggtgactataaccattgtcactacacctcaaaacgcaggccggttcaagaacgttcttagccgggctatccaatccggcttgcccatcaatctcgtgcaagtaaagtttccatctcaagaatcgggttcaccggaaggacaggagaatttggacttgctcgattcattgggggcttcattaaccttcttcaaagcatttagcctgctcgaggaaccagtcgagaagctcttgaaagagattcaacctaggccaaactgcataatcgctgacatgtgtttgccttatacaaacagaattgccaagaatcttggtataccaaaaatcatctttcatggcatgtgttgcttcaatcttctttgtacgcacataatgcaccaaaaccacgagttcttggaaactatagagtctgacaaggaatacttccccattcctaatttccctgacagagttgagttcacaaaatctcagcttccaatggtattagttgctggagattggaaagacttccttgacggaatgacagaaggggataacacttcttatggtgtgattgttaacacgtttgaagagctcgagccagcttatgttagagactacaagaaggttaaagcgggtaagatatggagcatcggaccggtttccttgtgcaacaagttaggagaagaccaagctgagaggggaaacaaggcggacattgatcaagacgagtgtattaaatggcttgattctaaagaagaagggtcggtgctatatgtttgccttggaagtatatgcaatcttcctctgtctcagctcaaagagctcggcttaggcctcgaggaatcccaaagacctttcatttgggtcataagaggttgggagaagtataacgagttacttgaatggatctcagagagcggttataaggaaagaatcaaagaaagaggccttctcataacaggatggtcgcctcaaatgcttatccttacacatcctgccgttggaggattcttgacacattgtggatggaactctactcttgaaggaatcacttcaggcgttccattactcacgtggccactgtttggagaccaattctgcaatgagaaattggcggtgcagatactaaaagccggtgtgagagctggggttgaagagtccatgagatggggagaagaggagaaaataggagtactggtggataaagaaggagtaaagaaggcagtggaggaattgatgggtgatagtaatgatgctaaggagagaagaaaaagagtgaaagagcttggagaattagctcacaaggctgtggaagaaggaggctcttctcattccaacatcacattcttgctacaagacataatgcaattagaacaacccaagaaatgattgtaacttttcttagattgtaacttttcttttgtattacccaaaaaaaatgattgtgacgtttgttctcgattacttctctttgttcaagaacaatttatgatagttttatttgaaattgtctctattatcgaatcttatactaacatcttagttagtacatacttattaagcattcgaattcgtacactcaaattgaagaaaaaaacacaatttcttatatactttttttttttctgtagctttagaagagtgtagaaaccttctccagtggtcctgcatgagatcgcaacttcgatattgcttgctccttggagtttagaggagtgtagaaacactttttgtttgtttacttttgctttctcgatcatgacaagttgacaactcgtgttatatccaaaatgacatcatgcatgacttgaaaattgaaatctatctatgatattaccatttctggacaattttgttaaccgatttatatatcttaacatctttcttttttggtattatttacgttacgatttttcatcgtaaatttaatttaaaattttatatatgccagtgtaaaaagaaattactcaaggtcattaataaaaataaaaataaaacgtttttccccagcggtctatcattgtaagttttattttacaaaaagaatcttctaatataatatgggctttgaaaatgtctaagtggaaggcccattaatatctcaagtccaataacaatggtgtacgaaccagcggcaccgtgtgtgaaagagtgaatcaaagaggtgcggcggtcgccggcgaagacgtgtgctcgtcgaagaaacttctccaacctaaaattttccgaaggtaactcctcgagcgagattttaagctcatcacacaaattacttttcattctcgctttcatgggctcttcttcgattactgtgtacatcactcaaattttgggtttttgttcctgtttccctctcgatataatcgtaaagtcttgaaattgcgagaaaccctaatttgggggttccttgctgatttgttaatttgtgtgttatgacattttcgtttaaatttgtgaacttgtagaagtaagagttgagcaagttatcaatg

SEQ ID NO: 13200 - DNA, 3000 bp, Unknown; identical to SEQ ID NO: 13196
  misc_feature (1)..( 3000): cDNA_ID_2702287_gDNA_ID_2214604_Annot_ID_187170 3000 nt of promoter + ATG

SEQ ID NO: 13201 - DNA, 3000 bp, Unknown; identical to SEQ ID NO: 13195
  misc_feature (1)..( 3000): cDNA_ID_3028552_gDNA_ID_2214604_Annot_ID_187169 3000 nt of promoter + ATG

SEQ ID NO: 13202 - DNA, 3000 bp, Unknown; identical to SEQ ID NO: 13199
  misc_feature (1)..( 3000): cDNA_ID_2702261_gDNA_ID_2214604_Annot_ID_135630 3000 nt of promoter + ATG

SEQ ID NO: 13203 - DNA, 3000 bp, Unknown
  misc_feature (1)..( 3000): cDNA_ID_2713232_gDNA_ID_2214604_Annot_ID_135637 3000 nt of promoter + ATG
gttgaaagaaaaaaggaacaaagtgattcagagaacaccgctcaaattattgggccaataatttgagcattcttatcaatctatagaaacaaaagaatgatccaaaagcaacgggcttaaaaaaaccgctattatacccggacccgtcttgtcgggtatgggtccatcggttacaattggtttcatatatttgttttcttcccccaaactttttctttttaacattcaagtccctccgacaagaggcgacgcaaatttcataactaactaccgagctccgagagctggctctctctttcttctcacctctctcggtcggattcttctccgtctgaaaaaaatcttgatcgatcaaaacagtcgaatttttggtcttcgaaattctgggtttttgaaatagttgatcggtttttgaaatggcttcttcaagtttagggagctcaatccctgcaccaggtataaaactttcttcctgaatcttcgatttcgattttttaatctacctcaaattgatcagtgtattggcttgtttgatcgaaaactcttgaattgtgtaattgggtcaacattggttttggcaatgtctgttttatctgatcaagtttactttttttatattttgttggcagaggctgttcaacttctggtatcatctctagctgatgattcctctgtggttagagaagcttccatggcttctcttagagatattgcctccctgtatgtactatttatctcattttacttcgtacacaagacatgcaactatgagtatcgggagatctttgatactgagctgttgtgtgattttttttttttttttttatttaggaatccgcttctggtacttgattgttgctatgctgtgtctcgtggaggacgaagggtaatgttctgtttgcttgtcttttgtttccttttattggtgggttgaaacttaaatcttgtgctgtttggtgttgcagcggtttggtaacatggctggggtttttcaagtaatggcatttagtgttggtgcgttagagaaaggggagagtgattcagttttcatgggaaagcttgctaagattgctacagctgagattatatcttccaaggtgtgttgcgacggctgaatcattgttaaagatttcttttttgtacgtactgatagttagatagatttacgtagtgaacttggaatcgtaggtgagctacattatttctataaaaacaggggacacttcttgcaatgctcacaaactttctcgcaactgttcgtatatgtttcctgatcaattttggatcttttaatggttcatcataacgtaggaactaaatgctgattggcaaaggcaagcatcagggctgctcgtctcaattggaacacattttcctgatcttgtaagtcttgtttttttcttttctgtttgctaattcaaagagggatttcttgacattgagaaaaaactgtttttttagttccatgtgactgtacactcttgagttgttgccttttactatacacaaaaggttggtaacatgattggtggtgagatgcattacgattcggattatctttgatagtttgcatgatataatatgagttgctgctgagaaaaccatagtagagactttcatctgccatcatgttaacatctatattgagacattttagatagtgtcatgagtaaagctggtccttgtctctatactgtcatttatgaggtagaaggcagcctatcccgttagacgtggggcttgatttcccttctttttggataaagtccaagatatttgatattttttaattgatatggacagatgatggaagaaatatttcttcatctgtctggtccggctacagctgcacctgctatggttcaaatacttgctgactttgcctcatctgatggttaatttctaactctcattcgtgtccctgtaattttttgtttctcatattgaaaagtttatggaacttgcagttctctgatattttgagttactttcatatttcctttgaagctttgcagttcactccacgcctgaaaggtgtactttcaaaggtgtcgcctattcttgggaatgttcgggacatacaccgaccaatatttgcaaatggtacagtgaaacttttgtagtctgtttttgtttagggagtgaaattcttttacagaaactactattttgtgccaattttcctccctcatcctgtaagcttttttttgtcttgcactatgtggttagttgactctaatctggcttctagaagggtcatgaggtcagagtttgttttcttgctgaaccaatatggcaatataattcatactaacataaaagtaggttattaacctgttgatctgtacatcttcgcactctaattatcgactttgtgtgtttagcatttaagtgctggtctcaggcagtgtggctatacatcacagatcttacctcagattctccgcttgacagtgatgtcatgtgagaccactttctttgttctgtttatttctgccagtttttgtgttaaacgctctcaaatcaagggcttcatctgatgcaggtcatttctgaattcagtttttgagctattgttgagagtttgggcagtttcccgagatcataaggtgagtccctgatctcttttagcattatactccactttacgttttaatagtattgcgcgtttcagtttaaaaatattattcaagagattaccaaggtaagaacatggttcgtaaatgttcacagactattattttataacaaagacaatgaagaaagatggtatgtaactttattaagataaaaataagaaatgaaagtttgttttcgggtttttctttcctcttcccccagtaatgtatctttgaaattcataatatggagagatacatctctagaagatattgctagttagttattcacttgctctccagacatgtctcgtgactttaaagtgtgcctcttctgctgaataaggtacgagtatcaactgtagacgctctgggtcaaatg

SEQ ID NO: 13204 - DNA, 3000 bp, Unknown
  misc_feature (1)..( 3000): cDNA_ID_2713280_gDNA_ID_2214605_Annot_ID_135640 3000 nt of promoter + ATG
agatagatatttgaatattcagatctttgatgacccgtctttagatccaataaaccctataatctagttattaacctgcagtataccgcaggtaggcttatactttagttaaactaaaaacttttattgtaaagatgatttaaatatatatgatattattttatttgattttaaatgtatagtaaactgtgagttgtatatgttttgttgatattatctatattgtttagtgtttaagattatacacttgtagtttggttgttaatttaagagtttcacctgtagtatatcatcttgtattaatatcgatctaaatccgtccattttacgattttccagcttgtattaaaaattgaatcacatctaatatgttattaattactgtagtatataagattataaattttcaatataatatgtgtgaaattgaatagaactatttcaaattatgattcgttactcagtagaaagttttcttaaatctatttttctcccgttataatattttttcatgtattgaacagtttatattcgtttttaaaaatttaaattatggcatatgcgaaaaaaactctaattatttgtttataatgatgatattatttttcggcaaaaatagaatcatataaagatgagaagtgaactataataattaataaaaaattaatatgataatttagatattaaatctaatttgttgattttaattggttacttttttggaaattaataatgtatttcgtttttctaattaaattaaattaattaaaatttagatatcaaatcttatatgttaattttgattggttattatttttggaaattaataatatatttcgttttttaattaaatttaattaattaaattagtatttgactttttaatctttaaagagataaattaatttactctttaaaattttatttctaatggtatacccatgtaattacttacaaaaattaaggttacattttaaaatgtacttcccaaataatatagtaggattttattaatttttatttgtctttaaacaataaagcttaaagcaaaagtgaaaccaattacaaatttacaacagttgcgatgtgtctagaaaagcgaaaaccgattttaaccctataaggccagaccaggccaaggcctatcatatcaaaaagggcaaaaacgagtgaatttggacaaaatcgaaaccaccaatcagaaaatatatgtggttaaaactttgaacacatcaataaacacgaaaagggtaataacgtcatttccataaattcgtaatcattcgtcctcaaatctttattgtcacttttacaaaaaatactcccaatttcagagaaacctgttgaaaaaaaattcagggaaaattggaaaaagtgatgatgatgacgagagatcaattcaaatcttaagtcctccaaattttaaaaatttcgatctccactaccttcgtcatcttcctctacttctgattctcttttctgggtttgtcgtttaatgggttgattttgtatcgtcaaaacggagaaaacaagaagacttcttttggttttcttattgcgaagaagatatttctagggtttcgagattttctgggttttctgggtttttgtgtgttctttgattggatttgattattgggcaatttccttggaattcaagaaacttctaaggttcttaaagtgtaaagctttgtgattttctcttattcatacattctaggactttggttttggagttgtaatggcttttgggtctgaaaatgagagcgagacgaagatggaaggttggttgtatataatacgatctaatcgatttggattgcatttctctagaaaacgttactttgtccttggagatcatcttctcaagagtttcaagtctatctccgattctaaaaccaaggtcaccaccatttgattaatcgcaagttcgtttggttgttcataatctcccattttggattaggattttaacttttagtagaatctgaatttggtttttacagaatgctggacgaagtgcggtgatagattcgtgtatccgtgttactgacaatgggagagaaaatgttcatagaaaagtatgaaagttctcatttttaaatctttagttgtggagtttagttatgcttttgttttaatggtttgtctggaatacttgtaggcattcttcatatttacactatacaatacatcaaatcacaatgatcagctcaaggtaaggtaatttctgttgttttgtttttatgttggtacactatatacatctctttttttcatttgttaagctttcttgttttaattgttatatagttaggagcaagcagtcctgaggatgcagcaaggtggattaatttgattaaagaggcggctttaaaggttatataaatggcaattagtaacaagttaagagctcttcttggaggttggagacttatagttatatgttttatgcagggtgccccttttcctggagatgtttttaattgttccaggagtcgatgggactctttgaggtacctctttttttccacgtaatcaattggatacatctctaagctaactgttaaataaattgctgagccagtagttcctgccaatttttgttagttacgtagtacagataatggtttgtggttacttaagaaagaaaatttctgaaatcagattgagtagctcagtgcgggaccatcactcaaactctattgactggacacttcggtcgtctgcacgagttgatcctgttacaactgatgttgttgcgccttctccctggacaatattcggttgtcagaatggtatagttcatactcaaatttcattgatttttgtttggctggaatgcatagtgttaacatgtgttgcacgcaggtcttcggctttttaaagaggcaaaagagagagattctctcggaagggtcggtatttttttcactcttaatctgttgaaaaggtattttgggtttattgaagggaatcatgttttgatgattttgttgc

SEQ ID NO: 13205 - DNA, 3000 bp, Unknown
  misc_feature (1)..( 3000): cDNA_ID_2713272_gDNA_ID_2214605_Annot_ID_135643 3000 nt of promoter + ATG
aatgcaagacaacccaccaacacattattcaccattctaattttgtgttgcttctttctagccatgtcaagtccacatattaattatatatgcattttatatacacatttacatgtataccagtgtgtgtattcgagataagatgaaaaagtatatggctgaaatacacttgaaagacaaagaaactgtgtgtcttgtcgatgattttatgtttttttcagaagtcatgcattaattgatccttttgttttcttcttccctcctggtccatttattctctattaactattttttgtttgctcattctttgaaaacgaacttaaacaatattttatttacattttacgttagaatagtcatgtgatttatctcttaaaattcacaagtagacaaaaaaaattagttacttcgtttcatataaggtcaatagaagtaaggtcaatagaagtaatacatacttaagttgtctgtttagtgtttgtatagttaaaaaggagtaaatttattacctacatacgactattttttttcaaactttttaatatcaaaacaagggacgaatattaatatagttcgtatgaatcctttatcgttgaatgtgacttaattatagaagataataatagttccaatttattaatattgtagctaatattctcaaataaaaataattgttgtagagacaaaaagagattcgtgtatttttttaacttatcatttttgaagttaagatagaaaaacataactgaaaacccatgtaaagctgttttgtgactaatctgttttgcgaatctacttttaaaaaaacatatttttcacaatcaaacacaaatgcaaaattagtttttttgttcttttttcggaacgacttaaagttttaaactggaagcagaaaaattgacgttatgcctcacctaagaacaaaacttaggccttagatggaaatctttttaatttggactttaagagttattattcttcgatggtagaagtttttggttgagttatataattaatttctaatattctaatgaagttagtaagctatacttccttatattacttttgtttgaagcaaaaaaaacacaaatttgtttttattattcaactaaaatagacaacgtacgaggaaaatctagttttcaaaatataaagaaacagattttctagattttatgaaactaatttctaaagatgagacacaaattttgaattatttctaactatacagaaggataaatacaacaaaaacacttaccaatcaacgtttaaaattgttatgagtaaatataatttgatggtaaaatagttgcagagaaaaaaggaccaatatacggatgagttgggtatgtcgtgtcaggttataattggataatattgatccgacaaaacaatcgacgagtacaaaacttcaacgaactcactcacactccaatctccacaatccctttttaacagccgcgttttcatctctcgggtcaacccccttctcctactcccacgtacgttttatccccacttttatgacgtcattttacacaactcataattattctttttttccttcctaaataattatttatccgtaattctatttttttttttcatcaaacattagctttgttattgacgagcggtgacatagtcacgatgaagaagatcagtaattacatgtggaacgaaagcataaaaataaaagaggttgttcaaaggaatatgttgttttgctaaagtatctgccaccatattcgagcatctccgtaattctttcaaagttgtggatcataatccattttctttagtttccttttttcattaattgattttgaaattaaaaatctttctagaagaaatttttatttttaaaaagtttgactccagaatttaactttaaatctaaatgaacactttatgaagaagaaaaccaatagtcaactaatgaatatttttattttatttatacttttgtgtgaaaattatcaaaagaaaatttattgtgaaatgaggtgaaatgagggaataatatgcaactatttatttttcatttaaataaaaagaaacatttgcatgggttaaaaatatcatagtttttaccccagtgtagtacaaaaaaggactgtttatttggcatctaatttcaacatcatataatttaccatgggtttaacctatttcttgttttaccacaatcgtgtaatggaacccatctttcactaacgggcaaaaaaaagagtcaaagtgaaaagcagaaagtaaaaaaaaaaagataaaaaagatttaaccatggttaggtttgtatctggtcaagcatggtttctgatttttcgagtaaaaaatcaaaaatttgttggtacatgtcaaattatcgcggctcgtgatacgataaattgctaattttattattattagtgaagcaacaaatgaaacaaacaagttagttgcagttttttttaatcaaacaaaaaaacaaaatttatttatcttgaaaacaatttattatatattatttatattaaaaaaatgaaaaataaaaagagttataaagtttgtgtttgagataatctctctggtttgtttggttcttgtttctgtatacatcattactaaagagaaaaacaagatgtttatttattacgatggtcttgtccgtacctgattatagcatctctctctatctctctcttcttcttctacgatctgatcagccattaaagctttttcccccttcactattatacctcttttgaagtgaaacaaaatcataaaagtcgaaactttactgtttcctctgcaaatttaaactctaatctctctctctctctctatctctttcacttcgctttctctatttcccctgaaaccgttcttgtctctctctctctctctctctctcttcttctctgctcaagacaagaacttgatgttcatgtcttgaaacttaacaaagtattgatctttccttttaagtaaagaatttgggggttacacaacttcgtctag

SEQ ID NO: 13206 - DNA, 3000 bp, Unknown
  misc_feature (1)..( 3000): cDNA_ID_2713268_gDNA_ID_2214605_Annot_ID_135644 3000 nt of promoter + ATG
acaaagattcattcatctggactctagaaaatttgcaacaggagacctacatacaaagtacaccagtgcctgtcactaaggcaaacttacctaagtaaccactaccagacaccatgatgcaaagcatgattaataaccaaattaaacaacagtgaccaaatgaaaaacatgatatgatagccattttatcaacattaacttctcgaagaaagctcatctagttaaaatgatctttatgaccatgatatatcccggattagcagctacatcatattactgggcaccagtaataaaatcccctatacacagctgttaactagcttctaataagccttaaagatactaatagactagcaagcctcataacttatcatattaagccacaaacccgatgcttattttgtattgcactttcggaaatggaaacaacaaaaagcagattccagttcatagtgtatagcatattggaagaaagatagggtgctatcacatccgattctgataaatacagattctcacagaagtttatagtaaagcatatattcgatttctaatagaccaaagtcttaccagaaggcggtaacggaaggaaaatcactagtagaagccatgacacaaagagcagcagcagcaaacaagaactgaaaaaaacgcaatgcaagaccaagcaatgttccaggcattccttccatatcatccatcctcacccgaggcggattctctacttccgtcgcagctgcaggaggatcttccactggatgtaccgatgcatggctcacattcatttcttcttcttctttcctccaccaaactcaaccaattcaacacatctctctctcccttcctcttcaccaatagctgaattacaaatctaacaatctactactactcaaatctcccctacctgtattcaccaaattaaaccacaatttatacaatctaatgataactcagtacaaagttcaaggaggactaaatcaaacatagaatcaaatctccgcgatagctaaactaaatccaaggttacgaaattgaactagatttggctccggagaagtaaagagaaaacgagatccaatcaattgagcacgtagatcgagtaagggattggtgtttacctgagagaattaagaagagaggaagaaattgaaagcagccatggagcttgggtagaggaaattaagaaaatcctaagctatatttgagggaagaagaagaagaagatcgtggaaatggtttttaaggtttatgcgaagaagaagaagaggtgtgggtgttttgatcaaaaggaagaatatagcttgacgaaaagagattaaccattaaaccaaatttagaggtcaattaaacttcttaaggggaaatataaccaccaatctatattttcttttgttcacattttttttggtttcctaaattatactttaaaatatatctttttttaagaaacaataccacatatattttttattttttccctttttacattaatatgggtactaattttatttcaaatattatcagtttatcactaactatgatttatattgtagcaatttagcatgcttttttttgttaaactccaaaatgtgatataatttgtgatgaaaaaatttctgtaccaaccaaacgacaatattgcattttatttttttgtcaaatcagtcatatctgctatagattttttaattataatcaaatttaaattaataatataagatgtctatttaagtataatcaaatttaaattaatactgtgtaacaaattttcaaggttaatatagtactttttatgttttatttactaatttcttattatggttctaaactggccaatatttcgcggctttacattctttttggcaaatttctggttggtaaaaaaaaaatttgtaagtttttagttcgcataactcgggtgtcggccttctaggatcatatattaaaagtatgaattcttcaagcatttaaggcttctaagtaaggtatgttcttcgatcagcgacgattaagacaagtagaccatggcggcatgttctcatacaagcattaatttgacagaatatttttctatcgacagtcttggtaacaccaagtagtaaagctagaaaaacagaaacaagtctgattaaaaaaatgatttaaaaagaaaaatggtatactgcaaaatcaaccaaacctaagcccaactagtaatgaatccctgtgaatctgatcatttggacaatgcgatcaaccacaatgttttcattcgcaacaattaactcaattattagcagagttccgctaataattgcaggattttacaagcaaatggatatgcattttggttttaatgtgaagatttcattcaaaaataaaagtataagctaagctattgttacaagagttatcttttaacacatgatcaaaagacagaataataaatttacgacggaaaagaaaaacaaaagagatatataaatatgtaatatgtaactatgttttttaatattttaaatgcttttatcaatattgttaatgattttagtaaaatttatacattgctctctttgattattagatgatgcactttttgtaacaaagttttttttggaataaattttacattttattcaaaacaaaataaggaaaaatattagtattaatcagactagagtattatttataatattaattaaaaaaaattaactgtagaattctaattttatttctagtgtttgcttggaaactacatagtatacaaaaattagaggtatttaaaaacttttgtccttatttatgcaaaatttgcaatttctgcctcgatttttcaaaaatatctgagaactccgatctcattctctctctctttggatctccatcaccattgactgatttgatcgatttcacagctcgaaccccaaaactcgccactgctccgctgctaaggttcttctacttcttcgactacgggcaaaagctctcagtctccttgtctccttcatcgccaccaccatg

SEQ ID NO: 13207 - DNA, 3000 bp, Unknown
  misc_feature (1)..( 3000): cDNA_ID_2994248_gDNA_ID_2214605_Annot_ID_135645 3000 nt of promoter + ATG
aaacaaggaatgaaaaaataccttctcatcctccaccaaagtcttaagaataacatcaatctcacatgtgaatatctcgcaagagatgaatggaaacctacgagaagaagaatccatcactagccagaaataaagcattgccagaaacattcaacaaataaaagcatggaaaactgaaaatccagtcattataaaagaagcaaacattacttgaaagcacgtttgctatcagcatcgtcctcaggctcttcaacaacataccgcaatagtttctccacttgagttttttcccttagactgcaaataccaatacaccatcagaaacttttccaagaaatgttttatacagtatgtctggatatgtgaaacaaagtagtacaaggcaaatccctcacaaattaatgagtcggctattcaaagctttgcattcttgaataatctcttcctcgtcaagaagctcttccaatgtgaaactgtctttgtctagtatcgactccacctatatccataacaaatggaaagaacatcaactcaggaataaattccaaattgacctgaattgcaatatcatcacaacaatgaatcaacaaccaatctccgtgtaaagctagaggtaaatcaatttcactaggaaaatgaatgaaaaatgcaaacgaagaaccattccaacttcctaaaaccagatcaccaaggaagacgctgagcagctataagaaaggagaagaaatgaatctatcgttgaaactcacaggagacgatgcagagagagaggctagcttccagaacatggtggtggcgatgaaggagacaaggagactgagagcttttgcccgtagtcgaagaagtagaagaaccttagcagcggagcagtggcgagttttggggttcgagctgtgaaatcgatcaaatcagtcaatggtgatggagatccaaagagagagagaatgagatcggagttctcagatatttttgaaaaatcgaggcagaaattgcaaattttgcataaataaggacaaaagtttttaaatacctctaatttttgtatactatgtagtttccaagcaaacactagaaataaaattagaattctacagttaattttttttaattaatattataaataatactctagtctgattaatactaatatttttccttattttgttttgaataaaatgtaaaatttattccaaaaaaaactttgttacaaaaagtgcatcatctaataatcaaagagagcaatgtataaattttactaaaatcattaacaatattgataaaagcatttaaaatattaaaaaacatagttacatattacatatttatatatctcttttgtttttcttttccgtcgtaaatttattattctgtcttttgatcatgtgttaaaagataactcttgtaacaatagcttagcttatacttttatttttgaatgaaatcttcacattaaaaccaaaatgcatatccatttgcttgtaaaatcctgcaattattagcggaactctgctaataattgagttaattgttgcgaatgaaaacattgtggttgatcgcattgtccaaatgatcagattcacagggattcattactagttgggcttaggtttggttgattttgcagtataccatttttctttttaaatcatttttttaatcagacttgtttctgtttttctagctttactacttggtgttaccaagactgtcgatagaaaaatattctgtcaaattaatgcttgtatgagaacatgccgccatggtctacttgtcttaatcgtcgctgatcgaagaacataccttacttagaagccttaaatgcttgaagaattcatacttttaatatatgatcctagaaggccgacacccgagttatgcgaactaaaaacttacaaattttttttttaccaaccagaaatttgccaaaaagaatgtaaagccgcgaaatattggccagtttagaaccataataagaaattagtaaataaaacataaaaagtactatattaaccttgaaaatttgttacacagtattaatttaaatttgattatacttaaatagacatcttatattattaatttaaatttgattataattaaaaaatctatagcagatatgactgatttgacaaaaaaataaaatgcaatattgtcgtttggttggtacagaaattttttcatcacaaattatatcacattttggagtttaacaaaaaaaagcatgctaaattgctacaatataaatcatagttagtgataaactgataatatttgaaataaaattagtacccatattaatgtaaaaagggaaaaaataaaaaatatatgtggtattgtttcttaaaaaaagatatattttaaagtataatttaggaaaccaaaaaaaatgtgaacaaaagaaaatatagattggtggttatatttccccttaagaagtttaattgacctctaaatttggtttaatggttaatctcttttcgtcaagctatattcttccttttgatcaaaacacccacacctcttcttcttcttcgcataaaccttaaaaaccatttccacgatcttcttcttcttcttccctcaaatatagcttaggattttcttaatttcctctacccaagctccatggctgctttcaatttcttcctctcttcttaattctctcaggtaaacaccaatcccttactcgatctacgtgctcaattgattggatctcgttttctctttacttctccggagccaaatctagttcaatttcgtaaccttggatttagtttagctatcgcggagatttgattctatgtttgatttagtcctccttgaactttgtactgagttatcattagattgtataaattgtggtttaatttggtgaatacaggtaggggagatttgagtagtagtagattgttagatttgtaattcagctattggtgaagaggaagggagagagagatgtgttgaattggttgagtttggtggaggaaagaagaagaagaa

SEQ ID NO: 13208 - DNA, 3000 bp, Unknown
  misc_feature (1)..( 3000): cDNA_ID_2713264_gDNA_ID_2214605_Annot_ID_135646 3000 nt of promoter + ATG
taactacacctaattgaaccaataagaaaataggatgtaaaatagaattgaccaaaaattattaaatatatttacttttgcatagaaaaataaaaagaacacttattttgaaagaaaaaaaagttccttaaactacaaatataataaaacagagggagtataattagtttttaacttttaagttttacagagtgatgtattttcatggttactaaactcactggcctatgcagtcagtggttagttcattaccatatttgacaagttctttaatggtatgctattattgttttagatatcttatgacttaaactcttaagcgaatccaagaaatccagattaataatgcctcttcagacaaaatctgaatttgttttatcttctcaagacattacggatgaacaagggattaatacaatgcttctaattaaatgctctgcttaaatgcacctgcttaaaatattatgaccccgaagtaaatgtatttaattacgaagtttatagttacacattaattactttgtaaattaattcgtcattaaataggtaaggaaatggtgaccaagggagagtattcctctcgttttcttccatctttatgtccttaaaatcgttggggttcgcattggacattcatttggatatttatttcttcctattattcctttttattatccgtttgttgtcacatttgcatcttaaaacgtaatggcaatagtaaatattacacatattattaacaacattgttctttataatctaactactcacaatttgtagtttaatgatatctattattactatcgaatacgatataatatactaagtttcagtacaaacaatttattctagctttctgttagtacaaacaatattatgtgcatataatgaaacttttcatgtggttaaatgagttaatataagtcgcaagaaaaaagaaaactagttagtacaaatttatgtggttatgtgatggatcagtcaaacttcatcaacttcgggagattgaaatagaaaaacgaaaacaaatataaaagtaaatgttggccactaagcttaactatgattatgaattccaccttttactactgcaaatcactcacagcgtttattacgataatgccccttatctctctctaaacgtaataagcattttggtaatttcatgatttcacatttgttcctcctctctctctctacccattgacttgtgtggacatggtttcaaaattcatcaaaagctaaattattctttagagatgtgtgaacattaagttttaatatatgaaaataaagtacgcactaacttcttaggtttcaagctgttttctagtattttgttttttcttttctttccattttcatattcctttttattagaatacgacttcagacttcccactaattctatgattaagttaaaattatacatcagtcgaacatatttttatttgttttgatgaaatattttatttaacttctactattgaagaaaagcatatagatcacactattgatatataagaaaaattatactagaaacacatctatgaaattttgttaattttttttagagaaacttactattattttctttaaccaattattttttataaaactaaaatgaatcaatgtggtagatcaaaattggagaccgcacaaataaacaaaagattcaacatagaaacaagttaaacccaactttatagtgaaaaaaggaggaacagccatgagattgaagtttcatggaaccaaggttgtagcctatcaaaaacgtatgtgggttggatagatcaaaattagaaacttttgtttcaaatggtaaaagcagttatttcacaattcatagatagttgaatgctaaaaaaaaaatagagaagatttggtaagtattaaaaatataaaaattgatcggagtagatgtgaatcatgtgatgaccaaaaaagatttgacaaccaaaattgtctttttttttggtgttttatgtattcagccgtttcctaagtgttattatagactttacggtttcgttttctccaaaaaaagtttatgattttttttcacaaattcaaaatgtatctattatacatagttgatgatggaacttgtgcggatttttcaattttttgtttcttttgaccgagatttcaaattacgagttaacgttaaactgagaagtcgcatggattacacattgtttaactagctacacatgattagaacaagttaaaaatactaaacatattgtttttttcgccaaaaacaagaaagttaaaccgttttgacgagtgttgttataacttcgaccgtttcgatgagtgttgttatagattctgccgtttcgttctttccataattctcttttaacttcttctctgttattacaaacgttaacaaaacttaataaactagaattaacctgtttattcaaatagacttatttttttcataccttacaattatacaaattgttcaatatatatttaatcttatgttttatgaaaattcaaattataaagcttacaatagtggtggattatagttaaatgtttttttttgttttttaaatccataaattaagatacatacaaaattagtatagtataaaaaggaaatataaaaatatcacatccatgcaggctaacgttcagttgactagcagcgataaaagcagataattaattctcacatttaattttattttattttttccattaaagcaaaaaccccacactctctctctctcttgctcctccctctcttcctctctctatctctctctgcaaaaaccctaaatttcctccgatttcaccatcttcaatctccttcacaccccaacttagcctcttaatcactccccaagctaaaccctccaacgattttccatgattcgaagatacagagccttagcgatgaagaaaaagccctaaaaaccaaagctttgatctctccgaaatcggagtttctttctttgtttggtaaatttggttttcgaaatg

SEQ ID NO: 13209 - DNA, 614 bp, Unknown
  misc_feature (1)..( 614): cDNA_ID_2713251_gDNA_ID_2214605_Annot_ID_135653 3000 nt of promoter + ATG
aacaacaatgttctatacaattagtacagacaatcgttagacaatcttaagcttacaggctgtccaaatttaaagtcaacgagatcagatcagacttcttaatctattccaattttaggaatcttccttaactctaaaaataatgaaaacaaaaaacatagaaactcgtattccatgcaattttaggaatcttcatagccggaaaccgtaccctaattttttttggtgtacactgttgtttaagctctttggtaattagacttgcatgtggtacgacgacttccggcaaaatagagtaaaattgaaaactcttaaccactttattaacaaaccggaaattaaaattggttacaaagttaaaaactaaaccgaaactaataaactaatcagacaattggaccgaagtaaaatcatctaaccgggtagggtttaaggtctgatgaatcttattcaattttgaaactccttcacttccaataacacttctcgaccatctgccgccacttccgataccgtcatcactaatcgacgagcttccttccgccgccgccggaaacctaacctcccagcgtctgacctatattaatctcactcccattgagccacttccaatg

SEQ ID NO: 13210 - DNA, 614 bp, Unknown; identical to SEQ ID NO: 13209
  misc_feature (1)..( 614): cDNA_ID_3028580_gDNA_ID_2214605_Annot_ID_187211 3000 nt of promoter + ATG

SEQ ID NO: 13211 - DNA, 3000 bp, Unknown
  misc_feature (1)..( 3000): cDNA_ID_3028587_gDNA_ID_2214605_Annot_ID_187208 3000 nt of promoter + ATG
ctagaaactccattgaagtattacattactttattgcatggttcttatatatcatatgaatgatttgagatttattgtaagtaaaaaaataattaacaatgataaatgcatctacaccgattaggcgctggagctgatggaactgattttatgcacataccagccgcttgcttaaacctccttacacacatctttttgcactcaccggtaacacaaaggtttacatctatagtcttataacactgttgtttatatccttggtccacgtctcccaccgctcctattaaaacaatgattcaaacttattatcttaatttcaatatttaaaaagtaaaaaaatatatactattttatccatttttcgagaagatatatatctcgaagagtttcatgtctattaacaaaaaataatctgtaacataaattatgtattttcttattcactaattcttcttgaaaaagtgtcataggatggtaacaataatcctcaataatatgataagaccatatcctctatatattagcagggaatttgaaaataaaatatttagggatcagtgtgctagggtatgcattcggcctaagaggagacacaactttacattatggaattatatactgtattgaacaaaaaaagatttgacacatattaataattaaaacataggtgaattgatatttagaagaatgatgctaagtggtgcacaaaaaaagaagaagagaaaaggtaactaaaacttttactagtcaaccagattttaactaaattgatttttctaaaacgaatatatgtaatatattaaaattttataaagataaatacaaacctaacacaaaaatggtgaacataatcagaatagcaaacgagagttgaatatgtttgcccatcatagatgatatacatgatttgtttttttttttctaaattgaaaaagtaagaacaaattgtagttatatacatgttagatgtctaggtactattcaaacatatctaatttaagctatctcccacctaagattccgaatgaaaaggatctatagtttgacccaagttctcgaccatttgtttattttatatgtaaaacgctttagactcggttatttttttcttctttacaatctacatttgacattgctaatttaaccaaaccatcgtcttcaaaaccacatcgctaaaaataaatgacctataattctattcaagtttaacaaaaaaaaaaaaaacaattctgttcaagtatcttttttggttaaagttctatttaagtatttattaacaaatttctgcagttgttttgatttaaatgaacatagtaaatctacaaaaatcacgtgagttcacttataattgttttgggctgaaatggaattcggatcccacatgagtaatgagtaacttgaaaattcgatcttaggtgacttttaacagaaaggatagcaaatcctgtgaagtgtgtgaacagtgaaagccaaagaaagagtcacgttataatacatgtgaaaccaattaaaaccaattacgtaccaaccgtcaaatatatcttttgacacatgaaacaattaatcaagaatacaagaggtaattaataaatcaaaaaacaacgtaaaacaaatcattattacggttttgtttagagaaaaatatatgaaattgaatggctaatgcaaccggaagccattaggtgattatttcacatgataattttttaggtgattatttcataaaaacgcagcactaaaaaccaatattcttaacataacataccaaatgaagttaatcataaaaataacgtaagatacaagactcaatctcacaacataaatggaaggcgtgaagggaagagatgcatgcttgacccctcttgtgccattatagattagagatcgatcgatgttgtgttccaaggcaggtgtgttattattacactcactcacataactctgtttgtaatatattaaagaaaatatatattgttgctgatccttcaagggaagaagaacttgaatttaattatagattgccaaagtgtaatgattgttcctacttcctacttgtgattctactacttcctaataatgccttaattaaaaaagtataggatgctaacaactaaaggtatgtgattaagtatcttatggaaccagatctagctactcaaattttctaattcgtaattaggcaaagtataaactcacactacaaaaaaatctaagtctagcatcaattttttaaaaaagttagtgttgcttttaaagtgacactagaattatatagtcattttgaaaagcgatgctaaattcagtgaagctaaaaatatttagtatcattttttaaatgacgttataattcatggttaacatcgttattttttggatcttgaaactaagcacaaaatataaacgaattttatttctgtttgattttgcataaaacattttagtaaaacaatcaattaatattatagatgctcaaatacttcaatatatttttgttattaaaatcatttattggatttagcttaattcggttagtttgattctgttagactaaatttatttagatttatacttggtatataaatttttacacggtttaatttgattggagttcgaattgatgaattttggtttgattcggattgattttttttggtccatccctagtttttatggtcaaaaacaagatcggtttagcaaaatctgaagactatttgggttttcattgaaccaaaagatttcaggaccatggaaacagagaaaaagtaaaaattatgttgggaaaaggtagagaaatcatgagaaatcatattgttcccttatgtaaatgtcttatctttttcacccaccagattattattatcaatcccaagcaacaaccactttatttcacatcaccttataaataccaactttcttcatagtctcaacaaatacactacactactcaacttataacctttctacactttcaagaaaccaaacagaagctgagttagagaa

SEQ ID NO: 13212 - DNA, 3000 bp, Unknown
  misc_feature (1)..( 3000): cDNA_ID_3028591_gDNA_ID_2214605_Annot_ID_187205 3000 nt of promoter + ATG
gatctaactagataagagtatgcaaaggtttaagtagattttattgaggcgattaaaaagatgtctatagattttacctcaacgggattcaaatattagattagtaatttataggattgattgataacatacttgtcattttttccgcataatttatggaattaagggattcaccaaactagtttttctaaagaattcaccacaactagctagtaccatcttgaaaaagatgcatgctggattcctaatttccatttggaaaaagtcatatgcatttttcttatggttatttacctttaaacaacaagaggaagaggatttgaataacttttgttttgacaatggattttaaatttcatctcattagtttgtttccttttatcgaaacacgttattaacttcttttctttttggcgaatgaatcataaacagttaaataagtttgcgtatagccgaccgtaaaaaggaaaccaaaccgcatccgcgtggatattttagtttggtaatggcaatggcaatgtcaatttttagacgtaacttagccagtggcagagtggtaatttctggtaaaagtacctatcaagtgagcccaaactgatgccgtgatccttaagagtatttcccaacgtaaagtgatgactgcacaagtcgagtcgttcggcgttttatgtgcgctggtcttgtcgttttgcattctttgtctttttcctcgttattttttttcttttagtttttagtttttaccaaagcgacgaatcgaatataaatgggtataatatcggtaccttccaaattaaacgtcaaatttcttttcactattctttccttgttcttttgatataaaccaaaaaattcatcggctgttatgacacttcaggtacgtctctttcacgtgtttggttataatataactaatgaattcacatgtccaagaaattgactatagaaacaattacgataaaaaagcttttggttgttggcgaaaacaaatagaaaataagtttttggtcaaatgtaagcaaccatagagaactatgaaagtcattgttaggaagcaaaaatttcatatggagaatgtgaagttcgttcatctgtaagaatttagttgatagaatggatgaaagatgagatttcgagctcaatcgttgttgcaatatttgagtgttatgttgcgattgcgaatggtgaaaaagaaccgcatttgtgacaatagttatattactcaccatatgatcgatcatattgctagtgtaacacaagtcacaaagccgattattcaagctcatcaacaagaacgtaaagaaccgactcagctcaatacatgacacggactacgatgatggattggtgagtggctcactcggccaaaaatccgtaacgtagtcatcaagtttctcaattccaaatcttttcaattacgtaatccaaaaacatatacattcattgtaaaaaccggttttttggttgaatacaatttacattcaattcaaagaaaaaaaacacaagtcacaaacttttttcgatagacttaattaacacagatccataaacataaatcttgattacggattagtgttatttcaaatttctaataactagatgaattcccacgcagcgcgtgggtttgttttgaaaattgtttagataaaaagatgttaattattttatcgctaatttatgtttattatttgtttgttattttatacttagtaaaattagactcatcttatgcacttacatttttattgttagattcatttttgactctaaatatcaatttctatatatttcatgtataatctgattatttttatatccaagattctaaaatttgttcattatcatgaacacaacagaatgtaagatatttggattttaagagttttcatatgaaaagaaaaaaaaagaagcaaaaattaaagagttatttttgtaacactttttagattttatgctattgcatatagccatataagacaaatggatttgttttgaatttcgtggtatgtctaatgtctcaaaagtctattacttgtaaatgttgaatgtcaatgttacgaacttacttaaagatacaaaaatgaaaagacagaatttcatatgataagatatgaagcataacgtaataataattaaaaaatcaaggtaaaataactaaactaatattaggtagcaaacaactaaactacaacacaaataactatttagtcattatagagtgatgaccattgaccattaaattttttaaaaaatagaaaataataaaagtaaaataaaagtagtaattgatttatttaaataaataattttataattttatttttattttgaaaaaaatcatgtaagaaattaattaatggaggatttaacacaatatgagacttttgattttctctcaattaattttgctgattttaatttaatcaatgttaaataatacatgtcattttcttgtgtgatgaaataattttataattttatttttattttgaaaaaattatttaagaaatgaattaatggaagatttaacacaatttgagacttttgattttctctcaattaattttgctgatttttaatttaattaatgttaaatgacacatgttatttttttgtgtgctgatgtgtcacttatatgtagagagtttgtcaactttgatatatatgattacaaatgtactcattggcatgatgaactatgaactatccatcggcttccactattcggcagaaaataagcccaagccccatattaagtagcccctctctcttttcaattatatcctattgggggaaaagcccaacaatatgggtcgcaaagcgggtcaaatatatccgactgaaatctggatccgttggtgaatcgtgaatcatcctcttcctcaatgcgagtggacaaagtgatctagcagagagaatcaatgaacacgtcttgccattagaggagaccaaccatttctctcctctctcttgaaaaatctataaccgatttctgcaatg

SEQ ID NO: 13213 - DNA, 3000 bp, Unknown; identical to SEQ ID NO: 13208
  misc_feature (1)..( 3000): cDNA_ID_2713264_gDNA_ID_2214605_Annot_ID_187204 3000 nt of promoter + ATG

SEQ ID NO: 13214 - DNA, 3000 bp, Unknown; identical to SEQ ID NO: 13207
  misc_feature (1)..( 3000): cDNA_ID_2994248_gDNA_ID_2214605_Annot_ID_187203 3000 nt of promoter + ATG

SEQ ID NO: 13215 - DNA, 3000 bp, Unknown
  misc_feature (1)..( 3000): cDNA_ID_2713272_gDNA_ID_2214605_Annot_ID_187199 3000 nt of promoter + ATG
tttctagaagaaatttttatttttaaaaagtttgactccagaatttaactttaaatctaaatgaacactttatgaagaagaaaaccaatagtcaactaatgaatatttttattttatttatacttttgtgtgaaaattatcaaaagaaaatttattgtgaaatgaggtgaaatgagggaataatatgcaactatttatttttcatttaaataaaaagaaacatttgcatgggttaaaaatatcatagtttttaccccagtgtagtacaaaaaaggactgtttatttggcatctaatttcaacatcatataatttaccatgggtttaacctatttcttgttttaccacaatcgtgtaatggaacccatctttcactaacgggcaaaaaaaagagtcaaagtgaaaagcagaaagtaaaaaaaaaaagataaaaaagatttaaccatggttaggtttgtatctggtcaagcatggtttctgatttttcgagtaaaaaatcaaaaatttgttggtacatgtcaaattatcgcggctcgtgatacgataaattgctaattttattattattagtgaagcaacaaatgaaacaaacaagttagttgcagttttttttaatcaaacaaaaaaacaaaatttatttatcttgaaaacaatttattatatattatttatattaaaaaaatgaaaaataaaaagagttataaagtttgtgtttgagataatctctctggtttgtttggttcttgtttctgtatacatcattactaaagagaaaaacaagatgtttatttattacgatggtcttgtccgtacctgattatagcatctctctctatctctctcttcttcttctacgatctgatcagccattaaagctttttcccccttcactattatacctcttttgaagtgaaacaaaatcataaaagtcgaaactttactgtttcctctgcaaatttaaactctaatctctctctctctctctatctctttcacttcgctttctctatttcccctgaaaccgttcttgtctctctctctctctctctctctcttcttctctgctcaagacaagaacttgatgttcatgtcttgaaacttaacaaagtattgatctttccttttaagtaaagaatttgggggttacacaacttcgtctagatggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggttagttagttactcaaagtctcttccttttaacagaatccatgtttgtttgttaatgttacggttatattggttgttataggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttc

SEQ ID NO: 13216 - DNA, 3000 bp, Unknown
  misc_feature (1)..( 3000): cDNA_ID_3028610_gDNA_ID_2214605_Annot_ID_187194 3000 nt of promoter + ATG
attactctagtatagttactttaatacttcaatgttgtatatgatcaatgtaccacgctaaatctattaaatatgtgatttatacaaaaatttacatgtgaactattttttaaaaaactttatctacccagagattagttttgaactcctccacaggtggtgaggatttatcttcaattaacaggaaaaaaaaagtttatcatcattcactctaataaatttatttctccagttttccatcttcattttttgaaagtaatatatattaaaacttgtaaattttaattttataaaatatttatattttacagtttataattgttattaagtaacgctataccacgaatccatgagacaattgttaaaatttttaagttttaacccctattaaaacagcatattaaacatatttcaaaattttataaatattgattcaaatacatctaccatataacccaattccaaaataaaacccgttctgtaatttctttacccgtcccgtggtttttttaaaaatagtaatttttaaaatttaagaattattttttatatataaaagttttgcaaattgtatcattctctaatacatttatattttatagtttaattttatatataataacattatacataccacataacatttttggttttatataaccttttctaaattaggatgatttgatatgtttaatattagtggtcttaaaatataataaattaaagatttaatccgtattgaaattgtggattaattatattttacttttttattaatgttgattcaaaaacccgtccctccaaatccgtcttgccaaaaagccatttattttattaatattaattttattaatgacatgactctgaattataatctaaacattttatctaataacaaatgagtgcaccatatttatttaataggagactgtaccatatgacccgaatgcacttttatccaaatccaccaaaaaagtcttgcaaaaatactatagagataagaaacgatagtcggttttgataggtataagattagcaactatataagttagcttaaattagttaaagaatacaaattgaaaagatatattacactttattcgaatatagtatcaaaacttatataacacagagatttgataattttttaattattgaatacattttttgtgctaatttttatgtgattaagatttaattgatttcgtatataaaatattaaattgttttacgaacttatttgtttataatttggtaacagatagatatttgaatattcagatctttgatgacccgtctttagatccaataaaccctataatctagttattaacctgcagtataccgcaggtaggcttatactttagttaaactaaaaacttttattgtaaagatgatttaaatatatatgatattattttatttgattttaaatgtatagtaaactgtgagttgtatatgttttgttgatattatctatattgtttagtgtttaagattatacacttgtagtttggttgttaatttaagagtttcacctgtagtatatcatcttgtattaatatcgatctaaatccgtccattttacgattttccagcttgtattaaaaattgaatcacatctaatatgttattaattactgtagtatataagattataaattttcaatataatatgtgtgaaattgaatagaactatttcaaattatgattcgttactcagtagaaagttttcttaaatctatttttctcccgttataatattttttcatgtattgaacagtttatattcgtttttaaaaatttaaattatggcatatgcgaaaaaaactctaattatttgtttataatgatgatattatttttcggcaaaaatagaatcatataaagatgagaagtgaactataataattaataaaaaattaatatgataatttagatattaaatctaatttgttgattttaattggttacttttttggaaattaataatgtatttcgtttttctaattaaattaaattaattaaaatttagatatcaaatcttatatgttaattttgattggttattatttttggaaattaataatatatttcgttttttaattaaatttaattaattaaattagtatttgactttttaatctttaaagagataaattaatttactctttaaaattttatttctaatggtatacccatgtaattacttacaaaaattaaggttacattttaaaatgtacttcccaaataatatagtaggattttattaatttttatttgtctttaaacaataaagcttaaagcaaaagtgaaaccaattacaaatttacaacagttgcgatgtgtctagaaaagcgaaaaccgattttaaccctataaggccagaccaggccaaggcctatcatatcaaaaagggcaaaaacgagtgaatttggacaaaatcgaaaccaccaatcagaaaatatatgtggttaaaactttgaacacatcaataaacacgaaaagggtaataacgtcatttccataaattcgtaatcattcgtcctcaaatctttattgtcacttttacaaaaaatactcccaatttcagagaaacctgttgaaaaaaaattcagggaaaattggaaaaagtgatgatgatgacgagagatcaattcaaatcttaagtcctccaaattttaaaaatttcgatctccactaccttcgtcatcttcctctacttctgattctcttttctgggtttgtcgtttaatgggttgattttgtatcgtcaaaacggagaaaacaagaagacttcttttggttttcttattgcgaagaagatatttctagggtttcgagattttctgggttttctgggtttttgtgtgttctttgattggatttgattattgggcaatttccttggaattcaagaaacttctaaggttcttaaagtgtaaagctttgtgattttctcttattcatacattctaggactttggttttggagttgta

SEQ ID NO: 13217 - DNA, 3000 bp, Unknown
  misc_feature (1)..( 3000): cDNA_ID_3028614_gDNA_ID_2214605_Annot_ID_187193 3000 nt of promoter + ATG
gaacgaatgaaaatgcaaaggttattattactactattttggggatagtgtttgggacttttattggtatcacattaccttcactttcgtttaaggtatgagttttgtttttcataggtccttttatgtgtccctttcatttttgcacctgttgaattttgtttcgtattcctgcagattaacttaccctcgcgccttatatcatctcttgatgtagccatatctggtgacaaatcccctgaagatttcggttcaagaaagtttcctgaggtatataataaacttcttgttcggttccctttcgttagcttttcgattatgttctagaatagtgcctcatttcagatgaaatgtatcgtttctgtatgtttgattgcagatatatgttccaactaacccgcgtggtgcagaactactacctccaggaatcgttgtggcgaaaactgatttttacttgcgtagattatggggagaacctaatgaagtattgacttctcattctatatttactttctcaatatatatggttttatctctgaaggccattagaatagttaatgtcaaaacaataacctttgcaggatttgaagaagaagccaaaatatcttgtgacatttacagttggatttgagcagaggaaccatattaatggagttgttaagaaggttctgcaatatcagcatgtgttttagcaagtattgttttatatattctttgtggatacactcagattttttgttttcttgtcatatcttcagttttctgaagatttccaaattttgctcttccattatgatggccggacaactgaatgggaccaatttgagtggtcgaagagcgcgattcatattagtacaagaaagcaaacaaaatggttagtcatctggtcatttaccggttattaagtatgtttgtcgagtatgtttttatcgaaattctctactggttttggcaggtggtacgcgaagaggtttttgcatcctgatgttgtgtcagcttatgagtacatatttatatgggatgaagatcttggagtggagcatttcaatgcggataagtaagttattacttgtctgaagtagcagaacaatcttatattttacattttgtgatggaattctattaaaacttcaggtacattgagttagttaagaagcatggtttagagatttctcaaccaggcttagagcctaacaatggactcacatgggaaatgacaaagaggagaggtgaccgggaagtccataagtaagatctccttctctaaccattcttctttgcctttctttcaaatttggttctgaattaagaaatgtgttgttacttactgttgaacagagatacaaaagagaaaccaggatggtgtaaagacccacatttacctccatgtgccgcgtaagtctctctttgaaacgttctctttagagcaactcaagagtgtttagtcattgtcagtactgagttttctgaaaaaaattccctctcacaggtttgttgaaataatggcgcctgtattttctcgagaagcatggcgatgtgtgtggcatatgattcaggttcgtcgatctgtagatacatagtcctagtcttagtccatcaaaataatgcttgttgttttgatcagtttgtttatgtttctgatgcagaatgatctggttcatggatggggtctcgactttgcgcttagaagatgcgttgaagtaagttgtttttgccccccccttgcttaccttaataacacaatattctcttgactgatgatgaaaatttgtgtgttttgcttttgcagcctgctcatgagaagattggtgttgtggattcgcaatggataatacataaagtgataccttcacttggaagtcaaggaaagtcagagaatgggaaagctccatggcaaggagtgagagatagatgcaaaatggaatggacaatgtttcagaaccgattggctgatgctgataaagagtatcttgggaagatggtgaaagattagatttgtttttcttttttctttctatataattaatatattaaaaaaacttttacttttgtatatcaaatattttacactaaattaggttttcataggacatgtgtgaagccctttttattgatattgtgtaagatttatacattttgattgagctttattatgttgtttgttactttctccatttcaaattcttagatgtttttaaaaagaaattgctttcactaaacaagagagaagtgaaacatgtaaaaaaaaaaaactttagaaaacaaaggtgtaatagaagtggttgttattacataatctttttgacttctgaaaagacaataagaaaacaagacttataaccagtttcatgatttatctatttcacccaatttcataaattggctattttatatttgctctcaataggtaacgtaaatggtagagaaattaaggagaagagaagggtattggtatggactttggagtgagtgtgaagctttacaccaaatccaaataatttcaattttcattttagtttctattttacaatattttgcccaatagaaaaagtatgagaaattcagtttcaccttcctttttgcttttagttcaagtcaattgtttgtccatagaaaaccatacaatgtctccctccattggctgtttcatttcagagtcttttttatggttaagaatttgctatcatatcattagtagaagtctcttatgaggaaaaacaaatattaagcaacatcattatagtttttctcatgtatcttgtgcgtaattatgtaaatgtcataattattaaaacatgaaattaggaagaacagaagtttggtgttagacaccaaccatttttatacaaacaaataataaaaatctcattatatcacctttgcatttcatcactcatcacattcacaatccttctctttttctcacatcaatatatatctctctttctctctcttcatttgatagatttgaagatttgagaggagagagaggaagaaaaa

SEQ ID NO: 13218 - DNA, 3000 bp, Unknown
  misc_feature (1)..( 3000): cDNA_ID_2702326_gDNA_ID_2214606_Annot_ID_135656 3000 nt of promoter + ATG
gaagcctctctcttttaccggttggagattgttttgttcaattgaattgtctttggtataaacccaaagaagacacgagcgtgacgggaaggaagatggcctcaagtgaccgtgatagtgatgttctctctttctctgggttggaaaatttaactgcaatgaaaggagaaatcaagatcacaaataggcaacgatgcgttaggtgtttccagcatatcatatggagtttcaaaagacaagaagcagaatcatatcaagcaacaattcaggtttttcttttaactaaagtaatgcgaaaagtattttggagtttcatctatatggtgatagccaattacgagtatgtaaaggagggacgtaacagatttatctgttagcctgtaaggcttccgatcggcaagcatggtcaattccacttctttatcgaaattgttttcaatttcttttatttgtgtcaatggttgtatatgagtggtttatatatcttgtaaaactttttatgatgtaatagatttgattgccggaaaaaaaaaaaaaaaaaagcttaacttttattcattatgagacatgaactagagtatatggctgttgttcctggagcatatcaaggaaacttaaaagacagataactaccaacccaaaactcaaacacgaaattgagagacaccaaaaatcatcacaagaatttgctttctctttgccttaaataaaatatgaaatcagttgtatacccaaagctatatatatagctctctaatggtcttatgatcagcaaatgagtatgtgtgtgcatgtctactacttagatgagtttctttttctcaaagaaagttttcaagtgccagaattgtagaccagccaccgataaacaaaccacaagcgacccgaaactcaaccacgccatcttcgagtttgtggatctattcagttcttgcatttcctcttccctactcccacaaaaccaaaacacaataacaagtattaattaacctcatcatatatctctctctcttccgaccaaacaaaaactaaggcttaaaaggtttgttctttgtctgttacctttcacgaagataatacatctcctcatgtatggaaataacagtatccatcaaggtcttaacctgatactccatcatctacaaaaacaacatcaaagatccaacaacaactaggtttagtaaataaacttttaaaatccacaaactctctacactatcttctctcattttcacattcaaaaccagacaaaaccctagctcctagcttacatgctcaaatttcatcaaaccaaacacaaactaaaaaaaccacttacatcaacttgactcttcttagccacattggtccactccttagagtgaacaccagtcttccaatcaaaatcaatagtcaacgtggtctccggcttataatcaatggcagtgatgcacgctacgtaactcccattttcataagcagtaaacgagaactgaccagcctctaccttatcggcttcgtgcaaattcttcccttgtggtggcatcacctacaataaccacaagataacaaataatgttttaaaaaaaaatctatcaattgtgagatttgcgatgaaatctataccttgacgatgatcttgtgagaatcaggaagaggatgattatcttcgttagggtttacgatgaagtatttaccaatggacatggcgttttcgtgaatctcctctccgatacatttcgttttcgaagactttagttcgtaacgcattgatagtgtcctaggagataacaacgcaatgatcaaaagcaaaatcgagcttcgacaaagatccatggcgtcaccagaaaagagaagagagagagagaaagagataaaatcttgcagtagtcaatgtttttttgccgtttagggtaagacaaaagagagtcaaagacgttctttgcacacgtgtaattatttaattggtgaagacacgttgacaagtcttctttgtcatgagcatattatgggctttgtatatggaactgggcttagttttgtaatgaactttcacttggcacaatatttgggcttacatagattaatatatccgaaatttaaattttaaattttcaatataggtccgaacattcatatttcatatcggattaggttagaatttttttgtatttggataattcggatgaaaaagtttattaaccattcggattatatgactattcggatttgtatggatttcaaatcagtttttgagaaaaaaaaactaaaaaattgtttaattttaatcaaaaatcgtttaattttactaaaatttggtttaattttgcaaaacaaagtaaaattataacaaatagaactaaaagaaatttggatattaaggttatagcgaatatttttgttatttagtattttttgggtataaattataactaaatatcactaatattttaagatatataattttatttcggattacagatatccattcggttttcggttcggattgaattcagttcggggaatttgggtagaagaattcatcatctgtttgggttttgtgactattcggttcggtttcggaaccggattttttggatcggtttttagatttcggattttatgcccagccatatatatatttttttataagctacagagatgatgatgatgatgatccaaaagagagataaagatgagatcaatctgttgggattttcaagtttttctaattttgaaaaataccatctttgcaaaaatttcgattgttttcgaataatcttatataaaagtaggtgtatttcttaagaaaaattcaattttctcacgggaaaagaaacataaacatatagaaaaaaaacaaaacttcgtacggtcgtatctgtattttttgtccgcacttgtttcggtcactaatttcataatttcggagaaaaaaatccacaaaagtttcaaacttttggcaaattaagcggtttttgttaggttttaattattttttccgatgatgaagcggcgatg

SEQ ID NO: 13219 - DNA, 3000 bp, Unknown
  misc_feature (1)..( 3000): cDNA_ID_2702339_gDNA_ID_2214606_Annot_ID_135661 3000 nt of promoter + ATG
catgtttttgttgttttctaacattttgcatcatccaaagtgaagtcttgctttctttgttttcacatactttaacgtaatgtatggcgaaacttccttaagaggataggctgcaagattgaatgaaactacacacttagaatttttgttttccttcctaagaatgtaagtattcataaaatgaaaatgtttatgttttacacgcgatacctaaggatttggtcccatgaccaaaaaaaaaaaaaattagaaatatgctggtcacaactctctttagtggcatttgctaaattgcattgtcatatcacggtgcaaagtagagatctccaaatctataactaattaataacctctggttttttaggccaaaaggatcgtctcctaaacaacaacttgtgaatccaagctacccaaagagcatatgcatatcagcatataaagaccgcattccttcttgcggtgcctcttagacccaatactcctttttctgcctcccctctgacaatcaactttaatcttgcatgcgactattggaaatgactctactttaaaggtaacagaagcttcaaggtctctcagagagcgtttaggtagtgtcaaaacagaacatcataacttaatggtgttgtgtatgaccaaaaaatcatttttaatctcccttcaaaagataatgtcttattgccaaatgcaatatcttatgcattttgacactcaaaaaaccttcatgtatttctccatcgactcggaattcgagcttgtgacctgattgttccaaatgcaatatcttatgcattttgacactcaaaaaacttcataacattttagtttttttaatcaaacatgaagcaacatatataaaacagaacaatacatcaagcataaactgtatcccactctatttctctttgatatttgtatatcttcttacatacacgtgaaactatatatgtctgtataataatcacacaacacatagcaaatgctcttctaatacatacatatatacactcgtctcgttacacgattcgaaccactcgaactctgcgtcgtgatgataacaactcgttcaatctcccaatttcaaccataagttcctttattctctacaaaatcacataatttccaataaaaaaaactttcttaagattactatagctctataagctcagaattagttaacacaaacctgatctttctctctgaggagaagaagcagaaatctcagtttctcttcatgtagccgtctccaccatctcacgagcttcacataaacaaggctcaagaccaacgagaagcctccaatgattgttaatgaccaaaatacccttttacgagttaggtaactacaacgcaccctttcgacggcctgaaagatgcacactgagttcttgattaatcgcttcttggtagtctcaatcactcgccacggaagccaaagattcacggtggaggggacaacagaatcttcatcatcgtcgttgatcgttggattttcacggcggtggcttggttgtaatatcggtgagtttggaggggtagatgcgtcagtacgtggggatttgggtgaggtttgtataacaactacccattcactgaattcttcttcttgctctgcctctgctctgttcataatttggataatgttctgttttttttttgttgttgttgtgttcaaaatattttcatttgctagttgagaacaaaatatctaatagaatgataatgacactattggtttctacactctcgtatttttatattcaaaattaatgattttcttatttataaattttaaaataaatctataaatattttagtagtaatataaacttcaaagtactttcagctgatatatatatatatatatatatattcatatttaataaacagattaattgtaaatgaaattttaaacaatcaacatgttaattaatttaattaaaattaatacttatacgcatgtttattatttcgtgctgtgcatgggtatgatcagaattaaattccatgcatgattatattattatatcattaacttatgttccaaacttttcttatacaacgtcttctctacattcataatttagataaaaacttaaaggtgaaaatggttccaagaatattgcatgaatggttaacatatatcggtaccttctctttgtgttttattttattatatatcacattacatatatataatcctttgtatagttctgctcttaatttatcttttatccttttcagcttcaaaagtttctgaaaaacttagcttccgaaaagcagcagaggaaccaaaccttcctattgctgctgctactactctgatatcacctcaaggtcgagtagactttgtctttatggacaatgaagcacaagagataagaaatgtttcgccgacatcacaagaacttccatcttcttctactacttctatttcacatagtaatgaacgatctaattctctacgatctatcgttattcagtaaatgtatatagattttctatcttatactacaatatttaaaattacaagataatatataaaaaagggtgatccttaaaacaatattttgtttgaactcaacggattttcctacatttttactcaatcatatacgtggaaatgatgataaaattatatcatatgataataaaattgatgggcttaaatatattatttggactttatattcaggacattgttttgcgtggtaaaaaggtgtgacccttgcaggatttagggtttgtaattcgtagtttgacagagacaaatccatcatatatattgagatgatactcatcaataacattgtgttagaagaaataatggtgagacttcccgtgaaaaccctaattggatttcaaagcgtgtctaaacactggaggtgtacgatagagtcgaagtctttcaaggagagattttgactttattaggaaacccaagaacccaaatttctcttaatctatgaaagcgagtgtgagagtcttgatatgaagact

SEQ ID NO: 13220 - DNA, 3000 bp, Unknown
  misc_feature (1)..( 3000): cDNA_ID_2702343_gDNA_ID_2214606_Annot_ID_135662 3000 nt of promoter + ATG
aaagggattttgcttagagggaagctgatgggtgtggaaggaatgaagacaaaagtgttggtgtgggttaaagtcacaacaatctcagtcgagagctccaagtctgacaagctctggttcactgctggtgtcaagaaatctcgatctaaggatgtttatgacacacctcatgatgctatcaaagtcattggagagttctaaggatttttttcacaattggttattatcatatttgattcatgaatttatttggggttatttgcattttgggaagaggtatacttaaaggaaatgtgtttatataactctcattttcctcctttatatgcaagaaatcacaaatctttatcaagccatagtaccgctaaatattactttgataatgatttttaatcggtagtaccataacaacaatatcaaaccattgtatagagtattgtttggtttcttgaattggtggtaataaggttccacatgttaaccgtaaaagatattgtttgtaccaacaatgggtctcaagatgccatcaccatggcctaggtaaattgtgataaacgtggaggtgacaattttatcaacctttaagtacataattttatgtgatgatcttcttcttctttttattttagctccccctagattgagctggcccaaacggccagacctaaacaatatttgtggctcatttttactcaagatttttgttaaccgaaaaaagaaaagctttaaatcataagattcttttttgtgcacccaattcataagatttaaaccactgattttcaaataaatatttggaaacttaaaaacaatatcttttaagtgatcttaccgagctcaaacttcacttttgctgatggtttagcaaactaagcgttttctttatcgcttaattttcattcgtttgttgtttaccgtatattgttaagccggttttgttggaggatactaatgggcacacaaactccagaaatgtccgattgtaattttctacattttttatttgaataaaacatagggggcaactgccttctatcattcaccaaaaaaaaattcactcttgctttgctttatgttcggctaaatatgaaactcacacaaaatctatcagtcctttttattgtcgtcatactcctttctttttttctataattgtttttaatagaaatgtgctgggccggccctgcaggctagattttaaaacatgaagctttgtactaagaatctgattttgcactattacacgatttactcctttcgtatattctctctatttttttacatattcgatttacacctttgtttccgtttctatgttttatagtgattttttttttttttttttcacatgttttatagtgattttttataaaatatttgcttggctttctcgatgtgataagtgaaagacgcgattcgttgtggcaatgaatgaaaagggccccatttgggtcctacagatattaaggatgtattgtctctttggcccgttttcaaagttacttgggccctccataaagtcaagttgtgttttcattttttgtttactccatcttctcacgtttcctctttcaccattttaccaaaaaaagttacttattatttaccaaatcaataaactccataaaatcatgacgagaaaaaaatataatccataaattgtttcatttaggacataaaacagctcttgtgagttacgattaggcttaaatcgaccataacttccgattcattttatgtatacgtggcgaaatgcaatttgtagaacgtggtgaagacaaattggttataacccgtcgagtcgtgcttagagctgctggttgacttgcgaggcacaaaccatcgttgtctcaagggacataattgtaatataacacattaaaccgacgctttttataaactactttcccttattagccaatcataactcaacgattactacaaaaatagacgaaataagacataatgaataaataaatatgagaaataaaaaaggaaatctgttagatccttgtcttcaataaaccactatatacttccaaaaaagttattatagcttatgcatttgtttttgggttaattcgctaaaaaaatcaaacatttgaagttttgatgttttttattctgtcttaaatttattatttattataaaatatgagaattgttatatagacgattttattatagacaattccttctgactctctttagatccacgacaaacgttacctttttctcattttctatgattttgatgaacactttcaatgattttccctgcgtaaaatcttgacgaatgactataattgtacatcgttggagatctcctgcatacttgtctctattaatctatcgaagttttgaaattttaaagtttgtgtataaaatgatacggtaaaaaattataactaaaatgaataattgattttgtgcatattttacaaataatatgatatcatgttattgtattttattacatgttattttgcaaagaaatctctatattttaattatcttccaaattaacttaaatgttttatgattttttttttgtttaatttcttatgtaagcaaccaatgcaaatttaaattcatgaaatactttactttcttttgtagcattcattacgatgtgtcattttttttgaaaatcaaaaattaataagaaaaataaaatggataaaatgaaaaagacagagagtttttactctatcatatctgcaccgcagactttatactgtaaacaaaattttattcatatttttcgagatctgcttgaagagacaaacacaagaaaatcacaaaaaaaatctctcccattaaaagactgcacaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcgatg

SEQ ID NO: 13221 - DNA, 3000 bp, Unknown
  misc_feature (1)..( 3000): cDNA_ID_2702318_gDNA_ID_2214606_Annot_ID_135663 3000 nt of promoter + ATG
tttacttttatattacctaatgttttaacgatcgagtcaacatttttgcaataactcacacatacttggctggatttgaatctaaatgctaacattacgaaaccgcactaattctaaactccggtcaaaagaagcaactaaaagtaaatgataatgattttttagtctaatgaaaatttgtttcttgttagtttataattgcctttttccacgggattttcttgatgagttaaagggttacgtgataatttttttcttcttttaattttttgttaaaaggttacgtgatagactgctatatagttaatccggaatgttctataaatagaataatacaagttaatctattgcatgggaattaaattcctgccaataatttacttataagcatgtgaagtgtttcttcatttaataacttttgtttttcttgaatatttttatagtaaaaaaatttcttgataaaacttttttaatagttacttattgttttcttacaaatatttacgttgcgttttgaccaaaaaattgaaaaaagtttcctctgtaggtacgttacaacaaagatgggaatcaagaagaacaaagcaaaacccaaaagtgatggctgcatcagcaaaaatcacatgtgaccgatcccacactagttacgatctttgctccatcaacggctcatgtattctcaaccctaaaaccggaactctaactcttatggaccgaacacttaccacatcagcaccacttgtcgagaaaatcaggccatacccaagaaaatcagaaaactggatcatgcctaggatcagagagctaaaactaacttcaggcccatcggacctgacacgatcatgtgatataacacatgattcgccggccattgtgttcagtgctggaggttacaccggaagtatttatcacgattttatcgatggtttcatcccactttttatcacggccaactcggtatacccggaccgcgatttcatcctcgtggttgtgaatcctaaggaatggtggatgccaaaatacatcgatattctaggtacgtttagcaaacacaaaaccatattactagacaaagaaaatgcttctattacacattgcttcacttcagccactgtgggcctaatttcacatgggcctatgacaatagacccaacccaaatacccaactccaaatcattagtagacttccataatctcctagacaaagccttgaacccaaacctatctattatcaaaattaacaagcctcgtctcatattggtccgtagatatggtaacattggtcgagtgatattaaacgaggaagagatcagagagatgcttgaagatgttggattcgaggtaatcacatttagaccatcaaaaacaacgagtttgagagaagcgtataaacttataaagtcaagccacgggatgatcggggttcatggtgcagcattaacccagttgttgtttcttcgaccaggttcagtgttggttcaaattgttccggttggactaggttgggtgtctaaaacgtgtttcgaaacgccggctaaagcaatgaagttggattatacggagtatcgagtaaatgtggaagaaagcagtttgatagagaagtatagtagagatgatttggttttgaaagatcctattgcttatagaggaatggattggaatgtgactaaaatgaaagtctatttaaaagatcaagatgtgaggttagatgtgaatcggtttaggaaacatatgaatgaagcatacaagaaagctaagtcgtttatggacttaaacggttgattgatttttgtgttttatcgaaatgatttgtaagttttaagctgtaaaataatatgtttgtttattttttgtgtctatgtcactatgtgggtatgagagcaccattaattattggtagttgcttaggttaattcttagaaaagtttggttataaatttaatgtttttaatcatatatttgttaaaaaagtctcttatataagagacaaattgaagtattcttagttttcgtttcaaaaaattaaaaatcaattcataaaaaattctaagaactaagttaacagtaatctaagacactaacaataatgatgctttgatgttcttataaactgatatgatcttaataaagtgaaccaaaactaagacgaaattttatattttaaatcatttgtgtcatattggtgacctatagattggttcaatgatttttgaataatttttcataattgcgatgtaattagtgttgcttgaaattattgtcagcttcttatatgagttttttaattggaccccaacgcatctattttattatccaagtttatttggcgttgaaactaagcttgcacttttctttatcttctttctaccttccgaccataatttcatttatcagaaaaagacagatgcactttaacaaacaaattttaatgttgccaaattatgcattttttttaccattaaattttcatgttttacttattgttcctgttgattttgcttcgattgtaaaagaatatttgcttagatctacgagactgaaacgagttccgttgtaattcgttttatattttttaataataaattccggtagaactttctccgtctatttttcatttttcttatcaaaaaaaaaaaaaacaaattttaatttttattctatttttcaaataatcaagttttcaaagaaaaatggaaacttgaattttagtaatttcaaaattcattagacggttagagagtcttcatcattgtttaaacatttccttaatttgacatttagccatcaaaacggaaatttagttggaaaataaagtaaatgacgaagttacgtaaatgcccccggttctttcatatttcttcaaaacagtttttggccaatggagaaagaaaaattgagagtcgccacagctatcactctgctctgtcactttgtcttttactcagagaatcagagacagagagagaaagagagagagagagagcgaggggaagggaaatg

SEQ ID NO: 13222 - DNA, 3000 bp, Unknown
  misc_feature (1)..( 3000): cDNA_ID_2702351_gDNA_ID_2214606_Annot_ID_135665 3000 nt of promoter + ATG
cagaactctagcatagctcaaagcatctagcatccaacttagagatgttctgttggttttatacccatgtagatgtagttatcacttagcagttagcacgactgttcttgctatatacactgaaacaagtcaactttattcaagaatgctttgtgtataaatgcttctttgttcatcctaactgacttatccagaaaagccaagacaactaacttactgctattccattgtgctatggcctgcaatcttgctcagacctctttgcttcatcagatttctcacttctttagcctgattccaccgtccatccgatgcatacaaattagagacgagaacataataagaggcatcatcaggatgtaaatcaagcatcttcttaatcacaatctccccaagatcaaatcttgaatgcattccacatccgtgtagaaatgccccgaaacatctcacgtctggttggattggcatcttttcgatgatatctaaggcttgctcaagctcacctgctcgagctaacatatcaaccatacatgtgtagtgttttgttgaaggcgtgaagttataatctttgtacattgagctgaagtacttcttcccttcattaaccatccctgtgtggccacaagctgataaaatagatgtgaaggttgattcgttgggtttttgttgctttttcagcatctcctcaaatagctcaagggaccctattgtatccccttgctttccatagcctccgatcatagcactccatgtgattgtgtttttctcctctatagtatcgaagatgagacgggcagattggggatccccacatttggcatagaagtccaggagtgcagtaccaacatgaacactggatgatgccaggaaacccaatttcacggaataggcatgaagtgatgaacctacagctagagacccaagggaagcacaggctgaaaaaagactcgcaactgttacaccattaggcgtcacagattctgaattcatgcgatggaaaagaaacaaagcttcatggatagagccgttttgtgaaaacccggaaattatagaattccaagcaactatatctttctctgactccatttcaaacacatatttagcatctctattctggtaacacttggcgtacatgtgaaccagagcatttgcaacatttgtatcccaaataccaactttgatggagaggccatgaactgatcttcccagttcaagattctcaatcagaccgcaacccgataagacacttgcaatggtaacacaattaggcttgatttcaacccccttcattttctgaaacaagctcagcgcctcattcacacttccgttatgggtataccccacaatcatagctgtccacatgacaagatccacatgagaatgctcattaaacacccgacgtgcattgcttatgtcaccacacttaacatacatatcgagaagagatgtcaccaaacatgagctgagctctataccactcttaaccaaacaaccatgaaaccactttccttgatgtaaagcactaagctttgtacaagccattattagagtaccgtaagtatattcattacccaaaacattgttttccctcatccgattaaacagaaccaacccttcttcgcacaagtcgttcttaacatacccagcaatcatcgaagtccaacaaaccacattcctcaaagtaatatcgttaaacaccttatgagcactcttgatttctccacacttagcatacatatctagaagacctgtcaacacaacattatcgaaactcggcaccttaacgagctggcaatgtatcttcttcccattgtctaaatcctgaagctcagtacacgctttcaaagctttcgagaaaacaatatcatcatatctgaatccatgcttcatcaataaatcatacaactttacgacttctacactctctttattcaagcaataacatctgagcatgactttccataaataaaaatctggttcaggaatttgatcgaacaccaagcgtgcatctttagtatacccaaagaaaccatatagactaacgagcttggtggcaatcgagatatcacccatgagtccatttcccgttaaaactccgtgagattgccttagagaatcaatgttcgtgcacttacttagaaggagaaagcacgggctcgaagcggcgtaatgcagagaagacccatcattctcttcagtcaaaatcaattctttgatagtcgtaaaagagacgcatctcggtggaaacccgaatcttctagtcggagaaagagtgatagagcgtagcattgatcttcttcgccgttcacaacttaccggcggcgtggctttcccgccaggttgttggtctcagcgttttgtaacgaaaaatctgaatgggccttaaatgggcttataaagatctaaagccgttgatgtgtttcgcaactacatataacaaaaaatcacaaatcgtaatcaagatttcataatttaatcatgttgagctggagaaaaaaatcatggcataaaaacaattgattctataaaaaaaactatatcttttgtttgttttttctagtttttgtctctttcactatttaatatttgataaattataatatggcaaaacaacaaaacaaattgtaaataaatagctgtaaacgcacactccaattgtcaattgaaataaattattaattaaatgttatattttaatattataagacatataattaagaagttacattttttacattataagcgtcgataataagacgtatcattctctttttttatttgctaaaaatgttaatatttggttagaaaatgaaaaagttaagagttacaagaatataaaatttatagtttggtcctatggtaaaaaagaataaaaactatgaaagcaaatatcattcggtccattgacataaaaaaaagtaattaagcttctggaatcaatgaagcggtacaaaaattttgatgaatcgcatataaaacatctcaaagaggaagataatg

SEQ ID NO: 13223 - DNA, 3000 bp, Unknown
  misc_feature (1)..( 3000): cDNA_ID_2994508_gDNA_ID_2214606_Annot_ID_135667 3000 nt of promoter + ATG
tagcaatctcattcataaccaatgctttatcagtttcaaaacctacatcttctttctcaggtttcaaatcagcaaacaaacgaagaatcttggtccgattcgccacgagaatcgccacgatatcctcaggtttgttctcgtttgccacaaagagtttaaagatatgaaatgcttctaactgaatgttcttggttggttctcttaaaagattcatcatgattctcaaattatccaaactgctcacatactttaccatcacacctgaattcgaacgatccatcaacacatctccaagcaatttcgacgcttgtctcttcgtaaaatagcttcctttctccaacaacttggtgttatactctgcgaaaaaccattcgtagttcttcgcaagatactccgctacagtcgatttatgcctcgtcaaaagctctctgaagatcttgctagcatcggtagctacatcgaaatacggaagctgaacataatcgaaaaacttctccaaattcttcgattcgagtatgtactttgcaacaacctgatgccgcacacattctttaagcattcccgtgtaatgcaacgccagctcatggtcgtgatcgataccttcgactaacgaatcgataacatctaagttcgattcaagatattcagaagcaacgagtcgaaattcgacttgttgcttctgaagattcgcgacaatctgtgtcgcgtcttttcttgcttctaggtcaagttttggtatagatttgatcaaaggacgaagcgtgtctgctcggaaaaactcttgagttaacaaaagacaagcttcaggaacaggctcagcttcaccattaccataaagaatcgatttcaaatctctaatgtttcgacacaactccgcacaaatccctaaccttttcgagtttctcgcatcggtttcttcttcttcggattccgctaaagcgatgagatctcgagtctgacgtacgatttcaccaggaagacgtgatttgttcttgaagagacctttcattctcgtgcttcctccatggtttccgaggttcccgcttaaactgctaagcttcccgctaaatgtgatgttgatgatggattcatcatcggtggatccgacgcgtagatggctccgtgtacggcggtgctttgacgacggagctaaatcggagcttccgtgtcgtttagcaccaccgattatggagacacacgcacctatgtttctcctttttgttgacctcaaaacaaagtacaaaaagaaaaacagagcaaaaacaaaatctatgcctttctctatctttttattctagggtttgttcaaaagctttttcaggggtttcgctgtgaaatccaaaaatgttgtttctatgaaatcttcttctttgaagaaaggaagaagaaagagacaacaaaacctaaaaatggagtctttgattggctaattttgccgcgctgaattttcgttgtggttagtttgaagaatctttgatgtcaattagatattaaacaattttttgaagcttattattctacacagtccatatctctagtcaactaattatctaattatgttttctctaaattaataattcttcaaaattttaatattttaaaattgtgtctattcattaaaagtcttttgttttcatactttttcacaaatagttgcattttttcaccacaattgttttgctaattatgtttggagttttttgttatatcttaattctcttttagattattgcatatatcatatgtttatctaatactcatgtttttaaaaaggttttatctatttttctttataattttagacaattaccaaatttttcatgaaatttatttttagaatgtatattcatatatatgtttgatttttaaataactacattccttctatactttcaaaactatttattagcttatatcatattaaatttgaaaaaattcacggactcaacaaattttgcagatagagaatgagatcacgtatgatgcagagtgatctcgactctctatctacgaaaattgatcttagcttgaaagattatggatttctctatataagaagacatgtgacattcagttgagcaccatattgtaggcatgaaccaaaacttaacttacttagcatagattgttgatgtgtgtttggatatgtatttatttttttcgtaatcggcttgtctccttcagccgtatttcttttccaaacattgggcctttatgaggcctaaattgggccttagagcccaaggagagttaaaaacaataaataatctatccagaggcattaagtttcaacgaaaaagaaagaaaaatctgtgaggacgaaaactctccgtcgttccggcgagtttctccagtgatcggcaaagtctttccggcatctattgaatttctctaaaccaattagtaagtctcttgaaatttcaattcaacaaacgttttgctgtctactcgaaggttttgactcgtgtttcgatttcaattttgaatcttagacaagtttgctatctcagacaagttcttgttgagttttgtaggaatattatcggtcttgataaaataaaatggttcaaagtcagtcgttaagcacattaacaatctgtggaagtgtaaaagtttcaagcttgttgaggaatcgtttaaattcagtgaaagcttcaagcttgatcggtgatcgatgtgtttcgtgtcagtttttgcgtaaatcaccgtcctttagaagccattggaagtcattaaagcaaagaaatttgttgagggttgaagctagatggccatttcaaggaggtggtgaacaaggtttagacccgagctctgagagaagcgagagtgctaatgaagatatattgatctttttctttcagctggatttggctactcgtgtacaggttaagactaaatgcagggtttttatctctttcaagatggttgctaatggttttgatgtgttacaatattgaatgatatgtggattggtgtgttttgaaatggcagtatgcaatg

SEQ ID NO: 13224 - DNA, 3000 bp, Unknown
  misc_feature (1)..( 3000): cDNA_ID_2685803_gDNA_ID_2214606_Annot_ID_135670 3000 nt of promoter + ATG
taaataaataaatcatgtatttgaacttatttacaatgtcatgctactgaaattaattatttagaaagaaaaatatttaattaacgatttaaatcttctaaatctttgcttttagagttattatgtcattatctaaaaagcaaaaatattttaaaatatttatatatttaaactttataaaacattattaatatttaaacttataaaaagtttaatatatcaaaaattttaacatcattatataatatatagtttaaaaaaatctcaaaaaaatttccgtcatattttgtgattaaaatttttaaaaatgaacatatattaaccaattggcgaaaaaatgtgtgggttcaacatcccgcatcgactaaaatatttagacaatgattcataaataagatcaacattaataaaataaatggttttttttgcagaacgggttttgcgagacgggtttgggaggacgttacttaataacagttgtaaactataaaataaaatattttatagatagatacaatttacaaatttttatatatactaactttaaaaaataaattgtccccgcggtataccgcgggttaaaatctagtataattatattttctaaaatattaattatttttggatcaaataaaataattaaaaatacctgaaaatagataaagtagtaaaaatactcaaaaataaccgaaaatgtccgaaaatatccaaaaataaccgaatatccgaatatattcaaagcaaaataaccgaatgaatactaaattttgaaaccaaaagaaccaaaaccgatagcgaaacaaaatttcaaaataagcgaatgaatactaaattttagaaaaataaactgaaaaccgaatgaatacgaactgaaagcggatagataaaccaaacgcaagtcctgagattgtgtaaaaggcccataaacgggcccaatatgcgaatccattttgttttcttgttgggaaattaatctttttctgcttattttaggagaaattgttttaattttaatttagggtctcttgtctttgatcttttgtacactttctctggattttctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaagtttgttcctttctcttttcaatcatattaagaactaatctgtggttagataacctctttgattactatagctgcagtaaataggttgtttaactgatgagaaagccttaagggaagtttttgagtctcgctttgaaaaccacacgaatctgcgttgtttgggttcttgagattagtgtgttttaggaacagtgtcagtatgtgtaaaaatgtttatggatgtgggatttgcagatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtatgttacataatcttatgtgccttattgttgttgaaacggtggtaaaatcttgttttgctatcataaagctgtaatctttatcagtcctgagtagttgatctcttaatatctaatagtcctccattggaattggacatataagttcctactgtgaagtagttcttccagtgtttagctctaacttcaattcattgcatgtatgagaagatggatacatttgatgacattttctttgtgtttaggtgctgatgtcaatgccaaaaataacggtggtcgcactgctcttcactatgctgctagcaaaggccggttggagattgctcagcttttattaacacacggtgcaaagattaacatcacagacaaggttttgtagcttcttaatgtcttgttgcttgtgatcatcaacacacaaacaaacttttttttgtgtggcttttaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggtaaaattttcaatctaatcaaccttaaaagcaacatttctttaaagttaaaagtttccatggatcaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgtctttagaaattttctcaaaagcaattttggaaacaagtgagaaaaaagtttttttttttgtttggttaaaaattatatatatccttcttatctcctaagagtcacttaccctcctcacaaaaatctaaaggcaaaatgatgcaaacaaaaatctcttctttctctcgaccaagctttagtctctatgaaccaagagtaattcatcatcctcgtatctccatggctctatcatcatcagcaccatccccgtttcaccatcttctctgcaagtccaccttccctctcgctgcctcactcacccttctcctctctccttgtaccggtaactacactactactcaatacttttcctgtgattcaatgtatatgcgtgtcatcatcatcagcatcatatgtatatgtatggatggtcctcagctgaagcaggcttaatg

SEQ ID NO: 13225 - DNA, 3000 bp, Unknown
  misc_feature (1)..( 3000): cDNA_ID_3028664_gDNA_ID_2214606_Annot_ID_187239 3000 nt of promoter + ATG
ctcaatgccattagcattaattttttttttccgaaataattaattttactttaaattcttaatttaaattgtcaaccacattatcaatcaaatttaatccaaacaaacttcacatcaatcccttaaaattagcataaacgtatttgttaacaatattttaaaacaaagttttttgtttaaataaatattattcttactaaacgttttttgtttaaataaataaatcatgtatttgaacttatttacaatgtcatgctactgaaattaattatttagaaagaaaaatatttaattaacgatttaaatcttctaaatctttgcttttagagttattatgtcattatctaaaaagcaaaaatattttaaaatatttatatatttaaactttataaaacattattaatatttaaacttataaaaagtttaatatatcaaaaattttaacatcattatataatatatagtttaaaaaaatctcaaaaaaatttccgtcatattttgtgattaaaatttttaaaaatgaacatatattaaccaattggcgaaaaaatgtgtgggttcaacatcccgcatcgactaaaatatttagacaatgattcataaataagatcaacattaataaaataaatggttttttttgcagaacgggttttgcgagacgggtttgggaggacgttacttaataacagttgtaaactataaaataaaatattttatagatagatacaatttacaaatttttatatatactaactttaaaaaataaattgtccccgcggtataccgcgggttaaaatctagtataattatattttctaaaatattaattatttttggatcaaataaaataattaaaaatacctgaaaatagataaagtagtaaaaatactcaaaaataaccgaaaatgtccgaaaatatccaaaaataaccgaatatccgaatatattcaaagcaaaataaccgaatgaatactaaattttgaaaccaaaagaaccaaaaccgatagcgaaacaaaatttcaaaataagcgaatgaatactaaattttagaaaaataaactgaaaaccgaatgaatacgaactgaaagcggatagataaaccaaacgcaagtcctgagattgtgtaaaaggcccataaacgggcccaatatgcgaatccattttgttttcttgttgggaaattaatctttttctgcttattttaggagaaattgttttaattttaatttagggtctcttgtctttgatcttttgtacactttctctggattttctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaagtttgttcctttctcttttcaatcatattaagaactaatctgtggttagataacctctttgattactatagctgcagtaaataggttgtttaactgatgagaaagccttaagggaagtttttgagtctcgctttgaaaaccacacgaatctgcgttgtttgggttcttgagattagtgtgttttaggaacagtgtcagtatgtgtaaaaatgtttatggatgtgggatttgcagatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtatgttacataatcttatgtgccttattgttgttgaaacggtggtaaaatcttgttttgctatcataaagctgtaatctttatcagtcctgagtagttgatctcttaatatctaatagtcctccattggaattggacatataagttcctactgtgaagtagttcttccagtgtttagctctaacttcaattcattgcatgtatgagaagatggatacatttgatgacattttctttgtgtttaggtgctgatgtcaatgccaaaaataacggtggtcgcactgctcttcactatgctgctagcaaaggccggttggagattgctcagcttttattaacacacggtgcaaagattaacatcacagacaaggttttgtagcttcttaatgtcttgttgcttgtgatcatcaacacacaaacaaacttttttttgtgtggcttttaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggtaaaattttcaatctaatcaaccttaaaagcaacatttctttaaagttaaaagtttccatggatcaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgtctttagaaattttctcaaaagcaattttggaaacaagtgagaaaaaagtttttttttttgtttggttaaaaattatatatatccttcttatctcctaagagtcacttaccctcctcacaaaaatctaaaggcaaaatgatgcaaacaaaaatctcttctttctctcgaccaagctttagtctctatgaaccaagagtaattcatcatcctcgtatctccatg

SEQ ID NO: 13226 - DNA, 3000 bp, Unknown
  misc_feature (1)..( 3000): cDNA_ID_2994508_gDNA_ID_2214606_Annot_ID_187237 3000 nt of promoter + ATG
atgtaacagagccaacaatgtgcaaatcttgaaactttacatatacccttttggtcttataagatgtaacattgtaacatgtaacattggttttggtgttctgttttggttaggaatgaaagagagattcaagacaaatattgtctgagaggagcagaatggggagtaggagattgctcaaccacaggaatgacagatgaagaaaaggagaaattcatcacaatgttgaaaaagaagactggtgttgaataaaacacacatcattgtatttttttgtttgcaagaatggctttagagagaatcatctatgctaattgtttaagtcacaatccaaatccaaatggttacaaaacaaaaatacatgtaggcatcgtgtacaaacaggttttttctttttcttatcgatctgcggttttgatatcgagaagagaaagtgtagcaatctcattcataaccaatgctttatcagtttcaaaacctacatcttctttctcaggtttcaaatcagcaaacaaacgaagaatcttggtccgattcgccacgagaatcgccacgatatcctcaggtttgttctcgtttgccacaaagagtttaaagatatgaaatgcttctaactgaatgttcttggttggttctcttaaaagattcatcatgattctcaaattatccaaactgctcacatactttaccatcacacctgaattcgaacgatccatcaacacatctccaagcaatttcgacgcttgtctcttcgtaaaatagcttcctttctccaacaacttggtgttatactctgcgaaaaaccattcgtagttcttcgcaagatactccgctacagtcgatttatgcctcgtcaaaagctctctgaagatcttgctagcatcggtagctacatcgaaatacggaagctgaacataatcgaaaaacttctccaaattcttcgattcgagtatgtactttgcaacaacctgatgccgcacacattctttaagcattcccgtgtaatgcaacgccagctcatggtcgtgatcgataccttcgactaacgaatcgataacatctaagttcgattcaagatattcagaagcaacgagtcgaaattcgacttgttgcttctgaagattcgcgacaatctgtgtcgcgtcttttcttgcttctaggtcaagttttggtatagatttgatcaaaggacgaagcgtgtctgctcggaaaaactcttgagttaacaaaagacaagcttcaggaacaggctcagcttcaccattaccataaagaatcgatttcaaatctctaatgtttcgacacaactccgcacaaatccctaaccttttcgagtttctcgcatcggtttcttcttcttcggattccgctaaagcgatgagatctcgagtctgacgtacgatttcaccaggaagacgtgatttgttcttgaagagacctttcattctcgtgcttcctccatggtttccgaggttcccgcttaaactgctaagcttcccgctaaatgtgatgttgatgatggattcatcatcggtggatccgacgcgtagatggctccgtgtacggcggtgctttgacgacggagctaaatcggagcttccgtgtcgtttagcaccaccgattatggagacacacgcacctatgtttctcctttttgttgacctcaaaacaaagtacaaaaagaaaaacagagcaaaaacaaaatctatgcctttctctatctttttattctagggtttgttcaaaagctttttcaggggtttcgctgtgaaatccaaaaatgttgtttctatgaaatcttcttctttgaagaaaggaagaagaaagagacaacaaaacctaaaaatggagtctttgattggctaattttgccgcgctgaattttcgttgtggttagtttgaagaatctttgatgtcaattagatattaaacaattttttgaagcttattattctacacagtccatatctctagtcaactaattatctaattatgttttctctaaattaataattcttcaaaattttaatattttaaaattgtgtctattcattaaaagtcttttgttttcatactttttcacaaatagttgcattttttcaccacaattgttttgctaattatgtttggagttttttgttatatcttaattctcttttagattattgcatatatcatatgtttatctaatactcatgtttttaaaaaggttttatctatttttctttataattttagacaattaccaaatttttcatgaaatttatttttagaatgtatattcatatatatgtttgatttttaaataactacattccttctatactttcaaaactatttattagcttatatcatattaaatttgaaaaaattcacggactcaacaaattttgcagatagagaatgagatcacgtatgatgcagagtgatctcgactctctatctacgaaaattgatcttagcttgaaagattatggatttctctatataagaagacatgtgacattcagttgagcaccatattgtaggcatgaaccaaaacttaacttacttagcatagattgttgatgtgtgtttggatatgtatttatttttttcgtaatcggcttgtctccttcagccgtatttcttttccaaacattgggcctttatgaggcctaaattgggccttagagcccaaggagagttaaaaacaataaataatctatccagaggcattaagtttcaacgaaaaagaaagaaaaatctgtgaggacgaaaactctccgtcgttccggcgagtttctccagtgatcggcaaagtctttccggcatctattgaatttctctaaaccaattagtaagtctcttgaaatttcaattcaacaaacgttttgctgtctactcgaaggttttgactcgtgtttcgatttcaattttgaatcttagacaagtttgctatctcagacaagttcttgttgagttttgtaggaatattatcggtcttgataaaataaaatg

SEQ ID NO: 13227 - DNA, 3000 bp, Unknown; identical to SEQ ID NO: 13221
  misc_feature (1)..( 3000): cDNA_ID_2702318_gDNA_ID_2214606_Annot_ID_187233 3000 nt of promoter + ATG

SEQ ID NO: 13228 - DNA, 3000 bp, Unknown; identical to SEQ ID NO: 13220
  misc_feature (1)..( 3000): cDNA_ID_2702343_gDNA_ID_2214606_Annot_ID_187232 3000 nt of promoter + ATG

SEQ ID NO: 13229 - DNA, 3000 bp, Unknown
  misc_feature (1)..( 3000): cDNA_ID_3028674_gDNA_ID_2214606_Annot_ID_187231 3000 nt of promoter + ATG
tggtcattgcaatatatctgatgtttatagtttcttgtatctttagcagatctttagcagtagttaattattacgtttagaactcttcacatgaaacaataccaaaatcttttgatataattaaaaaattagtgatgaagtcaagtcactataatcatatttcactaaattgtcttaattatatttttttaaacatatgtttataaaagttttatcgtatctacaactcttcatgatatttttggatacagttttaagaaaaaacaaacaacataatgatatcatagttcactaaattgtctaaattatgtatatatttgtttttggtcaaatgtctcaattatattttgtatatttttttttttgctcaaatgcctgatgatataaagcaaataaatattctcagcattgaacatataaattccgataaatatcacaaaaataaaaataatcaaatatcttatatcggataagaaaatacaaaatcagtcagtacaagaaaaaaaattaggtccaaaaagtttttatagaacacaaaaaaaattattataggtttgatccgatccgatttgacccgactcaaccttacccgaaatacaatatcttgaagcatgttttaaatgattaaaataaaaaagaataataaaaactaaagagagtaaaactcaaaacaaaagtttttttattgctttctatttctcttctcttttctttgtaacttataaacgaatgaatgaataaaatgaactatatataatagagtttacttagttagaaaataaattaattagcgaaaaaataataaataaatatcatccatattttagtgaagaagtaataaataaacatcatacatatttgaaataattactagaatagaacacaattgtatgtttattcctataatagaacacatcttttttttttattcgtatgttttcagtacttgtgtaattacacttaatacccttgattagttttaattaaatattattattaaattcgtttctaattaaaaaataaataaaaaaacagtgattatccatgtcatcagttcatgtcatttaccctaatccacgtcatccgaaaccaaaaattcccttaaaactttcagtttctcattttttcagcacatcttactgttcatccgcgcaaaaaaaaaaaaaaaaaaaaaaaaaaaaaaaaactgtcgctctcttctctcgttcagtcgacggaaccctaatttcatcgccgttctctacttatctcgtctctttcggccgaaactctttcggtggtgtcgaatttcaagtcatcaaaaatcgaaacccaaatcaaagagatctatggaattttatgtgatttgttacaggttttagttgaatcaagaataactactcttttactttgattttatatgtctatcgtttagttttcctctcaatcgatctatttagaaatatttctacttctatcaatgttttgattcatatggtttcgtcttcctcctatgtatccctcaaacagattattacgtttcttaatttgattgttgttatttggccaataaatttcatattgtcttccccagaaaaatgttgctttccgatctgtattataaatcagccgtaaagtgatgtaactcagccgtaacgtgatgtaactcagccgtaacatataatttacacaaccattcgtctttcctaaatgataactcagccgtgacatgtaatttaccgaacctttcgtcttccctgaagcatataactcagccgtaacatataatttacactcatctttcgtttgcccttgaacatataactcagccgtgacatgtaaatttatagatgtcttcccttaaacatataactcagtcgtaatgtaattttaccgaacctttcgtcttccctggaacatataactcagccgcgacatgtaaattgactgaacgtttcgttcttccttaagcatataactcaactgtaatgtaattttatcgaacctttcgtctttcttggaacgtataactcagtcgtgacatgtaaattgactaaacctttcgtcttcccttaagcatataactcagccgtgacatgtaaatttgtcgtgaaacaataagagatacaacattttgtctaactttatcatcgagcaccaacttcacaaatttgtcgtgcgttgttttcgcatctatctgcacaagtttacaccctctttcattagtgttaaatatgtatttttgtttctatacccaattcctggaaacaacaattaccaaaactagatcaaccatatcgggagaaagatgaaagaaattgaagaaaaatgaggaaaacgatgaggaattagaagttccggtgatgtgaaaaactcaagtgaagaagacgagttgaaaaaattttaccctatttttttatcctttgatgatgcacatggaatgatgacatggaatattacagccgacgtcgttttgaattgatgaggtggcaactaagccaccaaacgaacatttgataactcagccatcaagcaaatctatacgtcagtcgcaacatgaatactattacagtaattaaaaaaggaaaaaaaataaagttaagtcagccgtgtaatgtcgtaactcaactaactcaaccgtaacgttcaacaactcggccataactgcatgatattatagtaattaatcttttaaaaataagtcagccataacatggctgagttatatcgtaatccagctattggcggctgatttatatcactcgaccataactcagctgtcacatctttccataactaagccaatcaaaactataactcggccgcgtcgaggaaataagtcagcctttttctcataactcagccatattgttggctgggttatcgtataacttcttataactcggccgaacatccttaactcaaccataccgttgtctgagttatactataactcaggcaacatttttcaactcagccgtaacgtctggctgagttatacttatacttcgccgttttgtt

SEQ ID NO: 13230 - DNA, 3000 bp, Unknown
  misc_feature (1)..( 3000): cDNA_ID_3028680_gDNA_ID_2214606_Annot_ID_187228 3000 nt of promoter + ATG
gagacatttgaccaaaaacaaatatatacataatttagacaatttagtgaactatgatatcattatgttgtttgttttttcttaaaactgtatccaaaaatatcatgaagagttgtagatacgataaaacttttataaacatatgtttaaaaaaatataattaagacaatttagtgaaatatgattatagtgacttgacttcatcactaattttttaattatatcaaaagattttggtattgtttcatgtgaagagttctaaacgtaataattaactactgctaaagatctgctaaagatacaagaaactataaacatcagatatattgcaatgaccaagcttaacatcaaattcgtgagtttgtgtgatgtttctttaaaatgattgtggcgtacgtatcgagttgccattttttacatgagacgtatagtctcaatatagattgatccaaaatttactattttttagtcttaattaacttagataagatattttaatggttatatgtcctctgttctaaacacaatctactaggcatcaatcaacattgttgtataagctacgtgtcttcaaggttgagtcagtgaggaatattttggctgaaaccaaatctggtttattgttatatttgacatgattttgaagtgttgtgtaataattttagtattgctctccgtaatctccaaatacatagtgtgatcatgtttactcactctagttctttgccattctcatgacctaattttttttattaccaatgactaacttagtgtgatcatgtttttactcactctatttctttttttgttaaaggggtttcttgcattagaattaaaagaaatcaaagtttacataggagccttaaaccatagacttaaaacagaacataagaagggaggaggcaagcacaaatgctagataaggagagaagaaattaagaattgccgagagaacgtatgcatccggttcccattccagttccaatgcgtttttgatcctccaaaagtgttgtttgccattatctcctttcatatttgtaatccacagatagtcatttccattgatcatactaatatcttcaagacatgacgcctgagaaagaatactaagtttgatgactcgaaacatctctgtgtgaagattataggcaagaaccatcttattttgagtgcgacaataaacccatccctttgcacatattgttccttcttcatctatgtgtaaatcatgatcataaggcgtataatctatcacctacctccatttcttgacctcaaagtcgaaaacctcgcatgatgagatgttgttacttttgtcatcatgtaaccaaactagtttgtacgttcctgtaacattgtctttaccaaatcctaggaaagggaacacctttggaagtggcatcttattgtccaaatactttagctgagtcatggaaagagggaggttttgagaccgtcgcatagatgggtttgtcacaataattggacttatcaaaatgtcgtggtccaagatgcagacaagcccgtcgcaactacccataactctgacacgttccttgaatcgatgttggatgtgatgaaccgggccttcttcgacagctctagtagaagaccactcaaacctcatagtcttcatatcaagactctcacactcgctttcatagattaagagaaatttgggttcttgggtttcctaataaagtcaaaatctctccttgaaagacttcgactctatcgtacacctccagtgtttagacacgctttgaaatccaattagggttttcacgggaagtctcaccattatttcttctaacacaatgttattgatgagtatcatctcaatatatatgatggatttgtctctgtcaaactacgaattacaaaccctaaatcctgcaagggtcacacctttttaccacgcaaaacaatgtcctgaatataaagtccaaataatatatttaagcccatcaattttattatcatatgatataattttatcatcatttccacgtatatgattgagtaaaaatgtaggaaaatccgttgagttcaaacaaaatattgttttaaggatcacccttttttatatattatcttgtaattttaaatattgtagtataagatagaaaatctatatacatttactgaataacgatagatcgtagagaattagatcgttcattactatgtgaaatagaagtagtagaagaagatggaagttcttgtgatgtcggcgaaacatttcttatctcttgtgcttcattgtccataaagacaaagtctactcgaccttgaggtgatatcagagtagtagcagcagcaataggaaggtttggttcctctgctgcttttcggaagctaagtttttcagaaacttttgaagctgaaaaggataaaagataaattaagagcagaactatacaaaggattatatatatgtaatgtgatatataataaaataaaacacaaagagaaggtaccgatatatgttaaccattcatgcaatattcttggaaccattttcacctttaagtttttatctaaattatgaatgtagagaagacgttgtataagaaaagtttggaacataagttaatgatataataatataatcatgcatggaatttaattctgatcatacccatgcacagcacgaaataataaacatgcgtataagtattaattttaattaaattaattaacatgttgattgtttaaaatttcatttacaattaatctgtttattaaatatgaatatatatatatatatatatatatcagctgaaagtactttgaagtttatattactactaaaatatttatagatttattttaaaatttataaataagaaaatcattaattttgaatataaaaatacgagagtgtagaaaccaatagtgtcattatcattctattagatattttgttctcaactagcaaatgaaaatattttgaacacaacaacaacaaaaaaaaaacagaacattatccaaattatg

SEQ ID NO: 13231 - DNA, 3000 bp, Unknown; identical to SEQ ID NO: 13218
  misc_feature (1)..( 3000): cDNA_ID_2702326_gDNA_ID_2214606_Annot_ID_187225 3000 nt of promoter + ATG

SEQ ID NO: 13232 - DNA, 3000 bp, Unknown
  misc_feature (1)..( 3000): cDNA_ID_3028686_gDNA_ID_2214606_Annot_ID_187223 3000 nt of promoter + ATG
agtcgttcaaagagtgttctccctaatcctttcctttcagcttcagcactttggattgtaggtgggagttggagatggtctcctgcaagtatacatcttgaaccctttagcaaagctatccaacatgctacctcaagagcctgtgctccttcatcaatgatcaccaagtcaaaagttctattatcgagctttcgtgttaatgcaccagtcaaagttgtgagaattacatcagcattcttgatcacgtctgatacagctaattgctgccttttacgctcttccttgcccagagttcgaagctccttctggattagtctccttgtgtttttatctttcgctttcaacaacttcccgtttaaggccttcatttcctttctaatatcattcgctagaccgctgttatctccctttaggacctgagcatctagagcactatccagcacttgaggtaaaagccgtgcaggatgtcccaccctcaccagcttaactttatgtggaacaagtctctcaacaatattatcaactgcaatattcgaagctgcacaagcaagaatctttgaaccacgtttaacttcttgcaagactatttccaccaccgttgttgtcttcccagtaccaggaggaccatgtagcaaaaacacatcctttgaggataaagcctttgtaatcgcatctttctgcgattgatcaaggttcttgttaaaaggcgtaaaggacttaacatccttcttagacactgatggttgtctctcaccaaacaagacaggcactaaatcagaagcaggtcctcttaacacacctttactcagctgtatcaacgtatctttcatcctacgatacgtcacctcattcgcaagtttctccaacctaagagacgtgtttaacccttcttcaggtacctcatcaaacacaacagtaatcgaagaatcctttaaccggtaaacaactccttgcgcaagaggagacgaaccaagatcagatttgttgagtttcaaaacaacaacatcatggttaccaaacttgtgagcaggaagcacatctcctttgttggattgaaactcaataagagatttacccattagacctgtttgaacatcaacacatttcaaattgagaatcgttgtgcctttcttctgagcagtttcaatgttccttgaagcaccggaggttaaagacattgagatctcagcttctttctccatgtctataagtggagccattgttgacacaaaagcttcaagagacatcttcctcgccatttgcaagcgttaatttctctgaaagtgaaaatacatgatttcaattgtaatgagtttagtacacatttgagcgatactatacaaaacaacaactattgagattctaaattacgaaaccgaagcgaaactcagaggaatccgaattgatattaatctagccggagagataaatgatgtcgtaatgattctacttaccagaagaaggatttgttcttctcggttgagattgaaagatgaagaacaaaaccctagaaatcaccgacgaggaagacgaagtgagaaatggttgtggaaattggaagatgaagaagaactcaagaagatggtaacgagcacacgcatttgtctctcaaactcttctcaagcgttacgttataatgggcttagattttatcatataattgggctttaacgtttcgtttaggcccattttaaatgttttttttcttcatatatgtccctattttaaatgttttttttcttcatatatgtcagttttggatcagttttggtgtccatttaatttcagcaaaataaacttgtgcaagacatttcttttaccaaaataaaagttggaattttatatcattttaatttttgacagagattactagaaactgattaaagtacgctacagaaaaataaaaacaacattgctactcaaaatattttgaatcaattttgagcgaatatggctaagttgcgataagaaacactgattccgaaatcacaaagcccgagaatttgcgtggttaccacaatattgaagcactacaatcatcatcgttgttgccacgagcatatctattcgaaatcagtcctcaacacctcgtcatagaaaccatatcatataagacgtggtcatcgtttttgcatgttgccaagacatgcaaacttgtttcctttttccgaacaagaaaacatattatataaaacgtacaaaaattaatttgatcgtatataagttttttgcgggttgtacattatatatttatatttactcataattagtagaaaagagtacatttggttgccaacgaaaacatacttttttctcttttctactaataataatgaaagtacaacttttctctgcttgacttgtccacaatggccaatgggtagtgttgtactaaataatattgtgaagactttgttagaatgataaacggcataatgtatagagatggattcaaaactcgaatatttcaattgttttctattgaaagtgtagactagcctttgcaatatataatatacacatctacaaagactgcaggttacagcgacacataacattgattaatgacttggtaaacgtactaacatctaattcaaattgagacattttaacaatcatgtggttttaatattaaaatggatactaagaaaagatatatagattgaaacttcgattaatatatcattgatcatttctttccacattatcggtaatatctctctactcatatgctctattgatattgcatcattcgagcgacaaatttacaagtggctcaatttcttgtgaaataatgttttatactaatatttaatgtacaaaataagataacctttcacaaaaataacgaccatgtcgtattgtccagctaacaatttatttttaaactaaattcctatacgattaattggtcataagtcattacacttgcttctgtttctgtatatataaacttcctttttgtatttctttcggacacaacaaagaaagaggaagatg

SEQ ID NO: 13233 - DNA, 3000 bp, Unknown
  misc_feature (1)..( 3000): cDNA_ID_3028650_gDNA_ID_2214606_Annot_ID_187245 3000 nt of promoter + ATG
caattatacttttttcatgtataaatcttcttatctatatatccaagattctattcttttttaactatcataaaatattacaacaacaatatataatacaatgttatgcaattatattacttatgtggtttgaaacttatctaacttgattataagcaaactattctttgttccatgtattttcctaatctagtactctagtcacatcatgataagctcatgactaaatattgaattgtaataatttgaataacaaatgtataactatctactcatttatttcaaaagttctatctactcatttatttcaaaagttttataccaaaagagaaaacaaaaagcaaaaaattaaagagtcatttaagtcaacacttttaggtatctctctttgcatttacatatacccatattggagaaagtgtcttgtattgaatgttttggtatatctaagatcccaaaaaaacttacttgaaaaatgtgtatgtcattattaatattaccaatttatcataaggtacaaaaaaatcatatatcatgtagaccaaaaaatgtaataataagagaagattaagttaaaatactaaactaaaaaaggttaaatagcaaacagctaagttacaaatatcagataatgactataaaaaatagcaaaatagaaaaagtagaataaaagtagtgtttgatacattaacatgatttgtatttttttcttttattttgaaaatagttaattaagagtgggattgatggatggtttaatgcaatatgagaactttaatttttcgtcactaacttttgttaattgttaaatgatattaatttagaatgacatgtggcactctccagtgtgatgatgtgtcattcatatggagagagttgaccaactttcatatatatgatttgtgtccaagcaagatgtttatcatgatcattaaaaacggttaatatgattttccacaaacggtctatcacattttaatgatccatataagcaggagtgatccgtcttattgtgataattcctaagaagttgtattttaatcatgccttcatttcatggaagtctactagaaaaaagcgaagcttcgtaattacatatttggagattcaatgagaagatttgtgagaacttgagtgggaaaaactaatagaatttcttctctttatgagctatacccatcttcatagaatcctatattatgatcacaaactcttgcaaaatatctaatcaaaacggattattccaaaactcgagacatcatccatgagacgttgtgcaaatggatttagattactcgaatggagagattgaaggtagtaaacgcttatatttgatcatgcatgttgttctaatgatcttatctcatcaagacatcaacccaagttcgatcgttgtcctgagattttgatatctttgttggttttttaaaaatattatttacgactaaaatatcagtgttgtgtttagatttgttttctttcaaagttgttaatgcgacataataagaaaacgattgctttgacgttttgttgcctgatttctttcttttttttcctcttcttccataaatcgtaacaaggacaatttatttcttttaaaaataggactcttttctaagtacatataataataataggaccatgtacataggtgatatttttagagtatcacaagtcctaaaattatttttatattaataaagcaattataatatgtttgatcagtatcagtccactgatatttatgataccagtatcatctgacgtggcttcttctgattggtcacatttgacaaaaacaaaaaaaattatatatatttattaaacaaacattataaataatactaaaaaaattcttaatgatactttgtgagtatcacctatgaacatgctcttataattgagttacataattctatgtagtactcaaaattttataaatatacttaacctaacacgtataaaataaattatttaacccataaacatgaaaattaggttttcttttatagtagtggattgttattgctcaccaccaacaacataatcatacaaattaataataataattaacaaaaacctttttgatatagagaattttagaaaaataataaaataaagagaccaagagacaaagagaccaatttaataaatgcacaaaaagcaaaagtgcaccacgaattttgcaattattctcctcatgactgtttttttgctggaaccaaaactaaacaattctttgttttaaaaagtttacttacacatactttcttaattagatctaagtttaggattataatcttcatcatcattatttgttattattaatctccatattcagaaaattcgattaataaaaaaagaagcttacaagagagtgcccatataattggaatatctctctctctatctttcttctgaatctctcaaaaatttcgccattgttgttgctctgaaatctgttaactttggtacgcatctcaaaaaccctaatttgattatcgtcattttgtctgcatttaatttatttgatctgatcttcttcgccattctcgagatctcaatcatgggtttatccatcagaattattatcaagcttttctttttcttgaattttcgccgacaaaaaagcaaaattcgcttaatgtatagattcactagaaatggtaatgtttcttttttgggaaaatttcgatttttgatctgtgagatttgattgcaggtgatttgattgcatttgcctttgagagttttaatcttcaatttttggctacatcgagatttggttctgaattttggcatctctattagtagtgaggccatttcctgatttggatcataaagagtggagaaaaatcttgcctttgtctccttaggattgtggcttgatcaggtaatgagactatgtgcttcaaaattgagacttgtttggtgaaagaagcggatgaaaaagtttctgtgtacagcgagaggaattagtggtttctgcttacgaatgat

SEQ ID NO: 13234 - DNA, 3000 bp, Unknown
  misc_feature (1)..( 3000): cDNA_ID_1807998_gDNA_ID_2214606_Annot_ID_187244 3000 nt of promoter + ATG
cttagaaaagagtcctatttttaaaagaaataaattgtccttgttacgatttatggaagaagaggaaaaaaaagaaagaaatcaggcaacaaaacgtcaaagcaatcgttttcttattatgtcgcattaacaactttgaaagaaaacaaatctaaacacaacactgatattttagtcgtaaataatatttttaaaaaaccaacaaagatatcaaaatctcaggacaacgatcgaacttgggttgatgtcttgatgagataagatcattagaacaacatgcatgatcaaatataagcgtttactaccttcaatctctccattcgagtaatctaaatccatttgcacaacgtctcatggatgatgtctcgagttttggaataatccgttttgattagatattttgcaagagtttgtgatcataatataggattctatgaagatgggtatagctcataaagagaagaaattctattagtttttcccactcaagttctcacaaatcttctcattgaatctccaaatatgtaattacgaagcttcgcttttttctagtagacttccatgaaatgaaggcatgattaaaatacaacttcttaggaattatcacaataagacggatcactcctgcttatatggatcattaaaatgtgatagaccgtttgtggaaaatcatattaaccgtttttaatgatcatgataaacatcttgcttggacacaaatcatatatatgaaagttggtcaactctctccatatgaatgacacatcatcacactggagagtgccacatgtcattctaaattaatatcatttaacaattaacaaaagttagtgacgaaaaattaaagttctcatattgcattaaaccatccatcaatcccactcttaattaactattttcaaaataaaagaaaaaaatacaaatcatgttaatgtatcaaacactacttttattctactttttctattttgctattttttatagtcattatctgatatttgtaacttagctgtttgctatttaaccttttttagtttagtattttaacttaatcttctcttattattacattttttggtctacatgatatatgatttttttgtaccttatgataaattggtaatattaataatgacatacacatttttcaagtaagtttttttgggatcttagatataccaaaacattcaatacaagacactttctccaatatgggtatatgtaaatgcaaagagagatacctaaaagtgttgacttaaatgactctttaattttttgctttttgttttctcttttggtataaaacttttgaaataaatgagtagatagaacttttgaaataaatgagtagatagttatacatttgttattcaaattattacaattcaatatttagtcatgagcttatcatgatgtgactagagtactagattaggaaaatacatggaacaaagaatagtttgcttataatcaagttagataagtttcaaaccacataagtaatataattgcataacattgtattatatattgttgttgtaatattttatgatagttaaaaaagaatagaatcttggatatatagataagaagatttatacatgaaaaaagtataattgatttttgatcaaaggtaaatctaactaaaaaaaaaaattatagaaaataaatataattttattaactatataataacatacacaaatatgaacataaattaccaataaaaatagttaaaatataattatttttaaactattttcaaaataaacccacgcgtagcgtgggtactcttctagttcttttaagttaagatcattgaaccgttgatttctcactgcagggttgtccacaaatcactactgtcaccattgctttgatacggcaagaaaaacaaagatattgccaagaaatgcaatccatatcatgttagtatgttacttagagctcgagcttaacaacttaagcaacgaccatcaaataaaagtaatagaaatctttctaatcatataacaaaatattagatgtatctactttcattaagtggaaataagtcaaaagatctaactttagttactgtatgaaaatatactttttgaaaatctttacttgttttttatttttttatttttttctaattttttctttttttaaattgatatgtcatcaaataagttttccttttttacaaggcataactctctttttacacaatagatttaacattatgtttgatttccataattgtcaagattattttaggtggtttaaggttcaagattattttctcaattcggtttataaaccggttaacttgaaccaataattatgtctagatattgccaatgcaagttgattacacgtgctagtttaaaagttgaggctatttttgtaactttctattgagaggatttttaataagtttatacctctctcccttgttcacgaacccgtaaccctagccgccttcaaaaattcccaatttgttttttcaaacaaacttgctcagatcctcttcttcttagggatcaatcttcaaatcaattgtaagtttcttgtttcttataattctatctttcgattgatacctgtttcgatatcttcaagtctagttttttttttttcaatcgagtttttgatttagatcacaaatcgacagatctgtttaggcgtttttctgggtatcgattcttttcaacatccatgccttaatttcaagttttccccaattttcttaaccctaatatttatgtgttcatcagatctgcaaatttatttagggcttttgttcctcgtgctgaaagttaatcgattgtttgaatttggactcttgatttcatgtttttagccgtggattgaaaaatctagggttaggttttcgaatttggggttttttttttatttttaatatctgtttaaagtttgactttttgactaaaaattaaaaaattacactaataccctagattgttaaatcaattcaggttgttaaaataaatg

SEQ ID NO: 13235 - DNA, 3000 bp, Unknown
  misc_feature (1)..( 3000): cDNA_ID_2702364_gDNA_ID_2214606_Annot_ID_135671 3000 nt of promoter + ATG
tcggacgaacgtggcatgaggacccatttttccgtgccactcatcaaaacctcaaccaatactaaaacttttaagtgtagtaaaatacaccaaatattacttccctataaagtataaactctacatttatgatgaagaatccaagattatactagcatttacataggtaaacaaatacccaaaactaaaagtacccatccaccaataaaagtaactctatgatcaagaatcaaagataataagaaagaatttatcaagaccggttatgagggtcgacttttgcgaaatggtcaaatgtaatcaagcatcttttttacgtaggaagagaataaaattcactcactaaagtcgaaaagtagatctaaggcgtaagaatcgtgactataaatatcccattaactagtggataaagaaaaagaagaccaaaaactagtggacaaagaaaaagaacaaaaacctaatttcaagaaattcaataaatatcatcctccggataagttgttattgtacgtttaccaaattcaagaacaagaaaaaacttttcctttgaaacaaagaaacatggatttcttcaccgatcaagtaaagaagaaattctccgacaagaaaccggagagctctgatccggagccaaaccacaacaaaaacaaacccggtcacacggagccaacaacacataaacccggtcacggcgagccaacaacacataaaccggtctccaacaccgatccaacaacacacagaccggctacgaacgctgagctcatggctagtgccaagatcgtagccgaagctgctcaagccgctgctcgtcacgagtcagacaagcttgacaaagccaaagtcgccggagccaccgctgatatcttagacgccgcttctagatacggtaagctcgatgaaaagagcggtgttggtcagtaccttgaaaaggctgaacaatatcttcacaagtacgaaacttcccactctcactcctccaccggtggaactggaagccacggtaatgttggaggacacggtggtggagctggagcaccggcggctaagaaagaagatgagaagtccggaggtggtcatgggtttggagattatgctaagatggctcaaggttttatgaagtgagtaatgttttagtttctaaaaataattatgttagtaattatcttctataattactgttttagtaagctgttgttttttctgaattattattaactgttggatttgtcatttgtgtatgatggaggaaattatgatgttaaagatcatgtatcatgttgttgaccactcgagattgcgttaatcaaatatttgtataattagaaccgaactttaagttatgggaagtaatactaattaatatcgaatttaaatggaccgtctaaaaataaataaactaattattatcctgagaagaaggaggaaaaacacaagaaaatgataatttttaggttttggcaaataaattaaacctaatgtatcgaactgaaataggaaagcaaaataaagtcaatcgaaacaaaaatttaaaaataattactaaacattataatcaaaagaatcgaaacttgaattactacggaaccaaaatattttggataatcaaaaatatccgaaatctataaatacatttttgcagccattttaacaaataaatcttagagttggacttatttacaactcaatgccattagcattaattttttttttccgaaataattaattttactttaaattcttaatttaaattgtcaaccacattatcaatcaaatttaatccaaacaaacttcacatcaatcccttaaaattagcataaacgtatttgttaacaatattttaaaacaaagttttttgtttaaataaatattattcttactaaacgttttttgtttaaataaataaatcatgtatttgaacttatttacaatgtcatgctactgaaattaattatttagaaagaaaaatatttaattaacgatttaaatcttctaaatctttgcttttagagttattatgtcattatctaaaaagcaaaaatattttaaaatatttatatatttaaactttataaaacattattaatatttaaacttataaaaagtttaatatatcaaaaattttaacatcattatataatatatagtttaaaaaaatctcaaaaaaatttccgtcatattttgtgattaaaatttttaaaaatgaacatatattaaccaattggcgaaaaaatgtgtgggttcaacatcccgcatcgactaaaatatttagacaatgattcataaataagatcaacattaataaaataaatggttttttttgcagaacgggttttgcgagacgggtttgggaggacgttacttaataacagttgtaaactataaaataaaatattttatagatagatacaatttacaaatttttatatatactaactttaaaaaataaattgtccccgcggtataccgcgggttaaaatctagtataattatattttctaaaatattaattatttttggatcaaataaaataattaaaaatacctgaaaatagataaagtagtaaaaatactcaaaaataaccgaaaatgtccgaaaatatccaaaaataaccgaatatccgaatatattcaaagcaaaataaccgaatgaatactaaattttgaaaccaaaagaaccaaaaccgatagcgaaacaaaatttcaaaataagcgaatgaatactaaattttagaaaaataaactgaaaaccgaatgaatacgaactgaaagcggatagataaaccaaacgcaagtcctgagattgtgtaaaaggcccataaacgggcccaatatgcgaatccattttgttttcttgttgggaaattaatctttttctgcttattttaggagaaattgttttaattttaatttagggtctcttgtctttgatcttttgtacactttctctggattttctgaattcgaactttggaagaagaagaagctttgatcaatcatg

SEQ ID NO: 13236 - DNA, 3000 bp, Unknown
  misc_feature (1)..( 3000): cDNA_ID_2702371_gDNA_ID_2214606_Annot_ID_135673 3000 nt of promoter + ATG
aagcaaagatttagaagatttaaatcgttaattaaatatttttctttctaaataattaatttcagtagcatgacattgtaaataagttcaaatacatgatttatttatttaaacaaaaaacgtttagtaagaataatatttatttaaacaaaaaactttgttttaaaatattgttaacaaatacgtttatgctaattttaagggattgatgtgaagtttgtttggattaaatttgattgataatgtggttgacaatttaaattaagaatttaaagtaaaattaattatttcggaaaaaaaaaattaatgctaatggcattgagttgtaaataagtccaactctaagatttatttgttaaaatggctgcaaaaatgtatttatagatttcggatatttttgattatccaaaatattttggttccgtagtaattcaagtttcgattcttttgattataatgtttagtaattatttttaaatttttgtttcgattgactttattttgctttcctatttcagttcgatacattaggtttaatttatttgccaaaacctaaaaattatcattttcttgtgtttttcctccttcttctcaggataataattagtttatttatttttagacggtccatttaaattcgatattaattagtattacttcccataacttaaagttcggttctaattatacaaatatttgattaacgcaatctcgagtggtcaacaacatgatacatgatctttaacatcataatttcctccatcatacacaaatgacaaatccaacagttaataataattcagaaaaaacaacagcttactaaaacagtaattatagaagataattactaacataattatttttagaaactaaaacattactcacttcataaaaccttgagccatcttagcataatctccaaacccatgaccacctccggacttctcatcttctttcttagccgccggtgctccagctccaccaccgtgtcctccaacattaccgtggcttccagttccaccggtggaggagtgagagtgggaagtttcgtacttgtgaagatattgttcagccttttcaaggtactgaccaacaccgctcttttcatcgagcttaccgtatctagaagcggcgtctaagatatcagcggtggctccggcgactttggctttgtcaagcttgtctgactcgtgacgagcagcggcttgagcagcttcggctacgatcttggcactagccatgagctcagcgttcgtagccggtctgtgtgttgttggatcggtgttggagaccggtttatgtgttgttggctcgccgtgaccgggtttatgtgttgttggctccgtgtgaccgggtttgtttttgttgtggtttggctccggatcagagctctccggtttcttgtcggagaatttcttctttacttgatcggtgaagaaatccatgtttctttgtttcaaaggaaaagttttttcttgttcttgaatttggtaaacgtacaataacaacttatccggaggatgatatttattgaatttcttgaaattaggtttttgttctttttctttgtccactagtttttggtcttctttttctttatccactagttaatgggatatttatagtcacgattcttacgccttagatctacttttcgactttagtgagtgaattttattctcttcctacgtaaaaaagatgcttgattacatttgaccatttcgcaaaagtcgaccctcataaccggtcttgataaattctttcttattatctttgattcttgatcatagagttacttttattggtggatgggtacttttagttttgggtatttgtttacctatgtaaatgctagtataatcttggattcttcatcataaatgtagagtttatactttatagggaagtaatatttggtgtattttactacacttaaaagttttagtattggttgaggttttgatgagtggcacggaaaaatgggtcctcatgccacgttcgtccgactatccaactctttgaccatttatgattttgtcggcagaataattaaactatttgaagattggtagcagagtttagatgagttttggatgggcctatgagaagagagctcatatgggctcattaatagcccattattagatatatattctgagcccaactttgtttgatacattccattgaacgttgtcgtatgtgaagaaaaggatgtggtcatttccatcacacttactaattttttgtcaacaagatgaccacattattatgacagaacagaagtgaacaaaaatctaagtaagaccaagaagagtaaactgtatttatatatgtagaaacttgtgtagtatagtatatataagaagcagtgaaagcaaagtatggagaagaagagaagaacaacaggaggtgaaatttcaaaggagtggcatgtgaacacatatcctatggtttcttcaaatttccattgaaaccattgagttttgtgttctcaggtcacccctttgaatctcccctgttccattttttcaccttactaattttttttattcatactctaaatttgtgagcttttgtgctttctttttttttggtcataagtgagattttatgcttttttgattacacatttattataatggaacctctattttgtatctgaaacagagacaaagcattaaccatatcctacatatataccttaacaaattaatgacaactctggtttccaaaacaataaattatgtatgatttgacaattaaactggttgataaaatgtaaatttggaataaataattagttccataatatatgttttttatatctaaaatagcatagtcttttgaaggtgaaaagtcataaatcaggtttggtttcaaacaatgacttcataatcactcaaaaaactcttcttaattatcaccaaaaccccaaaaccaactaaaactgaaaaaacaaacgttgactttttgactaaccaccatcctccgccgtaaatc

SEQ ID NO: 13237 - DNA, 3000 bp, Unknown; identical to SEQ ID NO: 13234
  misc_feature (1)..( 3000): cDNA_ID_1807998_gDNA_ID_2214606_Annot_ID_135675 3000 nt of promoter + ATG

SEQ ID NO: 13238 - DNA, 3000 bp, Unknown; identical to SEQ ID NO: 13233
  misc_feature (1)..( 3000): cDNA_ID_2702375_gDNA_ID_2214606_Annot_ID_135676 3000 nt of promoter + ATG

SEQ ID NO: 13239 - DNA, 3000 bp, Unknown
  misc_feature (1)..( 3000): cDNA_ID_2702379_gDNA_ID_2214606_Annot_ID_135677 3000 nt of promoter + ATG
atagaaagtaactaaaaatttcaaatttttggttaattaacaagagttaaagagaataaggtacaatgatatttgtacttaagaaaatattagcatatagaataatacaccatcacttgaattgaaagaactttgaggaaaatatgaaatatatatgaattggatatccaaaattttaggatatgcatgtcggagggtctgtccgaaaatttgatgtgtggcattagatgccaattggttgcttgaaactatatattataaaaaaaattataaaagaaaagacaagagtaacaaacttttaaaatgcgatatcatacaaaataagtgagttcattacttatacagtgatgaaaaactgattttatttgataagattttaaaattaacttgatctttttcatcataattttctcagaattaatatacacatgtaacacagagttacagatattgacctcactggaacaactaatagtagaatattagaaataagaaacattttttgtaggatcactcttactggagtataatttattgattgaatgcgatgttccgattaattttagaaatttaattggtcaatggtataattgatagtaattagaatatatatatttatttcagcttttttatctatacgtctagactataatatcgttgcaagcaggttctaacgtcatgtgtagatcctttaagcagttcttgtagcatcacttgcattttcacgatcacgtagccttattgcttagttcaatttttattttctttgactgtgcctttagaaaggtctgagggtgatcctacaaaaaactagataactcgatatataagaccacatgtcagaaacttggaagggtttagtgattagacgactaaaacatcataagctatccaattaggaaaattaagtactaataagaggacgagattctcacatctcaaatacactttacatatgtaaagcttatttttgcttcattagtttttagagattaatgttctagaaatgttattatatgaaagcatagagcaactaaacaattacaacttctaaatgctctcttatttgccttgaatataaatttgattgggtagaaaaaatcttgtatcatcaaatcaaattgatatatccgccccgaatttgttttaatatgcatatatctaataattaatttgtattacatatgtgcatcaaatattaaacagaagcattttagagaattaattttatcaggtccacaattagttcatcggttttcaatgaaacctagatacgaaaagaaattttgataagactttgaattgcaaaaactctttaaaaaagtttaaaatatttctaagtaagaagaatcttctaccttcctggccacttcactaaagtccggtgggaagattctgcgactctcaaacttctgtcaatattatttacttaagtgaatatctgtcctagtttatggtaataaattaaatcagatattccctttctttctcttttttgcatccactaaaatttagaataattattcaacttttttaagaaattcaatttacaaaaaaatattgatcaatcgttatctctgtctctctctctcgccgtcgtgcaactataaatataaaaatcttgtggcctaatatgtgcttctttgatttatattgaatctcaattccttttgaaaatttaaaataattaactatataaattaagaaggtggtagaagaatatttgtttttctggcaacgactataaatttcccaaaatgtactaaaacgttcacaatttattcctttcacataattgcgttggtgattccataattttattttaactttgtcgaatatataagataattaagaaccaaatacctgaaatgttagcttagatctatttttcagtcaacatgagctaagatttataggagaattaggaaacatattttatcttaagaattatgagactgaatttacgaaagtataagctatgtgaagtggtgaaccaacaaaagcagaatctgagattaaaaacaatatatcgctttattagaaataatttaaaagtttgtattcttacccatttgttctttataacaagtttccatatattcccttttgctctgctgctttatatcttcctcttttctcctttagcctctcttttctctttctttcatatggaattatacatagattaattttctgaagaagtgattaaaaactaagcattataagagaagataaaaaaacaaatcaaatggttactaatttaatgattttactaatatttaccaagccatagttttttatatattaactattttgtttaagattcatgaagccatatatggtagcatcaaaagccttgattataagctttttgagaaatgagagtcacacatgatacacctttagtaatattgactcattagaaaataaaaataatttatctttgttatattttctcaaattttgctcaaacacaagcagcacttgatgtaaaacagtttttttccgaataattttacataatattaaaaaaaataaaaaaatattgactcattagagaagaggaacgacttctaacagtaagaagcctctcactctctctctctaaaaaatacacctccttagtctctccctctctcgatagatatatgtgtgtgtgtgtgtgtggtgacagatcacattattccgttcctttgaattgagccctctaaaaaggacaggaacctccttgtgatcctccttgtgtccacaacctaacattttattccccttttcctctatcttcttcttcattcgctcttcctctccaaaccctaatttccaaaaaccctgaaaatctttgaaatatttctgaagaaccatatagcatatacatatatcatctgaaacttgaaggcaccacaaattcttcttgattccttgatcatctatattatatttatataatcaataaatattcttcctatacagcgagagagagagagtatataagctataaat

SEQ ID NO: 13240 - DNA, 3000 bp, Unknown
  misc_feature (1)..( 3000): cDNA_ID_2702387_gDNA_ID_2214606_Annot_ID_135679 3000 nt of promoter + ATG
tacgatccattgattctcctctattcaacggttcgatatcaattacacacacgaagttaaactcttccctcccacaccttataaaaccctatacatgaaaaaaaccttcatcttgaaaaaacccctttccaagttttgcaatttccactgaacagaaaactttcccggttaagcaaaattcgccatggatgctcaacaacggagaactgatattcctcgagcaccaccggtcggagaacccggtggcgatatatcttcgattctcattgctttcggtgttttcgctgcaatcgccgccttggtatgatatctcctctcttctcgtttgatctctgtgttcagattagatacacgtatcatcacaaactgaatcggttctcttaaatgtttcatctttcgattctgagtcaacccttttctaaatgtgtaagctttgtatctgaagttgacttaaagctgatgactttgtattcttctcgacctagatttcacttgtttctttttagattttggattagtgtagtgtaatgtcacaagtacacttttttaaaacctatttgagtgacacaaaactctaaagacactcgctttgggttgtatttgttaaagattttgtttatggaatggactatcatcaggttatgtttccctcatcgttggtgcaccaagttcctgaaggtcacgttggagcgtattggagaggtggtgctcttctaaatataatcacagagccaggtatttatgatcccttttcgtagtttcattgcgatttcattcttttgttagttggaattaacttttgtgtgtttcaggttttcatctgaagctgcctttcataaccaactatgagcctgttcaagttactctacagacagatcaagtgagttttctaccataaaaagcttggatgtgtttagattgtagttttttttactaattgattctctactcttaggtgagggatataccatgtggtaccaaaggaggtgtcttgattacctttgagaagatagaagtaagtgtcttaagatttgcttttctgctggcatcaccattgcttttttaatcttaattatatgtattgatcagattaaacatgtttacaggttgttaatcgactacgtaaggattttgtttatgacactttgcttaactatggtgtgaactatgataacacatggatttatgacaagattcatcatgagatcaaccagttctgtagctctcattcacttcagcaagtctacattgacatctttgaccaggtacttgactataatttaaacatataaactttttgatcttaacagtttggaagcttaagctcatgtcattgactggttcatgtttttgatccatatggagtgacgtttccttcctctttttaggaaaacagcagtgattaaagctttctttagatagttttctaattgcgtccaaaatctggaaagtttacgatgatttccgctaattcatttgatcacatgtgtttcagattgatgaacgaatgaaagatgctcttcaagctgattgtacacgttatgctccaggaattgagattcttagtgtgcgtgtcaccaagccgaaaattccagagagtgtaaggcgtaactttgagcaaatggaagaggaacgtaccaaggtaaattccttttgaaccttgtccttggcaattcaatctgcactggtttgctcatatcatcaattccgttataatggactctggacgctttaagattgcttatacaattggaatgaatgattttgaaggtcttgattgctattgagaaacaaagagttgctgagaaagaggcagagacaaagaaaataatggccattagtgaagctgagaagaacgccaatgtaagcaagattctgatgcaacagaagttgactgagaaagacagttcaaggagagaagctgatatcgagaatcagatgtaccttgaccgtcaaaagagtctcgcggatgcagattactaccggtaatagcccgtctttttttcccatttagtttccttatgaatcaaacaaacaaagaacatatacagaataaatggctctaatgtttaaatttttcccctgatcaatgtccttagtgtactgagagaagctgaagcaaataagttgaagctcacccctgaatttcttgaactcaaattcatcgatgccattgctcgtaacaccaaaatattcttcggggacaaggttttactcgactctatctcatttctgaattcacatatctcgtgtcttatctctgttctgctgttctgaagaaagtatatctcttaactgtgcaggtacctaacatggtgttggatcaaaggctgcttgggaatttcctcaatcattcgacaaaagacaaagatggaagcttggaaatggccactgatacatagactagatgtttcagtcccacaaaaacaaattttcttttgtttttattgcataacataaaacacttatcagtgaaatttggaagcttctcccgtagctttcatttagttgcaacccagtctcctagtaaccatgtttttgtctaaaaagaaatctcattaagactaagctaattcggtgtaacactttagccattttatcagattcaatgctccacaaaatattaaaaatgactaagagattctctgtcagtttgagattcaaagtccaaacatatctgagctcattttggtcttattaggctgaaaatgaatgtgtcttgaaatccttcattgacattatcttttgatatacacatgtaaccctctccatacaaccgtcaacaacacacatgcaaaaacagagagaggaaatgcagggttggccaaacattgtccaagaagatccggtttagataaaccgagaatgcatccaaagcggtggggtaaaccgggtaagaggcaaagtccataaatgttacaagaaaagaaagtgtttttgtgttaaagaagaagagtagaaatgtatgtggttgagagcaaagcaggagctataggatgt

SEQ ID NO: 13241 - DNA, 3000 bp, Unknown
  misc_feature (1)..( 3000): cDNA_ID_2713284_gDNA_ID_2214606_Annot_ID_135680 3000 nt of promoter + ATG
taaaacacttatcagtgaaatttggaagcttctcccgtagctttcatttagttgcaacccagtctcctagtaaccatgtttttgtctaaaaagaaatctcattaagactaagctaattcggtgtaacactttagccattttatcagattcaatgctccacaaaatattaaaaatgactaagagattctctgtcagtttgagattcaaagtccaaacatatctgagctcattttggtcttattaggctgaaaatgaatgtgtcttgaaatccttcattgacattatcttttgatatacacatgtaaccctctccatacaaccgtcaacaacacacatgcaaaaacagagagaggaaatgcagggttggccaaacattgtccaagaagatccggtttagataaaccgagaatgcatccaaagcggtggggtaaaccgggtaagaggcaaagtccataaatgttacaagaaaagaaagtgtttttgtgttaaagaagaagagtagaaatgtatgtggttgagagcaaagcaggagctataggatgtatgatactctcattgtgttgtttgggaagttggccagcgattctgactctattggagagaagaggtcgtcttcctcaacacacgtttcttgatttcgcaaccgcgaatctcttggctgcaatcgtgatagcattttcgctcggtgagattgggaaaagcacgtttctaaaacctgactttaccactcagctacctcaggtttggttcgttctatatacttcttgagattcctgataaagtttatacgaacttgattggtaatatgaggttttttacaggataattggccgtcggtattgcttgcagtcgcaggcggtgtgcttcttagcatcgggaatttagcgactcaatacgcttttgcgtttgtcggtttatcggttactgaagttataaccgcaagcattaccgtcgtcattggtatacttcctttggtttgtgatgaatcaaaaacttatgtttctatggtttcttgcgtatcacggttgaattttataggtacaacattgaattatttcttggacaacaagataaacaaagccgagatcctcttccctggcgtaggttgcttcttgatcgctgttttcctaggcgctgcggttcatgcttctaatgcagctgatgtcaaagagaaactcaagtctttacctagcgagtataaagctgagacaaactaagatgttgctctttcttttgcctttgttccatgttttaaaaatgttttaacaaaactctgatctttttcagagatttatattcttctattgaaaatggtgaagacaagcctgaaataggtaaaacctatatatatattgatttgtgtgaagatatatgcaaagcaaaggaatgaaaattcagttaaaattagaaacttttggtggaactttgatcaaagttgtgatgttttcttgtttgttcttaccatgaacagagaaaactgatgtcgaatctcaagagaaactcgcggaaaaggcgaaagcagggacggcaggattctatgtagagctagagaacaaaagagcaatcaaggttcaattacaatgaccaagagaaaaacctttagcaagattacgtagcaaaggagagtatacaactactctcggtgcttaaaacctcatcaatgcgcaggtctttggaaaaagcataatgatcggactattcataacgctgttcgcgggaatcagcctttctctattctctcctgcattcaacttggcaacaaacgatcaatggagtacattgccaaaaggcgtacctaagctcgttgtctataccgcctttttctacttctcaatcgcgggttttctcatttctttgattctaaacctcatctttctttaccggccaatggtaggcttagcgagatcatcgcttaagaagtatatatatgactccaaaggtagaggttgggcggttttcgctggattcttgtgcgggtttggtaacggtttgcagttcatgggaggtcaagccgctggatacgcggctgcagactctgtccaggttattttttgcttcttcaaatttagtaatctcaaagtttacattttggtttttgcaagtacatgagctctgtttttggtttaggcacttcctcttgtaagcacattttggggtatagttttgttcggagagtatcgaaaatcgtcgaagcgaacttatgcccttttagttagcatgttggccatgtttgtggcggccgtagctattcttatggcctcttccggtcaccggaaatgatgatcttatcatagttgtattatacatgtaagattataagtgaatgaagaatatatgttctgtttcaaaaatgttatgttttttcattctaattggagaaacataattttttcgtttcgtctctacttaaatgaatattcaatgaaagaaaggagaaagaaaaagaaatgttaggtacttgtctttttccagaattaatttctctagtataaacgaaaatattagaaaggtcaaaaagtatccaaagattggaacctcactatgaagattccaaggcaaatcaaaaattttgtatatcaatttgagtcaatgttcagtatctttacattctctggacaaaagatctaaaagatatgtggtggaaactctcttgaacttatttgcagaagtgatattatcctctgttcttgcagaacctagcaaaggtagtgtctttttcatatacctattttggatgatttggttctacttatcttttaaatctcaaactctcttgtcatgaatagtttatggacatatgtatcttccatcaacatgagaaacaatcaagaatcttctctagtcttatgtggattgtttatctgcttttaaggattagataattctgaaattctccaagcatatcttttgcctaaaccaacatttttgcttgcagggctgatccatttagagcccgagaatatgtatctagtggagagcaaaggaggtgccatagcttgt

SEQ ID NO: 13242 - DNA, 3000 bp, Unknown
  misc_feature (1)..( 3000): cDNA_ID_2702417_gDNA_ID_2214607_Annot_ID_135688 3000 nt of promoter + ATG
gtaggatagaaattggtcttgggtatgggattccatgagatccatggcttcgaatagctcggcggtgtggcatggctgctataacggtctggtggttccggttcaggtgctccaccatctggttcttcctcaaaatccgagcttgatgagtagccatcatcatgccatgactcaacaaatctagtctcgttgtagtacgagtcttgactacatccatatgagtcctcttcatcagagctagagtagattattgtctccatcgttctcaaattttatttgtggtacctcgccaaagagagtaaaacaaagaagacaatgaatcagaacttaactcaggaagtaagtcaacaaataagtcaaaaataacaaaacacgatttatttatttttctttttaaaaacgagaatagcaaaattgaaacaaataacaaactagacaattaaaatttttattttgtttcactattaaggttgtggaagcaaatcaaaacaaattgcaaaaccaaatttttatggggttttcgatttaaaataaaaaaaatgaataacgaaaacagaaattgaaagggataaaagggaacgagttcaccttatgggattggagcttttagctctgataccaatgatgcaaacctcggaatccacctagggtttacgcttctcggtttgtcgacctaaagcttgaatgattcgatgaatgatggtagagatgaaagatggaggttttgttgaatgaatccacactcaacgtgcttgattgaatccacaatcaaaccacaaacaaatcaacttgaatccacaagctaattgatccgcacacacaagactttagtgaatccacactaacttctaatgcataaaactcaaagacactctttaaagaaaatacttgtttatttcgtaaaaggcttgaatacaaatgaaaactaaggtgagcttatatagaggctcaaacaatgttcatatgctctaaagaagtaaagaaatcgcaacaataaatgaaaatatggttgttggaactttaatgacgaaatcggccaaataaggaaagttgtgatgtgtcttgagtcttgacaacttgggctggaagtgatgtgattttgggacgtctagagtcattgtaggaagcttcttaattcccaaaagatgatcaaaatagagttgttgtgatttgatctcatttagctccggaaaaggaaagtcttggctccgcgggttcacataaggaatgatgcaccaaggattaagtgtgaatggttctaggtggcgtagaggatctccaggcttccatatgtggctctgggacgcacaaaagggaaggaaaggatagctttccttagttcgcacaagctggtttgatacatgaagtacttcaggtagtctgtcagaaggtccataaaaaaatccaacaagcagtctgtcaacgagtgcatcagccggtacgtcagctcccattcttacatcatcccctccctcttcaagaggttttgtcctcaaaactttttttacctacacatagataagtcaagttagtccattgaagtgtataagggtttagaagcttacattgagttttgcgaaattgttgagcatccggtggttctcctttgatctgaatagtgtcattgacactctcatctttgttcacagtaatttcgtccagtgtaactattcacagtaatcggatagtcatatacatcactataaaggttattgacgatttatgtgaattttgtgcatttttttcttatcaagcaaatcaacgaagtagcaatatgattctgattttaaaaacataacatttcgaaatgttaaactaaccgggatccgggtcaataaactaggttcaaaagagagaaaatcattaggattatatgcttgagtttgagggatgacttcagcagatcaggtatgtctctatgcgcaactatttcagtaccccctcatccataatatcacatgctcgttcgagcagattgctcctaaaaatgagactaagcagcatagaactcataatggtatcaacatatatactcctatatttttggttttctatctagcattctagcccaatatatagcagccacgcaagtgaaaagaacatcgttactcgaaaaatattttacttagctattttggactggatctaattaatatgtgaggtgtaagccaaattaacgtcaccgcattaaacgcctatgcacaagttaacgtcaatatgtctttagaagaccgcaacaccgatgcatggttatgaaactcctttatgtttttgttcatcattacgcaaattagtttgttctccagcgttaggatcgatcggctgaaacatattttcctgcaacatttattttactatatttaaggaggagaaaagtttttattaatcaacttttagtttttctaatatcacatggataaaataataaattaaattagacatacagttgttagtaattctttgggagatttgcaaaactacccttattctaataactttttgtaaaagtgccctttcctgaaggccatttttaaaactaccccttctaatatggcaaatgattgtcttaccctctgaatgattaggtttcacattcgtttcacaaacttcttcgttttggcacaaacttcttcgttttcctctccgattttcctctccgatttcattcaaaatcgccggcgaatttcctctccgatttcactcaaaatcgccgacgaatttcctctccgatttcactcaaaatcgccaacgaatttcctctccgatttcactcaaaatcgccgacgaattttctctctgagaaaccccaaaatcgcagacgaatttcctctccgataaacctgttcttctgtgaaggattcagatcatttctctacgacgcaaacaatccccagagatatcgatagatccgacggtaaccgtttttataatcgattttatagtcgattttatagtcaattttatagtagatctgacgctgtttcataacatgttttgcac

SEQ ID NO: 13243 - DNA, 3000 bp, Unknown; identical to SEQ ID NO: 13242
  misc_feature (1)..( 3000): cDNA_ID_3028728_gDNA_ID_2214607_Annot_ID_187263 3000 nt of promoter + ATG

SEQ ID NO: 13244 - DNA, 3000 bp, Unknown
  misc_feature (1)..( 3000): cDNA_ID_3028692_gDNA_ID_2214607_Annot_ID_187259 3000 nt of promoter + ATG
tgaactaattaaaattttattttaggcatctttggtgctcgtggcgaaccaagaagctattgaagataacacttctatgtataagcatatgctagacataatagaagacctttttgatcagtagtctacgaacaagagattgtgccgtgatcctaatgatgttgatgcgatgggtgatatgaaacttggaaaggatgtgcttgacaacgaaaagtatcaaaataattgatggcttatggatcaagaaagatgatgttaataaggttaagaaggttattgacatgaagatcaaatgtgtttcatgaagatggaaccgaatcaaccttgattcagttggtcaatctgatcttcatatgtcatagtatttctatggtttgctatgtttgagaactttttgtttggtttaactgtttttctctgaaattcatgtttaaagttttatgttactttgattattatggatttaatttggctttctttcaaatcttcgaataaattggattttgttttgggacttatttaagcttcaatattttcaactttgaaagtgttgttgtagttagttggctatacagatcttacaacaacacttacataaaaattaatacatttataagaaacctaaatcaatcccaaaaattaggatctttcatacatacaccaagattcaattttctcctcctacaaatgcaacaataattaccgaaaagtaaagtagagcatgtttaagtgttgtcaatgaaatatatcatttctcattttgaaaacagatattcaaactttttggcattcttatttcatctgtattcttcttcggaaaaatgggtaaaaaaaaccttcactttttacaaaaacatgtaaaaaaccctcaactttttttgttagtttttaaaccatcaccttttaataaatggtaaaataacacctagtaatattaaaccaaataaagtataatattaaaacataaagtaaaacaacttaattagtttgtaatttatactttccaaattcgagtttacgatattttttccagaatttagttattgtttttttggcgatataaagaaataagtttcaattagaatttgttatgtaaactaaaatcaatttatagcttaacacattttattttatttttctttgtatgttttctattttttgaagttttggatttaaaatatttatgaccaaaattcgttctaaacttgtgtgactgaaccaaataagtttttcttaatataaattttatattttgttattacaaaattagtttggtttctcgttgatgaaattctagaactcaaccaatcaaactttctttcaactaaatctatatataaaagaatatatcatacataatataaaataattactttatccaaattaaatcaaatctaccctcgaaccaaaataaataaaatttgaatagattctggatatgttatcttcaatatgtaacccattttgaaaaattctttctaatgcctttttcacactaccccttttcaattctactcttttctatttaccatttttatttataccctatttaaatttttaatgactattttacctctatttgtaaattgatttaggttaacaaaataaaatattaatattttttgcctaaaatattccaaaataaatttcccgccaaaaaatttcggaaaaaaaatttcccgccaaaatgttttttcaaaaacatttttccagccaaaattttcccgccaaaaaatttcgaaaaaaaaatttccgccaaaaacaaaattcgaaaacattttttccgtaaaattttttttggcaggaaatagatttacaagagattttaaaagggttttaaaatatttaaaagatttacaatagattttaaaagggtttaaaagatttacaatagattttaaaagggtttaaaagatttacaagagattttaaaagtgttttaaaagatttataagggatattaaagggctttaaaagaaatacaagagttttttaaagatttttaaagggtttaaaagtgttttaaaagatttacaagggatttttaaagggttttaaaagatgtacaagagtttttaaaagattttaaaagaaattatatgaaaaccctttaaaaactcttgtaaatctttttaaaaccttttgtaaaggttcacaagagttttaaaatggttcaaaaagagttgtaaatgttttaaatacttacaattctttttctaagagttaaaaaatgtttgtaaagattttataagagttttaaaaggatttacaaaggtttaaaatccttgtaaatccttttaaaactctttaaaaactcttgtaaatcatgttttacccttttatacgtttttaaaatccttgtaaatcattctataccacttacttatttttttaaaacgattgtaaaccatgcaaaacttttttaaaatcccttgtaaatcattctttgacacttacttatgctttaaaaacgattgtaaattaggttaaccccttttaaaatcccttgtaaatcattcaatgtcacatacttatgctttaaaacgattgtaaaccatacaaacacttttaaaatcccttgtaaatcattctatgccacttacttatgctttaaaaacgattgtaaatcatgttttacccttttataagcttttaaaatctcctgtaaatcattccaataccacttacttatacttaaaaaaagattgtaaaccatgctaaccctttttaaaaatccttgtaaatcattctatgccactaggggtgtcaatcgggcttgaagcccgcgggccaggcctgtatagggatgcaacggggcgggtacgggcacatttaataaagcccaaaaaaatgcgggcctcacggtcatggtccgtttggatcgcggttgaaagaagcccgacccatttttgaccgcggatttgcgggttgacccgcaacgtcttctttagcaccgttacgacttacggtgaatcgttgatgaattttgatatggtgatg

SEQ ID NO: 13245 - DNA, 536 bp, Unknown
  misc_feature (1)..( 536): cDNA_ID_2702429_gDNA_ID_2214607_Annot_ID_135693 3000 nt of promoter + ATG
tagtttacttgctttcttgtgtatgtctttaagttgtaagtggctgccactgatgtacttttcgaaatcgtgaacctaatgaaaagaaaacaacacttagtaaaaaaaaagaaaacatctttagtttatgcaactctcagactgtttagcttgattttcgagattattatttttcaaattatttatgtaaactaatttttctagaaattaagtaacggttgtggagttgagtttttaattagtgtgtggttgcttaaaaaaaatatgattcactttttaaaaggaacggtttacgacaaaaaaaaaaaacaaaggaacggtttagtataatttgtaccgaacgcagaccgcaactgcaaaaaagaagcgtctgggtgcgattgcggtataagcgaacaatccctaaacccgaaaataaccaaaaggaaaaacgcagagaattcgaaccagagagatctttcgaatcaaaacgatctgaagaagaagaagaagaagaagaatcaaaatctggatcagaaacaagggaggagaagatg

SEQ ID NO: 13246 - DNA, 3000 bp, Unknown
  misc_feature (1)..( 3000): cDNA_ID_2702464_gDNA_ID_2214608_Annot_ID_135697 3000 nt of promoter + ATG
aaaagtatcgactaatcgctaaaaccagcgactgatcgctaaaaatttcagcgaccaaaaattgcggtcgctgatcgctggcgattatcgctatttttggtcgctgaaccagcgacaggcaaacgaacaacttttggtcgttgtcgctggtttcagtcgccagcgacaagcaaacgaacagggcctaaattctattataaccggagatattccaaactctaaaggcgagggttcttctccagcggcaaaatttatggacaatgttgtctacagattgtgtttcaagggtttggtgaattatgaggcggttgcggacgatgtagaaaaggcagtgaaggctggatttggggttgcgatttgcgatgagaaggataatttgttgcatgagattaaagaatcacttagagacattgagattagtcgtagaggagtagagatcatggcactggttcgtggattaagtgaatccttcgatttggggatgagaaatgtcgtgatttattgtgatgacgattggatttaccaatctgtaagtggttctcttctttgttactgctttgggttagttattttggaatcatgagactataatagtgtgtggactattgatttattttgcatgttacaatatttttttcttctttttatgagtaactgaatttcgtagtgcgtatttaagttgcactccaaagataaatgtcacatataattgaaacgatgatgattttaatttgtttttagttttagattttggtcttcgttttttgctatagattataaaaataaaaataaaagttaaaaaattcagagatgaaacaaatcttgtgaaaaaaatagttttccacaaaaacctgaaaatcatggtttttagtattctttgaaacatggagaaaccattcaaaataaaatactagttttccaaaatcgttggaaattctaatttttttaatatcttgaagggtgagaaaatatattttcaatgaaataaaaaccaaaaaccacttaacaactagtaacttgagctttttttcaaatcaaaactagtaattattgtagaatcttagaagagtaatgatgattacgactttgacggtgatgatatattgtcttagtctaaggagaatatatctgattttcattgcagataattggtagagggaagtctaaaaagaagattgaccatcttgtggaagaagttcaaggcattttagaaaaaatggcctgtattgacgctgttttggttgcacggaacgatgttaagtttgcttttagacttgcaagagaagccataggcagaaacagcgttgatgtgaacgcagaacaaggagagacttgtggcatattttttgaagaaaccgatgtagagcacatgttcgttaccgagaaatgccttcaccgtcattgctttccttgtgtgaaacaacatgtgaaagtgaagctgcgtagcggaactgagcccacatgccttgaatatggatgcaagtttaagctcacccttgaaagatgtagtaaagtgttgacactaaagcttattgagatgtggaaacaaaagatgaaagaagactccattcccgctgcggagagaatatattgcccatatccaaactgctcgatgctgatgtccaaaaccgaactatccagtgaagccgacttatccaatgttaggacatgtgtcaaatgttgtggactattctgcattgattgcaaagtaccatcgcatactgatttatcgtatgatgattacaagaaacttcaccctgaccctctagttgatgacttgaagctcaagtctctcgcaaacgacaaaatgtggcgtcaatgtgtcaaatgtaggcatatgattgaactttctcatggctgtaaccacatgacttgcaggtatatatatttatttaactcgattttgctacatcatatgaatattttcattttgtaatgttttctttgtgcttgcattgtgtagatgtggttatgagttttgctatgaatgtgggattgaatggcagaaacgggacaaggtgattatgatgatgaagatagcgatgatgacgactcagaacatgattgtgaagaggatatgtgcgagtgctattatgatgaagatggtggtcgttggaatgattttgaagattttgtggatcaccaaaccgcacagtgatgctttgcccttttgttttactactttgattcttaaactctcactgcattgttgtgattgactttattttattatatggttcttgcagctacgatgcgccgagggatgatcaggatgtggtatacaagtatccttctcctgagcagtttttcagtgaagaaaggaatgctgatggagatgattacatttgggacgactacaacaattatggcggtttaactggcgataaaggaggctttgatgaaggctttttcagagattattattctctttaatttctgtttggatcaacacatagatttagtattggaagttgggaacacatgcattccatctttttcttttgcattttcttctttatgatctttgagaattttaaggacattattttttttcttaacattgcaataattacaaaattttttttatgtttttcttaattctcgtaattgtttaaaaaattattaatatacatatacataagtaaattgtcttttctagattttaattaacatttgtcatttgtattctgttattttccgatttgaaatcaatattcaataatgtagattttcccgaaaagaaaatacagaaaagggaactataacattatagaaattatcctacgaaataaaaaaaaagattatagaaatttaaaatttagagaatcaatcgacactctcattaacaaaatacgcttgcaaatattaaggaactttgataaagagcagtgaacgagaatttatttaataacttctcaagcaagctatattccctctctctcctcatctgtatatatatatagctagattttcacaagaaaaattggagactaatcagtc

SEQ ID NO: 13247 - DNA, 3000 bp, Unknown
  misc_feature (1)..( 3000): cDNA_ID_1837627_gDNA_ID_2214608_Annot_ID_135700 3000 nt of promoter + ATG
gtcctagatatccgaaatcttgtaatttgatagcatgatcgttttcattcttaatataatcattttgctgaaaacagaaaagaaaaaatccaatatataaacacttccatatagaagtcgcgggatgggagattaatgagaagaaaagacatgcagctattttataaaaatgctcgtcaatgcattatggtgatgaaataacatcattgggttttctataagttaataatcttattctcattaattagtcaaaatatacgattggaggtttatatatagattgactttgacctaaaccatagccgtaaatcggaaaatgacaatggtttatctttgtgcaatactagttcaaaatgcaataatagtaaaaaataggaaacgtagggccttctccattagtgtataaagtactcatttctaactttttaatatatctttgtgccaaaccacattatgacctcaaaactacttcctctcctcctcaatctcatcttcctcttcttctttccccttctaaacgcatccgaacaaaaaccttgctacagtttctcatgtagtcaagagagcgtcgttgctcgtttccctttctccctattctcctatcaacctgagtcatgcggctactcaggattcaacctcatatgcaaagatgatgccaatactaccttaaagcttcctaagtctgaaccctttcttgttaaggagatcgactatgaaacacagcgtattcgcctcaacgaccctgagaattgtttggccagacgacttcttaactttgacccttcaggatctcctttttcttttcttcgctctcgtaactacacgttcttgatctgtcctaaggaagcgaacatcactgcatccttcagagctatcgattgccttggtaataccacttcctccttctttgttgtgcagtttgagaatctcggttcgatgccatcttcttgtcacatctttaagatattacctcttccattttcttggtttgtcgcctacacgacataccctgatggccaaaacagtcgagacatgtggctcaaatgggactcgccggattgtagagattgtgagaggagaactaattcaagatgtggattcaaaaacaatacttcccatcaagtcgaatgcttcagttctgttaaccctggtgcgtacaatctcaattcttctctgttcttttgtacttcacgatattccaacttgaaacgacatcatctacttttgaaaaagttctttcccaaagaatccataaatggttgaaagcttcaaatccaaggagttgttaattaaacaaagaaatgaatctagttggctttaaataatgacattaaaccattgacttgattagtaaatcaatatattttcaaatagcaaacatgagagaatgtcgtaacattagaatatatgaatacttgtacatacaagtttcaccgttgacccgttttgttgttttgaaaacaggacttcacaacacaggcttacaagtactaaagataatgtgcctctccctagtcggaccactcaccgccttgactttttgtgtcggtcttgtcatgtgcagttccgagagagtctcttcacagatacaacaagcagtggttgcacgcctttctggatccgtaacgtcgcagccaagcaacgaagtcgcaaggataggtctcgatgagtctacaattgagtcatacaagaaagttgagctaggggagagtaggagactcccgaccgggtcaaatgatgttgtttgtcccatttgtttgtcggaatatgcaaccaaagaaactgttaggtgtttacctgaatgtgaacattgcttccatactgaatgtattgatgcgtggctcaagttgcatagttcctgcccggtttgtcggagtaatccatctcctttgcgcgattgattgctttgaatagtcttgtagcgtttgtatgtaatttggaatttggatctctccataaatgcattacaaactgtgtcaaaactcaaaactaagcccaaacgccaagtttattagaaaagtaaaaatgcaaatgagaattcgtagattttcctcggcagattctatgaaaccacaaaattgggaaatttcatgggctatgaggaaataagtgattaattctatataatatttatcgataaattaataattaatttataaagagattattttaattttgtaatttttaaaacaattctatatggaaagtagttttttctttgtaattaatatatttctaaaaccaattacaagtagataaataattatttagtttaaaattttttatcgatgtaataaaaataataaaaatgaactcttccaaaaattaatacaaatttatgtaaaaaaaacaatattaaaattctatttcactaagaaaatttatatataatattttaaatatatataataataatttatagatgtcatatatataatattcttcgtccatatttgttagttatttaaaatcgtaatttctaccatcacaatttttactaatcatcatttataatatagtcaaagcccttataccaaattcatataacaaaagtttatattgtttagaggcagaattatcaataattaccaatcggctcctaacttatttaataacggttgaaactgtatctgtgtttgttttgtttcagcaaattcccgcatcctttgcgtttaaaccagtcctcgttaattgaagtttataataataccccgtccgagggtatgataagtaggtgaacttatctctctgactttggtcgctttcactacactacactagactgtccattagcggattaaacgaagacgacgagttaagcttttgctgacttgcaaatttctcattcgtcttctttctccaaatctcgatgccaatttagggattctacttgacgttccgtgcaatttcttcttctgcgctactagaattgatttctctcgaaccctaaatttcctctggacctcaatgcttgtttgtttctaattacttggttcaacg

SEQ ID NO: 13248 - DNA, 3000 bp, Unknown
  misc_feature (1)..( 3000): cDNA_ID_2713302_gDNA_ID_2214608_Annot_ID_135702 3000 nt of promoter + ATG
ttataattggtgtaaggaaacgggtgtggcgagatcgtctgagtatccggaagttcagaggattacaagcaagttgttggagactttggaagagtttgttagagatagggcaaaaagagggaagagtcccgagaggaaagagatcgaagctcctcctccggtagttgaagaagaggagcctgagcctgatatgaatgagatcaaagctcttcctcctcccgagaattacactcctccacctccgcctgaaccagaacctcagcccgaaaaaccgcaatttaccgaggatttagttaacttgagggaggatgaagtcacagctgatgaccaagggaacaagtttgcgcttgcactctttgctggtccaccgggtaataacggaaaatgggaagctttctcctcgaacggagtgacctctgcttggcagaatcccgctgcagagcccggtaaagcggattgggaattggcattggttgaaacaacgagcaatttagaaaaacagacagccgctttgggtggtgggttcgataacttgttgctcaacgggatgtatgatcaaggaatggtcagacaacacgttagcacctcgcaattgacaggtggtagcgcgagcagcgtagctttacccttacctggtaaaaccaacaatcaagtattagccttacctgcaccagatggaaccgttgagaaagtgaaccaagacccattcgcagcttcactaaccattccaccaccttcgtacgtgcaaatggccgagatggagaagaagcagtatctactgagccaagagcagcagctatggcagcaatatcaacgtgatgggatgagaggtcaagccagtttggcgaagatgaacaccggtccagttccggcttacggaatgccacctgtcaacgggatgggaccgccaccgacggggtattactacaacaatccttactgattcattcttttttgcacccattcatatatgtgtagatgactcgtcttccacctttgatcttgtgtgtgttttattatatcccctcggattgtcgtaaaacgattccatcttcttccttgtctctgctcgagtttgatttatagtttatgtacactttcttgagaatcttgattcccttctgtataacattttgatatcattcatgtttccactgtttaacttaagaacacttctgtcggatagtcttaacttgcaaagtctccataggacttattatatttgggttgtgttgtccaaaacaaacaagtgaaacatagccactctttcaagtttgaagccattggttcatttgtacattattaggtgagacagatttgtcgctttcgtatatttctttctaatattccaggagatgtttactataaattaaattcatcttttttatagttgggattggaaaatgaaagcacgagaagtctctgttagattaaaagagttaggtgacccaataggttatatataatgatagataatgtgtgaccgtccactaccatccataagtatgtataatgacaaattctttatattatttgcttgtggagaataatacaaaagaaaagctaagctggagtctcttcatgaccaactcaaataagggtgtctcatttttgtaaacaggtcacgtacacgtttctggataacttaatttgatttatcattatcactgttattataattagacatggtcacatggacaatacccgatgaaaccgaaccaaaaccgaataggttttaattactgaattgatcttaatttttatatccaaagaatcgcaaccaaatccgatatctaatagatactctaaagtatcgggaatataaatatttatcttaaaaatattatttatatttataattgtaatagtccaatacaaaaatgatattttaattaaaatgatatcttcttaatatatttcttatattcttaattaaaaaaaaaaaaaaaactatcttaaatgatatatacgaaaataagaataatcattatgaaaataaataaaacaacggaaaacttataatacgatacaatacattatcaagcacacaaaacaactaaaaacacataacttaatcagtacaaaatttgagaaattcaattgcttaccatttgagaaattcaatcgctctaccattcgtaacaattttattatccgttgaagtaaaagaataagggagtgcatgaaatgaatatgctattacagattaataatgttgacctataaaattcgtgatagattaattcaagttctaaagtaagcccaattatttttgtttcaaaaaaaaaaagaacatgcccaaaactatttttgagttgattttactttttttatccaaaagaaaaattgttttccctaaggcctccaattattgggccggggctgttaacagaagcactaaaaagagctctatactagaatcactgaagcagaactctccctaaagacctcaaattattgagcagaactctagtatacgcacacggcgtgagaatgaagaatcagataaatcttctccataatgtaatcactttgacaagtccttaactttgaagtttgaacttcgacaaatccacaaacaaacaataatcaatgcccactttatcacgtccccaactttgaactttgacaatcaacacaaaataatcaatgccacacatgttattttgtaaagctctaagggctacaaacttctccatcccccaatccaaaaacgtatcaaatttgtctcaacatacatattaaaaatttcaaactgatgtattccaatccaaattttacgttgatgaaatatactaacgtagatttcacgtcatgatttgagtggctcttagacattatcttggcaattacgcatacttttctgctgactttagttatagctctgacttcttataagtcaagttatgtttcaatgaaaaatgaaaacccacatctttatttctaccaaatttttctctcacttttcttaaacaaaatcattattcttaaaaatatttc

SEQ ID NO: 13249 - DNA, 3000 bp, Unknown
  misc_feature (1)..( 3000): cDNA_ID_4262177_gDNA_ID_2214608_Annot_ID_135703 3000 nt of promoter + ATG
gtcagatctccgttgactcagcaattccgaagaaaaagtcaacgagtcgtcgcggcggtggtagccatttcgactctttttcctccccagccaccgcgtcgagttcaggcggacgtagccccgtagttgaaaccgggttattttcaagcccggatgagaaccagtctgaaccgggtcaaaaagccgggtttaattggtggaagagaagacggttaagcttttctatgacatggagaagagaaccggtacgcatttgactttctgaattttcaaactcggttcgattttgtccttaaccggaccggtttattgtttgcagagagaggatgaagttacgaagacatcaacaaaaccatcggaggaactagaaaaaccggcgacggagataccaatcgaggcaaacaaatgggtaatgaaggatttagtgagccgcgatggaaaatcgaagctgaaatcggaagtttacttagcgtcgattgatcaaagaagcgaacaagccgccggagaagcagcatgcgcggcggttgcggtggtggtggctcattggttccacgcgaatcctaagctcatcaatccttcaggaacagcgttcgattcactaatcacgcaagggtcttctttatggcaatctctttgcgacaaagaatcgtatctaagattgtttccaaacaggcatttcgatctggaaacgatcgtttccgcaaatttacgaccggttagggtttgtaccgataaatcgtttaccgggttattcagcccggagagatttgcttcgttggatggtctgatgtcgtttgatcagatttgggacgaggtagagaaagaagtagcgttagcctcaagtaatggtgaaactagggtttatattgttagctggaacgatcatttcttcgtggtaaaggcagatttagatggtttttgcgttattgattcgttaggggagagattgtttgaaggatgcaagcaagcttacattcttaagtttgatgattcgagtttgatgtatgagaaagaggaatcgtcggagaagttggtttgtgagggtaaaaagtgttgtagagaatatataaagagctttttggcggcgattccggtggcggagttggcggcaaaggaggagaaagggaatgtagtggatgtgtctcttcttcatgagagacttcagattgatttgcatcatattatattgactagtagtgattagagttttttttttttttttctgactattgattggtgactcgttagtgtagatttgttaggatggtgagagatattcaatgggagtgtagatttaggatggtgcatgtggttcgttataatgttcttgagagaatgtgttggatataataagtcaagaaaaagttatcatttgtcatggcttaggtactaaaatccaatcagggtttctttttgacatgttttcgagtacattcctcagccgagaacaaaacccgaacccaaacctaatgtaggtgatgttggaaatacttaatcctacttgacaagatcaagagaagatgagaagaagaatcgtaagaagagaagaagaaagaagatgtttgtttgtgtaatgaagaaaagaagaagaagaagagtcaacatgaaaggaagagaagataaaggcttttgggccatgttgcacatgaatccttagtcttttttcctttttttttggtcaacgaacgagcgcatgaatcctcagtcaattattatatttataggctaaagatagtcggtagagattttaggtttgataaatgagataaaattaaactttcattttatcaaagttataattagagagatttaactttttatcaaatattttgtgtatgtcgggtttgcacattcaaatattttatattatgtatgggtaaaaactttcaaggtcaaaagcacaagacaaataagtgtaaaaaataatatgaaaggttatgctaaatgtagatagaaattccagaaattgaaagatattgtgactggttattgaaattgaatttgatcctgacacaccacttcattttgttttgttatacatacggagaggccacacacgtctctttttctttttctttctttgtagtttgtatacaaaggaaaaaaataaaaggagaccccatggcgggaaaatacgatcgtttgggtgagttaaaagcattcgacgagatgaaccaaccaccacaattttcttatctaatattgcgattttaatagtatataaattttataaaatatctcaacctaataatttaaagctttacacatatcaaacacgtccaccacaattttcttatctaatattgcgattttaatagtatataaattatctaaaatatctcaacctaatagtttacagctttacccatatcaaacacgtgcagtggaacttctagaccggtgaacactaaacagatttttatcatttattaacctaaaagacaactaataaatatttattaacttaacagatttacacgtctctttttcttatggcatatcaacatcaaacaatattatagcaaagataatgtgattatttggttattgtaattgaaattaatccatataccaattcattttgttttgttatatatatcgagaggttattgtgatttaaaaaaaaaaaatatttaatcatctacccagtaaaactacgccacataaccaccacaataactctaagagcacttcttaccttgaaacgtctcttacttaaattaataattaaatctttaatttttatcatttattaacctaagaaacagctaataaatatttattaatctaagagacttacacgtctctctttcttataacatatcaacatcaaacaatattatagcaaagataatgtgattatttagttattgaaattgaaattatccacacaccaattcattttgttttgttatatatatcgagaggcctaagacaacacttacacgtctatctttctttcctttgtataccaaaaaatataaaataaaaaacactatg

SEQ ID NO: 13250 - DNA, 3000 bp, Unknown
  misc_feature (1)..( 3000): cDNA_ID_2713298_gDNA_ID_2214608_Annot_ID_135704 3000 nt of promoter + ATG
taacattaaaaagcaaatgaaataaaactcctaatcagtttgagtgtgagttcaatgcaaagacctcaacggttataagtattcaactagaaatgattgtatattaataaagaaaacaaaaaagagtcaaagtctctgttaatgtacacatttaaaagtcatgtgacatgagttaagttgagtgaccactatcgtttactttgaaattgtatgaaaagacaaaagaaggtctttgaatatcggataatatatgtgtggcttaagatgcatatacttctaccacgaagtatgttaagtttaagtcatgtgaaggatactacttttgtagccatgtggctacctcaatagtcagatgaattttgacccatgaacatcttccctttcattggattgggcaaaaaaaaagggttcaaagtctacaatactggattgtatgattgatgtccaaacacctcaatgtaagctttaaaatgcagtatgaacacaggtgcattggtggaagaaaaacaagtcgaacaaaataataaattttaccagctcatgtgcaatttctttgttttacatagatgaagtctcgtcacttgttgattaacttaagttgaatagtgaatccaataccacttgatctatagtgtttatgattgaagaaaaagcaacttatgaattccaatcgctacaatttcataatcatctcaattccaaacatattcaaattatacctaaaccaagtcgcattggtctagctagtggtaaaagagagaaaagtttctgtaatcttggttcgagtaacattgatctccagggttcgaattctaacatggttttcccaggctccgctgagttggatgccatgtcacctgacatgttaattgaatcaataagcccccttgtaggtgtgccgttagctcttttctttttgtataagtgctcttttgctctctctgtttcagagcttggtgtgtttttgggttaacattgcattatgtaaaccttttttcattggtataaatttaacattagaccaaaaaaaagttagggacagcatcattaaatattaaaaattagaagttttttccaaaaaacacaattctttttttttttttatcagatgaatattttaccgtatattgaagaaggcgataaattcctcaagagaattaccgtttagaaaactaagttctaaaatctagatcaaaccagtttgatagacaaagttccgatccagttttggtttggtatagacatttctacaacaatggatgaaaatagttttttttttgtttggattaatgactttcaattttattctgttttatttgttgttttacccatctctaatactatgaatgtattctatttcaacaggtaacataccctatatattaagcgcttcttgtctcattaaatgtggatttaaaacatgaatttaaaataccaaatataattaggaagttaaatttggtggaatgataaaaatatgtgtgagggcaaatattgataattcaacggcgtccggaaggtgccatgacatccatcttaacagattgacttatatattagtggcagtcaatgtatgcattaagtcaccttttattaattcagatatgaaatttgaaaatttatacgatttcaccttttatttatacaagtacttcacttaatggtttttcatggtttggatatgaaagaaaaaaaacgttttcccctcctttatttagaatctctcaaacatatatttgcgtgctgattttagctaaagtatgtttgcgtactacttttacgcttttagctatagtacgactgcgttgtggtcctttgtcatccaaaaaaaacacagttgtaaatgtactagttcctttaccattccaaatttgtatctcatctacacttattgtacttattccatttgatctgcttatcaaattccacctttattgcttgttccttgttcgaaattgtagattatagaaccaatattttagcacaaaaacgctgaaatgcattaaaaaagttatcaaaaaacaaacacagagaaaaaacacgtgctcgtataggaaataaatcgtcagaaacacgtggcaggagaatcgtctgttctcctctacgacacaagtaggaaggaaggaaggaagtacataacttgcttggagtaaacaaatgtgttcacgtgcattttgttgctttatccgtgttgacgtggaaacgttttactggtcttgctgatcctttaacgaaaaagcattatatgtactattaaagaacaaaaaaaaaagcattatgtattttggaaagaaaattaggattcctttgtcctctttgaacgagttaacttttttttatcatataatagaaaataaatccaaagattatatttccacgaactttcataattttttccaaatgttttattgaaatattaaccattatttaacaatttgaagcaaattttaaaatgatgaaaggagtagagatgaaccagtccgaaaataagttctcttgtcttgcaaaagttgtttagacagagaaagtttcgcttgtcttgtcttaaaccaatgtaccaaactcatccatccaattagtaataggcacgtcagcattagcccgcggaaaccagaccatgtgagtcacacgtgatgtttttaattccttttatcgatagcctcaaacgcggatttgctgcgtttgctgaccaagtcgctctttgtttggccatttttaattgtgttttcttggagggtttctttctttgctgtctttgattcttttttaatgttctctacgtttccttagccttatttagaagacatacaatgcgtatgatacgcctctacgtacacatttacatacatctatatataaaccaacaaattatcgcctcctttttagtcacacatttatatcaacacctaaaagaaacaaaaaaacagaggaaaaaccccaaaaaaaaaaacagagaaagaaaccctaaaaaaaacagaggaataacttttgaaatctatg

SEQ ID NO: 13251 - DNA, 3000 bp, Unknown
  misc_feature (1)..( 3000): cDNA_ID_2713294_gDNA_ID_2214608_Annot_ID_135705 3000 nt of promoter + ATG
tgtttttttttttggggtttttcctctgtttttttgtttcttttaggtgttgatataaatgtgtgactaaaaaggaggcgataatttgttggtttatatatagatgtatgtaaatgtgtacgtagaggcgtatcatacgcattgtatgtcttctaaataaggctaaggaaacgtagagaacattaaaaaagaatcaaagacagcaaagaaagaaaccctccaagaaaacacaattaaaaatggccaaacaaagagcgacttggtcagcaaacgcagcaaatccgcgtttgaggctatcgataaaaggaattaaaaacatcacgtgtgactcacatggtctggtttccgcgggctaatgctgacgtgcctattactaattggatggatgagtttggtacattggtttaagacaagacaagcgaaactttctctgtctaaacaacttttgcaagacaagagaacttattttcggactggttcatctctactcctttcatcattttaaaatttgcttcaaattgttaaataatggttaatatttcaataaaacatttggaaaaaattatgaaagttcgtggaaatataatctttggatttattttctattatatgataaaaaaaagttaactcgttcaaagaggacaaaggaatcctaattttctttccaaaatacataatgcttttttttttgttctttaatagtacatataatgctttttcgttaaaggatcagcaagaccagtaaaacgtttccacgtcaacacggataaagcaacaaaatgcacgtgaacacatttgtttactccaagcaagttatgtacttccttccttccttcctacttgtgtcgtagaggagaacagacgattctcctgccacgtgtttctgacgatttatttcctatacgagcacgtgttttttctctgtgtttgttttttgataacttttttaatgcatttcagcgtttttgtgctaaaatattggttctataatctacaatttcgaacaaggaacaagcaataaaggtggaatttgataagcagatcaaatggaataagtacaataagtgtagatgagatacaaatttggaatggtaaaggaactagtacatttacaactgtgttttttttggatgacaaaggaccacaacgcagtcgtactatagctaaaagcgtaaaagtagtacgcaaacatactttagctaaaatcagcacgcaaatatatgtttgagagattctaaataaaggaggggaaaacgttttttttctttcatatccaaaccatgaaaaaccattaagtgaagtacttgtataaataaaaggtgaaatcgtataaattttcaaatttcatatctgaattaataaaaggtgacttaatgcatacattgactgccactaatatataagtcaatctgttaagatggatgtcatggcaccttccggacgccgttgaattatcaatatttgccctcacacatatttttatcattccaccaaatttaacttcctaattatatttggtattttaaattcatgttttaaatccacatttaatgagacaagaagcgcttaatatatagggtatgttacctgttgaaatagaatacattcatagtattagagatgggtaaaacaacaaataaaacagaataaaattgaaagtcattaatccaaacaaaaaaaaaactattttcatccattgttgtagaaatgtctataccaaaccaaaactggatcggaactttgtctatcaaactggtttgatctagattttagaacttagttttctaaacggtaattctcttgaggaatttatcgccttcttcaatatacggtaaaatattcatctgataaaaaaaaaaaaagaattgtgttttttggaaaaaacttctaatttttaatatttaatgatgctgtccctaacttttttttggtctaatgttaaatttataccaatgaaaaaaggtttacataatgcaatgttaacccaaaaacacaccaagctctgaaacagagagagcaaaagagcacttatacaaaaagaaaagagctaacggcacacctacaagggggcttattgattcaattaacatgtcaggtgacatggcatccaactcagcggagcctgggaaaaccatgttagaattcgaaccctggagatcaatgttactcgaaccaagattacagaaacttttctctcttttaccactagctagaccaatgcgacttggtttaggtataatttgaatatgtttggaattgagatgattatgaaattgtagcgattggaattcataagttgctttttcttcaatcataaacactatagatcaagtggtattggattcactattcaacttaagttaatcaacaagtgacgagacttcatctatgtaaaacaaagaaattgcacatgagctggtaaaatttattattttgttcgacttgtttttcttccaccaatgcacctgtgttcatactgcattttaaagcttacattgaggtgtttggacatcaatcatacaatccagtattgtagactttgaaccctttttttttgcccaatccaatgaaagggaagatgttcatgggtcaaaattcatctgactattgaggtagccacatggctacaaaagtagtatccttcacatgacttaaacttaacatacttcgtggtagaagtatatgcatcttaagccacacatatattatccgatattcaaagaccttcttttgtcttttcatacaatttcaaagtaaacgatagtggtcactcaacttaactcatgtcacatgacttttaaatgtgtacattaacagagactttgactcttttttgttttctttattaatatacaatcatttctagttgaatacttataaccgttgaggtctttgcattgaactcacactcaaactgattaggagttttatttcatttgctttttaatgttacttgcaatggaagggaagcttttcttgtgccaatacttgatatgggtg

SEQ ID NO: 13252 - DNA, 3000 bp, Unknown
  misc_feature (1)..( 3000): cDNA_ID_2702449_gDNA_ID_2214608_Annot_ID_187289 3000 nt of promoter + ATG
cgaaagacaagattttgacaggtatttgtacaagtactgagtcggtcaacaaaccccgtctggactctggacccgaagtaacccaacaaacgttgcgacaactacattagcaccaccaccaaggcaccaataatgcaacgtaagagggacgcagcaaaactgtcgcgatgtgagattcacgcgctctaatttaaacgttgactctttgtttcatcgttactctctcccatttatttacttcgcatactctcttcgttacaagtttccatttaattactcttaagtctctaactaatagctttagggattcgtcattaatttaaggcaacgtaaacttaaagagtttcgactaaaagccgtttcaggaaacatacatcatcacatactttatctaaataactggcttattaattttataacaaaaatgacgttatttagtgttaagatatacaaatatttaatttttactaaattagttaaggtaaaattgtgttcctttctgtgagttttccgcaatattaaaaaaccctagagaaattaacaaaacgtaattgactaaaaaaagagttcaaaacaaaacatttgttacatttatttcataatttaaagactaagtataaatccactagaaaacagatgattaaaaatgcgggtcccacaatacgccaatcgtcaaataatcgcgcaccttttcgccacgtagcataacaaagtcacgtaagcccttcctctacattacaagaccaaactcaaagtctctttctcccccaaacccaaaaacattgacccaaagagagagagacttctatcgtgcgcacctctctctcttaatcctttatcctgcgcaccaccaccaccatcttcttctccggcgaaaacaaacccaccgccatggggaaaggtcgtgcactttccgacggagtgatcaaaaagatcatcctttcatacacctatgtcgcaatctggatcttcctcagcttcacagtcatcgtctacaacaaatacatcctcgacaagaagatgtataattggccattcccaataactctcaccatgatccacatgggtttttgctcttccttagctgtgattctcatcaaagtcttcaaagtcgtcgagcctgtttcaatgtcacgcgagacttatctcagatccgtcgtaccaatcggcgcgttgtactcactttctctctggttatcaaactctgcttacatctacctctctgtttccttcattcaaatgctcaaagccctaatgcctgtagcagtttactcaatcggggttttgttgaagaaagagactttcaaatctcagactatgactaacatgctttcgatctcgtttggtgttgctattgctgcttatggtgaagctaagtttgatggttggggtgtttttcttcagcttggtgctgttgcttttgaagccactaggttggttttgattcagatcttgcttacttctaaaggaatcaatctaaatccaatcacttctctctattacgttgctccttgttgtttggttttcctctctgttccttggatctttgtggagtttccagttcttagagatacttcgagtttccatttcgatttcgtgatctttggaaccaattctgtttgtgcgtttgctttgaatcttgctgtgttcttgctcgttgggaaaacctctgctttgactatgaatgtggctggtgtggttaaggattggctcttgattgcattctcgtggtcggtgattaaggacacggtcacacctatcaatctgtttggttatggacttgcctttttgggtgttggatattacaatcactgcaagttacaggcgttgaaggctaaagatgcacagaagaaggttcaggcaagtgatgacgaagctgggaagcttttggaagagagggaaagtgaagctaaacgcaacgaaacccaagattgatctgttctgattcaagaatgcaatttcaggaaataagagcttcaaggttagaatgatttgggaagatggattttgcattttcataggtatgattatcattgtcggtgttcgttcgtctacgttttagttttgcgattatatttttaagttatggctgattatattacatagtgatggatgggtgtttaattagaggttcatgaatcttttgaactccattgtatcttcttcttttgagttgtattttgtttcttacttcctcatgaatctatctttgtgggtaacaattgttttagtagtacttctttatattttttccctccattgagattgttaaatgtcaaattgaaagtcccttttacgtctctctttatccaatgaaaccgttgtatgttggaaggcacaagaagatggtcaacaccaaaaactttttgatattttatgggttatgtaggatcatttagtagcaagatccacaatttaaggaaataaacaaaatacccataccgacgttcccttgcaataatatgacacatgacaccatcatatgaatacaatggtctcatttaacctctacaaatatccttcctttagtctcaacaagtttctgtcctgagtaaagggacaggccaaataggtgttagataccaaactaaaaacattcaaacaggctcacgggttatggatttctcatcagcgaatatttgggaacttttaacacaattcggatctactctcgcttggcataaaagctgttttgttccagaacagaattcataagcatgcattggtgcttggtttgtcactttgtgaaatgtgactttgaatagccatcctacctcttggcagaattgtttttggatttgggttatatcctatcaaattccaaaacttaacaaaccagttttgtttgatttcaactggaatcttataactagctcatagttcctacatatcttttttttgtttgaatctactacatatcaggcagtagtattctagactcggacgaaactttattagtccaaattaggctgcaccaaacgaaatgcagatacatcatac

SEQ ID NO: 13253 - DNA, 3000 bp, Unknown
  misc_feature (1)..( 3000): cDNA_ID_2991239_gDNA_ID_2214608_Annot_ID_187287 3000 nt of promoter + ATG
atctttttttttttgcaacatcacaaccatccattaattattttagttacttaataagaacttctcatctgaatgcatatattattggagaatgaaagaaaccaacgtaaatattttcattaattaatagtatgtaagtatatgtatgtaaaaaatgtgtagaaaaaaggaaaaaagcaagcaagtgtaaggcatcgaccacccgaccacccttataatctagtgtaaggttgccaattgagctaaaagagtaacaataaccaatagttactaaatagttgttcataatcagtgtggggcacgtgccccaccctcttatacactagatccgcccctgaacctaacagtcactgacttagaagtacgaagcttacatgtacacttgtgaatggagactttccgatctcattgcataaatgacagtgatgttctggttttataataaatcaagtattcaaccgaatagacaagaggaaatacaacaatgccattatctctaacatttctcgtcaaaaaacttgtcacccggggttgttttccggaagaccatttaactcttaagtcttaagtggtcgcgcaaaagagacggtacaaaaagaaatgtaacaatagagcattgtatatgacatatttagagtaatttaagtgtttgtatgtatatgttctctacaatgttagagaaatattctcagatctaatgcaaccctagcatcattatcatcaacttcatgacatgcaactttttctttaaaaaatgtagtcgtccacggtttctcaagacattgtacactttaacaaatcattttttgcagagtggtcatgtaccttttgagaaaatgtacttgagctacaagcctacaacacatcgttaatgaatttttcagtgagttctttagaaagtcccatgactgtatcaacacctcccaccacggaatcaataaaaggtgaaataaggggatgctcaagcatcaaacctccagcaaccttgaaagttattgcatcatcaataagatcatcgatgacatgttctggtatctcatggaaataaacctctgctttgtcccatcctattcttccaactccagttttcaagtttctcacaaaaacagattgcacaacgccaccgtgtgaccccgaatagcctttgataaactcgcgagcttcttctttactagttggttattctctaataacacctttgtacacaacaacagtatctgcagtaatcaatagagttggttgagaatcttgtgtaaactggttttcacctcctaatttcaatataatctcatttgcttttgcttcagcaatagtcacaaccaaatcttcaggcttctctttcctaatagctttctcatcaatatctgcagttacaatagtgaaatcatatcccatttcagccagaatctgctttctcgccatcgactgagaacctagaatcagcttatatccgttctccatcgccttctttgccattctcgtgttgtactgtaagcggaaagagtaaagaagaaaaatcaacaaacaaaaagaagattgaacaaagaatgttgccatcttgtaacttcaaaattttgtatagcgtacattatccaacaacaagatgtcacatactataattatattgtcatcataatatagaatgctaattaatcaatagagaacaatagattactcttatctgtcagcagaacaatatcatttctaataaccattaactgtctgtaattaatggtattctgtttctcctattagctattacaccaaacctggcacacagtggacaagtcctctccatggtagtctaagagaaagattataaaccttgaggccataaacaaagaaagtagaaaattttccatgggctatcagataaattactagcaaaagcttccactaaaaccatcacacttggctaaaagctaaaatgttaacgtttgacacatctacagattttgataagtgtagtcctaaattgttcgttgatttcatacgtataaacacaatagaagaaacacgtttcttccagaagaagtaagaaaactctaaatatgcaaactacacaaggaacagaacaatcagaaaagcaaaaacaaaatgcatttacagtgaagaaattaatatgtgaagattccattagacgcgtcaatggacaaacagttcatgatgctaattgtacatatatatgatatatcaatgatccaataaaaactgctgaggcaaaactctaggaacagagaattagggttttgagattcagcagattcaaactcaccaaaagagattccttaattataggtaaacatacgattttcgaatgtagaagaagattgatacgagggaatgaagctggaacgagagctggagagaaaacaacagatggctgtaattttgcctcctcaagtttcctggtgttcggcctcgtttgccgattagtttggtttggcccatttctttatttcggttatcatctgtatttgggccttagcctttgtttttgtattcattaaaaatcaaaacgaataataagtctaatattaaaaaaggttattattattttagatatcataataatttaatacataatcacaaacaaatattattttataatataacacgtaaatacaaaaatttgttaaaaatgagttctctgcaatatcgggttcttaacccagtataattagtaatacaaatatgaaaataaggaatataaaatgatcttttaaaatcatatggcgaattggctattgaagacttttcaccaaataatacaacaaaaacttcgagactcataaaataagtgatccaactaagtcgtcgatgactataagcttttaagtctctcgctagactgtccacagatttcttcatcttctttgtctcttagcctttctatattatccaccatatctttaaatttcttttataatttgctgtatagcctatataaatgcataaccatgagtgacactaataagcaaaataagagggaatattaag

SEQ ID NO: 13254 - DNA, 3000 bp, Unknown
  misc_feature (1)..( 3000): cDNA_ID_2702457_gDNA_ID_2214608_Annot_ID_187285 3000 nt of promoter + ATG
agagcaccaaatctcaacactagtctttctgaaactttttacaaattttttatgaaaaaattacactaagagaggaaataaaataataaacttataatttccacacataaaatgctaatgtcttgggtcgtaacatgagactcttatgccttttcacgtgattatgatcagttcatcccaattggtcaatatactagaggaatcagctagaaaaacgttgtactagtcaataccttcagttcatcccaattagctaaaacagaacacaagaaaggtcttgctaaagagccaagtcccaaacgacacgaattcgacttggtctttgtcaatatctcaagtccaaaatataatactccttacgcgttgatccggtataatctaattatgaccaaaacaaaacaaatactccgtatttgtgattagattagcaaataaaatatttctcgttaactttctctgtttttttttttgttttttttgggtaaggactttctctgattatattagttaactatttccacaaattgtgtattaaacatacaatttacataattgtggcatgtttttgcggaaccggcccactaactccataatcaactggatcattaattatttagtttatcgtaattttgtcatagcttcatggtggcactaactcaatatgcatgaacctcgtctagactcttacagtaggttatagttagtttaaagttgtcgctgctttttgatcaagaattctaaaattagttgagcactgtatagtttattaatttgtttctcactttcactattctttcctttaaaacaaaacctactgaataatattttgaacccatccaatgttcaatgactgaaggacatatacatggtaaacgttggtacggagatctataacaattttcgtgacaaaataattaaacatgtaacaaaaatatcaatagacgcatgcagtcagaaagagagaagatcattttctcctctagggactaggggtgtttaatctgatcggaaccgaaatattcaatccaaaaatcgcatcatttcgaaaatagagtttaaatgaatccatgttttctatatccgataaatgaatctgaatacaaaaatcgcgccaaaaaaaaaataaaaaaaaatcttgatctaaaatcgacatattttaaaaaagtatagatacttttgactaaaacaagattccaaactgaaattgtaccaaattttggtttgtttcaacgatggtctctatcttgaaattaatttgaattttatcataagaaaaggaagcataaaaatcgtatattactaaaagcctaaacgattttaatgtgactttttaacaataaaataatgagctagttgatattgagacatgaagaattgcaataataagaacatgggctgtgtaagcaatgaaaaggatatataatgcttccacgaccacttgggtgtcttttgttcactttctcttttaataacatgtttataatgggcaatgggtcctctccacagatacattcagattccaattttaatcatttacgatttgaccatcttttttacaggtagaaggttgaatatggaatcatgatatgtaccaaggaaccttctaagtcctgatgctggtgtaggagattattgtattggtgattcaatcgtagaagaatttgtatgttcatcaaatctgattttttctatctcaattttgatttcccacatgggggattttgaagatatcgaaataagatgaagaaaataatacaaaatttgtcatcagtcggtaataagttgattatcgtgttaccatttgtgttggaacgactgttctcgtatattaatgtgcacgagactatagaaacatcagtatgttgggtatttggggattagatttcaagtaagttatggttttgtaaaatggagttgttgccttaacgcatctctaaactatcagtaaaactttataaaaagtctcggttataatttttgttgcgtttacttttgtaaattttttcatatcggattatcattatcatttttccctttttcttttgatatccatgagatttggattaatcggaaacaaaagagagttggagtagtttaggatccaactagtttagcatgattatggttttttcttgcgttacattttactttccgccaacacctctttaacacacttaaggagattgtggtcgacccggtgcaagaaggacggacaaagtggcacagagtcactcactttttgcgtttgcatatttttgtgggccggggaaacaacttgaccacattcataagatagatgttgttggaagtctcatttatgtgaagtatagaactaggcatgatcttgcgtacccaattgggatcattagtacgtttatgagtacttacaagttacaacacacatgatttcagctcaaaactcccaagaaaaaaaacacacaacataaacgatgctgacgtcggccacaaacgtagcaaaaagagtaaggttgttccaggaaccaaacaaaaacaatttaatactataactaaactcggtaaccaaacacctcataacttgccttaacgcgctctcaaaggtgaaaaaaaactggtctatcttaagcaacttctttcttttgtgtgttgtgggaataaaataaacgaaattaaatacgaaccccaattctcagctcagatacattgcatgtgaaatttcaactaagtatataataactcatatcttgacctcttactgaccgatcatttcgttttcctgttttttttctccttcctctcctctctctctctctggtttttttttgccctatccatagggttttcttcgctctctatctcctcgatcttcatgtgcatctctctctttggtataatcggagctaattcgttcgttttcttcttcatcttcgtcggatctctcttttttgctctttcccacgggttttcgcttgagaaatcaagcgttttcgtttttcctgggagttttgagctcaaatcatg

SEQ ID NO: 13255 - DNA, 3000 bp, Unknown; identical to SEQ ID NO: 13249
  misc_feature (1)..( 3000): cDNA_ID_4262177_gDNA_ID_2214608_Annot_ID_187281 3000 nt of promoter + ATG

SEQ ID NO: 13256 - DNA, 3000 bp, Unknown; identical to SEQ ID NO: 13248
  misc_feature (1)..( 3000): cDNA_ID_2713302_gDNA_ID_2214608_Annot_ID_187280 3000 nt of promoter + ATG

SEQ ID NO: 13257 - DNA, 3000 bp, Unknown; identical to SEQ ID NO: 13247
  misc_feature (1)..( 3000): cDNA_ID_3028771_gDNA_ID_2214608_Annot_ID_187277 3000 nt of promoter + ATG

SEQ ID NO: 13258 - DNA, 3000 bp, Unknown
  misc_feature (1)..( 3000): cDNA_ID_2713290_gDNA_ID_2214608_Annot_ID_135706 3000 nt of promoter + ATG
tcacaggttgtgtttcaataatgttcctgaagctctctcacaacaaatttagcggccgttttcttccaagagaaacaaacttcccttcacttgacgtgttgagaatggataacaacttgtttacggggaacatcggaggtggtttgagtaactccactatgttgcggattctagacatgtccaacaatgggctctctggtgctattccaagatggttatttgagtttccttatttggattacgtattgatatccaacaatttcttagaaggtacgatacctccttctttgttgggaatgccttttctttcgtttctagacctttctggaaaccaattttctggagccttaccgtcacatgttgatagcgagctcgggatatatatgttcctacacaacaacaacttcacagggccaattccagacacattgttgaaaagtgtccagatacttgatctgcggaacaataaactctctgggagtatcccgcagtttgacgatacacagagcataaacattcttttgttgaagggaaacaatttaacagggtctattccacgggagctttgtgatttgagcaacgtcagacttctagatctttcagacaacaagctcaatggtgtcataccttcatgcctctctaatttgtcatttggacgcttacaagaggacgcaatggctctcaatattccgccctctttcttgcaaacaagccttgagatggaattatacaaatcaacttttttggtagataagattgaagtggaccgctctacttatcaagaaactgaaatcaaatttgccgcaaagcaaaggtatgattcttatagtggaagatctgagttcagcgaaggaattcttcgtcttatgtatgggatggatttgtcaaacaatgaattaagtggtgttatcccgacagagcttggagatctcttgaaactacgaaccttgaatctatctcacaattccttgttgggatctataccatccagcttctccaaactgatagatgttgagagccttgatctttctcataacatgttgcagggaagcattcctcagctactcagcagccttacctctcttgctgtgttcgacgtgtcttccaacaatttatcaggaatcattccccaaggaaggcagtttaacacctttgaagaggagagctacttaggaaatcctctgctttgtggaccaccgaccagtagaagttgtgagactaataagagtccagaggaagcagataatggacaagaagaagaagacgataaagctgctattgatatgatggttttctattttagtactgcttcaatttatgtgaccgcattgataggcgttcttgtacttatgtgctttgattgtccttggcgtcgagcatggctccgcattgtggatgctttcatcgcctcagctaaacatgtgttgccttagatctgttgagcttagttcttggatatttcagtgaaattttgtttatgtatggtttgagtgtttttgtagtgtaatttacgatgccttttcacttatgaatagttgtgtctctttatctcaattttttgttaaaatatttaaggttttttttgtctttttattgaatcttttttttattgaaatatttacggattttttaaaaggttttgtcctcttattacatgtcttttgcacttttgaacggttgtgtctttttaatgcaattttttgttgatatatttataaattctttcgaatgtatctttctatcgtatctttttgttgaaatgtttacgattattttttacaatcgtatattttcagtttacgtttgtgtctttatagttgtatctaatcatttaaagttatgtctcttcattatattttattgcatttactcgtcacaatttctcgtatgagtagttgtctatctaaatgtttgtgacttttgaactttatatatttgtcactttctaagtgaatcccaaatttttgttcttttacacaaatttgttttattataaatccaaactaattaatctgtaaagtagctccaagttctttactctctaaactatttttaaacatacattatttcaatattaaagaaattcctctaatttttgatctaaaaaaaataaaaaattggcatcttcgttagaatttttatacttttttaaagttgattaaaaattcttcatttctatgatcattccaaaatttgatttagaatatataatttttaatgaactttaaattttagattgcaatgtattttgatttattgttaaaaaaaactttttaaaaaaaaattatcttagtttatgacttttcgtttcatatttgtttattacaaacttttttgaaataattttctccgcgatgtcgccggggtctgcgtcctagttattagtacaatggaatcaaactaatgtaaaactgtgaacttgacggaaaaaaaaaaaaaatactgtgaacagcaaagggaaaaaaaaaaaagaaaaaaaatgtcagaacaaatccttctcctccattgagacagtgtacttctgcttcaatggacatttgatatcatcaaatcctgcgtcaggtgagaaagacgcttcgccgttgtcagagttccttttctttattctctgtagaaactagaggcaaaaaatgtcggaagttttcatgaatctgagtaacttgtatctgcttctgtttacatgtttctttggtccgtagatcgaagtagaactgtcacttacagtttaagactagtaagctcattactaaacaactgtattaacaagatttaggcttctttttttattagaatgtttagatttgcttctaattcagatgtaattttagtttattcaatctcaagaaccagacgatgagttatttacatgaaagataggcttaattaggttgtttctattggcctaagtgaaatgtgtgcctcctatgttgggtgttttaactaatgctgattgatatgtcatatgttgactgattatgttactgtgtttgtagtttacga

SEQ ID NO: 13259 - DNA, 3000 bp, Unknown; identical to SEQ ID NO: 13254
  misc_feature (1)..( 3000): cDNA_ID_2702457_gDNA_ID_2214608_Annot_ID_135707 3000 nt of promoter + ATG

SEQ ID NO: 13260 - DNA, 3000 bp, Unknown; identical to SEQ ID NO: 13253
  misc_feature (1)..( 3000): cDNA_ID_2991239_gDNA_ID_2214608_Annot_ID_135709 3000 nt of promoter + ATG

SEQ ID NO: 13261 - DNA, 3000 bp, Unknown; identical to SEQ ID NO: 13252
  misc_feature (1)..( 3000): cDNA_ID_2702449_gDNA_ID_2214608_Annot_ID_135711 3000 nt of promoter + ATG

SEQ ID NO: 13262 - DNA, 3000 bp, Unknown
  misc_feature (1)..( 3000): cDNA_ID_2702441_gDNA_ID_2214608_Annot_ID_135713 3000 nt of promoter + ATG
cttccataagccaaggttggccaaaaaaccaacaaaacaaacagagatatctaaattaacgttacatcaaaccctaaagtcaaaaagaaagaggaaaccaaccccatcatcggaatcgtctctgttccgaacaaactcatatctccggtaagatcccgcaaccatgccggcgttttgctgcaacgcttaagcgcttaaaacgtcttcgtaatgcacactccaaaagaaagatctaacacataaccctaaaaattcgccatcgattcaaatgcggaatttagagagctctttaactacattaagtctacaacaatctatatctactctgtcacagtctcactttgttctcttctcgtaagtgtccattttattgtttacgtttccatatattttcttttcttgcgaattaaatgttcacacgtggaagtcgtcgaccgttctaagtctctgtcagtggccataacgtttgccaccattaccttaaaatcacacaaactcataatttaacaaaacatgccaataaaggaaaactatatagtaagatggaaatatataagatacacgtcacacatagttttaatttttaggttaatacatcaatatatacgagactgatggttcaccgaacgattgtggtattttttttctaaattagaaacttaggatggcttgcttggctgcatctaagatagaatcagtctttaataaataactaagttagtatccatggtttgcacggattaattttttaatttgtctatcaatttcgcttattgatataatactaatttgactaatattgtgtttgtctgtaaatgttaatttatataatttacgaagttaaaagtttatcaatttattattggtatcatttaaatatagtatcaaaatgagtttgtatcgattggagagacagtacaaactggtttacatctacttacctttgatcacgagaaaaaaacaatataaacatattcatagatcttcaaacactttaaaaaaaaaaacattgtgaccatttagttttttcatagttaatacctcagtggcaacaagaacttccatgatgggttgcataggatactcatcaatatcatcttcaatctttggtgcaagttgtctcctacagaacgaaagaacgaatttgttcctcctaatgttattctaacgaaaatactgcataaaaatatttaaggtgtatacaattatagatttaacaaaaataattgtagtggctttgataaaattatattctcgcaaaagcagccagtgcatccaacgttgtatcaacaatgacttggaaaacatcaaatgcatttgaatggctaatagtatttgtacgtatattttaaataaacttcactcgacaattttatatttttacaataatagaatagttgaaaagagtatagttcagttgagttacctttgtaaaaatcgattttcgcaaagcgaatcaaacaaacaacgataccatcaatagattcttggcatgcttgatcaacaatctcaataaactttacctaaagagtacatgccaaactattgtcccttgaaggttcaaaactattacaaacaccagttgttatggagaattgcctccaaacctgaaactacttaacctgaatatgccatgcattccttgtaagacttgagagatttcaagggggtgggggtggggtggggtggggggggggaatggaaaaggattagccaacaatatcattttacttcttttttttgtttcgtatgaggaagaatatgcaatattggtgaatgaattatgcatatgggaaagacgtatttataagagtagaatggctaggtcgaaaatattcttttcggattatgtcttgggaaaatattgtctaaatcacataaatatagggaaatattaagatgattgctttaaacttagtttggcaaatatggaacatgttaagaaacagtttaatgattcgagagattattgaacagaaatattgaggaatattgttaaaatatttgattacttagaattgggtagaagatttaaattcgaatgatataacacaagataattcaaaaaagattgggaatattccttttcgactaagattataaggtatgatctgttcggataaaaataaaatcaacggttaataataaagaaatcagatagccaagattagaacttaggggtttgattgctttatgattcaaaagagttttagtaacttaaaatgtcatgtaaaatctgttgttattaaatcaaaatatcttaaagtatgttaatgttttgtgtttttcatttaagatttataaaaaataatctaaaatctttataaatttgggatgattggattcatactcttataaagtcactaaaagttttgtgttattcaattaaaacaaaaaaatttctaacttttaatgatttaaattattatgttattggttcatgactttctacatttttcttcacaaaagaaagttatagaaagtcatgaaaagtattatccaaatagagagattgtttgaaaaactttacaagattatgaaaaactaatcaacaaaaatataaaaaactatctaacaatagtttaaaatatttcttttatttactttataagatttgaagaaagtcatcaaaatctcttgtaaattaaaaatcaataacactttcttaattaatacaccggttcatcattaatacacacaattattacatgaacgatggctctttctctctctgagggcgattttttgcctaactcacaccgtttcaattctcctcgccggagcagttctccgaccatcataatctgtctcttttcacggttttatgacggcggttactttctgccaatcagtttccatggcagttatcattgcccttcactttcggagggtaactacccacacaaaccgccatggatacaaacttatatatacttcaattcgctccttcttctcccttttctgcaattcaccatttctcaaacactgtcatccacaatc

SEQ ID NO: 13263 - DNA, 3000 bp, Unknown
  misc_feature (1)..( 3000): cDNA_ID_2713330_gDNA_ID_2214609_Annot_ID_135720 3000 nt of promoter + ATG
aacttgaagatgtcaaactacctcaaaagccaagattttggtgtgaaatatgcaatggttttgcaaaatatgttgttgccaagttagtctttatgaaatttttagattgaatgtattatgaattctaatttggtttttataagctaataatcctatttaaattttaggttttggttacatctccatattacggaccaaaccggtgaagctagatgcatgttattcgatagtcatgtaaaagaaattcttggcactactgcccctgaattgcttgatggtgcatttgatgaggtatattgcctttttaaaaacaaattttttcattaaaatgactatgttcatgttataataatctatagtttttttgtagatcgaagacccaactgttttgcctgatgtgatcaatggtttgaaatggaagacttttcagtttctattgtgcattcaaagggaaaacatatttagtggatatgattcattcactgttgcccaagtctacaccggtaacattgctgatgaaatcgttcaagaagactctgatgcatacgttgatccatcatccttaatttcgattgaacaggtttgtcaaataacattaaacaattccaatcatttatatttatattttagagttgtcttattaaaatgtttatgtattttcatatagggttcccttatactcactgatggtgttgatctttctgatgtgaatttatcgtcaacctctactccatcatcaaaacgaaaagattcagatgatgttgatgaaaatgatcaggcttccacaagtaggaataaatgttctaagatgaccatgtctgaggaaggctccgtcgattgatgctcaatgactactccagcttggatcgttttcttctttcttatgtctttgcttaaagttatcgaagttgttttctttttttaagttctaaactatctttattttattttattttattttttgggaattaataaagttaaattcattcatatgtcgttttgttaacaattttattacttaagttacactccctctgttccactaaattttatttattatatgttcacacaaattaagaaaacaactttcatgaaatattattattttgttatttaactataatattagtaatatttctctcttctttttattgtttaacaataacaatagtaatgatgttgatgcagaacatcaatctttttgaaacaataaaaaactcaaaacatcaaattttgtttattattacaaaacacattattttatattataatgttaatcatactaagaactataaacaattttgctaattttgtgttaaatgttcaacaaaatcagaattagcaaatattttgtacactaaataatcagtctaactaaacaaacctattcctatttttcatagattctcattttaataattacaatttgttgtaacacgttaagaattaaatgtcatcattatttttataacctataagaaattatattggttgtagacgattcgttttctttttacacatcaattatttcaacgaggagataattgatcaatcatcccttaatttgtgttccaatttgaacaataatatagtagaaaaactaaattagaatatacattatgtatgccttgccataatagatttagattataaattttttggttaacaaaatattttcatatatattgtttcctaatttttagcatgactatgtttatcatattatttcgtttcttatacatttagctttatactgaaaacaaatcaatattctttgttattttttcgtcgattacaatgaagaaaagaaaggataatgatgaaaatgatgtacatcaacaacaaaaaaatcagaaaaccaaaaaaagaccagacgtttgttcgatgaaccaactttagttctcgtcagttctgtttttggtagagtgtttagtgacattaccaatgtcgatcttaccaaaagaagtcaaactgctcatactcccgtgtccttaccgctatacccgacaaataataatgggagttactcacccattacacctattaattcgatgaactcaactcttacaggtagtattctcatatatcatcatcattacttctttcgactttatattgaatcatatatgtttgcacttcaaaggagacagagtaatttataatacaccaaacacatgagaaaatatagtcaatcgatctaatagctcagaagtttttaatccaacttttacaagagctgccgcaaaaactagaaaatcaggttagtaagttatatactatatgatatacaatattatcatataaatttaattataaaaataatattttatttctaaattattttttatatttatattttttactgctttatccaatacaaaaagtataccatcatcacttcgtaagaaaaccaatgtcaatacaaccaacaattatgatattgttaacaaaacacctattagaagattgtctcatgttaaaggaatggccagaaaaagatcaaacccatcaggttataattttttaatactagatacaatacatattagttaatattattatttttctttatttggttgttgttttctcagtaggatcacctgacttcttaactcctaatcaaactaccccaaacgtaaacacattgtttggggtagattactctagaaatgtcttatcggatataacaaatatatcgggagaatccatcgtctccaccattagattaatgtccaataagaagaaaaaagtatcaacagggcaaggttcgatttatatttgaaagtagctatttatgttattttttagtatgtttgtctaatgttcaatagtcaaacagaaattttattgtttaatatttttgtttgatgattgttaggagtcccccattcaacaaaattacaatcaaaggagaattctacaagtattgtacgtgacaacacactcaatgatgaagaaattgatcattctgaagcaatatattctgatagtggtataatg

SEQ ID NO: 13264 - DNA, 3000 bp, Unknown
  misc_feature (1)..( 3000): cDNA_ID_2713318_gDNA_ID_2214609_Annot_ID_135723 3000 nt of promoter + ATG
ttatttcgtaatatatattgccaaacattatttagttttctataataaccttattattaaaaatatctaaactcatttaacgaatttttaacaataggtgtccacattagtaaactataaagatttggaaaatctacttagataaattcaataatacttaatatacaacaaacaacatacaattaatacttaatttacacatgctaaatgtacatttaaattatgcctctggaatagattacactgtatatatatatatacataatatttagtaaaataaaaatctctaaatttttagcgaaaatatcatctcgcagtgtaccacgaatcaatttctagttctaattaaatttggaatatgtttagttcacaattatagcttagaaagtcttaataatttcacaaaagcttagcattatcaatgtttgatgtgtgttgcttatagcatgaaattgatgctcagacaattgatgtttcgattgatatatgctcaaccaaatcactttcacggactatgcaaaatcgcggcggctcgtctgtctccaccacttatttgacgcctaaccggctgccttgggcgatttttagaaccttaaaactatacatccaatcaaatttggacacgtgtccgtctctctcatattctcaaacctctattcacagagacgcctctctcattttaattcagttttgattaatttttgatccaaaatttcaagagaattaacctaccaaaaattgcattacaacctcccattggaaatgctcttagtgtctgacatgttttctcttcttttcagttttcttgtcgtttttacgatgtttcttcagatagtcctttcttatcctcggaccatgctcgttatctgagtcttgtgtcaatgaaggtggtctctcgatcggagcccaagactactttccgttccctgttcatccatcataggaccaatagagcctctgcctattatttacaagagagtcacattaaagttttttcatgtgaaggaaaatgagggtagctagcaaactcatctgctaggtaaagagtgtgaaaggacacaccgtgattggagaaaagtctcaatgtcatcatctcctaagccttcctcatcttctgaataccatctcttgtttgatgactcacacgtaacctttttctcatcaccggagctgaatctcttatctaaactccttctcatgaaactaccattctgcttcattcggctactaccgctttcctctcgtgattttccatcttcttagtcaagaaacagaacatgtaaacaatatgcttttaacaccttctttctcagctttccttctcaattctgctgcttctctaaatagaattgaacctattcgattctcagtttgaagatccatctcctaaatcgattcgttaaagttagtaaattcaagatccctaaagctttctaaccacaatcttgtggaaaagatttgatctttcgaatgtgagacgagagcaagaaccaacaatctaaaaaacagagaataacataatttcttacgaattgtggactaagagaaattcaattaccagtaaaatcgaatacttgacgaatcaaagcttcacagagtcttgcggcggacttctccggtacgcgagcacagatcaccaccaaaggactttgatatgtccatcgaataagaatcgttcaccgaagttttttagtaaaccggaccaaacccgtgcaataaattgaataaatggcaggaatgccactatctgcgaaaaagtaaccaggaatgctactcttctaattcccattttttgtcgaaccctaatttttaaaatcaaaccgtttctgctctcattcaattcaaattttccaaaatcaaattcaaaattttctcgcctttcacgattttccgacgaattcttgattagtgtaatagtttgatggctcgtgttagagacggtattgctggccctgtatatgattcgacggagaagtcgtcgtccggtgaagtttcgacatcagaaccagttacttcagaaattgagaacgagggagatgccgccgacttagttccgaccgaaccagcaggtccgacagaaccagcagcacgagatgttgcggcgaatgatactacaaagaaaccgctgaaattgaaaaggctatggaggaaccgcgtgttggtgatgaggcttctcctaaaggaaccgccgaaattgaagaggatcagacagggacaactttgaaacctctaattgacgctgtcattcaacaattcgaagaagcgaaagacgggaatggggaggagttggaggaggaggaaatggtgaatacaattccaaaagaaggggtagaaaacgttaatcgtcaggtatatacaattgaatctctatgacacatttttgttttgtttgagtattagttctcgtattagttagaaatgttcaactagttcatctgtgacacatgtttgatttaagtaatttgatggaactagttcaattggtacatataaattgttagtttggtacatatgaattcttcaattggttaatgtttattgaatttggaggatacttgtgaggccgaggatgatgaggtttctgttaaagagacagaggaagatgaggctagcaatgatggtttagaggatgatgatttagattctcagccactgccgccacagaccatgcattttcttttttcagaatacggcaaagtgtgcaagataagcagtaggtgccacgtcacgcagacagttgaattgatagagaggaagtttaaagaagaagttgtatggttcaaaagacacgatcagttcaagcatatattccacatgcctcaggagcctaaccagtagacgcaaggcatgtgggtgcttatgctgcgcacagtgaagacagatttgctcgaggaggcttggtttgtggtaaatggagtacctattaggtattccattaaagagcatgtgttgttaagtgggtttgattgccacagttacccaaaagaactgaatacaatg

SEQ ID NO: 13265 - DNA, 3000 bp, Unknown
  misc_feature (1)..( 3000): cDNA_ID_2713310_gDNA_ID_2214609_Annot_ID_135726 3000 nt of promoter + ATG
tccatatagcgcgtcgccttgtggagggcgtcctctagatacaccggtcggtttaacaacaaatcatcgcgaaagggtgactcatgctacacggcgttgcgtagtgccgagatggccgcctcatccgggacggcgatgtgagaaacgactgccttgaacctgtcaatgaaggtgcgaagcggttcctttgggccttgggccatagtccaaaggtctgcgtgtgtcgtgccgcgctcgatgtacatggagtaatgcttcaggaaggcgattgaaagttccagaaaacttcctattgaattagcaggtaggtcgaaaaaccaattcaaggccgcccttgtgagatgttcggagaataactgacacttgccgacctcagcttcgctcggatggaaatggtctctttgtgtggcgacgctgaaagacgataaaaattgttgtgggtccgtgttaccttcataactttttaacttgatcttgttatcatgccgaactgagacattactaatatgcacggcaaaaggcgtcttctggtttttttccaggatctgctctaattcgggagtggagctggttgcctgatgaactttctgggacatcgcctgaattgtacttctcagctcctaaatttcctcgttttgagatcgttcttgatatccacgtccaacggcatttagaccgctcggccttgtgttatttgctcggcgcatggcgcttgcgaatccttccgaatgttgagctgttggttgacctcggaggtccgtgtaagcgttagtgagaacgtcgaacagttcgacattctttcgatcctgagcttgaatttgcgccagaatgttacgcatcaatgctcctggatcatctggccttgctggtggagtcagagctgggcgtccttccatcccttgtactcctggctccaatcccacggtcggcgttggtgtgttgagtgtgggttcgttctccacgggattgacctcgatcgggttcgtcgcgtctttgccctgctcacctcctgttggagcgacggcggcatgctggatcctgtctggggtgtcttccacaaactccccacggtcactttcattttcacttcgcggcatccttccttctcgcagatcttccttggccttctcttcttcttttcttgtggtagacccctacctggcgcgccaattgttggtgtataaaccgaacctctaaaccaaagaaggaaatgacgagcctgaaggaagatctttattaatatcactgaagttcggccgtttacagagtatttctacaaccgagattagatttctgatctcttaacataaatacaaacttcacaagtcaaaattagacttatgtttctgaatcagaatgagaagtttctattgcttttctctgcagatttcaggtgtcctttcctgacattcctttgtcagtatttataatactgcaaggacaatctatagtacaattttcttctcgatttgggactctctcctgaccagcagctccctgaaggtgggcttcgtctggtgttgggctctttcgtctttaaacgggccgatcttctcttctttcctccctcgttgccaattacgatatgttgggctttaaccatgttgttggggcgaagcccatatccaacaacactggaggactagtcaagtggtcaaaaatgcggattacactttggttataagagaaaaataatattagtaataatatttttttcctttaagattcagtcaacgataaacagaagtaagatattctgaacagtgaacaccgaaattttgaggagtcttttgtgggtacggagacgaaaaaaaaaagagttcgttgtagtgcggttcttcaattactttgacacatatttagccttttgcaagaaaggtgatgatcattatactgacattcctctacattacggtgttaccaaggattttcaaggtatattttccgaggttaccttctagacattgtaactatcgatgctaaaataagattccttgatttatcatccgacttacagatttttttttttgaaagtttcagcatctacaagaagaattctaattaaaatcggcacaactacgcggttgctgataggtgcattccttcggtgattaaactatatttgttgacttgggtatcattatgcatgctaatcataacattaatgctatcaaaccaaactccatatacttcactagtatatatatcagggatcattgccgaaataacatagatattatatttgttatagaagattggtcatggtgagttcaatgggaagaggaagagagatcagttttaattaatgttgttgatgcaacatatatgaagtttgtttggatgttttggtgactattttgatctaatgattatttgcctcctctcatggaatcaggcctggcctgtccataaagcaagtgaagcacttcctttaggccacaaatataaaattaataatcggaaggccataattttaaaattacttgtgtgatccgctggttaagtacatcaatgttttgatagaaaaaagtcttcaataaatcaatatatttgctgcaataatttagaaagttagtttttataagaagtagaatattttatactttcttaaaaataatcaacaatttttcaatacttttctaatatttgaatacaatttttttaacccaaatatttgtattaaaggtcacatgttttaaaaatgctttaagccacctaaatcataggacaccattgcatggaatgcataaatcactatgaaagggaaatcaagaccaaatcgagcaagaagaggacttagaagaagaagaagccgtctcactagaagaagattcgatggttgatacatacgctaatggcgggagctataaaactcaagaagggcatgctcagggtcatcagactgaagattgttcaaaaagtactgatgggctcaccgattcttcaagagaagaagccagtttcgcaagatttaaggacacctactcctgcatacctatc

SEQ ID NO: 13266 - DNA, 3000 bp, Unknown
  misc_feature (1)..( 3000): cDNA_ID_3028855_gDNA_ID_2214609_Annot_ID_187307 3000 nt of promoter + ATG
gtgtatgattgataacttgttatacagttgtggtcagggcgggtgtaaatatttgtgtgagccacatgaattggataggtgtgatgcagaggggatgaattggacgggagtgagaagttttgatttgcagcgtctcaagtacaggttctatcattcgagggtggtccactttggtgggaagatgtcaagagtgtggcaaagcgctcaagatttacttctcggtgccaaattgaccaactttgcgctgaatattgtcgtcttctggaatgttctcgtcggtggtcgtggtcaccaaaccttgcagatttggtgttataagatttccttgtgcaagagagtcgacaacatttggggcgcaaacaacatttggggcacagttgagtgctccaatgttgtcttcactttctattctctcttgagtatcgctaaggtcttgtattatatatctgttgatgtttgaaaactacttggattttcttatgctttctagctaggttgtaacattaataaaattaagctgttccgcttcactattttaacactcaaatgaattttttgctcctagtaatatgtattagattcaaatgaaaatatttgtataatatagcaacatgtcattcttaatatcactttccatacagaaaattttagaataagaaataaagtttggtgtaatgttatgtcaggattatatatgatcaagcattcagttcccactttccattctagaaagtacaaataattgtcatatgttcatttggagtaatgagaaactaaaaggtatatgtttgccaaagtgagagatgtttcctgatgcatatataccttgaatttgtttgtacagaagagacaacacgacagatggaggtctataaaactctaatggttgattgatctaaaaacatatcaaatacttgccttaagtgtagcggttgaagggagagagatgtaccacgatgaattttcatgaccagcctgtcgactctactacctttctgttataacagtagttggtttcggagttaaaagcagagctttctttcataggataggtaagtttagtattgtttgtgcagtctacttggtgtagatagatgtttgtagcaaaatgtggtagaagcaactgtgatatagtatgtctttgctttactcttgagcttgggtccttaccttatgattcttgatgcataacttagtgctcaaccgcttattttaagaaaaaattaacttgtttgtaattgagtaatgtttgtacaaaaaaatttagaacaagaaataaagcttggtgtaatgtttgtcaggaacaacagtactaggagtactctcgagccgcatagcaacaaaattcactagtaaatttggagatctgattgatgtgagtagtttaattactgaagatatttggttttgccttttatcatagagagttgtttgttcattacatcataaagcattgtacacttaatcagtttaagcattccgatgacatttagtggttttcaccaatgaaatagcatttaagatatcttgatattttctttgcaaagcctttgataggctatcagtgagtcccataacaagcaacatcaactgcagataaataacaaaatcaaatgtgtaaaaatacttgagaataccatatgcttgtctttcggtggtgtcgtctacttagactttgacttgtttcttgtacgtaatggcatcaactgaaatcacaaatcaaaacagacatgatctgtacaaaagaaagtttttcaagttctgtagcagaataagaaactataccatcatgtagattactaggtaactaatgaaattattgatgcgatagaacttatattaaccggtgtctaatttgatttctcgcggtgaacggtttagctacagtttgggttttagttttgttttagcaaagtttgtttggttttgatttcattagttttgattttattttggttttaaaataaaaaacaaaatatgaaataatgaattaatatgattatatttgttttagtacatgtatctaattaaactataatttttagtgatttgttaaacaaaaaatcaaacacatactacagtagaaactctacaaattaatactcgataatttaataaatacgataaattaataaattttgtcggtcccaagtcgggccaatataaaaattaaccaaaatcggtaagataataagataatattttttttaattgaatatacaaacaacaaaatatgaagaaaattaaattaagaaacattttaaaaaaaaattagtattgtgttttacgtaagtataaattaatatttattaatttatagaataaattaataaatattattatatattattataaattaataaaatttcataatcttatattattaatttataaagtttcgtagttgtttagactggacacagaaatagaaattgggcaattaatgggccgtaatagagccttttgagaatgattaagcggcacacgcacagttttgagttttgtaaaaatcacaaaatcttcttcttcgtctcaaaaacctcccgaccaaacattttcgttcgctgcaaactcatggctgtaagtttttaatcttccttcgctaatccacgatttcgattccgttatttctttttggaacccagttttagaatttacttctagggcttgcaaaagctctgaagttcgagctcttctcttgttaatttgtccaattagaactaattaatggagtgttcacgaatcagaactgatgggtttggttttaggtttcgaaaaaatttgcttttttcattattatatgtatgaatgaagcttggtttgtaattgaacgtctatagttgatttttaggttactactgttttagatgtaattaaagagtatattaatactaagtagtttcattcaattattcagtggaaacaagagcaatgatccatttttgtttattgttttgaagaccataccagtaaacccgaaaccagcttaaatggggaatg

SEQ ID NO: 13267 - DNA, 3000 bp, Unknown
  misc_feature (1)..( 3000): cDNA_ID_3028872_gDNA_ID_2214609_Annot_ID_187300 3000 nt of promoter + ATG
ccgtatctaatatccaagaggatgttaaagacttacccgagagtttttctgtgctcgtgcttgcaccaccattgagtaagaccttcaaacgacgccactccacatcactaaagccactcacaccatcacggtctgcatcagtgataacataattcgcttgttctgtttgtggttgttgagaaacatgaacagcattgacgttgatatgacgccctcgaccaacagaagcagctccgggtgtgacgcctttgcctcttccattaacaacacggctacgtggtctctcaccccaccattcaggatacccgacgactgcaaagcagttgttggaggcatgaccggagcgattacaatgtttacaaaccacagctctctcgaaagcatcaattcgatcggagatgggacgtgacttggtttgaaccgcatgagccacaacttgagaggaatcttcatagtgatgcaccgtagttttgagatcttcctcttgacgaacaacattgtaaacctcctccagagactggataggcacacgggaaaccagagaagatcgaacagttcgaaaactgtagtcaagaccagacagaaactcatgaactttgtcactttcacggtcctgttcttggagaaatccaagatcgcagtcacactttccacatttgcagacacgcacgggacgataatgagccatgttgtcccaaatctggttcagttttcagtagtacgcctcaatggcgagaccacgttgcttgcaacacgccaactccgccttcagttgctgaatacgcggaccattcgtcacagaaaatctcttcttcaagttgtcccacaaatctttggcaacatcacgatgggaaatactcgaacggagagatgaatcgatggacatcttgatccaggacacaagtaaggcctgaatcgtccaccaatcgtcaagatctgcagacccttctgctggcctagcaatcgagccatcaagaaaaccaaatttcttgcgagagcagagagctgttttcatgccgcaagaccattcatcgtagttggatcccttgaataagggatgagagatcacggcacctggattgtcggctgcggtaaggtcgtaaggtgagatggtgcgtcgtgtctccatcgggttaggggtcgtggtcgtttcggtcgcatcagagtttgctggggtggccatcgtttcaaagcaaacatgtttaagacaatagaaaaaaaaattgtcagggctctgataccatgaacaaatagagatcgatgtatgagaaaaagtttcttgtccttattcacagtagcctttacattgttatataggtaagagacgatatctactttcctaaagagatacaaatcagaatcaattcacaataaatgtgattgatattggagcgtatcacattgatacgttaagatacgctattacgctattacaaagtcctaaaaaaaatggattaccgagttacggtcgcatggaaattttaaactaagggtatcagctggtttagaaagtactttatatttggtaagggtttcttatacaagcatttgagttgtgtgccctgaaaatatttgcctctacgtatttctcggtttggccacttggagaaagataatcaaatgctcgtattgactgaatggaagtactagtgtggctgttactagtgtggtttgttgaaaaacaagtctttctttcacgggaaatcgttcagttactttacaagttatcattgcttttattaatggtttatggaaactacaatatcctgtttaggttggttggtatctttcgaaagttaacaatgagacatcactagagagagcttttaaccttcgtcggagtctttctccactatatactgaagtggaagtactagtctgggcagtgccggtcctgacctaaagctgaacaagtaaaggttttaggcgccaaaatatatataacattttgagggcatcaaaacaataagatattttgtagtatagtggctgttccttgtttttttgtttatcatgtcttggatttacgtctcccaagcatcattttgctatattttcaatatttgtctgcaaaaaaaaatagtttgggctttaggcagtccatagtgttggaccgatcctgagtatgagtgatgagatacatgatcgatgaacataaaattgaaattactttcgtcacgaactgccatgatctagtaatattagatttcttcaacacaaaccctttcaaatggcaatttgttttcttacaaatttatcctcaatttacaaaaatatgcaggtcaaacccataaaattcaatttaatctacaatataatccgtcactaccacccccaaatttatcaaagtactcccacatgaggaacgtgagagtgttctacattaacattctattttttggttgaatcatttgtgcttatctatatatttttgaatcatttactttgaaaaaataaagattttgttttatatatctatatagatgatgagataatacaattttttgaaaatagagaaaattaaataaagatgagagggctaattaatattattgaaaattgttttgttctattgaaaaagaataaaaacatccaacacagtaaatacatttttatgatactttacaaaatcaaataagctatttgtgtaaactttgaaaaaaaatacgtgaataaataacttttttttttcttctcactgataaaaagatttcaaagacggtggcgcacataggtattgcgtgtgcaacgcttacctcacatagttttgacacaagctagacttgttaaaccacatgccatcattttcatttctttttatatttcctgcctaatcaatctagcggctcccacagaaaattactctcctccataccaatctttctttattttttgcatctctatctgtcacacaccaattcttattttatgtatatatattgacgcatacatctccaaattaatcaatagcttatctagttcttgactgttcaacgatca

SEQ ID NO: 13268 - DNA, 3000 bp, Unknown
  misc_feature (1)..( 3000): cDNA_ID_2702520_gDNA_ID_2214610_Annot_ID_135729 3000 nt of promoter + ATG
aaccaccgaagggaatgttcccgacatccaccgtgtcggcggcgtaattgacggctgtgacgtcatcttcgtacggagctgttacgagtatgaagcggagtggttaggacttacacaagaacttcaccggaaaccggttataccggtcggagttttgcctccaaaaccggacgaaaagtttgaagataccgacacgtggctgtctgttaaaaaatggttggactcacggaaaagtaagtccattgtctacgtagcttttggttcagaagctaaaccgagtcaaacggagctaaatgagatcgctctcggtttagagctttctggtttacctttcttttgggtgttaaagactcgtcgtggtccgtgggataccgaaccggtcgagcttccggaaggattcgaagagcgtacagcggatagagggatggtgtggagaggttgggttgagcaattgcgtacattgagccatgactcgatcggtttggttctgactcatcccggttggggaacgataattgaagctatccggtttgctaaaccgatggcaatgctggtttttgtgtatgaccaaggattgaatgcgagagtcattgaagagaagaaaattgggtatatgatccctcgagacgagacagaaggtttctttactaaagaaagtgttgcgaattcgctaagattggtaatggtggaagaagaaggaaaggtttatagagagaatgtgaaggagatgaaaggagtgtttggagatatggatagacaagatcgttatgtggattcattcttggaatatcttgttactaatcgttaactttgagtcttgatccaatggtcggttaattgagtgaagttgatcaagtgttgcaaggatgatcattgtataatgttatgatattttggaatggtcaagttttcttgagacaaagaaaattagcgtctcatgatattgtggtatcaaatactctatccacatgaaaaaatatagggtttattggcaaagtaacactttttcaaaaataatttgtaaagtagatagtttttttagaaattagagatataacatttttcttactttttgtgagatagagaatatgtctaatagactaaaaaacaaaatatatatcaaatactataataccctttatcttgagagagaataaaaataatatgagagaccatttatactttattttatttgtctttatttttttaatttttattttagttttcttaaaaaaatttcttaaaaaattacgttgacttttagagtatttatatgtcattaatttaatacacaaacatttcaaagatcgttttgtacactaaccattattcattggtgtatgtatataccgatattcataaatagaagtaatattgtttttaatattttacaaatataatgattgtataaaccaaatattattacttaatataatggtttacatgatggtgtacataattaagttaatcttgatggtgtacaaaatgattgaaactattatgacgattggatagaatggtgtatacaacttttgaatgatatcatacaagattggtaaacaaagtgtacaaaacttggtgtacacttacagggaatgtataaatcattatttcagttagtggtgtacgtcatctcgtacaccaattttagtacagtctcatagatctttaaagctgtacgatcatgtacaccatattttcaatcatctatgtacatcattttgtatactattatactcactctatcacttcttacgataatattatatgttgatttttacattattatcgtacactaatatttgtacaccagttttaataatatcacgtatactgtcggctgggattaaataaaaaaatgctacatatttttgaaatatagcaaaattagtctttttagattcacatacaaaatttaaaaattaatatgattatatggtaattttttatgaagaattattattaaacaaggtaaaaaaatttaagtaaaaaaaaaaaagagaaaaagtaaaatttgacttgaattttgtctttatcttactacataataaaataacaaaaggttatataagtcatttactaaaatctctattagacaaaaagttgtattagagtggaaagagaaaagtgtctatttctcctatttctaaaacaactacttactttgcaaattatttgtagaaaaagtgtctactttccaacttatctcaaaaatatattcatcctcgttaccaccatctctacattcacatttttttcttccgagaatccaactttatgtaccatgattttattttagaaagaaaaaagttgaagtattaagacatatatgtttactgcggtaaatttctaagattgagattgagactgcatcaattaaaaacgaatactgcggtaaatttctttaaacgaggaacaaaagtttatgaaaaagagagggaaaactctaactcaaattttggtaaaaggtaatttaaaactcaaattgaatttgaatgagttcaagttactagttactacatttaatgttgattatatttctattggaaaaacttaaaagttgattgtttatctcgcaatcatccttaaacaccacacttgcaaatgttacaaatgcacgtgtttggtactttacctttaatctgacaaaactttagcgtttgcgttttgaaacgctgcatcgcaatcgcccgagtgaacgtttaacaaaatcaaaattgaagattgtcaatttccttctaccattaacctttccttttataaaaaattaaaaacacactgatataaaatctcagcgaaaatcgtggtaatttcagagattcacgcgtcctaactaaaatcaaatcgtgtttttactctttttacctctttcctattacatcaaaaactaatcttttagcgtttaaaaaataaaataaaggttcttttagcgttttctcgttcccgcttacttcactgcgactacaacgaagagtcgttttcactaaaaattgtgccgcc

SEQ ID NO: 13269 - DNA, 3000 bp, Unknown
  misc_feature (1)..( 3000): cDNA_ID_2702516_gDNA_ID_2214610_Annot_ID_135730 3000 nt of promoter + ATG
tttctcgttcccgcttacttcactgcgactacaacgaagagtcgttttcactaaaaattgtgccgccatgaacaaccgccgtggagtaacaaccgccgtatcgaagcgtcgtccagtgattcacgtgttaccagacgagacagcgatacgagtagtctgccacgcgtcagtaatcggtggtataatcggttcaaacggttacgttgtttcaaaactccggcgtgaaaccggtactaaaatccattgcgagtctccagttaacggctccgaccactgggttgtgttcatcgttggttcaaccgctgttaaccaaagtattctattgactgatagagtcggagaattctccggcggtgagcacgaagattgggtgacgtgtgaagtgtccgccgctcagacggcgttgattagggttttggaaagatcatgggttgttttagccgcgaaagatggcggcggagttgttgatggtgaagatgaagaagcttattgtgggattttggctgatcggaatcagattggtgctgttttgggtttgggtgggaaaaatgttgagtggatgcggagaaattccggtgccatgattagggttttgcctcctccgatttgcggcactaagaatgatgaactcattcaggtaaagttgaagtctttatatgatttttggttaaaaagttgttaaatttgttttggttatttggtttttgatatgttgtgaatgtcacttctttgtgtgttgtattagattactggtgatgttttggctgtgaagaaggcactagttatggtatcgagttatattcaaaataatgcacctctcaatgggtatccaccgccgcttagcatcaaaggttatgagtcattatcaactgatgggaactcagaggatccacattctgagtttttcccaaatttgcgttcttcttcgttgtcaaatgctacagaaattgttgcatccaatagacatttaccgtatgatggtggaaatagtacagaacgaaaagttgtgttcaagataatctttactagtgttgtagctggaggtattattgggaaacaaggaactattattagagctctgcagaatgaaacaggtgcttctatttctgttggagctccattgaaagtatctggtgaacgagttgttactgtttctgcacgtgaggtatataggtttctattcttctgctttctgctacacatttatccgagtttctttgttgaatgttgacataatcacattcgctttgttgttttcttctccttagaacctcgagtcacggtactctcatgcacaaaatgctctggctcttgtctttgcaagatctgttgagattgatgttgagaaaggtctgcgtccgggattgcacaatggtgccatagtgaaaactaagttgttggtaccatcacattttgctaatagcttcaatggaaacggaaacagagaagcaatcatagcaactggtgctgatgtacacatttcagtaggcaaccaggttttagagtggatctcagaaaatgaagtggtgattgaggtaagtgcatgttttcttgtaatcagtgtaagtgttttcttacccttagagatgagaacattgcaccttttgatcctctgattgttttaagattaagggagagtatagtcatgtacagaaggccttgactcatgtttcgtctaaattacgggaaaatctattgccaaagaaggtcctcggagaaatgagagctagagttagtaatccatatgaaagtgcaggaggaagaagccagatttataatctgcaaccatcacaacaagtaagtttgtttctttcctccaagctagaggtgatcgcagccatctaattcaataaaaccgcaggatgcaagcaggggtgattctctctcggtatcagctgctgtaccagacttgaagatggttagaagcggtgcagaagtattgaaatcaaattctgtaatgcacaccgaggtccttaaagaggtggatgaactcaacgactttacacttccacaaagtttgctggaggaagacttgacacaaggaatgaaacaacttcaaatgtctagcaatggagacgtctcttctttaccaccacggtctgttcttgccaaacagcaacggttccattttgttaacaatcattctcgttgaataaaacaaagtttctctttgttttgaagcagaagtaaaggtgtatctgtgagaaaaattaccttggagttagcagttgagaaagatgctcttggttcactctatggcagagatggcaccggtgtggataatctacaacaggtatataaatgataccctctcttaatatatatcttcagatgatgctagacaatgatgttgatgagtttttgcaaactttcagatttcaggagccaatgtggatgtgaaggatcctacaggaactgaagctacagtcttaatctctgggaatcctgagcaagcccgcacagcgatgtctttgatcgagtcaatccttactgatcaataaatgattgcgttttgcaactacttttggttgtttcgttttgagtttacatatcccaaaactccatccattttttgtgactggttttgaaaactagcacttgttgcagtgttgtctagaagaatacaacattttgccggtttaccaatactggtttacgaataccggaatcaacgacaggaaaaaaatatttaaaatgcttagtttgaagtcatactaataccggttccatattaaaatgcttaatagggactacgggcccaatataaaagtgtcaaggcccatgtaaaactttacggagttcaacgttaacggtaatactaataatcttaacggtcgtcgtcagagattcaaaatttgaacacaaaacgcagaaaaggaaaatcaaataattcctccggacacgcctttctcttacctcactctcttttatctttctttgcgttaagcttttcaatttctacatctacaaaacagagagacgatttgcttccaaataatt

SEQ ID NO: 13270 - DNA, 3000 bp, Unknown
  misc_feature (1)..( 3000): cDNA_ID_2702508_gDNA_ID_2214610_Annot_ID_187339 3000 nt of promoter + ATG
tgaaaaagatctagactttttcttcttctaaacagatataaagtatctggtaatgcctaatcacaacagtatgtttcatagtaggcctttggccggcccgtgagtccaagaagagggtgtctccatttggacgatttctttgttgcggtccataattcataagccgtatattagcatagttcatacttacccataattggaatggtataagtgcggactattttagttccaaaaacatttagaaaatgttgtgtacgaataactttattggttaacgcaattctgtatccatatataagagttaatgtataaaatatggcaaatcgaaattgttaatgaattcaaatattgaactcatggccaacaaccttggaacatttagtacaattacaaccagtgttcaagttccaaggactcaaatttcaaccttcaattaagtaaactatgtaagaactcagaaaataaatgtaattttatggagtatttggaattaaaagcatcaaatggataatgataaaaatgagttctctttatggtatgaagttcacgtgaaagagtactaatctcgaatgtatcttagttcagtaaactggtgaatccgacaatagttttgtagcataatataatgacgaacgtaacatttgtatgataatgttgcaaaaaatagtttttctcttcttcttctttttttcaaataccattcaaacctgcgaaatatagacttggccaaaaatattatagtactacttttgttttcgttgtatcgttttcattgaattttctttttcaactcgtttaattactgaatattactgtaattaccgatcaaattcatatatatttccaaaaagattaaattaattttttatttttatgagaaaaccaaaaccttttttagaaggatcaaaatgggacattgacggctgatggttgacatctggcaggtagatttgtttttgtttttctttttctttttagtttcattttaaggataaacattatcttgtgttggagactcgagatctgattggtcgaaagaaacccacgtggtcaccatgttgtcattttaggtcccacctaaactcttcgatagctttaagcctttaacagtagtgaatctagtgatactaaactttactaattaggatttaggaagaacctgaagcgaattcacttaaagcactagattcaaaactatgaagcatagaatagtaatttaatatctgtaagtgataaactttcacatgcactataataataataaatgatcatattttggtaaaactatgatcgagatccctcagaacttaaatattataaatccttcttttggaatcaaactagtgtttcttagtttatatgtaaggccacattttttatcgaaaaaaaaagtgaaatatatctgaaatctgatatgtactttagagatttatacattttcacatgtattgatcgtttttatatatttggccaacctatgatcgaaagctcaaaaactgaatacataaaaaaaaaaatatacatgaatcaagaaacttgatttcttgattctatcattttttaacctaattttatttcatcgtacttttttttttttttgacaattcccttactcttaaatcttaactcatgtatccttagaagttttgcattttttggtccgaaaagcttctccactggatcagttaccattggccaagtaagtttagtatcctcaccaacatcgaaaatcgagatattattgatgcgtatttcttttgaaaagtctcctttcaacaaaatttaagttgtaaggctgaacattataggttgaaataaagaaattgctcaggtgtacgaaatttaagccgaggacaaaggagcgtgcgaaagcatctcctaattggtatcctcaggaactgtttctgctactctcacgtgtatgactctcacaaatttgcatattccaccatataatatacaatatattatatatatatatatacttacatagtttgatagttcaaaccaaatagttacaatatagacgacttgatattagttggaattcgatggccattatcatattaattgaaactttaaaaccaaacgtaaatccatttctagtttggtttacttggaatcgacggtactaaaaaaaatttggtctacagatgttgtaagtctcatattgaaaacggtaagtcaaataaccaagttatatttttattaagcatatattgtctgcgtaatgagacttaattaggtcatttagttcatgtataatactgtacataaagtcaagtaattactagtacagggtaaattaattaagttctaattaacgagttttgctcattctcttatatgcaaaagttcgcctatatggaaacttgcaatagatcttaatatattggtagaatggaaatgtcctcaactcctaatttatgtgtgacacgtgttaataaaatcaattttgtattttgttctattatagaaaactatcatcagtttttaatattctctaaaatccatctaccgttttcaaagcttttttcccgttatatattttacataatttttttgggtaaaatggagatatcaaataaaggaagtttatttgtagtagtatacatttcttcggtttcagttttgattcagaaagtttattttttctatgtaaatactttataatactgttccttctgtctcatgtgttctatgaactatgtgtatactgtatacatattttaggttattaacttggtacgattactaattagccctcaagctgtatcgaccaacacaacgactcaaatagataaaaacgaaatccttaatttattcctcgaatacattgttgactcttacttccttcttatttttttcttttccttttctctctctctattctctttctcctgattcgttcttcttcatctttctttggccttgcgaagatctagaaaaaccctagaacgcaccaagatctaaaggaagatcaaaatagggtttaaatta

SEQ ID NO: 13271 - DNA, 3000 bp, Unknown
  misc_feature (1)..( 3000): cDNA_ID_3028903_gDNA_ID_2214610_Annot_ID_187343 3000 nt of promoter + ATG
gtcttaatacataggataccacacgtgatctacgtatgatcgcatgtacacgatctttgacttatctttccttttatccaataaacacatgctctctagagagtgacgttgtacatgtatacacttgtcagttttattatccgtcttgcttaagcagattacttaatcctacggctatggataattagttgttaatttgttattagtttaattaaacttttagttaaaaaacgaatacaacaaaggtgtgaccggcataagcggaagcagtgggtccaattgtcgtcgcactgccccgcaaaatctgttgctcaaagcaaaggttttctctatttgtttatttagttaagtttttttctttctttttactaaatattactcattacggatttataagtttataataatctcttcacgagtgtaatgattttgttagtgatcactgatcatcggtcatcttttgtaatcatcttgaattattatgatgctgattcattttgattttgctatgttcttttttcaaggttcgtatattttggcttttcagttaaagattttcttaaaaaaagttttgttaaatacacttaaataaagatttacaattagcacttaatttcaatagaaatttgaaagtaccatatttcaatgcaaattatacaaacttactctttttagttattaataagaatataagattacataatctcaaccagagatacaatcacattttataaagtttattcgttgatttattatgacttctaatgttttttcgcagctattcttatttacgaacagaaaaatcccttaccaacttactataatacttaaatggcaaaatcgtagtccttaaatttagctataacgggatgaaaaagtcatgcgtagcttagctttttgttggccacgtctttctttaaagcataatgtgtaaaagatatgattgtgaaagttcacactatattgtgcaatgtgtaagatcattatatactaattaatttacagcaaatgaaagaaaaatgcatggaatcttcttactcttttacctgcgatcatttatgtgcatagatcatttgggttttggtatgttttataatctaaatatctgataaccatcgataacatacaagcatcggcaattcaacatccataagtttcttgattgtcgtcatgccgtccagattgattttagtagacgatcatttcttacgttgactctctgctaacttacctacttgataaaaactacacaacatatacatcataagtaaatttagagaggatctagcatctcttttatttagaaagcaatgaaactctagcatatataaaccaaactcatgatggtatgtatagtggttaaataatttatcatggctgtggagaactaaagttcaaatttcaattatgacgtgaatgttttaaaccatgaaaatagggtaaatttaatatctataatgtttaaccataatgttttaatccaacattataaaccaaaccataccataatgttttaaaccaacattataatccaacattatatgttttaaaccaaaccataatgttttaatccaacattataaatgttgtgaaaattagcttaggatttggtcaggaatctccaagaatcaaaaaataattgtataaatttgattggtaatatttcgtaattgcataatgactctatttgtataataaaattttgcagaatgaaaagttgtaaaataaaaatttgtgtcgattagatacatttgcaaaaatgcggaataagattttatatcataaacaagtatatatctacatatttgtataatgaattgttactagtgtttttaggtgaaaacacaaattttctattttgttaaatgttatgcaaatatttttgactgataatttttttgtataattacgttagaaaatgtcattccgctattattatgcatattaccaataaaatcaactgtgtaacaactaggggtgtcaaaatgggtcaaaattcatgggtcaactcaactcaactcaacccatgaaccctaatgggttgaaatttttgactcaaatgagttgatgggtcaaatgagttgatgagtcaattggtttgatgagtaaaatgagttgggttgtaatgggttaatggttttagtggtttacccaattaacccatcaaattttgtaaaattgaattaaaccaactaaaatttctaaaccaatatttaaccaacacatctaaaccaatttaataaaatcatccccaaatttacaaaatcaatcgtttctcgacctccacttcgacctatactctccaccggtctcatccacatcggagactgacaagacgacgaagactgcttcaattgaagacgacgatgatgatgtgcttgtagtgggtcaaaagggtgaggtatgtttccactggacccttctcatttctaactactttttcgttttcttcattcgaattggcgtgaaagttcagattctgtatgcgttagtgttgtttagctcttaatcatgttcaggatctaacttaagtgatggtagaagcgtattcaatgttgctctagagttctgaagcttgtttatatggttaattttcactttatttgaatggctctacctttaatagactagtcttcttctagtttgtggtacttgagcgatgaagtttgagttctgggattagttacttctgatagttttgatgtgattgccaaattgttatgtgtttgtttcggtaaagggtttaagctgaaagaagatatatgcttgccgtattgtcatatccttctctttgttttgatgtgagctaacaaaaatcgtatttagtcatatgcttgtcgtattgtccaaaacagtcttcttttctctttgttttattgattctttgactgtgtctatgtgattaattcttgtatttggctaataacaggttttattaagcaatctctaacttggccttatttctatgtatagttatttgcagctgatcttttacaaaaa

SEQ ID NO: 13272 - DNA, 3000 bp, Unknown
  misc_feature (1)..( 3000): cDNA_ID_3028895_gDNA_ID_2214610_Annot_ID_187349 3000 nt of promoter + ATG
acttctttgtgggatcttaaggaaaaagattgggatcgtaaggataagcaaagcaaaaaccaaatgcttgaaagtcttctttcaagaaccgaacctctttcagagtgtgacttggttcttaagaagaagctaattgaggagttgttttcataagtaccgaacctctttcaaatgtttaatttctttctaagtacttctaggatttgtttcaatgtcacaacaatgacatgtttaatttgctttgtctgtttttattgcaaatcactttgcttatgtatgatattgtcttaatgttatgtatgatattgctttaatgctttttatgatattgttttgtctcttatcttatgtcacaagtcatatttggccttatatgtcacaagactttgttgttaacttttgcagtttatcatcacgggttggagacaaagatagacaagacacgtaacttgcaactcatgttccacttgatgccaaaagagacatatgatttgtttgctttgttgtcttgtttttagctttgagtctatcaacaatttaaatatgaggtacttttagactaaatatatttaattaaggtatttttattccaataaaaaatattaggtattaaacaacaaaaaataatagatgattttttcaggatttttttgccaaattattttttagtttattatataaaaatattatgctttatttaacatatataaaagataaataatagaatatttattatattatttagtaatcacaaatgatttaaaaatgctaagactgcaaaactactattttttacggtaaaaatgtcatttaatcccccaactttcaaaaaattggccattttatacatcaacttcgtatgtggctgtttaaaacatgaactaaacgttgactaatttttaaaacatgatctttcattgatcaggccaaaatagacatgccgttatcagtcattaacggaacttctaacgtccgttatcatccgttaactttattagtcaagtttcaaattgtggccattttaaacatcaacttcttatgtggccatttaaaacatgaactaaacgttgactaccatttaagacatgaaaaattcgtttacagggccaaaatagacatgtctttatcagtagaacctagaaacccgttaatgactgttaatctgtccaaaacaacgtcgtttgaaaataatcgaaagaacataaagatttttcccatatgaaattccatattaaaaagttttaagcagaacccaagaacatagtttgataaagcgataatcgcagtgccagtaattggaaacaaataaaggtgttttcgtttatatatttgttttaaattttaaaaggaatcatggaagcaaattgaagactcattataagattgttcgtcttgtttgggcggttgtagaaatagatttggggaactagggtttcatttagaaaacaatcctgattttcttttgattattctcaaaacaaagtcgttttaggaatactaatagactcgttaacaagtgataatgaatgttataagtttttttaatgaatgatgacaacatgtttattttggcttggtcaacgaatttctcatgttttaaatggtagtcaacgcttagttcatgtttaaaatggccacatataaagtcgatgtttaaaatgaccacaatttaaaacttgactaataaagtcgttaacggatgataacggacgttagaagttccgttaatgactgataacggcatgtctattttggtatggtcaacgaataatcatgttttaaaagttagtcaacgtttagttcatgttttaaacgaccacatacgaagttgatgtataaaatgaccattttttgaaagttgggggattaattgacatttttccctattttttaccaccttttgcaacaataaccttttatgttgtacatttttaaaaataccccttccctttaacagaatgaccaaattactctcatctaataggaacatgtaattggaaactgaaattttctagccaaatttatttttcccgcaaaaaaaaaaaattccgccaaatttttttcccgccaaaaaaattcccataacaattttttttttcagccaaaaaaatgcttttaaaaatccttgtgaaatatttttagcggaaaatagatttacaaaggattttaaaagagttttaaaagatttactagggatttaaaagagttttaaaatatctacaagggattttaaaaagattttaaaagatttacaagaaattttaaaaatttttaaaaagatttacaatcgaaccgacccgaacctgattggacccgaaccgagattttctatttattctattgaatcctagaataatatacccgatatacccgtacccgaccgggtattacccaaacccgacctgcatacctgaatgtcctgccctactacaaattttgatatacagtattgctaaaactttatcatcgttttgttattaatatgacgcggttaaaaaaatatgagaagtctacaaatttttagacgtagatgagataataaaaaggaaatataacttttctctattattggtatttagtttttataaacaaaatgtttacaaaaaagaataatattttttttgtaataataaactctgtaaattgtgtacttttgtgatatataagcttcaactttctatatactttttaatctttgtttttttttttaatttaaaatctttatataagcaaatataatttatattccactccgtttaaagcaccatcgatgaaaattcccggtggattctcgccggtaggaggagatgtctcaattttcactcaaatcttttttagtttttaccaaaaatatattaaagtaaaaggcaaaaaatcttcaaatttattcttaccaaccaaacaaacaaaaagaatccttgcaaaataatcataaattttaaatattttcccatttaaagagatatgcaagtgagaacttttgagaggcgcaacaacaag

SEQ ID NO: 13273 - DNA, 3000 bp, Unknown
  misc_feature (1)..( 3000): cDNA_ID_4255094_gDNA_ID_2214610_Annot_ID_187342 3000 nt of promoter + ATG
gaaggaagtaattcttcattgcaacttaaaacagctttagacatgagtttcccaagccaagcatgatagagtagtccccttgatccgagccctgaaaatacccagaagttgcaaaactgaccagcacctatgagctgattaacacatcccaagagcggcagtgatccatggcttgtgacaggtggcattgctctcaagcccgcccttgctcccgcaaattcccacttttctatgtctggataaactgcacttgctttcggaagaagctcgttgagagctcttgaagcttcctctgctgggacatccgatgaataatttcttgattgccattcccatgtggatcccatgtgcagattacggggtccctgaaccgcgagccacgcatctgacaagatcgaaggtccatcgtccgggtaacttcctctgcattacataatttaataaagaaaagcttttgaacaggaaaaaaaaaccacaaagataagtagctgagctcaacatagtaatgtgcgagtatgcgactacatcaacacatactttctttttttggaaggtctcacactaaaaaaaaacagagaagaattgtacaattgaaagaggatgtaaagttgacatcagagttgaaaaagaatactaggaatggataactataggcgcaaggtctcgcaatacctggcactctcgtgtaactgcatatgagtaatgacacctcggcatgtccttaaagggagctttccagtaagccctggaagaaagtctaccttggatccaagacatattactactgcatcatatcctcctacatataacaacacaaaagctgttcatactaaatttctgaccatgcggatgagaacctcagagaaaaagcatggatactatactcttggattgttaacggctatctaaattgtgtttacggtctctagatttaagtttatcacatcagttttcatgcctgtgaaacttgatccaaaaggactagttgtggttggaggatgtttctataaagcttacgcaagttccagaattaaacaaaaatataagaatatagttcaaaatcattcaccttcaagttcaagcacatcagttatagacttgttcaccaaagttatgtttttccttcccagtgatgtttttgctgagctctggcatgctagaaagagtgcctagagaagggagaaaaactcggtaaagaaaaacgcaaaagcttggtgctaacatatttgtgttgtcttaacctggagatatcggtgcggattaacattcatagctcctggaaaatagaaggcgcagttcaaaggcaggtatagattggggacgagattttgtgcaccatctttgtcaatagtctctactacacaactagcaagacagtttcgagcattctaatcgcataagtaataaacagtaaaactacgggtttagttaatatttcaaaggtatctaagtcgagttcaaacttacatcactcattaaatctaaagtcttggcatttgttgctggtctcaagattcccctaaagcaagaagaacttggtcaaactaaagtatcattgaatgaacatttcaagttattagtgttattgagattggtaccttcttcgaaccataaaatttccgaaactctcgctaaagtctctgttctccgtagattggtaactagaagaagcagctgtttcagccacatttaagagctctaaacattctctccaacactcagcaccatgccaaagtagctttcctacataaagtaagaatctttatgaaacaatacaataatcaccaaaggggacaatttcttctacctttaggagaataaggatggaggagtcctccagaaacaccagaagcaccacctcctatgccaacttcatcatatacgtcaacacttaatctcagctcttttggactctcctgcaaaaacaacacatattttaaattcagaagcaattatctcacaacaacacaagaacaaaatcaaatttagagatttaaccttaagcaggtgccaggcaacagagattccagcaaaacctgcaccaaggatggcgtacctggaggaacaagaagaaactctaaaaatcacagtgagaaagatagagagaaacaaatgaagagagctaacctaagaggaggacggttgggaagagagagagacgccgaagaacaagggtgaagaacagcagtgatcatgtctacacgccaatgcctttggattccggcaaatgcttgttttgcctgcgacgagttcgttatatcggataactcagttacctaccactactgtaaaggaacctctgattcatctagagggtcttcttctcagggacaaatattggtttagatcggtacaagaaaaattctacatgattctaaacccggttgagtacattggattcgataatccgatgcgtatactacacgttaaaaagtacattgaattttggtttaggccttttctccaattagtttattttctgagtcagacaaggcgttacattattgttcgcctttttagttttattttatccattttcgcaaacgttaaaacttaaagacacaacaaaatatataaaacggagatatgattgaggggcatatttgtcattttcttgtgatcgttgatttcgaagtcgctataagagtataagtagcagccttgaaaagtgttgttcatctctcgaagtaaaacttttctctcagtgatcggataaaattctcggcgaagaagtgaagtttccggcgatcagaggtgagttttccgttagatccttatcctagttgctacttgtgtgacttcgttgattaattttgatctgaatatcaaaaatcgggttttaagattctccagagtcctgatttttctcatgcacatgatcttccaaaattcatagggcttatgcaattgattagataaggatcattttaggtcaaaatctggtaatcacgtattgatttacttagttgtttgcattttttgatcgttttgaaaggtgat

SEQ ID NO: 13274 - DNA, 3000 bp, Unknown
  misc_feature (1)..( 3000): cDNA_ID_2702512_gDNA_ID_2214610_Annot_ID_135731 3000 nt of promoter + ATG
atatactggtgtcatgattatgttcataacataatatcaaatccaaaatttggtcgattttttttgttagaatgattgacgacagttctcaagttgtataattgaaatcgaccaaagaagtgtgcacttacttgaagaagaagaaaaaaagaagtttaccctccattttcctacaagttcggcaataaatgactagagataattctttataaatctacatatacatttttacagacattttaacaaataaatcctctactaagaacttatttacaattgtatgccactgacattaaatatttgtttttaatgattaaatacaagatattatattcaataatagttgccaaaaatctctcaagatatctaagtagttttaattattcatatttgaaaatttccatattttatattgcgctcaacaaacgtttccaaaaatctctccaaaaaattctacataggtttattcacacatctataatcccagatttttttcatcaactaattactgtcaacatacattttccgagatttctactctacgatatctgttgaattatatatcttttaaattgatttgaattatatatctttaaattaaaatattattgaaacaaaaataacaaaataatatttaatttcactgaacggggttagatggtatgacgggtttggatcgaaagtaatacgagacggtatactacgggtgaaattcattagatatatttaatttcactgaacgagattaaatggtaggacgggtttggtcgatagtaatacgagacggtatatcacagatgaaatcctaaatataacaatcaaaatacaataatattatctttaacactatacaaaagaaacaatactaacaaaaaaatataatttaaatttaaattattgttataatttagattttaacttaatgaactgtatgttattgtttttatatttttaaacagtaatgatcaaacatagtaattttacactaaatatatatatatatataagaattgtatatttagaaagaaaaaaatattacattatatatatttttaatctactaaaccaattaaatgttttgtttttgtataaaaacatatagtcccgcggtgtaccgcggataaaaatctagttatatggatatttgttgaaatttgacccccttttaatttatttttttgaatgggtgttcaggcagtgcataagtcatcgttttggttacactgactttaacagtataatatttttctagttatttatatagatgagtctctcttaaaagtcgtcgcaagagaaaatctatgtaccatttcggtaattgttacttttctttacaattttaatcttggtacttcgcctaagatacggaaagttgaccgtactctgaccgattgacgaattttttctgtgatatgaccgattgacaaaatttattatatattgaaagaaaaaaatttgacgtagttttggcagccatttcttggatatttacattagatgtcaataaaaacagctttccgatgtatattttggcagtcttatacaattgtatatatgtaaatgcaataattttatctttttttactttgtgttaatatgcaagtatgtagagtttataccatacacaaacggatttttgttagcttttagacgttacagtaatcgtgagttaatgaaatgccaaaacattgatgtgaagcttgacaagaatttataggcagaggttcaacaagtttcattacatcataaaacgacaacaaaaggagcagaaactttttgcgcatgggacaatgaggtaaggttaaacttgaaaatcttcgacatgaatatatatgaaggtagatttttgtttattggtaaatgttctttaggatggacaaacgttctgtcctgtctcgattccatctacacatttccgtttcatataggaatgtgtttccaattgtgacaaagttctaattaaatcctcttttgaaggaatattcctcatattctatttaggataaaaaaaattatattcaaattatttattaccccaatgtcatgaaatgttatgtggtaataagggtacttataagttatttcaaatcttatattacaaaactcttattcagtttctattctattcggattttcattcatgttcgatgttcccatttccttaccgcaaagtctcgtttcgaatttctgttgttttttttgcctcgtaatattgataaacagtctacattttaatatttcgacaaaaaaaaagtctacattttaatatatttatatgatgaatgtattagttagagtacctagttttttttgtgcaaataattagggtacctagttataatacttgtttagttgaaaaatagtttatgatatttctcttttattaatttaatattttatccttattttattatttttttaaagatgaaaaggttaggcaacaaaaagtcacacctgcaacattaagatggtctagatcaattacgtatgcccaaaaatttagatatatatgcaacatatacatattctgtatatacatacagacacagaattctatgtacacgtcccccacacatctgaatgcagattctgtgagatatataaagctacttaagattctaatcctatgattattgtaagaactaaaaaaagaataatcagtgcattttagagagaagatagagatagagattaccttcttcttcttcttcttttttgtcaaagagagagattaccttcttcataggaaaagatttctttcttcttctgcattccccaaattttatcttcccaagaaacccaacacagaagaaaatcttaaaggtacacttgaatagttttttcatttgttgcagatttttttccttctaattaaacgcattttttagttaaaccttagagaaggttgctttgtctatgtatattggtgtgttgatatacgtatctcgaccttaacggttggtttctttgtcggaagtttagtgaattgtggtggagatg

SEQ ID NO: 13275 - DNA, 3000 bp, Unknown; identical to SEQ ID NO: 13270
  misc_feature (1)..( 3000): cDNA_ID_2702508_gDNA_ID_2214610_Annot_ID_135732 3000 nt of promoter + ATG

SEQ ID NO: 13276 - DNA, 3000 bp, Unknown; identical to SEQ ID NO: 13273
  misc_feature (1)..( 3000): cDNA_ID_4262546_gDNA_ID_2214610_Annot_ID_135735 3000 nt of promoter + ATG

SEQ ID NO: 13277 - DNA, 3000 bp, Unknown
  misc_feature (1)..( 3000): cDNA_ID_2713342_gDNA_ID_2214610_Annot_ID_135741 3000 nt of promoter + ATG
aatgtcatttaatcccccaactttcaaaaaattggccattttatacatcaacttcgtatgtggctgtttaaaacatgaactaaacgttgactaatttttaaaacatgatctttcattgatcaggccaaaatagacatgccgttatcagtcattaacggaacttctaacgtccgttatcatccgttaactttattagtcaagtttcaaattgtggccattttaaacatcaacttcttatgtggccatttaaaacatgaactaaacgttgactaccatttaagacatgaaaaattcgtttacagggccaaaatagacatgtctttatcagtagaacctagaaacccgttaatgactgttaatctgtccaaaacaacgtcgtttgaaaataatcgaaagaacataaagatttttcccatatgaaattccatattaaaaagttttaagcagaacccaagaacatagtttgataaagcgataatcgcagtgccagtaattggaaacaaataaaggtgttttcgtttatatatttgttttaaattttaaaaggaatcatggaagcaaattgaagactcattataagattgttcgtcttgtttgggcggttgtagaaatagatttggggaactagggtttcatttagaaaacaatcctgattttcttttgattattctcaaaacaaagtcgttttaggaatactaatagactcgttaacaagtgataatgaatgttataagtttttttaatgaatgatgacaacatgtttattttggcttggtcaacgaatttctcatgttttaaatggtagtcaacgcttagttcatgtttaaaatggccacatataaagtcgatgtttaaaatgaccacaatttaaaacttgactaataaagtcgttaacggatgataacggacgttagaagttccgttaatgactgataacggcatgtctattttggtatggtcaacgaataatcatgttttaaaagttagtcaacgtttagttcatgttttaaacgaccacatacgaagttgatgtataaaatgaccattttttgaaagttgggggattaattgacatttttccctattttttaccaccttttgcaacaataaccttttatgttgtacatttttaaaaataccccttccctttaacagaatgaccaaattactctcatctaataggaacatgtaattggaaactgaaattttctagccaaatttatttttcccgcaaaaaaaaaaaattccgccaaatttttttcccgccaaaaaaattcccataacaattttttttttcagccaaaaaaatgcttttaaaaatccttgtgaaatatttttagcggaaaatagatttacaaaggattttaaaagagttttaaaagatttactagggatttaaaagagttttaaaatatctacaagggattttaaaaagattttaaaagatttacaagaaattttaaaaatttttaaaaagatttacaatcgaaccgacccgaacctgattggacccgaaccgagattttctatttattctattgaatcctagaataatatacccgatatacccgtacccgaccgggtattacccaaacccgacctgcatacctgaatgtcctgccctactacaaattttgatatacagtattgctaaaactttatcatcgttttgttattaatatgacgcggttaaaaaaatatgagaagtctacaaatttttagacgtagatgagataataaaaaggaaatataacttttctctattattggtatttagtttttataaacaaaatgtttacaaaaaagaataatattttttttgtaataataaactctgtaaattgtgtacttttgtgatatataagcttcaactttctatatactttttaatctttgtttttttttttaatttaaaatctttatataagcaaatataatttatattccactccgtttaaagcaccatcgatgaaaattcccggtggattctcgccggtaggaggagatgtctcaattttcactcaaatcttttttagtttttaccaaaaatatattaaagtaaaaggcaaaaaatcttcaaatttattcttaccaaccaaacaaacaaaaagaatccttgcaaaataatcataaattttaaatattttcccatttaaagagatatgcaagtgagaacttttgagaggcgcaacaacaagatggcgcataatagcaaaagacctaattttgcttctgggtccttggattttcttcctcttcctctttattcccctcaaaacctaggagcccaacgagagcacccctttcctcttcttctatatccctttttatctcttcgcagctttctctcctctctcagatctatactctcttctccttcacaatcgttcgttttatcctctccatcggattcgtcagatatcttcgatttctcgtcgtttcatcggttccaggtcaaatccaggtatgtcaattgtaaaatttcgatcagattcgtcgatttcgatcagctttttcgattttggatctattttctatgaaatatcagatctggtgattgttttacatatttttgggttgaattcacaagattttctggaaacgagatcgattaattgagttttctgtgtttttatcttaagctagatctcgatttctatgtttttggattgatttgataagattttcgagaattttttgtgtttttgtcaaagttcgatctcgatttctatatttttggttgaattcacaagactttctggaaacgagatcgattttgtgagttttctttgtttttaatctcgatttttggattgatttgagaagattttctgaaagcgagatcgatgtttttggggattttctttgttttgttcaataattcggtctctgttttcttatcaaaaaattcgttttccatctcaaatcgatgttcttattgatttaattgagttttagtttgcagggatttgatcgttggtaagctatctttcagcaaac

SEQ ID NO: 13278 - DNA, 2614 bp, Unknown
  misc_feature (1)..( 2614): cDNA_ID_2713389_gDNA_ID_2214611_Annot_ID_135744 3000 nt of promoter + ATG
ctttagttcattttgagagtgactattgtaaaatatatatcgtttggcttacaagttgttaggtgaattagaattgatgcattgtcgtaaaaacatatcatgtaaagctttttccaactcgtaaaataaatagtaagttaaaaactaaaccaaatcatgttagtaatattagagtattagaccataagttcactagttcatgattcacattttgcagtatgtaaaggttataaattctgaaatgagtccctccaatgcattcacatttccctttttctttgttctttatattttgctttaagaaataaaaaaaaaagttttcttctttcttgtttttgccggaatgagtcattgacatgtcatgatcattatcatgtatttacgaaaaaagaagtaataatcatgggcttgcactatctatatccactcgtctctatcggcaggcctcgtcatatcacgtgtctatgaacctcttttcttctccgactatcttcttctcttatgtttcaactaccaagaagttcttctggacctaacactatcacatctctttagaagaaaaactagcaagaagttctttgattatggtaatctaagaagaaaacatttatttttagtacttataaaagaagattaaaattgatggactctttgcaaatgcactcccaagtcgcaacacatgtatttgagccggacatggtataaaataaatatgtacatgttttcatgatctttgttgatttaactacttttcaagcagcattctaccatacatggaagcaaagaattaatgcggtcacaaccagcaatctattcactcttccaccgtcttcaagaaatccacaacacaatcaccgcaagaagacataaaaaatctctcaagcaaccttatgcaactctggttaatctgaactcacatcgagtaacgtttctactatggattccttgtttatctgtttttgcctaggattcaaagccataggctcttattttgtaaagcaaaacctattgattttatagagatactaaactcatagcataaaacaaaacccaactatttttcaattctagttttagtttatgtattgaagttaattactgttgtgcacaaaaaaaaaaagaagttaattactaatcaatccggtttattccggttcatcccggtctgctcacgggtaagtaaatgcatcttctttgtttcttttagaagcgctgtgacttggactttgcatagactctctgaatcgtctcggttctctcattagtttaagtatgaggctttgctcccagaagtgccaatggtctagccgttctcactttccggtggaagcgaagccaatgatctcaaactatctcatcaaacgagtcacattcgcgcaatgatgatctctttagcgctctttctatcattttcccctgtttttgtctgctccttcttcttcttcttcttctttgaggctatttgatgatacattcgaagtcaactgaacagaagttgatgtcgctctgttttttggcggggctacaaaatttgtacacattgaagagaggtcttctcttctttgctacctttttttgttagcagccatggctgagtgaatattcttccacctgtctgagagaagggtattctgatttgctcaataatacttatatgtttttaattttgattaattctgttcaattggtagtctgagtgatgaaattagatagatctcagagcagcaacagaagcagtatctgagaaaaggtctagtctttgtattagttgaaacttgtaaaccatattctttcttcttagctactaccttttcaatgacatgcttctgaatggttattacagcaataaggatacatcagtgttttgcttgaaaagtaaattgtgggcctaaaaccatttttaaagaatgaatgaaacaattatgaaagtggtcaactttgggaacaaagtttgtgcctttgtggtgctctattcagctttctctaagtttgtgacaacaaactgatgtgagttgtatcttgtttttgttcaagattgtgacttttgtggtgggattatttcaatttatcagtttagcctacctaggttctgttgagtggaattattggttctcagatctcaattaatttgagaactcttatcagaaactattccaagataagaaggtgttttttttctctatctcatagcctcattggtatagacctttttgtgttttggcagtattgttttgggagaaaccaactggattttaacgaaatattgttaaaccaaaggtttgttttcttggagattgagcttagctttgtttggatcattcggccacttgtgtgagagtttgattgatggttagtcttttttatatcatcatcatgctttgatagttgagagagaggaagaggcagaatcatcacaagttctgataaaggacaaaaccttttctgatgcaactcacgttttcacttcacaagctccaaaagagtttacttgggaaaacaaaagtttgacgaatgcaaaaccaattttgttagcataagaccaaacctacttcttcgtctgcctctttgcctgtatttgagttgttcttgttttgagagaaagggtgagaaaatg

SEQ ID NO: 13279 - DNA, 3000 bp, Unknown
  misc_feature (1)..( 3000): cDNA_ID_1009169_gDNA_ID_2214611_Annot_ID_187385 3000 nt of promoter + ATG
aggaacatcaataaaaccagaagataaagaaaaatcatgaaaatcctgatgtaaaactaagagtttttctttcccaacaactgatagagctgcaatatcttcacgattaaaactcttaaacgaaagaggaaaacgtggttctatcagttgttggaaaagacaaactgtcgctgttacatcagaagatattaaagctatggccagaagattttaaaccctagagttccgattctaaatcgtccggaagatcggagatcatcattgtctttctcatctcatccctcgaggaagaaagcgttgcgtatatgtgtataaaaattagggttttcgttacaataagcctaatcgatttatctaaaagcccattagaaagcccattagcttcacaaaatgtattttaacccgatttaaaatttcgtttgggccaaagccatcttaacccgacccatattaacatcactgcttacgcaaacacaacaagatttggagatttgtcgttaaacaaatttcgccgacctacgtatgagccgtcgcctccaatataaaccaaagccatccctaatcctcgaattcttcctctctgagtttttattctgagatagagaaagatgtcaggtttagcttgtaattcgtgtaacaaagacttcgaagacgacgctgagcagaagtttcactacaaatccgaatggcaccgttacaatctcaagcgcaaggttagaattcaatctcttgtgttttcgtttcgcgattaagttcgtctatggtttatggatttgattttggttcttctagttcatgattagtttggttttgaaatgtttatagatagctggtgttcctggagtaacagaggcactatttgaagctagacaagctgctatagctcaagagaaggttaaagctgttgaagcaccgatgctttatagttgtggaatctgtaacaaaggttacaggagttccaaggctcatgagcagcatcttaagtcgaagagtcatgttttgaaggcttcgacgagtactggagaggaggataaagcgatcatcaagcagcttccgcctcgtcgtgttgagaagaataacactgctcaattgaagggttcgattgaggaggaagagagtgaagatgaatggattgaggttgattcggatgaggatttggatgcggaaatgaatgaggatggtgaagaagaagatatggatgaagatggtattgaatttgagttggatccggcttgttgtttgatgtgtgataagaagcataagactatagagaaatgtatggttcatatgcataagtttcatgggttcttcattcctgatattgagtacttgaaggatcctaaagggtttctgacctacctcggtctaaaggtttgtgctttgtgcttagtctgtcttagatctttgtttttctttgctacttagtacttacatggttgttgtttcaggtcaagagagacttcgtgtgtctgtactgcaatgaattgtgccatccatttagtagtttggaagctgttcgtaagcatatggacgccaaaggtcattgcaaagtgcattatggtgatggtggtgatgaagaagatgcagaacttgaagagttctatgactacagcagcaggttccatttcttctgctttctcctctgttgttggtgtctaaatgtgcttgaactaattgtgtcttcttttgatgtgtgtttgtacagctatgtcaatggagacgaaaatcagatggttgtgtccggtgagtcagtgaacactgtagagctttttggtgggtctgagcttgtgatcaccaagagaaccgataacaaagtaacgtctaggactcttgggtctcgagaattcatgcgctactacaaacagaagccagcaccgtcttctcagaagcatattgtcaactctctaacctccaggtttgtctttaaccgatcagagatcatttatcactgtctctgtgtagaatttgaatctgacgtgaatgggtcttaaaacacaggtacaagatgatgggtctagcaacagtgcagtcaaaggaggccatagtgaggatgaaggtgatgagagagatgaacaaaagaggagcgaaaagcagtgtcaggctcggaatgaagagcaacgtcatcaggaatctgcccaacaatgtcacctattagtcttgctcctcgattttcaggtctctcctctttgtttgattttgtgaccagagttttggtgagtaaatctatctaagtttttcactagtactcaagtatcttaggcccatttgggtctctgttttgtctgatttagtcttttgaaaatgttacgttttggctgagtttgtatctcttgcccagtgctttgtacactctacattaatctatatttcatttggtagaagatcaagagctaatcaatctttatctgctaaatcataaatctagtacacttttcacttatctatacatttgttttagataacgaatgctctcgacttcactttctctagctatcttgataaattgtataaaggtaaatgcacaggtcgatttacgagttcctcacaaaccgcgagtaaatctcgacacgaatatcttgcatcatccactatatctctttattatttatcactctattgctctctcttacaggcactactgtttcaaaagagagaggaacaagtttaaagcctaactctttccaaagtccaacagcccaacttcacaggagcccatcgaaatcataagtcttctaaaccggaaagcttttgagtcgaataaactgaactgagagtaaaccggagaactgaatttattaaaaagtaattatattatagatttacctcgccctaattggcgggaagctctaatcaaaattggagggaaaatcccccaaaaattctttcgtcgctattaaaattcccccaaaatcttctcttccctttactttgatcacttttcaacttcctaaatctcttcacagttactttcgattttccgatttcgtagcttcgaaaatg

SEQ ID NO: 13280 - DNA, 3000 bp, Unknown
  misc_feature (1)..( 3000): cDNA_ID_2702541_gDNA_ID_2214611_Annot_ID_187379 3000 nt of promoter + ATG
aaaaaagaaggtcgttttcatataaaatgagattttcaaaattttaaaggctctcgagtgaatattttctattaacatgcatggttcggatttttctaaaactagatcattcaaatttgctttagattagtgagaatgtttgcccaatcatatacgcgaaagataatatgatgagataaatgtgtcgtaatttcttgtacgggtgagcatatcctaacatttgaaaaagttgaactgtaaacagattataacaatcttttacatattttgttaataaaaaatggttatctacgtaataatggtagcttcgtaggaaacattagaggtaaaatgaacaaagaacggtaggttctaatgatcgggacattcgtcgttgattaaagacgcatttcattttcttacttgaagtgtttgataagttaaacctactacattttctggaagactacgaaatataagaatatgtgggaagatatactataatatatcttctcatggtataattggcatgactttttttcaaaattggcatgtttcatttggtaataaaataaaatgttatcgtatttcaaagaaaatttgagcaacaatatagtttatacaatggtacttcttatagtgataattgcgataactgttgattcaaattctttattttattaatattaaatatctagtaagccctattgttcaattattccatgtacttttgacgatgtatagtcggagtctaagctagtttttttcttctaattatgagaatatgaatctaaatctttctaagttatgttgttgttttgtttcaagttatttctatcctaccactagtcagtcaaaccggaatttcaaaacttcaaagttaaatgttaggtttccattgattaattactctatacaccttttttttgtcgggcaaaatcaatatattaggacaagacgtcggaaaaagtttggaagaaaaccaacaatgtgtccgcaatatttggaccgtaaagaatgattatatattacgtttatacaaaatgatcttgaagtgagggtacctaaaatgctaggttgatttccaaatatgtatttgtgttggagcgaattaatcagcgggttgttgaatgatcacatgaaatccttaagataattgaaggagactcaaattacacacacgcaaactcatccatatctgatcttagatatattatatatggaactaacattggtcattttgcggtcttgagcggaagagatgactcaatacttagtacttttctaagaagattgaactcaaaacagcctcaacgagctaaattatttttgtgtgaagatagaactcaaaattacatccacagaactgcaatctatttatatgcgaagagataacgcaacatttaattttagcaagctaaaattcactttccaattaaacgtaaactcaacacttactttcaacaaactgatatatctacttgaaaagaaaactcaacgcttgcactcagcgagcataacttctcttcttcttcttcttttttcttgtcgaggtaacaaaaatgtcacaagttttgttgaggagaagagtttacagtcacatcgggagtttttttttcccattaaatctcttttctttggaggtctttaatttgattctcaacagatacgtgatcaagttgtgaataatcaatttttttgtgaatatataccaactcgaataaaataaaaacataaatggacaaaataaaaaaaagtcaaaaaataaaattgtcattaattattatgtgtccttttttggtaatttatttttgggaaaacagtaaatattttattgtgtttaattatatagaagaatagctaatatttggaacaaaattgttcacgtggaaaagacagtgagaaaacttggatccatccatagtccatatatatgggtagtcttccttctttctttatttgatgtgttattcatgaccattttatatttgaattaaatcatataaaccatttgattctttgaccatcgaccattgacccctaaaccaaacatatgattttttttgggagtcgtaattagcaacaaaacggaccggctcgtgcgtgatccgacaccaacaccaacataaggtttttttttttccgttcttaacaccaacatagttcattcatatatatagggaatatacacatgtgggtgtgtgtataagtatatctgtatatatgtataagctaagatgaattaataagggtcctaaaaggagaatttcttgaccaactacacaaaataaacaaaggataaaatttggacgtgtgaggtttagctgcatgtaccttgtacttgaagacccttattaggtgagagcttcatgcacacactctcttccacattttcctcccttttctacataataatttctaccccatacaatagtaatgttatttaattatttataaacaatcacataaacactgaaatgtaaattatattcttacagcgtcttattgaaaattctatgtctttcaaacttagatggtaattgggttttctaaatatgctaacaaaacttagaattgataaatatgtgtatgtatttataaattaatcaaaaccgtgttagcgtaattgttttttaatcccattcacgataaagtaagaagaaaaaaaccctactctttgtcgtcttccttcatctttttcctcctaagaatagtcgcaagtcatccttgtctcatgatatataaataccatcaaaaccctaatctcataaaagttttagttgtctggtttttcctcatctatacaagtaagcccaatttctcaccctatacatatcatacatatatatcgatcttttactattctctcttctttcgaattcctcctttaatacctttgtcttatggataaacagttgtagaacgctaggatctatgtgaaacttagacttgttactatgtgttttaagcaggtataaaaaggttcttggatttggagtaaactaaagatcatataaaatg

SEQ ID NO: 13281 - DNA, 3000 bp, Unknown
  misc_feature (1)..( 3000): cDNA_ID_3028991_gDNA_ID_2214611_Annot_ID_187372 3000 nt of promoter + ATG
taactatatttctctcctctttttattggtcaaagaataagaataataatgatgttgatgtagaacatcaatctttgtgaaacaagaaaaaaactcaaaacatcaaacttttaggaacagagggagtataacacaaggaaaccgtcgagtgaaattcttgacacttgtttttcttgtgaacaatcaactgtgtacggtagagttggagcatttgcgcctaaactatttgaagaaacccaagaaacccgacaaatggagattaatagaatatttaatgcaagagaaactttaaagtgaagtttgtcacacatgtaattttttgtgaacaatcaattaactttaagggaacatatcaatctcggacatgtacatatcaatctttgatatatatacgacaaatttggagtatttgcgttgtttgcttttaggagaaaagagacaaaagaagatcaatcgaacttaatgcaaggaaaaccgtatagggaaattctctaaacgtgttatttcattcctagtaaaataactgatataaatgaaacagatcgatctctgacatgtacgatattttgagtaattacgttttcagttctagaaaagaacatacaaatggatatcaagagaatacttgattcaaggaaaacatcgagcaaagttatttacacaacttgtttcctacaaagaaagaattggctttaagggaacatatcaatctctaacatgtataccggatttgtagcatttgtgttacaaggaaaccgtagaatgaaattcttgacacatgtttttcttgtgaacaattaactgactttcaaggtactgatcattctttgacatgtacaatagattgttgagtatttgcgtcttaactattgggagagaagaaaccaaaaacgagattaagatgatacttaatgctagggaaaccttaaagtacaaaatttttgtgttaattcctaggaacaatcagttaactgtaagggaacatatcattcttagacatgtatgacaaatttggagcatttacatcataacttttgggaaaagagacaaaagaagatgaaacgaatttaatgtaagtgaaaccgtcgaatgaaatttctcacacgtgttatttcttattttcaaacaactaactttacagaaacatatcaacctctgacatgtatgacaaatttggatcgaactccgatctttttaaatgtcggctctataaaaaaagttcgttagtctcttaatttttgttttaaaaatctcaatcattacaataaatatgatgttgaaattgtattattttattaatttgtaaatatggacataaacattaattcaacattagtttttgttagagaaatactgtaatataccacactgttatgtttttattccaaaaatgccaatactagtttatcttctcaataatatcacaaggttttgtataaaaatatttattcaaccaaaatgaaatacaaataaaattaaaatatgtatatttgagttgcctagctctttctaatttaaggtttatatttccatcatttaaaagaatttttgagtcattttaatattaaatttgttgtactattagaaaaaaaatagtgattgtatttaagaacaaaaactaaaaaatatagtattttagagaattttccaaaaaaaaaattcacgttattgagttattcatttataaacatttacttaatttatcacaacataagaattttgttccctagtttcaaaagtttcttttaccgaattctaattatgtaaagagataaacaatttatgcttttataattttttattttgtataggtcttaaaaaatacgagattctattttttatatgagaaaaacaaatggacgttttcgaggaaaaagaggagaaaagaaattataacggcaaaaaaaaagttgctggtttaggcaaattaataataatttgtgtaaagaagggaggacaagcgtgaatcagaaaagaccactgtaaccgtagctttaaagcggcaacgcgccgcctcacacgacaacctcgtaaaaccgaattgaaacaagccacgtgtcttatcctaaagaacgtgtgatacactctccgtaagtgagattgggagtgagaaaagaatttgccaataaaggaaggatcaaaattataaataaacaaaaaaggaaggaaaaacaaaaaatcaaaagctgagaaagtaaatgggaaacgacgactgagactcttcttctccttctccttcttcttctacttatttcatcgtttcatttcttaggtttctgatttcatcacaacctctggatttgatttttgattcggaggtatataaaaaaatgtttagtggggtttgcgattcgatgaactagggtttgtaatttcactatcttcttcttctcttcgatcgtttactcatcgggtgagaaggaagcgtctttcatgtgttcttccgtgtaatcgactgttttattgggcttagtagctctaggtaaaccttaatttcttcttcttcagtacttgattcatcggatctgcgtttttcttatgttttttcttctgggttttggctcagagtcatgatctgtagctttatctctgttaggaccttaaagttataaactttgatttttctgtaatgggtattgattctactaatgaaagttttcgaatcttatggtaaatagttaacctagttggtttcttcgttttgactagctcgtttgtcttaatttgggtatgtgcatggtctttgagagcgaaagctgttttttttgtttcaaggttcttgttttcatttttgaagcaagtctttcatatttgatatgttaattttgatgatagtaagatcattttactgatggctagtgctgttaatgagactttgtttccagtttttgagctaatgcttcttgtttgtgtttatctttgagtctaaagattttatttgtgtgtacttgcagtttggtcaaagaattcgtaacaagtgaatcttagattgggaagatg

SEQ ID NO: 13282 - DNA, 3000 bp, Unknown
  misc_feature (1)..( 3000): cDNA_ID_2991470_gDNA_ID_2214611_Annot_ID_187364 3000 nt of promoter + ATG
aatattcagccagagattggttaagtggagcatttgtttatacagccatggttaattatccaactgcagctaatttcatggcgccactgcctggttatcccgtagagcaggtgagatattcattcgttaaagtgtgtcatcgagtattttctttttcccgaccgtcattttctcttgcatcagatgtgcaagatcatcgacgggttccctcgaggatccagtaatcttgaccgtgcctttgctgctgcaagcttatactacaactattcgggatcagaaaaatgcttcgagatggaacaacaaactgatgatcatggacttgatggttggcaatatcaggtaaactcatttagaccgtcatttagatatttgaacatattctaatagatttgacgatttgcagtcgctagagcaagaaatggttttatgttatgaaacttaaaacttataaatgacacaaaatgattattgaatggaaacaggcgtgtacagagatggtgatgccaatgagctgctcgaaccagagcatgctccctccgtacgaaaatgactctgaggcattccaagaacaatgcatgactagatacggagtcaagcctcgaccccattggatcaccacagaatttggtggaatggtcagtttttttcttcccctccattggatcagtttcttcggctgtaagattcaatatcctgctctttggtcatcttttgcagaggatagagacagtactgaagagatttggaagcaacatcatattctccaatggaatgcaggacccttggagccgtggagggtaagtggtactacacagtactattcggttttggttcttaaacagatggattattttcatcaaattttcagggttctgaagaacatttcaagtagcatcgttgcgcttgtgaccaagaaaggtaaacacttctgttatgtttatgaatgttggggaaagttagacagagatagatttgagtgaaaaatcgaaacctaacattgttttgtgtggaacaggagctcaccatgcagatctcagggctgctacaaaagatgacccagagtggctgaaagagcagaggaggcaagaggttgccattatagagaaatggatcagtgagtattacagagatttaagagaagagcaatagaggagccaaacaaaagtttattgcactaaaaatcaacaaataaagaaactaggtgtttttgattcggttcgtgtaacaaagtaaaagcttcaccaggaatttgtattccctcaaacaaaataatctgatgtttgtttctctatggagtgaattctgtaactaatatctgattatatcgtggcattcatgaaaatgttatggaacaaagagggtatcatcgcaaatagtcaaaaatgtcacgcgtatttaaaccctaattagacaccgagaacataagtaacgtacgacacattcttcatgaaacaaatgcgaattcaattagattcctattcttcttcttcgctctcttggtccaaatctgttgtcgaggtaggagagttacaagtcccgaaagtgtatcccttctgtgtcaacttgacggagaccatcatgaataaaggttcttgtggcaagtcagatttttgacttcttatcccgtttggcttggacaatctgatcagctatatgttcggacaagacatgatcgtggaattggcttaggagaagttgatagacgtagtttggttcgaagtttctgaagtctagaaagattagtgggtcgggacctcgagaaggattctggtaagatccgagactcgtgacgctaccatccctgtcgtttatgataaattcctcgaagtctctgtctcgactgatcattaccgagtttaagaaacctgacgatgatggagtacgagaccaagcggttacatgaacatcgagtttcattaattcagtatccattgtcgaatttttattcgacaaaatcagagagaaaatatgattcgtggagaattaaagtgtaatgttatgtttttataagcatagatctgattataatttgttctaacttctaacgcgtttatggaatttccttttttgtctccattttttttcttttttcgttcttattttctttttgtttaaattgtttaatattatttgcgggtttacgatgtgtttatagataagatattttataaaacaaagaaaaaaagaaaatctttctaaaaactgtaattaatatttgctataatacaataaaaagtaaagtttggtagtggatcatgctgaaatttaaccttgaaataactaagttaatgaaatttgatcattttataaaaagttaaactaaattttaggatttaagtgttttttcgaaagttcataattttttcgttcaaaatttaaaagttttttttttttttggttcagactatgaatgatcatttgatcgataacttgttttttattgggttttgttggatttctcatagtaatttcattgttcctccttgtctttgcgattgtcctctttgacttcatggtactgaaatcttttttggatctttctattttttggaaattgcttggatagctcccgatcgtttatctttcaatcaaactacggtttcatttttctaagcccaaataatctcgatttccgaaatttcatttcacaaggcttcaaactaactccgaaagatgtggaaaaatttagtgaatacgaaaagatgtgggacgcttcataaataaagatgtgcggcaattttgtaattacgcaaagatgtaggcaattacgtaactacccaaagatgtgaggggatttcgtaaataggggaaaggtatgggataatgtcgtaattaccaaacgatgtgggggtgatagagttactagtgccaatcttggaatagatagtctccctccagttacagtgctctcttttccactatcgccatgattgctcaaacgtgaattgaatgatctgatccataatctaaaaaattgagctttcatcagtaaccgaagca

SEQ ID NO: 13283 - DNA, 2614 bp, Unknown; identical to SEQ ID NO: 13278
  misc_feature (1)..( 2614): cDNA_ID_3029005_gDNA_ID_2214611_Annot_ID_187362 3000 nt of promoter + ATG

SEQ ID NO: 13284 - DNA, 3000 bp, Unknown
  misc_feature (1)..( 3000): cDNA_ID_2991470_gDNA_ID_2214611_Annot_ID_135746 3000 nt of promoter + ATG
tccctccagttacagtgctctcttttccactatcgccatgattgctcaaacgtgaattgaatgatctgatccataatctaaaaaattgagctttcatcagtaaccgaagcaatggcacggaggtctggaaattgcatgagatgtctagtgatattctcggtggtttcagcattattagtgtgtggacctgctctttactggaaattgaataagggtttcgttggatctgctcgtagcaccaactccatttgtcctccttgtgtctgcgattttcctcctcctttgtctctcctccagattgctcccggtactgttgttacatctgggttttcaatttgattcataaaataggagactttataaatctggaaatgcttagatcgtgcttggaacaatcttgtggtttctgtgatggatctttctatcaaagctacggcttttaaattgtatacataagaagagtctcaatttctaatgaagtttcattcttttgcagggcttgcaaacctctctattacaggttagatctcgttcccaagctttgaaactctgtatgtattgtttcttcagtttctctagtatctctactgatttagtatgaatgagaatgcctatctgatgatttctcactgagaacccttactgaatcgtttgaaaacctaggaatttgtgaatcagtaaccaatgggtgcaactatatctcttaaagttagactttatttgggtttcttgatcagacataggagcctaagattctcttatctgttgccaattgcattaggaatacttttaacaaatagtttttttagttatctgttgagaagatgttcctcttttagtccatggaaaagtagaatatgatatatctgttgacttgtgttatgtatcaggttgtggcagcgatgatccagagctcaaagaggagatggagaagccgtttgtggatcttctcacagaagagctgaagcttcaagaagcagtggcagacgagcatagtcgtcatatgaatgttacacttgccgaagctaaaagagttgcttcacagtaccaaaaggaggctgagaagtgtaacgctgccactgaaatttgcgaatcagctagagagagagctcaagcattgttgctcaaagagcggaagatcacttttttgtgggagcgcagagctcggcaattaggttgggaaggtgagtaagtaattcactgtttagtgacttcttcacagtctactctgacgagtttctcaatggaagcaaactagattttctcttccgtatacaactcgtgagaacatgggaatcgcttaattcgcaaggcaatgtttttgtctcacatgttctctatatatgtagttcttttttgttttgctcttggctctagacactgctaaagaaagggttggccttgtattgacttttttcttcagatatatatttgtcagtcacactggacaaagtcaccgacttctgtattttattgttcatgtttattggcaaacgcaaccatcattttctcaccaggcaaaagcaaaatatataattatgatcttattgaacttggatattgtgttttttgagatgtgcatctgattgagacagcaagcctgatttgatttgtaagaggatttgttttgcagctaatgttggatgcatctgtgattatggtttaagcataagtgtgggtcaagagtcactaacaaagacttttgagatgtttaactaacactagaatttgtgaagagggacaagagcagaggaagagacaaaattagagaaaagtcaagaaagggttgacataatgcagcatatgatctctccaggtattacacagcaccaactttcaatactcattcatgcacaaaaacagctgcttttttctgtttatttgatttgtttatttttactagtgtcagccattaataatactctctttctctcgttgcattattctaatgctcacatggacagattccttaaaggtttttattaacactttagatctaccattaaagaacagatctcggttcagtgacttctgcaaaccgtctagacccatgtgggttgtccaaactctatagcttgaggctatttgttctatattcaacttattatgtggttatgtttcttttatgttcttctctgaagcttcctttgtggacttctgctgtttttttcctaactttggaatagtttttgtttatctctggacacagagatcgcaaattcttttttcttaaatggaaggttccatgaacaagcgaggatacgaatgcagtcaagaggatactgacaagctgccagaatcaaagagacaaaaagtgcctgctttagcaaggtaacttccttaaggattttctgtcattttctagttcaaagtagctcaatggttaaacatcacaactattgaggaagaacatgctttgttgtaagattcatggaggagaatgtgttccatttgaaactaagattctttactctttctgagtgagatttgttctttgttgagaggttcttttgtaagctctcaaattttagtttttatgtttccagacctcttgattatcttgcaagtttgttgattttctcatatgaaacaaactttttctagtgttattgtggaagctgtcaaagtagatagtctgcagaggctttgctcgtctttggagccgttgtttcgcagaattgtgagtttctattctacccctgatctagccacgtaatgctattatagtaaattgtgagatgcttgtggaggtgtttactgggtatggtgtggacaaacacacaggttagcgaagaagtggaacgagccttatcaaggttgggaaacgcaaagttaacctcgaggtatttgctccattataccttttcctcttgaaatggctctatgatctttgtagcgcttagtttctgattaacccaacataaaatctccaggtcaccagaaccaaagaggatccaagaccgcaatggaagaaacctgcaacttcactttaggacgcga

SEQ ID NO: 13285 - DNA, 3000 bp, Unknown; identical to SEQ ID NO: 13281
  misc_feature (1)..( 3000): cDNA_ID_2994259_gDNA_ID_2214611_Annot_ID_135752 3000 nt of promoter + ATG

SEQ ID NO: 13286 - DNA, 3000 bp, Unknown
  misc_feature (1)..( 3000): cDNA_ID_2713369_gDNA_ID_2214611_Annot_ID_135753 3000 nt of promoter + ATG
gtcttctgagttaggaaatgtgacacacttgaacactttacattttctacacaacacaaatcccacctataatcacatcattcaagttcccagatttagataaccaatccaaagtttcacagatacattacttagcaacagtttaacctaatcgaaatttacgaaaactcacagctttacaagttggacatcgtcgatagattcgattattctcagatttcacatttgttttctgtcctttacagaaatcgcagagcaaccatcctttcccgttacaatcctcacacaaaatcacagcattgtcgtctcccttcacgaaaaatcctcaatcaattgtcagatccgatttcaacttcatcgatttttaatgtccaaatttttgtttggtacctgctgcgactgatcgagctgaggctcttgttcttgaagtggaacgcatcgaaatggcttaaagagacgacgttgttttcgacgcgacgtggatgaagccggcgacggcgctgatgatggcatcagccgtaaataacatgaaattggaggctgtaacgttatccaagtcgccattttttttttgctctttcctgaattcctcaatccaacttccgtggcggttaattcacacaaagtccgtccgctacagtaactagtgggctgataatggatcgtaggaaggcccattaatttcgattattgctggtattagtagggaccagtacagtacccacacaggctatggacagctcaacagcaactaagtggcggatacacaaatgacaaatctgtggaattaaaaatccgggacttggtccatagtttctcaaggtttgggaggtccagcccaaagtttaaattctattaagtctatttggtatactttgcagggtctttgttttgaagctttggttgccactcgctttcactatgcttcagttaataatctatcttctgtactaagatagaagcacattgtctacaacatatgaccttccctagctaataaaacttgatgctatctacaacacatttgttgtccactttttgctttataatttccaataacatcttgatttggtattacttactagtattgtggaaaattcacacaattcgtctcaaacatagtagcaattgagctctcgtaaaagataaatgcgaacaaacaatcgaagctaaacacatgtctatatgtgtattgtataataacataccgcacaagaatctgtagctgttttcttattccttatcagttgaattaagtaataccacaaaaccccaaatccccctcatgtatgtgtattcatgaagaagaatctaacccttcctagagagaacaccaagaatatattgactaattcattgaggaaactataccagatttcatttactgatccgaatgtagcggcgagtcatatctcggatttcggtaaattcaactcttcagcaaattctttagtcatcttcaagaaaccttccatgtgaagttgcttccattcctgtggaaagtacaatggaaagcatatatatacatacacaattcaaacaagtaatgatccagagagcctaatctatgaacaaattaagatagctaacctcgaaatcccatgtcccgtataggtcaggatcatctttcttggcccaaacgtaggtttttgtttgcagtttctcgtctgaactatcctgtaaacatatatatcaatatctctgcattcaaatcaaatatagagaacaaatgaattgttcttgttcttgcatctttgaatctttgcaaaaacaacaacacatttttttctctctatagaaatggatggagaatgaatctgagaatgactcactgttaacaaaacttgaacattctctctttcatactcaacatcctcaaactcatctaaaacattaagttcatcatctgtgattccaaataacacctgcacaacaacaatatcaaaatttcccaatccttaaggcatgagtaagaatctgattcggatcctgacctttccagagactttatcagacttagctggtataatcgccggataaacacgacctttgatgctgaatctatggctgcaaaaatctcaaaatcaccaatcaatttttttcaatttcaacaaagaaaatcgattttgcagagatggaatcgtacaaatcagggagggttgcggaagcggtttgagggatacggttgaggaggagacgaacgacgtcgtccgccatgagactgccgtagacgaagacactgtgcattgtcactgtaccactcatcttcttcctcttgacttctgcgagctttcgattatgtgagacttgtgagtgagagagaccaaaaacagaatcttcatgagattctttgggcctttttaagcttcgagccttcaaataattcgcaataaaaaattagcaaaaagaaatcgactctgctggggatcgaacccagaatctctggtttcgtagaccagcgccttatccattgggccacagagtctttcttgcaagtggtatgtattaacagtatataaccatgtttttattgttccataagaaaccagtcacgtgctttggaatttctggtttctccttctgtgttctttttcatttactttttttggaagttttttcttttcttttttggaagtttggacataccttatatgttacttgcgtggaaattaatctatacacaaattggtattgtaaatcgtcgaagaaagtttcagttaataggaaagagaaatcaagaggaaggagaggcggagaagaaggagaagcgttcatagagagatagagacgaaacaagagaaaatttatttttatagaaactctcttttctctgtatcctcttgtttcgctctcttaacaaaaaatgaaaaatagagaaaccatctttgaacctacctcaaaacacgtctctctctctctttcgatttcatcttctcaagtttctttattgctctgaatcttgaatcctgaaggagagaaagcgatagagagacgaagatg

SEQ ID NO: 13287 - DNA, 3000 bp, Unknown; identical to SEQ ID NO: 13280
  misc_feature (1)..( 3000): cDNA_ID_2702541_gDNA_ID_2214611_Annot_ID_135758 3000 nt of promoter + ATG

SEQ ID NO: 13288 - DNA, 3000 bp, Unknown
  misc_feature (1)..( 3000): cDNA_ID_2702554_gDNA_ID_2214611_Annot_ID_135765 3000 nt of promoter + ATG
tcttagaaggggaaaaaatacattgttacaaatttgtagtatataaaggttaataaatacaccaaaatgttaaaatactagataaccaacaacaacaaaatcttgaaccttgtgtaaatgtgtgcttggttttatttgcaagagtaaataaatttaaagtatcttacttattgcaaactatttaaattttcataagaattggtgacgtgagcgactgctcaaagatcaacaaaatgttttaactctttgttttttctaatccattaatcttcctacaaaatccaagaatctgagatgtgaaagtggctataatcagaaaaatgtttttgagtaaaaatcagtatatcaccaataaatagaacaacttgttgaacaattgaaataagatgcctttgtagtgtctttatagacttgtttatatatatcctctccaacaacgtagactctggtcctattttcatcatccacgtcaatatcagaacacactgccactttattctcctcatccaacaagaaacttgccacattcaccacgctcggtaaattaaacttatcataatccactgttaagacgaagttgctccacgacaattctatggtttcatcaatcttattggtcaaccatatcttcatctcatttgaaaattcaagaatcttttgatgtaacactgagagtttttcttccctaacaactgatagagaagcagtatcttcacgattaaaactcttaaacggaagaggaaaatgcccaaatctctcccttgtgaaatcaaaatacaacatgaacatgcccatttctttatctccagcaacccagtaagtgtttcttttcaagggcccgccacttgaaaatacaccatagtcatgagtgaagtaatcaagaaccctccaagtatcagagccaaactcatagatctcaaactcagcaacccattgtttctggtcgtttctataatagcaagacctcaagattttgaagctatggccagaagacttgctgtttacgtatcctaaaccatagtaatcatcattccgaaaacgagttctcggtttgatccaccgggtttcaccggtactggagtcccaaaccacaagtctagtgtttcccttagtagagcataatattaaaccctcacagtgggaagatcttagatattttcaaatcctctgaatcctttagacggcaaagtttaccagaaaactcgatagatggatcaacgtttttgtgaattccatggtgatcgacactaactgaataaactccaaaattactcagtaacatcaacttacttggtgcgttaccaaagttcttcttgatgaagtttggatctctgaataaagcataccatcgtttgcaattttgctagagacttggttggaaccctagagagtatttcagattccaaatcgtccggaagatcggagatcatcattgtctttctcgttgttgctgatctgatcacttgtggaagaaagcgtacagtatatttaagtgtatatagaaattagggttttcgttacaataagcccataccatttattgaaaaccttattatgtgttgttaaaaagcccattacctccactgatcttcttttatgtttttagcatatatactagaaacttgggtctcaagctcttgggttgtacggttgtaccctctttttcttttggatttgagttgttacaatttttcctatcatcatcactcctcaacaagttagatgcaaatgattcttagctattttcttttagagtgttcatcaaacatttcttcatcttttacaaatagaaagttttcttcaaaggtattgaatagtttagtacgtcatttcctttataattttttcatcctctttccttaggtcttgttcacctagtaccaaaccctttttggcttcttcataaaaatgatggcattgcaaaactcaatttgtatttgctagattcggattttcgcagaacttaccctcgggattttaaaggtagaagtgttgtgatttagccgtatttattagtaatacatacaatatttttatttttatttttttggttaaaaagctagtacattattatcaccaaaaccgtttaatattgtagtctacggacagcttccaaactgctgaatggatgacgcaattcattgcagttcagacacacgaagtctcccttgacctgaaacaacaaccatgtaaatgaaagtgatgagacagactaagcagaatgcacaaacctgtagaccgaggtactttagaaaccctttaggatctttcaagtactttggcaatcataatgtctaaatggctttaccatggaattcattatgtatagtattaaaaaaatcattatatcaataaatagaaacaactacttatgactaagctcgaacaaaggaacatcaataaaaccagaagataaagaaaaatcatgaaaatcctgatgtaaaactaagagtttttctttcccaacaactgatagagctgcaatatcttcacgattaaaactcttaaacgaaagaggaaaacgtggttctatcagttgttggaaaagacaaactgtcgctgttacatcagaagatattaaagctatggccagaagattttaaaccctagagttccgattctaaatcgtccggaagatcggagatcatcattgtctttctcatctcatccctcgaggaagaaagcgttgcgtatatgtgtataaaaattagggttttcgttacaataagcctaatcgatttatctaaaagcccattagaaagcccattagcttcacaaaatgtattttaacccgatttaaaatttcgtttgggccaaagccatcttaacccgacccatattaacatcactgcttacgcaaacacaacaagatttggagatttgtcgttaaacaaatttcgccgacctacgtatgagccgtcgcctccaatataaaccaaagccatccctaatcctcgaattcttcctctctgagtttttattctgagatagagaaagatg

SEQ ID NO: 13289 - DNA, 3000 bp, Unknown
  misc_feature (1)..( 3000): cDNA_ID_2702566_gDNA_ID_2214612_Annot_ID_135771 3000 nt of promoter + ATG
agctttttttgataacatgtgaatcgctgaagtggaatgataaagtggtgtggactaagcccaagttgcttctaattcttcttagtagcccgatagtgtagctaggtggtcattcatatcgttataactcttctctcctcctctttaatataaaatctacatcttaaatgatctgaatgacctcttgtctcaaacatagagtacgattaagcatatagctgtaatcagttaattcacattgttggactaaattctgaaaatctctcattcctcgtgatatcaatggtaaatgttcatacattgaatgatcctctccttccaacacctcactgaaatctgcacatatcaaccaagttttaccatgaaatagagcaaaactatgatagtgtcgaagatcggcctatagtgttttgcgttccatcacaaaattggatgcataaacaaatattgcaaaacattcttccttttctccttcaatcaagatcgaacatgtaatcaattgtgatgtcttgtagataggcgtgacttgcacgttatttctccaaagcaaccaaattcttcctagtctatattcttcataattgcatataaaagaccattctctaaaaactgactttgtaatcttgtatacctttctttcttttacttttgtttctattaaaaaatcaaaatcaaacttccccctattcatccaatcccttacaacatcatgcttacctcttttattaaaatatctaatgttccagaagaaaccagacattaagaatgttgtggaggtttacttgtcttcaagtagttaggatttattatcctagaattgtgcatgtttttgttgacaaaaattcgtgaccatcctttgaatacatgttcgattgattacatcctcagcgtgacaaatccaaattcacaataaatcatataagcaatacagcttttcgattacatcttaaaccaccttagtgaggttctataactaaaatggttgaattatattaaactaaacaaacaatgttttctaaaaatggtatgcccaaaaatggtttacgaaaaatagactcaaaaatacaaatgtcattggcgaaaaataaatgacaattaatgaatatacaaataatagataaaaagcaaaatgaaataaattttcaatgtttcatttagttaaagatagtgtatcttgaagatcataacgtattttagattatgtacctgatttataagtggcttataaatcacctaccattttaccagtaaccgatctaatctacacacaaatatcatcttttactcttataagattttaaccatatttttagatctcataagaatcaatgcaatttcatataaaacatcaaaataattctataaattaaaattttctcaagataatatttaattttatttataaatctcttaattagccatctttctacatttatcaaaagatattagctatctgttctcataggcaatatgataaaaaaaaaaactttttccaagttaggggcacaaaaagagtttccctgggacttgggctgagaataatgaagtggctgggaaatgattagttaaggatggcttgatgaattctcaatattctgttgagggaacaaaatatactaggaaggatgcaagtccagtttggtctaaaccattgtacgaaccaaaaacaatcaataaagtaactcagggctcacaaatggtcgataatatttctaaagtttcagttctagaggatgagcaaaaggatttgatgatgggagatgtactagaggtacaagacaagagtctcactgaagggttgaatttcagatattttaaatcacgtttggagtaacaaaaaacaaatgtgagaaggagctcaattagctccaactgaatctagtgttattagggatactttggaaactccaattcaatctttaagatgtaggattgatgaattcatggaaatcggcagatccatctatgaatttagtatggtggtgtttcctaggaattgacaatacaattttacttggtgcaaagtgtcttcggaggtgtccctttctttttcactcggaattggaagttttaatattggcaataaaaaatatcctttcaagaaggataaagtgtcaggcatttgaaacagataattattcagagtaagttttgatggtacagtcccctgaagaatgactcgctttctctaattttttagaagatcttgaattgctatgtgtctccttttcttgctttcttctatttcatgtttatgtaatactaaggcaaactatttagcacaatattctaaacttttattttctgaagttattttttaaaccctttccctcctaattggacaaccaatcatggaattagtttttacgtaatgttttaaactcactatttcacctttattctgacctgttaatggaagacaactatgactttatacattgaaatgttgtcaacctgttatatattaatgttaacatagctaatgacctatcaatgtacgtaaagcgaatgtcaatcatattcgtatccgttaatttcatttaggaaatcaggctcattgccaatccactaagaaacatctctgatagatccaaataataaaaataatataatatgaagcaaaatagaacgaaatatctcacgcggaccaaactttgaactttattataaaacaaatcagcacgtgaaagtaatggtcggttcggtccaagatgccaagaactcctccggtccatccatcaacctaaccttttttggatataaaatttagcaaattccatttccacgaccacacaacaacaacacatccactcgaattttctatttccgaataacaaaaccggtaaactcatcacaaacttaagttactttgtagtttgtgttttgtccttttatgtaatgaagaagatccaactaactactactcaatatttttgtattgaccgttgatttctcagatctgacttttacttctccttcttccagatcggcggagacatg

SEQ ID NO: 13290 - DNA, 3000 bp, Unknown
  misc_feature (1)..( 3000): cDNA_ID_2702603_gDNA_ID_2214612_Annot_ID_135777 3000 nt of promoter + ATG
acaactttgagatcaaaagcggtctcattgcaatggttcaggggaacaagtttcatggtctgccaatggaggattcgctcgatcatcttgacgagtttgaaaggctctgtgaccttactaaaatcaatggagttagtgaagatggtttcaagtttcgcttgtttccattctcacttggagataaaacccatctttgggaaaagacgctaccccagaattcaatcacgacctgggatgactgcaaaaaggccttctttgcaaaattcttctccaactccagaactgcaagactccggaatgagatatccggattcactcagaagcaaaatgaaagcttttgtgaagcttgggagcgctttaagggttaccaaaccaaatgccctcatcccggatttaagcaagcttctcttctcagcacactctatagaggcgtcctgcctaaattaaggatgctgctagataccgcttccaacgggaatttcctgaataaggatgttgaaaaaggatgggagctagttgaaaacttggctcagtcggatggtaattacaacgagaactatgacaaaagcatcagcaccagctctgaatctgatgacaagcaccaccgagagattaaagctctcaatgacaaaattgacaaactcctccaagtgcagcagaagcatgttcacttcgcctctgaacacgaagtcttccaaatccaagagggggagaatgatcagtgcgctgaaatcagctatgttcagaaccaagacggctataacaaagggtacaacaattatagacccaacccaaatctgtcatacagaagcacaaatgttgctaatcctcaggaccaagtttaccctcagcagcagcagctgaaccaacccaaaccgtttgtttcttacaaccaaagccaagggtttgttccaaaaccgcaatttcaagggggataccaacaacagcaaccaccacctggtttcacaccacagcaatatcaagcctctacacctcaggaattagacatcaggaatatgctccaaaagatcatgcaaggccaaggcgcgggggtaatggaagccgctaagaagctggctgacttaaacatcaaaattgacagatagttcgttgaaatgaatagcaagctcgaatcattgagcacaagggtacgatatctggacggcatcaccgcttcaccacctgttacaaacaacccatgccaggtttcaggaaaagcaatacaaaaccctaaggagtatgccactgcccacgcaatcattatcagacatgatcgagagctgtcaactcaacatgtctctacatcaaacactgaggacagtgtaattcaagaaggggaggcttccgttcagattgaagtctctgttgctgagatcgactatgcagctcaaactttctatcaggctcagtctgacttggaggagaaggctactataatcgagagaatggtaaaacgattcaagccagctccatcaccttcacttgctcttccatggacgttcaggaaagcttggaaaagcatatatgaatctctggcagaaaaacaacttgatgagatggaatctgtgatgcccttagtagaagtcctcaagttgatttcagaccctcacaaagatgtgagaaacctgatactggaaaggctcaacatatatcaggattcagatgacgaagaagatgtcattatgcatcaagccgctggtgagaggattattcaagagaagctggaagatcctggatctttcactctgccatgttccattagccaattgactttcagcaattgtctatgtgatctaggagcctcagtcagtttaatgccactctctgtggcaaggaagctgagattcgttcagtacaagtcctgtgacatcaccttgatccttgctgatagaacttcaaggagacctttcagcattctagaggatgtgccagtaatgattaatggtgtcgaggtgcctactgattttgtcgtgcttgagatggatgaaaagtctaaggatcctctgatcttaggaagacttttcttggcctcagtgggagcagtaatagatgtcagatttggtaagattgatctcaaccttgggaggcacgacaagttacagtttgacatcaacaaatctccaacaaggtcaccaacagaaggaaaaaccttagagatttagagagcggttccatgtgaaggccttgagatcacaatggggaaggagcaaaatttagttcaaactcagccttcgaactcgactactcgatcgagtataccctccacacttgattggctggagctccaaaggaagactgatctccaaaacgggaacattcaaaagctgaacttcacagttgaaaagcttagagacaaactgagtcaaatgcaaaaggagggttaacctcagctcaacactgataagatttcaagaaagaagatcacctcgaattgatctgaagagaaagactatcctctagaggaggaagcggcttactttaaggaaagaggaattgaatactcagctgtacaactgtcaagggaggattctgagtatgatgttgagatcagtgaagaggaggacttctcaagttctctctatcacattttctccacttaattagtgtgaggagtcaagctagagactctaaacaagctcacttgggaggaaatcccatgactatccctgtatatactttttatttatttgttacttttgatttgttatggttgtgtctttgattctctggaaatgaataacagctggagtgatcaacatggatgtgatcgagtgttcaaatgaaaattttacaaattttgataaaatactcgatcgcaacataggagtaaaagctcggaagtgcgatccagcggttttgagataacaacttcatcaacatcattttcaaactactagatcgcaaggaggagtgaaagtgtccgcagaacgtcaatgagaaaccttgctcccataaacttcactggatttcaatctccaccgaaactccaaaaagcccatg

SEQ ID NO: 13291 - DNA, 3000 bp, Unknown
  misc_feature (1)..( 3000): cDNA_ID_2713393_gDNA_ID_2214612_Annot_ID_135782 3000 nt of promoter + ATG
tgcaagaagaccgctgatgcatccaacatagccaaactatttttcaaggaggtagtgcgccttcacggggttcctaagtcaatcacttcggatagggatacaaagtttctaagtcatttctggtctactctgtggaggatgtttggaacagctcttaatcgaagttctacacctcatacgcaaatcgacgggcaaaccgaagtaactaatagaaccttgggaaatatggttcgaagtatatgcggggataatccaaagcaatgggatttagctttgcctcaaatagaatttgcttacaacagtgttgtacatgtggttgatttggttaagttaccaaaggctcttgggtaagtgcatcagctgaaactatggctgaagagattttagttgttaaggaagttgtcaaagctaagttagaggctaccgggaaaaagaacaaagtcgctgctgataaacgtcggagattcaaagttttcaaagaaggtgatgatgtgatggtgctccttcgtaaagggagatttgcagttggaacgtacaacaaggtaaagcctcgcaagtatggcccgtttaaggtgttgcggaagatcaatgataatgcttatgttgtggctctcccgaaatcaatgaacatttccaataccttcaacgtagctgacattcatgagtatcatgcagacggggtcctttatccagaagagaacttgaggacaagttcttcagaggtggaggagactgatgtaggagagatttagcagttttacatttcttttcatatttccttatttcaagttttctattttgcttagagttttctattttatgatttggtttcttctctatatatagaaagaccctaagttttttgctcgacacgttttatcattttaattaataaaagcagagagtttttctctaatctggtggatttccaaagtttcaacctttcaaattcgacgcttgcgaacttgattcatgtttaggcatagtgattgctattcctagaggttccgactccgtaagtattttaattctatataaataaatgaagaaaaaagtaatcataattacccaaataaaacagtttgtttatattcctttttaaaattttaagtaacatcgttaatgtgcttagtgttctttatgttttgcttcccgtcaatattaaataatctttacatggaaattaatcggtctcatatataaaagagaaattgaagacgattaagatgctattaactttatttatgagtatgtattatgtgaaacaccttttatttataacttcaacataatcgtttctaatctttcaaaaaaaactgcctaaatatttttaaatcgttacgtctcaaatatagtctttttaaatatagttaatttatcaaccttatatatttttggataaaaaacatgatttatatgatcaatttagatgtatttttagtattagaggttttcctaagaaaataaatcatgtttttatgaagtgtaagtttctgaggttttttcacaaacccccaccatctgttaatgcattgggtctaacttcatttgatgaccgacttcaaatgaattatttacataggcatgaacaaaattttaaattttgataattaaaataatctttaacaaagaaaaaagataattaaaataatcacagttttttttcttttgagaaatataaaataatttagaaaaattcaaaagaaaacaaaaataaaagagggagaaagagatgtggcatgagtgatgggtgtgtatgggagtgagtgagagctgtgaaagggaagagtcgcagagagtgcagaagttttcagagtttgcagactcactcattattttccctctctctctctcaaacttttttacttctattctcataaatattttttattcaaaacaatttattattcatgcatagtgtttttaacacaagtggaccgtgtacacttaattttataaatgtcgaatgtgttggagctacgagtactacgagtcgtctatctaaccaaagatgtcacattacacgatacggtttatttgattgaagaacaaaaataatgatttggtataattcaaaatttataaactcattacaattggacttctttcattttattttctaatactataatgaatgattaagagaatgttctttgtggttagctaaacctttataacgatctttgtaatagttgcaatatgcttacatgtttctttttttatagttaaaacattaagaagaatagaagagggacataaatcctctcacttggctatttacttactatatttaggatcgaatataaatgctaaaaacatcttaaatattgtagggttaaattcaagcttctttcacaaataagtattttttttttcttattttttctttctcacatatactaaagtttgagatataagttatatgactcaaaagatatcataacaacccaacattagagctgaaatttttaatgtcttattattttgtacacaactttacctcttaagtttcatgacttgttagattttttttttgtcaaccaaaaataattagaacttaatagagtcaatcccgaaggatattgtttacgtatacgtatgtaacttggtagattctcttttcggttaccaaattttctcgtttttctaaacgcaaacaaaagttacaaactcctgaatataatacgtaaataaattaaacataagttatctatgccccttgtcacaaaatttagcttttaagaaggaaaagaaaaacctgaaatggtgcttaagataaaaccaaaactaaagctgaaaagaaaattttaagaaataagaaaaaggaataataaacaagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttc

SEQ ID NO: 13292 - DNA, 3000 bp, Unknown; identical to SEQ ID NO: 13291
  misc_feature (1)..( 3000): cDNA_ID_3029020_gDNA_ID_2214612_Annot_ID_187424 3000 nt of promoter + ATG

SEQ ID NO: 13293 - DNA, 3000 bp, Unknown
  misc_feature (1)..( 3000): cDNA_ID_3029074_gDNA_ID_2214612_Annot_ID_187406 3000 nt of promoter + ATG
aaatccttttgctcatcctctagaactgaaactttagaaatattatcgaccatttgtgagccctgagttactttattgattgtttttggttcgtacaatggtttagaccaaactggacttgcatccttcctagtatattttgttccctcaacagaatattgagaattcatcaagccatccttaactaatcatttcccagccacttcattattctcagcccaagtcccagggaaactctttttgtgcccctaacttggaaaaagtttttttttttatcatattgcctatgagaacagatagctaatatcttttgataaatgtagaaagatggctaattaagagatttataaataaaattaaatattatcttgagaaaattttaatttatagaattattttgatgttttatatgaaattgcattgattcttatgagatctaaaaatatggttaaaatcttataagagtaaaagatgatatttgtgtgtagattagatcggttactggtaaaatggtaggtgatttataagccacttataaatcaggtacataatctaaaatacgttatgatcttcaagatacactatctttaactaaatgaaacattgaaaatttatttcattttgctttttatctattatttgtatattcattaattgtcatttatttttcgccaatgacatttgtatttttgagtctatttttcgtaaaccatttttgggcataccatttttagaaaacattgtttgtttagtttaatataattcaaccattttagttatagaacctcactaaggtggtttaagatgtaatcgaaaagctgtattgcttatatgatttattgtgaatttggatttgtcacgctgaggatgtaatcaatcgaacatgtattcaaaggatggtcacgaatttttgtcaacaaaaacatgcacaattctaggataataaatcctaactacttgaagacaagtaaacctccacaacattcttaatgtctggtttcttctggaacattagatattttaataaaagaggtaagcatgatgttgtaagggattggatgaatagggggaagtttgattttgattttttaatagaaacaaaagtaaaagaaagaaaggtatacaagattacaaagtcagtttttagagaatggtcttttatatgcaattatgaagaatatagactaggaagaatttggttgctttggagaaataacgtgcaagtcacgcctatctacaagacatcacaattgattacatgttcgatcttgattgaaggagaaaaggaagaatgttttgcaatatttgtttatgcatccaattttgtgatggaacgcaaaacactataggccgatcttcgacactatcatagttttgctctatttcatggtaaaacttggttgatatgtgcagatttcagtgaggtgttggaaggagaggatcattcaatgtatgaacatttaccattgatatcacgaggaatgagagattttcagaatttagtccaacaatgtgaattaactgattacagctatatgcttaatcgtactctatgtttgagacaagaggtcattcagatcatttaagatgtagattttatattaaagaggaggagagaagagttataacgatatgaatgaccacctagctacactatcgggctactaagaagaattagaagcaacttgggcttagtccacaccactttatcattccacttcagcgattcacatgttatcaaaaaaagctataggcactgaaaccacaactccgcaggatggggaaatggttgtagagagatatatcaattcgaacaaaggaggcatataaaaagctttgagatttaaaaaccatataatcagtggacttggaggcagcaacttacaataaatggaggagattatcagacattgaagcaggatatttttgacaaaaggcgaaactcgactgtattaaaatagaggataaaaattagaaaagtttctacaacgcagcaaaactaagaagatggccaaatagcagtcactcaaagagagaataaggctgaacctaaaagatatttaaagagttttttaaccgagaagccacaaggctacgaagaatggtcaagtgagaagttgggacatctaatggagtttaaatgtgaagaaaatgataaggcaatgctcacacaaaaaagtctcggagggaaaagtgaagaaagtattgttctcaatgccaagcaacaaatctccgagtccaaataggtcagtagtgggaaaagactttgtggtggcatttcaattcttttctaagactgttttttttgcctaaaggggccaactcaaccatcttagctttgattccaaagaaaaaagaagctattgtaatgaaggactatgcacaaatatcatgctgcaacgttcttaacaaagtcatatcgaagcttctggcaaaccgaatcaagactattctaccacgattcatttctccaaatcaataagcatctataaaggatatgttgatgatggaaaaccacctcctcaccacatagatcatcaatgactaccacaaagacactatttctcctcgatgcgtgatgaaaatagatattttgaaagcttttgactcggttcagtggagttcctactaaacacgttaagatcagagctcttgaattctgagagaaatatatacagtggatttagacatggattactacatcctcattttcagtgcaagtgaatggactaagatgatggtgacgacgagagacaagaagatgatcatctcgagaacgacaacgaaactgggttgttttctggttgtagatgtgttgcagaaagagattagttcctcgaataccttcctaataatgtagaggagcaaggagaaaaagatgacagtgccgaaagccacattcagaattccccagctataggatttcttcccgtagatgggtgacacgatggagaaagtggtagcagagcctgtcacgagcctgttacaagagagaaaaaa

SEQ ID NO: 13294 - DNA, 3000 bp, Unknown; identical to SEQ ID NO: 13289
  misc_feature (1)..( 3000): cDNA_ID_2702566_gDNA_ID_2214612_Annot_ID_187405 3000 nt of promoter + ATG

SEQ ID NO: 13295 - DNA, 3000 bp, Unknown
  misc_feature (1)..( 3000): cDNA_ID_2702623_gDNA_ID_2214613_Annot_ID_135785 3000 nt of promoter + ATG
ggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctggtgatatataagtttcacatgatggtgaagcttttgtctattcttgtttcagtatagataactttcaggttcaactagaaatagataaaatccttttttcttttctctttcttatagtgaaaggaatccggtttaagtatattcattaactttatttagaccattgattcacatatttgtatcttgggaaaatatttcctatactttagaaaatcaaataaagtatgaaagatatttgacttctctttctttgttatggatgctttattcagttacaatttgggatccattctttttttttttcaaataaagcaatagttataacaagttaatattatccaatcaatgttattcaggtaaatatttgattaattatcttgtagaatgttcatgtacatttgaattttgaagtgaccaaatcttatatattggtcatgaatatgatatattgacatttcaagagactgagctaaaaattacttaaaaatgagaatcaattattttttttccattggtccattattttatgcaatgcagcacataataatctattttggttttggtttgggcttctggtagttctgaaaagcccagtataaagcccaactccattaatgcatcttcacctctacgacgagaattgtgcttccgattcatttcacatagggtttgtttctccgatcagatccaatttcaatccttctccgtcagattatctcctcggccacgatgtctctccgccgcactatcctcgatctccaccgtcaaacccagagagccactctctcaaagtctctacctttctcgatgagtcacatctcctccgcatccgccaccgccgccgtgagaaacccactgggaagagacctctcttcaatccccttcgcacaagcccagaaactgaaaccagattcaaccaatctcgtcaccgatcgctcgatttcgtcttcaattgggcaatctgaactcaacaaggcagccaaattctcgcgtcaatcgtcttctcgaggttacactaatggctctttcttacgcaaaatccctgtagtctttcacatacatgaaggaatggaagagattttggcggattatgttcaccaagaaatgacaaggaatttgattgtgatgtctttgggattgttccagattatcgttcttaaagatattatcttgtttcttctctgaaaccaagtaaacatcttttgggatctaaggaacactctcgatcatcatcacctgttaatgaatgaatagtgtgggctaaaaaaaaggtctttccttttatcttctttgttttatgaataagaacttgatgcaatgttgcatttttaccttcaagcttttgttgtgtgttgtttcagtttctggtttcgtgtatttgattctgtaaggcttaaaatggaattctaagcctgttaatcttttgattgaataatgacaacttttctcagctttgaggatcatttaatcactacgtttgcatttcgaatttagctttactgtaatcagaagcacgagagacttacgtgagttttgcagtagaaaagttgtggtttttaccaagtagatggtttgattatatacaacttttgaagagattttctggttttggatttggtgtgatcattataaaggtgatggagactctcaagaagtcacaaacagagaattgtcgatgttatgtttacttagatcaaacatgagattttgaagatataaagctatcaaattgaatcttagttagatgttcatgaacctggttaagatgcaactggaccaacaatattcatgttccatagcagaaagcctgaaaggttgaatagaacaaagggatatgaaacgagttaaagaagcgaattaaaaggcccatctttttatctgtaggcccatacgaattacgattgtactggttcattgattcaaatactaactctctccttatccgaagttttaaaagcatcctaatccaaaacggtgaaataatgacgattaaaaccccaaagtctctggcttggtttccactccaagggtaaaatacaaaacaaaatcaacgaaactgccgtacaccgttgacaataaacaaaggaaaagtgtacattaaagaagaagaagaagaagcttcattgtacgcgtcacctacgcgaacgaggtggagacacgtgtccttcctaccactttccttttgaaaaacctctctctctttcctctaaactcttttgacccttgtttcgcgagctgttttgtacgccattagattgaaccctaaaaactctattattggattggatcatcatcgttaaagctccacgccttgtcccaatttcctctttggttctttccttctggtaagaatccgctctctttctctctttcttttttcttcatatggtacgtcatcggcgacatcaattggctcgatttgattcacctgtagctatcaatcaatccctgatctgtttaggtttgatctcctctgttttttcctagggcttgttattgttgtttctcgaaaaagaagaagaagcgatggtattgggattttagggattattgcggtttgttgtatatatatatatagaagctgagggattttgtgttgtgaagaacatcgaatcctgtttttttccgtaagaaagttcttagatttctccaagtgaaagaagatg

SEQ ID NO: 13296 - DNA, 3000 bp, Unknown
  misc_feature (1)..( 3000): cDNA_ID_2704852_gDNA_ID_2214613_Annot_ID_135786 3000 nt of promoter + ATG
gagattatgataaacaaagaaagccacgtggcgcatgatgtatttttgccgtacttttgaatataaaggttaaaaatgtcgacctcatgtggcccattgaagcccacgaaaaacgcgtgatatataaagaagaatagaagatgagttgcgtaaacaaagcgacttatttagcccctttgttcctaaccgaattttcccaagtaacaccactttgcaacattagttttacacatattggtagctttcgaagaaaacatacgttgaatgacaaaatatatagtacatattaacatatatatactcccacggttcctttatacaaatatgttttagaaaaacaaacttgttttaagattttatgcatgtttttctatgtagtttttaaagtatagttttcgagaaaatatagaggtatataaatgaacggtaacactttttttaataagaaatagtgatacaatataaattttagtacctatattatgaattcacaatagagtcggttttgttaactcgtttttatttttggcttattttccctacattttgttgataatcattcaagttatatatcctttacacttctcaacttataaatggatagacgcgtttataattgagaaaaagaatgcgaaattgataagctgctcaaatcttctacaacttttcatctacgaaatggttagacgcgtttttcgttagaatagagaaagagaatgcgaaattgcgaggacaaaagaagtgaaacacgacaaatcatttttgcaatttacgttttcaaaaggcatatgagacaggagaagttattgtctgcaataaagaccaccgtagtcacgagtgtctccacttgaccccacattttccctatcattcgctctctgccattcgattattgagccctactcttatccgttattgtttttttattctcgttgcataatctcactaatgtatatataacactcgtttgaattttgttaaaactattttgttttattttatataaaattaccgaaattcaatctacaaattcaaatttaaattaggttctctacatatcttaaaaagataaataagtgaaattcataatgataaagccaattttgttttgtaactattattagcttcttttttcttttttttgaagcaatgtatctaatctattctcttctaacgaaagagtattaattattatagacaaaaaaaaatagtattaaacaagcctacgcaaaacacgttcagtattaggttatagtttttagtactaattaaaatatgagatatgagtttttttgttctattagaacttaagaagataaagaatttataagttggtgcgactccgaattactcaaaagacaccaatcatcgcgttatcatcctaatctacaaaacaagaggtcaaattttgcatgtcacgtcacaatattgtacattatcatcacgtttttttacaaagctttagtatatcaacgtatacatttcaatgtacgagttttcattgtactatctatccctaagtttgaattaggtttatcgaatctctttctttatttatatgcaaattttaatgatgtcattttaaattattataagaaaatatccccatacaaaacatggtgaggcttatctcatgcgataatactttaaaataggttatgaatataatcatgtaattataaaaaaagtttttaattaatggggagaaaacaattagaaaactacaaacacatgatgatagaaaagtaggttaaaagtccatcacatggtgctctctcacagaacgagaccctttttgttgaacgttactgttgggcatgagattcacgcaaatcctatgcgacaaataattttctttccataaaaatctaaataaagaaagaacgtaccattttttatatcgaagttaaggactatatatatactattgataagaataatatactcagactatactattaattaaatggacccacgttaataacgatgtctgaaataaccaaaaccccaccagacaattcagacaatatttctttgtttctttatgcatgtgagttatttttattggtagagaaaaaaataaaaacaaataattaatttagtactatttagtacataataaattttaaaatatttcgaccatgtgatctatacttcttaagtacattactataatttgaatctctcacgtaggtacatacacacgtgtgtacacaaaacactattttctctaaaatttaccaagtgcaaatatcgttgtttcactaaaatcaccatcaagtatgtattacttttacgaaattaatcggatttggagacaaattcaaagactagccagatttaggggtgagataatccatttgcaaaatagatttgaaaagagattttagattttctatctttattcggagagaaacaatcaaagtaagtgaacttaaaatcaggaaacagagttaataatcagagtaattattaaccatggttaagttgaataaccaaagtaattaacgtgcataagtaaccatggttgggtttttaaaaagagctttcatacaaacttcaattaccccagcaagtcttgtctccttctctctctctctccctctctaactgtatcttcttcttcttcttcaaccttcagacttttctagttgcaactctcattcaattgttcaatttctctgtaaaaatcaaagctttttggaatctttcttcggcgagatatttcttcaccggcgcaagcttctcttgagcgtgattcatcactgggtttgcattttttcctggtgggtattcttcaaattgttcaaagctccgaccttttcttccttagaatctgattactggaatcttgaagctggagagactcgagtttatatggtttcaagcatcgttgagtcaatcattgagttgtgtagaagaaaggtttggttttcttctccgtttaagtggttttgggtttggtaggatttggtgtaatctgggagataaagaaagatg

SEQ ID NO: 13297 - DNA, 3000 bp, Unknown
  misc_feature (1)..( 3000): cDNA_ID_3055835_gDNA_ID_2214613_Annot_ID_187440 3000 nt of promoter + ATG
aattcccattcaatgatacactttaatttagaggatttaaatgttgtttttataatgggatttgaatggatgctaattgatattggaacacatgtttactatgcaatcagatttcaaatgttagatgattaataaaaatgaaacaggataaaatatattttttaattgtttatgtgaaattttcttctagtgatgtatcatcatttgtttatgtgaaatttgatattccatatgttttagtatatccataagaaactcatatctaaaactgatgtatcattatccattaatattaatttgttgtacaagtgaatgatagttaatatcgcttatatacgtgatttcttgccgcatgtacgtgagatcacacttcatgtgcatccaaaaatttgcattttatttctagaaattaagcgacaaggaagacagagctagagagtactgtctttactctttagacgtgcatatgtctcctcgtactaattactcttttaaaatccttgcatttcattattttctgcgacaacatatttggtcggaacttgccaaatgatgtagctattgtccacgtgatgttttagtttgctataatatgttttaagtggatccttactcaacattaacaccaccctataataataaaaaaaatttaaccattcattattcaagtttgataaccaatatatatccgttgctcaaaaaaaaaaaaaaaaagataaccaatatatatcttattgctgtatttatctttatatagttttattttaatagtttttgaaaactgaaaccataacaagaaagcgtgaatccaaacgcattcctatgaattgtaaattgacaagtagcattttagaatagatggaatctaatctctaaatcgtaaccgaataaatggattggatccgttgcacagatggtttacaaagataatcatattataactaatccgaatttcaatcttgttttgatctatcttttaatagcaaagtccatgagtttagtgtttttgagattcctggaccaaagggtcatttttcgcatattaaaatgaatgagataattacgacaaaaaaatgaatgagataatttgggaaaattaaatatatacaaaaccattattatatgaatgtactaaattatttttaaatttttatatttcacctatacctaatacagaatacagtgtcattgctttgactccctccaccaacaagtgaaaaacctaataaaattttactaatagaaaacgaatagtggaagaaaccatgtaatgtccaatcaaccagtaaatcggtttaaaatatataaaaagtcagtattcttaagtagaaagataataaatttgtgcaatagtaatcaagatagtagatacgccgttggaatcaaatcttcttttcttgaatgtgttgttaacttaagccaaccatttgattctctttactgcagctatattaattattaaacaccaatgcaataaccatacatttcttcgttttatttagtctgtatattcgatcatgacatcattctcccacacttccaaaaaaaaaaaaacaattcgatgacgatatctatattagttgagacatgcatatctacaatacgaatattcgttattctcatttactgatgtggcgattatgatttatgactaaacgagtgattaactatatacaaaaagtaacaattaaaacaaaagtaatagaaaaatattgtgaaatgaaaattccagtgtatcactaatgaagcaattaagaatagaaaactaatactataatgtttatattcccatccgtgcgtttccattcactttaagaaatgatcatattcgcaaccaacaatttgaagcaaacggtcctctactttttattgttcgttttctctttaccgaattttaaaatcacgttaattatctgtataactacctttttgcgttgaagtatttacaacttgagtaaaatgtagattcgtatcaggatacaaacacacaataatactattcagagttcttagtaaattagtttccttttgcagcgatttatttccgtcaagtgtataatatagttaaccaacataacttaagttaaaatttcccaagtatagatataacagaagatcaaatatcgactcgaaactgagttataattaaattaacacgtgaaaataaatagaaaaacaagaaaatatctcgcacgctttccaaagccctagaacaataacgttcgatggattggaaaaatctctgctggtacattcacgagccaacacgtttgcctgccacgttccagacacaagctagaaagtaacggcatcgtcaaatctaacgagactcatcaaggaacaatttataaacatcaatttctttttggtttcacacgccttattatggtaagaaactatttttgcctattgaatgaaaaaaattgataagacatatgaaggatgagacctaactatagtcttaagtacataacatttactactactcaaaaccgttgtctttaattttaacggtccacattcgttctcacaataattgaccatacgtttgtttaaatacttcaaaggaaaggaaaaacagcaagacgtttgtgaggtaatggacaaacgacacgtagtttgaaagatgagaaggaagacaaaaaggcatagagaggaggaagagaaggagcggtttcgtaactgaaactgaaaaagctttaagagaaaacccggaaaaaaaaaaagagaaatattttaatcaattcttctttatcacaaagagtgcctttgtattaatgaattttgatgttgtgtaatgaatacagacataaccgtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcg

SEQ ID NO: 13298 - DNA, 3000 bp, Unknown
  misc_feature (1)..( 3000): cDNA_ID_1446584_gDNA_ID_2214613_Annot_ID_187447 3000 nt of promoter + ATG
tagtttctcaaatataattaatgattaataacatgaaaaggctgagaaaaagtgtttttgagctataatatacaacaataataattttcccatgcaaattaattattcatagaaaatgtgcaaacaaactgaaatacgtatatctccaatctctataaccacaaacacatatgcacacggatatatgcatataaacaagtatgaaatctttcacggatagggaagagagtaagagaaagataagagagaaaaaaggaagaagtagttaataggaagaagaagaaacaaaagagaagaggcaaaggaagatcttttaagcacctgtgtccacttcgtagcgtccatgacttccgacaaagagaaagccagagagagagaaagagagatgtgtgtgggttttgagtaaaggccaaagagaagaatgtttttggaggactttttttttttttttgccttttctttgtttgtgagtgatggctcttctatgcgttgcctttcactttatggatgatgagagccagcgaagaagacggagaagagaagaacccaatttttaacttattatctaagagaatatagcttatacataatacatgaattggttcgagtaaacaaaaaaatcggttctaagaaaactatatatagttcaattatgatttgttgaactaaataaaaaatatctgaatatatagttttttttatataaaaatgataagaaggcgaaatgagtggttatttgttttgccatttagattatcaacatgaaaagatatttgatttagagattatattatgttttgtaatttcataattgtcatccgtctaattcgggagaaaactatggactaaacttttaagaaatttcggttataaaaagaataaaggtagggaaaaaagagaaagttgggtttgttgattttgactagtgatgatgtctcgtgaccgctctctcttgctagctctttctggtccctcttaaaaaatatacttttctaagagaaaaaatcgtgtgtaaggaattatgtcgtcttgctaaaatataatggatataaaactcttatgtgtgtatcataatgcatagtgtgagtggaactatgagttgtatgctatttctcggcctcccattttgtgattggatactatttgttggccatatggtccatcaaatcgcctagctacatttttaaaatcccaataccatacctatttgtatatacaccacatgtcttgcgtacatgtgattagtggctttgacacctaaatttagctcgacagaacttttactatatctctatattcaatatatatatatatatattacactgatacgatctccattttataaaaccgatgagattcgttaatcgttgaaaatccaaaaaccaaaagaatgattaattatactgttctgtaaggtttttgtttcacttacacaattttaatctttttctaaaacaaaaatctatgtttagttattaaatagatttgaagactgtgtaagtgaaaaaattaagactgttcagctattaattgttttgtaaaacaaaaatctatgtttagctatcaaactaacatgttgtaatggtagtgtttttaagactgttttacaattttgcaattaaatatttctaaaatataattttatcattctattattcatatgtttgtttgattacgacattacataatgttaccaaacaataccaatatctagttacatttattttagcaatatataactttttagatgtaatcaaaggatcattacatcatagatatctaaagttaagtacgatttgaataaagcgataaagatcaacatctaattaacattgacacaaaagcatcttattcaaaacataatgtgaaatatgtatgtattagacggaaaattcacgagaagcatatagtaaaaccgtgtgaaccttctaggtacatgattcaacatgagttataaaagcaaaattaatcgtcatttaaaaaacctgatatactacttttttgtaatgaatgaattgactcctttatatcaattcatagattcatttggctacaattatacaacgaataataaaataaaaagaaatccaagtgaaaaagtttataaataataaaatacagtactaaagtaatagattgcatctataaggaattttcgaggaggagaattttgaaaaagagaaggagggaggagaagaatttagaaaagagaagaccgacaggaagcgacaaaaaggaggtggagctgggtcccactattcgtggcgtgattgtgattttattttatttttctttctggatgttgacatctgtcttctcttacccaacaccttctcccacccaataaaaaatctctttccccatcttatcgtgtcgttttactgtttcagctttaccttggctgccgttttgctttaaagacttgtcaattgccacatgtccttctagttgtttggtttagtcggttcgcacattttttcccatttagatatcaaagcttcatagatattttgggctcaatattaaagttggcccaataagatatttagtcatcacgttagaggcctaatactatcaaaaacagaaaacgacattgtttaaaagtgtggcggaataatgatctaactaatactatacagtatagtctatactaatgagattatcgggcccgggtgggcctcgtcgttagtttatcttttaagcccaaaatagtgcatcctctttgtatttatctcttgttctttgaaagcatttatcgaaagatcatcaaaaaaaaaaacatttatcttcttcctcaaatttcttcaactaagtataaggcctaatgggcctcataattagtatctcgtttaaggcctatttctttaatagcttgcttgtattcattctctttgtctttggtttctctgtaaacaatcgatcgaaagatcaatgaattaaactatcattgtttgaacaaacccaatccgggtctatcagaagtaagtgacgaagaggatg

SEQ ID NO: 13299 - DNA, 2543 bp, Unknown
  misc_feature (1)..( 2543): cDNA_ID_3029125_gDNA_ID_2214613_Annot_ID_187450 3000 nt of promoter + ATG
tagttttagtaatttttaatccaactcgggattgattattttgaatacattatttgtttatatttaattatcggtttgtttttggtttttggatttttgagttataaaatgtgtaagaaatatcatatgtttcagttttgtttgacctggatttgcagtatttaaaagtttaaatacggttttagtttggtttaaatgggatcaactagattgatcagctcgatcttaatatatgcataattgaacacggaatcatgatgaatgcacataccgatgacgttcaactggtacaactttacaggcaatcgattagtgcagaaaatgtaaagcaaaagctgataaaaataacggaagaacatttatttccagtgagtgtaattattattaatataggaccaccgtgtatgggtatggcttcaggaaatttgaaaattcccatgctgaaacattcaaagtctttttgagtccgccaatacacaccttgtataaacgaagctattcttgtttgaagagtcctccaaattacaaacaaaataaacaatgaaaagtctgcacgttagtctttagacgaaaacatatttaagtttgcatgatattaagattcaaaaaaaatctacattaagcaaaatgaatgctttaaccaaataaaaagaaaacaacagatagataaccaaataagagttatatgatatagacttataccttaacataattaaatgagtgttgatatttcttgtaccaaataacaaacaccaaacacatgcaatcttataaaaagaccacaagtgtatttactcatgaacatgacacttttcttgtaactgtaatgaattaattatgattagttgcgatattatccaaattactgagtccctcgttgaatggcggtgttttggtcgattaaacttctttgtagtaggctgatttttggtgcaagttaggaaatacaaatatccgatgctctcgctacatatcaacaataagcaaaatattaaaactattaattgttggaaagaaataagtgctgcactcatttaatggttaaatcaaaatttaattagtcgacgttgaaagcaaaatagtttaagaaaattagcataggggcataaattgtccggtctattcttctgctatataataggaagaataattatgcggctattccggaaacttatacttaattttgtttattgtaagtgttagttggtggtgggaactaaacttttgggcttaatcatgaaccatgaactatacaaagctgtcttttggccgttcgttctttttctttattcagtataagtctagtcatctctctaactaaaatgtatatattaaaatttacgagttagttaccaattcatcaaataaaacccttcaaaatgccaaagggtttcgccgcttgttaagttgagtataaattagaagtgcctaattcctcttgcgccgaccctaaatgttcttgacaaattagaaaaacatgacagacaagtttagcttgtttcttaagtgaattagctatgaagtcctgtccttgataccgattgtaataatatatatgtggaatagtcgagtaatgaacataaataatatttttttttgtaccaaaaataaaaataaaaaatcatgttgctttgtttcctcgtttaagttgactttacaagttcgtcttgtcacgatagttgaaaactaatctgcaacgaagaatatttcggttgccgtatcaaatgcaacatgtatcgcgttaccaatagattacgctgttaatcttccttatgcgtaaagataaataattaactcgacacctaacttatattaattgagaactataaagactatgcaacatattttgtggtagataagaccataatattctctcagtttttttttttttgtagataaacgtataatttttggtttatagaaattagaatagtaatagaagatttatcctaactctaatatttttccttggtaattaagttccgaatgtaaatgctttattaattactatttatctaaaattagtaaatatataattttttagaatttttttcagccaaagtatcaaaaaaatctctataaatctaatgaatattttatcttcttctaataataatattttttgccatgtggattattagctttaaaagaaaatcttccaaatcagcaatcaaagaacttgtcaaacaactaaatcgccgttacctagatttataaaaatcacccctttgattgctgagtgacctcgtccccgtcacgccttttttcttaaagaataatttaagaaaaaaataataatatctcgtcgtccttttaggctttctccgattgttcttaatattcctccaaactttctctcaatctccgtcaaaataatcactctctctttgttttttctcacaattctccgaacatgcgtttgctttctttattctctaataaacctagtaaactcttcttcttcgttactactatataatatagcggagagttttggaaccagagagaggttttacgtttttcttattttatttctctccatg

SEQ ID NO: 13300 - DNA, 3000 bp, Unknown
  misc_feature (1)..( 3000): cDNA_ID_3029129_gDNA_ID_2214613_Annot_ID_187445 3000 nt of promoter + ATG
tgttggcaacaaaccgaattgccgcccaacctcctactgggactccaatagtgttcaagtaaggaggatcctccaggttaaattttgctgtttgttgatcatagtttcctgtgccatagccaatgacataaaagctgtgtccatgaagatgaattggatgattttctgttgtgagtgtgccagtattctggaagatgatttgtatcctgctcccatactcgaaaactattgctctggtcccatttgcagcctgcgtgtcattggctatgtcattgggtgccccattgacaaagtcataggctttttccggcgtggttgggaaatctaaagtgaagtaaccttccagttgcttgtaatatgcttccaaaatcgagactttaggttcgatgaagcttatgttgttcattgaagctgctagtcttccttttctgggcccttggcacttgttgtttggattttcagagttgcatttgtttacatttagcccgattgtgataaagagatgagcgtcaatgtttcttggaacatcaactgcatttagacttctgagcccatccatgacagtcttaacagcaatattatcattgaaaataggtaacttagctggtactgttacattgttaggcaatgcaccaatgtattggaaattagctattgctgatgtgttttgaaacttgacgttctttgcagactcgtacggacccatggccatggagtatctcccaacggtttgatcagctgtgacaagaatgttcattgtctgtccaggtacaagcatcacacgctctgttgtataaggcttggtgtattcgccatctacttccactatggtcaacctgtgattagctatggtgaagaaggtctccatgttaataccagcatttatcagtcttagcaggtatatcttccttggtactatctgaatctcataaacatctgaaaaacaaagacataatacacaagaatcaggaatctgttttctcgttgtaaattaatcatatcatttttcatctgatatttattacctttagaggagcaattgtagttaggtcctggttgaccattaattgtgaatgcatctgctggaggaggaggtcctccactttccagtacatgttgttcaagctctaccacgttcttaagccaatactctcctagatttattaggagacaaacaagttcagtgataccaaatagtgaatgagactaactttattaagaataaagattacctaggagaattgtatgctcgttgaagggtttcttgaatgggtaaggaacagatgctttaggatatacaataagcggaccatatactgtagctctaagccaagaaaagtgtgcatgccataaaaatgtgcccttttgttgtgccactttgaagttgtatgtgaaactttgtccactctgaattggacattgtgtgatataagatggaccatcataccaacatgatcgtttttgcttaataccatgcctgcgcataatagaaacaagttttgttagtctagaattcgtttaaaaagcatttatattttatgtatatgtgtatatgtacatcggcataccaatgaattgtggtattatagggagtcatgttgatgactttaatgacaattctgtcatcttcttgagcagatatcgccgggccagggaatttcttgttgactgttacaatctcgtttgtttggcatagcctggtgagtcttattgtttgtacctgttagaaaaatcagtgacacaacaacagaccactgtttagaaatctgaatacagagaaaagaaaaagaaataggcatgcatgagatgaaaactgtgttcaatattgattctaatttgaataggaagttaacattttgcgttgctgataccttgaattggtagaatctagttgcagcgccaatcctgccaatattcattacttgaagagtgaacaagagaaagctaagccggaacaaggacgggacagctgaactggtcatcttgaatggaaagagacaaggagatttgaggttgaaagatactgcttaatgcaactggtttttatagcgtctgaaggcgaaaaataggaaataaaataaatagagttgaggaaaagtttcatgatttggagagttgggaacagagacattagtgattataaggtgttgggaaagcgtgacttgtttcttgaccccagcgtgagattgaaggcaacacacgagttactataaaaggagaaagatactcttagttagtgtctgctctttgattttgaatcagtaaaagctttatacattatgatgcaggattctctaccaaaccgctgactgatctggaccaacccggtgacctaatgactatttcttttgacaggtcgttaatcatcaactttaggatcagccgggattagtgaggtgcatgatttagcatgattagagagtgtttagtagggtcgtgttggggttttttagagtgttgaaagagaaagaagaagaaagagtaagaagggatcaagcttcttggtcggaagtttggatggtcttaattctttattggtcgtgtcatcatcaaaagttcgtgcacgccttcatttgccaaagagaactcttatttatttattttttttttttcttctaaattttgtttaatttctgaatttttttttccttatattgtaagaccactgatactgatatttacgtaaatttcttatttgatttttaattacgtaaatttctgatatttacgtgttttttttccattaaacaacacaacagtcatcatagttagcaaagccaacacaagtgtgttccttattatttgcgggtctcaacacttcttcttagcagcaacacttcttatttgcggatctcgtgacaatttatttacgttttggctacaataatcaaaattcacaatttctatcttcacaatacacattaaattagggaattataatttttacatcataaaaatacacatacaataaggaggcccaatgagatatgggcctaaatg

SEQ ID NO: 13301 - DNA, 3000 bp, Unknown; identical to SEQ ID NO: 13295
  misc_feature (1)..( 3000): cDNA_ID_2702623_gDNA_ID_2214613_Annot_ID_187435 3000 nt of promoter + ATG

SEQ ID NO: 13302 - DNA, 3000 bp, Unknown
  misc_feature (1)..( 3000): cDNA_ID_2713401_gDNA_ID_2214613_Annot_ID_135788 3000 nt of promoter + ATG
gttagatgattaataaaaatgaaacaggataaaatatattttttaattgtttatgtgaaattttcttctagtgatgtatcatcatttgtttatgtgaaatttgatattccatatgttttagtatatccataagaaactcatatctaaaactgatgtatcattatccattaatattaatttgttgtacaagtgaatgatagttaatatcgcttatatacgtgatttcttgccgcatgtacgtgagatcacacttcatgtgcatccaaaaatttgcattttatttctagaaattaagcgacaaggaagacagagctagagagtactgtctttactctttagacgtgcatatgtctcctcgtactaattactcttttaaaatccttgcatttcattattttctgcgacaacatatttggtcggaacttgccaaatgatgtagctattgtccacgtgatgttttagtttgctataatatgttttaagtggatccttactcaacattaacaccaccctataataataaaaaaaatttaaccattcattattcaagtttgataaccaatatatatccgttgctcaaaaaaaaaaaaaaaaagataaccaatatatatcttattgctgtatttatctttatatagttttattttaatagtttttgaaaactgaaaccataacaagaaagcgtgaatccaaacgcattcctatgaattgtaaattgacaagtagcattttagaatagatggaatctaatctctaaatcgtaaccgaataaatggattggatccgttgcacagatggtttacaaagataatcatattataactaatccgaatttcaatcttgttttgatctatcttttaatagcaaagtccatgagtttagtgtttttgagattcctggaccaaagggtcatttttcgcatattaaaatgaatgagataattacgacaaaaaaatgaatgagataatttgggaaaattaaatatatacaaaaccattattatatgaatgtactaaattatttttaaatttttatatttcacctatacctaatacagaatacagtgtcattgctttgactccctccaccaacaagtgaaaaacctaataaaattttactaatagaaaacgaatagtggaagaaaccatgtaatgtccaatcaaccagtaaatcggtttaaaatatataaaaagtcagtattcttaagtagaaagataataaatttgtgcaatagtaatcaagatagtagatacgccgttggaatcaaatcttcttttcttgaatgtgttgttaacttaagccaaccatttgattctctttactgcagctatattaattattaaacaccaatgcaataaccatacatttcttcgttttatttagtctgtatattcgatcatgacatcattctcccacacttccaaaaaaaaaaaaacaattcgatgacgatatctatattagttgagacatgcatatctacaatacgaatattcgttattctcatttactgatgtggcgattatgatttatgactaaacgagtgattaactatatacaaaaagtaacaattaaaacaaaagtaatagaaaaatattgtgaaatgaaaattccagtgtatcactaatgaagcaattaagaatagaaaactaatactataatgtttatattcccatccgtgcgtttccattcactttaagaaatgatcatattcgcaaccaacaatttgaagcaaacggtcctctactttttattgttcgttttctctttaccgaattttaaaatcacgttaattatctgtataactacctttttgcgttgaagtatttacaacttgagtaaaatgtagattcgtatcaggatacaaacacacaataatactattcagagttcttagtaaattagtttccttttgcagcgatttatttccgtcaagtgtataatatagttaaccaacataacttaagttaaaatttcccaagtatagatataacagaagatcaaatatcgactcgaaactgagttataattaaattaacacgtgaaaataaatagaaaaacaagaaaatatctcgcacgctttccaaagccctagaacaataacgttcgatggattggaaaaatctctgctggtacattcacgagccaacacgtttgcctgccacgttccagacacaagctagaaagtaacggcatcgtcaaatctaacgagactcatcaaggaacaatttataaacatcaatttctttttggtttcacacgccttattatggtaagaaactatttttgcctattgaatgaaaaaaattgataagacatatgaaggatgagacctaactatagtcttaagtacataacatttactactactcaaaaccgttgtctttaattttaacggtccacattcgttctcacaataattgaccatacgtttgtttaaatacttcaaaggaaaggaaaaacagcaagacgtttgtgaggtaatggacaaacgacacgtagtttgaaagatgagaaggaagacaaaaaggcatagagaggaggaagagaaggagcggtttcgtaactgaaactgaaaaagctttaagagaaaacccggaaaaaaaaaaagagaaatattttaatcaattcttctttatcacaaagagtgcctttgtattaatgaattttgatgttgtgtaatgaatacagacataaccgtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcgatggcgaatgtggaagctgatttcagaacatcaggtgagttcaaattttgacttcaattttctcaagttttgaattttctttttctcttgggaaaaagtcaacatttttaactctaatc

SEQ ID NO: 13303 - DNA, 3000 bp, Unknown; identical to SEQ ID NO: 13300
  misc_feature (1)..( 3000): cDNA_ID_2713397_gDNA_ID_2214613_Annot_ID_135791 3000 nt of promoter + ATG

SEQ ID NO: 13304 - DNA, 3000 bp, Unknown
  misc_feature (1)..( 3000): cDNA_ID_2702646_gDNA_ID_2214613_Annot_ID_135795 3000 nt of promoter + ATG
gaaccgatttttttgtttactcgaaccaattcatgtattatgtataagctatattctcttagataataagttaaaaattgggttcttctcttctccgtcttcttcgctggctctcatcatccataaagtgaaaggcaacgcatagaagagccatcactcacaaacaaagaaaaggcaaaaaaaaaaaaaaagtcctccaaaaacattcttctctttggcctttactcaaaacccacacacatctctctttctctctctctggctttctctttgtcggaagtcatggacgctacgaagtggacacaggtgcttaaaagatcttcctttgcctcttctcttttgtttcttcttcttcctattaactacttcttccttttttctctcttatctttctcttactctcttccctatccgtgaaagatttcatacttgtttatatgcatatatccgtgtgcatatgtgtttgtggttatagagattggagatatacgtatttcagtttgtttgcacattttctatgaataattaatttgcatgggaaaattattattgttgtatattatagctcaaaaacactttttctcagccttttcatgttattaatcattaattatatttgagaaactaatggagatattagaagaaagtcatgatttgtatttaccctttgttcttggtgttcatctattttcgttttccacgagatcctatatacatagttctatagaatatctaataaggaaaatctaatgttcatgtttcatttttctgtttaattagtgcttaaaattgcaaagcatcgtgcgaactaaccatatgttttaattagcttattatataacttatgtatcaattatggtctatacataattaatatacatgtacattgggtttcaattaagctctaattaactctttaaaattcaaatttttagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtgaagcaaaatgatcaaaaggagattatgaaattagctttctaattctctttttatgatctcttgcctcacatgggttactttagttaaagttgtcagaacttagctaacacaacatagtctttttattcttcctttccttttttttttttttttttttttgttaaaatcaatatttattttctaaatgttttgtagtttggtttgatgataatttgggttggtttttcattttggtttgttgattaattagtatataaatcacggcgttatgtatgggtagaagaatatgtgaatacgaatctctcgagtgttgcatatatggtatatggtatgcactatgtaactatgtattcatcgcttcttctatctgtataagtgttttcataaaaggattattcatatgatcatatctattatcgatatagaagttagtgtgatatactctctagatcgatcacttggaaaaatcaataagcccgggccatcaataaggcagctaaagtaactacgtaaccattggccattgctaagatggttatgtaggcttctaacatgtcctcggtcgttggttcaaaaagccacaatgatcattttacctttctcttagcaattttatatccagttaacaactacttagttcatattttttcataatagtcacatctcaaattcagacgagaaattaccgttacatcaaatcagttaaggcttggacggagaaagagatattttattatatgtcgacatgtcgttattattgtaagagaatccaattccattgaagtaaataattgaaagacacgacggaagaaatcaagaaacgaaacttctccgaaacttaccattgtcttgtctttcttttgataacaatatatgggagtgggaatgcgtcgtattcacggcccattcgaactttccacgaaaccacctaataatcagctgcttccctccctactcacgaaatcgcattttatcttgga

SEQ ID NO: 13305 - DNA, 3000 bp, Unknown
  misc_feature (1)..( 3000): cDNA_ID_2702642_gDNA_ID_2214613_Annot_ID_135796 3000 nt of promoter + ATG
ttgtaccaaaaataaaaataaaaaatcatgttgctttgtttcctcgtttaagttgactttacaagttcgtcttgtcacgatagttgaaaactaatctgcaacgaagaatatttcggttgccgtatcaaatgcaacatgtatcgcgttaccaatagattacgctgttaatcttccttatgcgtaaagataaataattaactcgacacctaacttatattaattgagaactataaagactatgcaacatattttgtggtagataagaccataatattctctcagtttttttttttttgtagataaacgtataatttttggtttatagaaattagaatagtaatagaagatttatcctaactctaatatttttccttggtaattaagttccgaatgtaaatgctttattaattactatttatctaaaattagtaaatatataattttttagaatttttttcagccaaagtatcaaaaaaatctctataaatctaatgaatattttatcttcttctaataataatattttttgccatgtggattattagctttaaaagaaaatcttccaaatcagcaatcaaagaacttgtcaaacaactaaatcgccgttacctagatttataaaaatcacccctttgattgctgagtgacctcgtccccgtcacgccttttttcttaaagaataatttaagaaaaaaataataatatctcgtcgtccttttaggctttctccgattgttcttaatattcctccaaactttctctcaatctccgtcaaaataatcactctctctttgttttttctcacaattctccgaacatgcgtttgctttctttattctctaataaacctagtaaactcttcttcttcgttactactatataatatagcggagagttttggaaccagagagaggttttacgtttttcttattttatttctctccatggggattctttgggattcgtttctcttgttacttgtgtcaacgtttgctctgttcttagttaggatcctgttattcaaaactggattgatttacatggtcaagttatggcgtaggaagatcatcgactggtttcatgtttaccaattctacaaagtcccagaattcaacgacaacgttcaagagaatcatctctaccaaaaagtctacatgtatctaaattccttaagctcgatcgagaattctgatttcacgaacctcttcaccgggaaaaagtccaacgaaatcatcctccggttagatcggaaccaagtcgttggcgacgagtttctcggcgctagagtttgttggattaacggagaagacgaagatggagcgaggaatttcgttttgaagattcgtaaagctgacaaacggagaattctcggttcttatctccagcatatacatacagtatctgatgagcttgaacagaggaacacagagcttaagcttttcatcaacgtcggaatcgatgatcatctgaataagaagaagaagaagaacggacggtggagatcgattccgtttgatcatccttgtaccttcgacaacatcgccatggaaacggatctgaagaacaaagtcaaatctgatctcgaatctttcctcaaaggtaaacagtattataatcgtctgggccgtgtttggaaacggagttatctcttatacggaccttccggtaccggaaaatcaagcttcgtcgcagcaatggcgaatttcttagattacgatgtttacgatatagatctctccaaagtagttgatgattcagatcttaagatgcttctgttacaaaccagaggcaaatcagtgatcgtgatcgaagatctagatcgacacctctcgacgaaatcaacggctgtgaatttatctgggattttgaatttcactgatagtattctcagctcttgcaccgccgatgaacggatcatggtgtttacgatgactgggaaagaacaaattgacccggctatgcttcgaccgggtcgggtcgacgtacacattcattttcccttatgtgatttcacggcgtttaaaacgctcgctaataactacttaggtgttaaagagcacaagcttttctctcaagttgaaggaatatttcaaaacggtgcgtctttgagtcccgccgagatcggagagttgatgatcgcgaatcgtaactcgccgactcgtgcattgaagcatgtcatcaatgctttgcagactgatggtgatcggagaggaactggacgacgtttgcttttagaaaatggttcgagaaagtcgacgtcggaggatgtttctgatgatatgagtggttcgctttgcggcggtggcggaggaagttcgccggcggtgaaggagtttaggaagttgtatgggttgttgagaattaaaagtagtagaaaatctggatcgttcgatgtggctcgagagatgagggacggctagtgattaaaaagtttttaaaagtcagcagccacgtgggttggttttattggttgagagagagtctggacaaaaagcgtagactagagaaagttgttactctgtttttattgtttttgggttttagttgatgtacagaagtttataagattttgcttttgagtccccaaagtatgagattctgagttttgagcactttgtaattgaacattttgggccggttgtaaaacaaaagcccatagcgttaagcggattaataattttaacggaatgacaaatatgcccttcatggtaacagcgtcaataacacgcttttcggttcatcattataagattttgtgtcattaatacgaagctccgtcttcttcgccgagcgtcgtcgtcgtcttctaggtttatctttctcgtcgtcgtctcttcagattcttcaaggtaaattgaatatctccctcagaagatgaagatttatcgaatcatcaaagatactttgcgagctcttcgagtataaatgttctgatctttgttgtctttgtttatgttgatcacaattggtgttaggaattcgattgcttttgcaagaatg

SEQ ID NO: 13306 - DNA, 3000 bp, Unknown
  misc_feature (1)..( 3000): cDNA_ID_3029252_gDNA_ID_2214614_Annot_ID_187461 3000 nt of promoter + ATG
tattccggtctttggatcttaaaatacgtgtaaaatgtggtgtgtttgagtttgtgaagccctggtattcaattctcaacctctgtcctcttgtctctttttaggttgacgaagttgacgatgctttctctgcacttcaattatgagttttccaaattcgtttttttcagaatttgagagtcataaaggattttgtattgaacgaatcgttatcttttagcatggctaaaagggccttcttgtgccatttacttgttaaaatacaatttgattatgcttggtctctgtacgttctgtttttaaataaccaaactcagtgatcaataaagtgtgccagtgattacttgatgtttccttgaattcgcagtaattaaacataagagttaggagtcataaacagttaagaggtagaagaaagtttgagaaataagtgaccattggatacaactttttctgtttgaaatgttattgtgaccgagggacaaatcttttgaggtgtagaaacaacagagtcgattaaagagttatagtgattaatgctttgcgtagttgtctttaggaaatgttcttgatcctcctctctctctcaaaaaagatgggtcaatgttctgtttctgcgtttcgtccatatacttcaggaaatggtattcagacatttgatcattccctttaacttaaacaacaatagggctattacaccaattcactcttaaaaatactcatcatctcatttttaaagaactaacacatttaatttgttaagaaaagacttgtgatttgggatttgataatgcttaaaaaaattaatcatgagattatatcccttaatctctcgtctatccttgatggatcaatctgattgcttggagatcaaattgtatgtgatttttttttaagtttctacttcgttgtgatttatattgtttctatgttcagggcagatttcatgtagtgatcaagctcttctctctctattctagagaaacttcatacacaaacacaactttcaactttcaggaccgttcgaagaaactgaaattaaaacatggaaaggttccagtggggaacatcaccgttgatatggtatggattctaatgttttttgtgattacacaaaggctttatcttttaaacatactcgtatatatagttttacatgtggtatttgtgaaggtacttggtggaatgagagggatgaccggattacacaatcgtaacctcattgcttgatgcagatgaggtatggttataaatttgaatcatatagataatcacaagcttttgtttcaaactgggagtagataattaaatcatattattttttcaaaatttctgttatatagattgaaggctgaagaactgatggcttaaaggacgagtgaaggctgttacctccggagactgcttagtgatcacggctttgagccacaacagagctggacctccaccggaaaagaccattactttttcttctcttatggcacctaagacggtgagttttaatctgttcttttaccagatattagtgtttgaaacaaaagcttgtgatcatcccaaccaaatgctgaagctgaaaactgaaatgaaaacatgtacatgtgaatcgactgtttgcttgagagataatggtatgtgtgtggtgatggtaaaagatttcgattgtttatatagcacaaaacaaattaggttacgattgtgagtctagaagtaaataggcgctggaattttgaggatattccatattttcaaatttgatttgatttgtttaaattttaatttaaaagctgttatggtagataattaggaatagttatttgatttaaatgttatggaatattagaaggaagataaggaatgtagttaggaggacttatatttggctttgctcattttacgggatcgcatataggagagtataatttttggtttaattcattgccaaaattaggaggttatattcttgttgtgattaagactgatttagtatatattcttcaatcaaatcgggtaattgaatctcttttatgttaactacattgattatctgaataatctaaccgagatttgtgcgcttgtttgcaggaccggcaaaatttgaaagttttgaaagagaggtttgggccgaaagagagagaataaatcgatttggcccaaagatccggacaaaaaagcaggtaaaacccaaaaaaaaaaaacgacccaataaatatgggttaagttgtacttcaaaaatgttaagtagatatgaaaacttagttaaggtgtttgtttgaattatgttaaggaagacgaacaaaaggacatgatatgcttagttacacaattagctaccaaacaacatcagattaaatcatcacaaatcttcttcttcccgccctcgagatgaatcttgtgtcttcaccgccttctattgagtggttttgctgaagatgaagtgctaattgttggtcttttagcacctgtggcaaatcaagagatgacttatgagcaaattggcactaaagatctacgggagattctactgagtcgaaacaagcatctacttcatatgagatcttcatagaaatctaagtaagctttgattagagactgctatgagtgtaattagaggcaagcatatttggtttttaggacacaagtcaaagagttgatgtatagagacattatctgttaaagccttagaggaagagctagtggcaattgacatacgagacggtctggttttgcctggtggtttcaaggtctgctttggaatcttcgatggaatattagttctgcttttaaaatcccaaaacaaaacaaatataagaatctgtaaatgccttcagattgttctcttaatgtgtgatagtagaggatactaacctgtcttttggttcggttttccccattttcactgatttctcgagtttctcagaagtcatgcgttcttcaggtcgttctattatttcaagaggctaagcagtttcagggaatagagtcaactctactgcactgctt

SEQ ID NO: 13307 - DNA, 3000 bp, Unknown
  misc_feature (1)..( 3000): cDNA_ID_3029195_gDNA_ID_2214614_Annot_ID_187479 3000 nt of promoter + ATG
caaacaacaaagtgtaatggattttaatattaacagagtattctttacaatggcagacatattaggtcaagtggtcagtgtggggaaagtggatgagattatggctaaaaacaaaccgaacaaaaaactagagtttcaaaagagatctcgtgcaagtcttctcatttgtttttatataatttttgattcataataactatattttcaaataagtaatattgaaatcgtttgttactatattgaagcaatgagcgtttgtcttgtactttgtggggtgtgtttgctgagaaagtatttattgctttaaaaagtgtaaagtatttagtgctaaaatcaataattttaaaggtattcactcttcccttaactatggctaaagtaatcatattggatgtatatgtgcatgtcttagttaacatatattgtctaattcagttaactatgtgcgactagtattacaagtgcttttgatgtttcggaagtcataatcaatccagttcatgttcctgaggttgaactcttcgtgaaatcgtaagtgcaaaatatattatgaccttctttgttctgttttaattcacaaacatgttaacctgacaaatgcttatttgcagactcccaagtgatggtcttgctctcactatccaagataattatgtgaaccgtgacatcattaaggttaaatcagataatttttttaattatccttccaaaacaattgttgctttacttcaagggagagacgtaagtatatttccactaattcataaattactgtgtttagtttaagtacctataattgtgattgtattgaaaattaggttgggcaatggagaatacttggttccatttttgcctttgataccgattggggatggttctattttggatgtcctaaatgtaacagaaaactgagctggttaaaaaatcaaccagcactggtaagatggtcaggatacctatgaaacctaagttctggtgtgacaaatgacaaatgtcaggagagcatcacaaatgtggaggaaatgtaagaatgttttctgttactcttttatcttgtacaagataaaaaaaattgtttctattagtatatagaaaatataaaggtttataagtgtatattaatttgatatgtacaatacattttattccacgtacaagcttcatatttgtgtaaatgaccagacagctgaaattaaactcatggtgtttgaaaataatgcaaccaaacttattggaaaaacttctaaagagttagtggatggacaatatgaagaggtattaaatatatgttgtcattcaagtattagctatatgtctatggtagaatgaaaagtactaatgtaagacagtctatagattgaggatcctacgatcatacctgatgtcatcacaaatttgtgtggaaagacattttactttctggtcagtgttgagaaagccaatatttatggtggtaaagatatttacaaagatgcattttggaacagacatagccaaagaagaatcaggtttgcttgaagacactcagtataatccatctgaggaacaggtatgatcatattcacctaaatacaagttgttatgcttattaagtgttttgtactcatagatcaaataatatttctcaatttttattgtatagggtcaattgatgttaactaatagcagcgagaactgttcagatgctacgaacaatgaacagtctactccttcatctaagcgtggttcgacagcgttgtctaatatggctgatcaatcgagtactactaagaagttatgctctagggttagctcagaaaatggagatgatgagattggaaccaatgtgataatagaaaatgctgatgaggttaaagttatttcaaatgatgctagaagtgtacttataaaaagagtagttaaagagattgagccccaaacctcaaaagctaaaggatcaaccaaagtgaagacaaaaagatacaagaaataaattagttatatgttttcacagttttttttttatggttttggatttaaaaaaaagtctgaaccttctgactttgtttatctttttcaataagtattaaaaccattttcaatttttatgctgctttatacatttacatgtattgctatttttttgagagattttatttctggttttcactttctttgttctactatatatttatactctttatcctaactttattttcttattgaaaagcaaagaatcggtctctaaattatactgaaacagatgaaaacatcaaaagatctttggaattttagagtaaatatacttgcatggtatattaaataatttttgaaacgtaagatgtgatatatcagaaatataattgttaaatctgaattttcaaaaataaaccaaatcattggatctggaaaccctcaaaagaagctgtctaaattcaaaaaagtaatcattcattggcaaaaatttgaaattcatttctgatataattatttccaaaaaataagaagttacgtttattggaaagattaatagattctcttcttatctcattcatcttccacataagaaaaaatagtagagaagaaaaagagtttttcttcaatgacaaacttcaagaacttctctgatttgcgtcctaaaaaaacataatggtttgtctttgttaagctactgaggttgtggaattggcctcctaattacttcggggaagaacctactatgattttagttgatgagaaggtatgaaacttatattgaaagtttttatttctataattgttgttatttaccggatctcttgaatataaacatccataacagatttgatgagattttatatatgatctcagggacatcgaatcgatgcattgtctcctctacatgcatacaaagaagaaatgatttccacactaagagaaggaaaatggtatctactctcaaactttgaagtggttgtagctaacccacttgaaagattctcttctcatgtgttccaaatttagtttttacgaaagactaca

SEQ ID NO: 13308 - DNA, 3000 bp, Unknown
  misc_feature (1)..( 3000): cDNA_ID_3029172_gDNA_ID_2214614_Annot_ID_187486 3000 nt of promoter + ATG
atactggagatggatgaggagccaaaagacccattgatcttaggaaaaccattcctagctactgcaggagctattatcgacgtgaagaagggaaaaatcgacctaaacctggggaaggagatgaaaatgaccttcgacattaacaaagctatgaagaaaccaacaatcaatggacaagtcttttggatcgaagaaatggatggattggctgacgaattactggaagaacttgcagaaggagatcacctagcaagtgccttaaccaacgaaggagaagaagattacctacacttagaaactcaagggtacaaagagtatctagacgcccacataccaatggaaggaccaggagagtttgaggaattgattgttccctcagaagaagcagtatcaggatgcaccatgagcctaatcgctgaaaaaacgaactctactgagatgctagaccatggaggagagaatataagttcagatgactggtcagaactcaaagctccaaaggttgaccttaagcctcttccaaaaggtctgaggtacgcgtttctcggtccaaatgatacttatcccgtcatttttaatgatggattaagtgatgaacaagtgaaccagttgttgaatgagcttagaaagtataggaaggcaattgggtattcattagctgatattaaaggaatttcacctagtttatgtactcataggatctatcttgaaaatgaatcatatactagtattgaaccacataggagattaaatccaaatttgaaagatgtggttaaaaagaaaattcttaaattgcttgatgctgatataatctatccaatttcggacagtacattggtctctcctgtgcactgtgtacccaaggaggaatgactatagttaaaaaatgatttagatgagctcattcccactagaactataacaggacatagaatgtgcattgattacaggaaactaaatgctgcaactagaaaagaccattttcccttgccattcattgatcaaatgctagaaaggctagctaaccatgtttattactgttttcttgatggctatagtggtttctttcaaattgcaattcaccctaatgatcaagaaaaaaccactttcacctgcccctatggaacctttgcttataagagaatgtcatttggtttatgtaatgctcctgggactatccagagaagcatgacttcgatattcccagattttattgaggagataatggaggtattcatggacgatttttcagtgtatggatcctctttctcctcatgtttgctaaatttgtgcagggttcaaggtgtgaggaaaccaatttggtactcaactgggagaagtgtcacttcatggttcataaaggaattatgctagggcatacgatttctggtaaaggaatcgaagtcgacaaggcaaaaatcgatgtcatgattcagctgcaaccccctaagacagttagggatatcaggagcttcctaggccatgcagggttttactggagattcataaaagatttttcaaagattgctcgacccctcactagattgctgtgcaaggaaactgagttcaactttgatgaagattgtcttaaagctttccatttgataaaggaagcattggtgtctacacctatcgttcaagcactcaactgggaccacccatttgagatcatgtgtgatgcatccgattatgcagttggggctgtcgtaggccaaaatattaatggcaaacttcacgtcatctactacgctagaagaataatggacgaagctcaaacaagatatgcaaccatagaaaaggagtttttagctgtggttttcgcctttgagaaatttagaagctatttggttggctccaaagtgaaggtctacacagaccatgcagcgctaaggcacatctatgccaagaaggaaaccaagccaaggcttctgaggtggatactattgcttcaagagtttgacatggaaatcattgacaagaaaggtgttgaaaatggagttgcagatcatctctccaggatgagaattgaagattcagtcctgatagatgacactatgctcgaagaacagcttatgttctatgaccttgttaacaaaaacttcgacacaaaggacatgctggaagaagcatatgcagttgaagaagaaaagttgccctggtatgcagatttagtcaattatttggtaagtggtatgatcccccagagtttggatgcatatacaaaaaaaaaattctttagagacatccaccattactactgggatgagccgtacttgtataaaaaggagagtgatgggctattcaggaggtgtgtctctgaaggagaagttcaaggtatactgggacattgccatggatccacctatggtgggcatttcgcaaccttcaagactgcccagaaaattttgcaagtaggtctgtggtggcccacaatgtttaaggatactcaggaattcatagcgaaatgcgatccatgccaaagagttgggaacatatccaaaaggaatgagatgccacagaatccaattcttgaggtagaagtttttgatgtgtggggaatagacttaatgggtccgttcaaccctccgtcatatggaaatgcttatatcatagtagcagtgggttacgtctccaagtgggtagaagcaatagcagcacaaaccaacgatcacaaagtagttctgaaaatgtttaagtccattattttccccagatatggtattccgaaggtagtgataagtgatggaggctcatatttcataaacaaagtctttgaaggtctattgagaaaatatggagttaagcataaggttgccactccccatcaccctcagaccagtggctaagtaaaactatcaaacagacagatcaaagctatactcacaaaagttgttgatgtctcaagaagggattggtcaactaaacttgatgagactttatgggcctataaaaccgcatacaaaacgcctattgggagaaccccattccagatgctatatg

SEQ ID NO: 13309 - DNA, 3000 bp, Unknown
  misc_feature (1)..( 3000): cDNA_ID_3029198_gDNA_ID_2214614_Annot_ID_187478 3000 nt of promoter + ATG
cacaagtcaagtctacggaggtctcacaaccaaaacaggttagaaaagcgctatttacaacggcggatcagtcaatggtggcacaaatgggtgttgatgcggatgggccgtcaattgaggtagaaactgcaaaggaagttctccatgaagagggggaaattacagaagctacaatggtagtaaacaacatggagagttctattccattgagtaatgtgtcgggtgaggaaaatttggacaaggtgctttctaatgagcttgaacggggagaacaagtgttcatgtcaactaaagaggtggacgaagatgactcaatggtctcttctcctctgcagcctgaggatccggttgatgaggtggaaaagtttgcaaaaaaattaatggatgcgacaaggcttcaagaaggtgttggtgcagagcaaatggcgatgcaggaaactgatacgggtaagattggagatacagaggcggctcgcaaagggaaaggaactgcgctacttctggggattagctcaaaaaagcgttatgctcttcttttttcatcacctcggaaaacgtttggtatcacgagtggagagcaagtaaatgaaggaaatgtcccaacacaccatggcacggtcaagggaggtatgggtgggaacaaaccaccaaaaccaaacggtggtaaatgaaagttttaacctggaactgtcaagggctcggaaataaggcaacaatcggttatcttcgggatttgtggaaacaacatcggcccaattttttatttcttatggaaactaaacaatcttctttatatatggaaaaatttgttggtcattttggttataaaaatttgaaaacggttgatcctatcggttgtaatggtggtttagctctttattataataatgattttaatgtttcaattatttttcaaaacaatcggttaattgatattgaagctatttacaaaggtaaaaccattaatcttatctttgtttatggagatccggttcaaaaaaacagagaacaagtttgggagcggttaacgcggattggtgtatcgcggtatactccttggtttttgataggcgattttattgaattaaaagaaaacaatgaaaaaagaggtggtaaattaagacatgcatcttcttttataccttttaagttaatgatagaagattgtggactcttggaatttcctcatctcggggattggttatcttggcggggatggagggataaaaaaccaataaggtgtcggttggatagagctttagctaatgaagattggcatgaattattctgcaacttgttcattgaatatttaccgatgttagcttcagatcatacatcagtgatagctactattgtggataagataccacgtgggaagcacaactttcggtttgataagagatggattggtaaagaaggtttactagaggctatttccaatggttggaaccttgataatggttcaggagagggtaatattattgaaaaaataattagttgtagacgggctatttccaaatggcggaaagacttacctccttacgggagaaaaacaatcgaggaattgaaatctgagttagatgcggcacagaaagatgattcgagaacaagtgaggagataacggatttaacaatacggttgaaagaggcctatatagatgaagaacaatattggtactagaaaagtaggagtttatggatgaaggttggggataataactcaaaatatttccatgctctaacaaaacagagacgggctaggaatcagatcacgggacttcatgatgaaaatggaaaatggtctacagaggataaagatatccaacatatagcgatgtcttattttgagactttgtttaatacgtcgaatccccaggatattgcggaatctttatcataggttaaaactttaataacggatcaaataaatgacttcctaacggcacctgctacagaagatgaggtgagagcggctttgtttttggtgcacccggaaaaagcaccagggcctgatggtatcacaacgttattctttcaaaaagcatgggctaccataaaaatggatatgctttttctggttaactcttttttacaagatggagtttttgataaacggttaaatacgactaatatatgcttgatcccaaaaacgaaacgaccgaatcgaatgacggaattaagacccattagtctttgtaatgtcaggtacaaaaatatttcaaaaatcctttgtcaaagacttaagaagattcttccaagtcttatttcggaaacacaatctgcttttgttgaaggacgtttaatttcagacaatattcttattgcccaggagatgtttcatggattaagaactaatccgtcatgtaaaagaaaattcatggcgatcaaaattgatatgagtaaggcttatgatagggttgaatggaattttatcgaggaattattaaagaaaatgggtttctgtgaaaagtgaatatcgtggataatgtggtgtatcacaactgtccagtatagggtcctccttaatggacaacctagaggactaataattccaaagaggggtttaagacaaggagatctactctctccttatctatttatcctatgtacagaggtgctcattgcaaatatttgaaaagcagagcaagaaaaattgattactataaatcggtcaccataaggatttaaaattacaaatctgtcgtaacataaaatatttttaaggtcattccaacaatttattttattctttattaaacctttcatcaaacgacagatttatggtaatataaatttatctgtcacaacataaaacaactctgtaataacacaaaacattatattttagaaaacaattatgtttaatataatgtttggggttaagaccgagagttatgatgagaatgttctaattggtatgtatttctaaattccctatcattctcttaactcaaacaacaaagtgtaatggattttaatattaacagagtattctttaca

SEQ ID NO: 13310 - DNA, 3000 bp, Unknown
  misc_feature (1)..( 3000): cDNA_ID_2702674_gDNA_ID_2214615_Annot_ID_135801 3000 nt of promoter + ATG
gagcaccggcaatatcaatatcggatggagaagctagcttctcctcttcatgaaggaaaaagatcttgagttggctgcgtttttgtctactgattctacagaaccaaaaccacccctctaaccaaccaccacaggcacccagctaaacaacccaactccaagcacatttccaaccaccacatgcaccccagaagacaccggattaggcaccactacattagtctccacttcagctactttgtctaatagttcttctaaccattgaacttgattttctaatggttttttgaaaaactttatcttttgttgaaaacaatttaagatgataatataatgtatgagtgaatgattttaggaatgttaacttgtttcatgtttttaatcctctttatttagtactaatagcttctcaattcaaaatctaatcaggttaggtaacagacagtagaacaaagagtcccaaatcacttgagaccaacaattttcgtctcaaaactgtcttaagtaagcggcgttgctttttagtcggatatctacaactttctaaagtagtcacaaaccagtcgcttatgtgcgactgaaaactgcggtcagataatagtcgtaaataagcgaccatgttgcgactaatttatttagcgactgtttttttcagtcgttatataggtaaaaccttggtttgcgactgatttgagaccaatttgggggttgcaaatagttggttgattttttattttggtataactacgtggtttgttaatcttagtacaacttgtttaatatagttatttgaagtatccgttaggtataacttggtacgtagatgtactacccagattttgttctgtctcatcttttctctatctttaattaaaaacaaaaaaattgaaaaataaaaaatttcaaaacttaaaaaaaaacgtgggtcaaattgcaagtggatcaaagcatgtgggtcaaactgcaccgtcattgtagtaccccgcgtattgacctcggaaaagaatgaagggcaagaggaggagaggagagaaatgcgcatgaaagaatgaggagggtcgcctatttataaaccgaggaagccagagtagagcccaagtctaaaaccttggagccgaatccattcggtcgagccaacttggtgaccaagtttccatccgagccatgcaagccgacttggagcccaagtccaaagacttggagccgaatccgcttaagaccacgggttgcatttcacgcgcctcctcccatcgttaatccaacccgcaaccttagcttataaataggaccacacccccctttagtcgaacacttagaaattttctcaccgaaaggctgcccaaaaaaaacccgatcgtccgaacctttaggataacccgagagagaaagagagagagcccgagttagagatcgtcgaccaagttaggaggattcgccggtgattgtgagttccggttttagttcttgcatgtttgatttcattcttgcatgttttcgattctcccttcctttaggtttggttttgttatctttgagtttattaaggttgtcttatcgattatgtaacgcccgcgatcctcaataggatcgttggctaggacttggtccgagagatgaaggtggagtctcggacaagtgagaaggagctggccataagctcggacaaaggggaaatcatgcaggctaagctaggatcgtaaagaaatcagctgggtcagctcgcccaaagctcaagctcagctggaaggactgacggttactcaggtcgagtgacagtccagctcgggcagctggacgagtgacggttgagctcgaggtagctggacgagtgacggatgagctcgaggtagctggacgagtgacggactagctgggcggttatgggcgaagagatacaactcttcggaaaggtgcaactcttcggaagggcgcaactcttcggaaaggtgcaactcttcggaaaggtgcaaggaacggatgtattgattcgggaagcatcctttcgccccctatataaggaagggcgcccgggaccattccactcaccacaacacaccgaaaacacaagaaactcaccattaaaactctctccctcttgggagaataaatagtcttaggattcggtagccgggctgtggccggcaataaagaaggagggtcggatcgacctaacctcgagaaggaaggtaagggatcctagactttgagtctaagggttctaggatgtgagtaagtagtcggatccttgaaaggattgactagagggcttggtagtatccgggtcatgtgcatcctacacaagactcggtccgggtagggatcagctgaggcggggacacggctcgacggaggaccggcgggtcttaactgacctgccgagaatcggccggactgatgcgcgatcttcccctctctgaattctctccacggatccgagtagtgtatggcatatagagcattgcatggacttgcatatgattaagtaaatgagattacttatggctctatgactttcatgaacaaatggtgatcgtgggaaggacttggcttaggcgcgagagactcaaggccgggatgatgggtggtgatagttcggatagtctagggatcgattatatgacttgtaatagcttatatgcaaactcataggttgtatcgaatcctttgcttaatcaataaagtatccgattgtttgtttactctattcgtctcatatattgaatcacggaatcatatggaacggattagactaggaaagaacctcataaacggttagggccgagtcacttactgtcttaggtcgagagaactcgtccggactttaggcagtccggatcggggcctttcaagttggtatcagagcatgcttggttctaggactaggtgttgggttaaggggtatcaccactcgtcggcttgagaatctcgcggtagttgttctttactcttttgctattttactaggagttatgtggattaactttggaggtttcgcagatg

SEQ ID NO: 13311 - DNA, 3000 bp, Unknown
  misc_feature (1)..( 3000): cDNA_ID_3029277_gDNA_ID_2214615_Annot_ID_187512 3000 nt of promoter + ATG
cccgtgaagttccttcaattggagcttcaagttaagagctttgataagtgtgagcgagtctgaagcgaaagatatgtggatgaaagctaattcatttgcaacgcgaatcgcagtaagagttgccagtgcttcggccatgaggggagaaggaacaaaagagagcagagtcgagccttgtcggacgatgcaattttgccaatccttgaagagccaacctaagcacgctttattctcaggtttccaggaggcatcagtaaagcaggtaaccagattgtcgggtgagggggcttggaggggtgggttggggagagctctgatcattggattagaagattgagcctactaccactcctttgcctggataattgctagaacaagtgcatcctttgctgagatttgtttcttactaaaaataaactgatttcgtgaagtccatatgatccaacaaatctatggaaagagaggaccattaccaatcccagacggaggaagacaagtaaggttcttagcacacatgataccttttttgatggacactagattgtttcggttcagactttctttgaatggagcttgattccagatctgtgtcacaaatggacaggtgaagctccgtgtcagcaattccggagtgtgggcattcgatagagtctgtgactagacggtgggatagattttcgccaacagaagtgctctttgagccattttcaatagcagaagttttgtttttggggaggtagctaaggacaaaatattagatttccaactgcaatggtcttgctgcaaaaccactggggttgtaggtgaggtctcctcctcagagaaggattcatggtaccccgatttggtgctataagatccatcttttgtgggaagccaagcccatttattagccgcacatcttttactgggtttcagacttagaatatccttctcataggctggcagtaagcgttggatcagggctttattccaaacataagcatccgacaataacagattggaaacagtccaactatgtgattcaaaggtgggggtcccataggggcttgaggagaggtcatggagagccaaggacttctccagaggggaatagacgtaccagagtcaatgaggtaccccaacttgggttttaagaggtctctgccgaagcagatgctgcaccaaccatgagaagcagagttgggaactatgtaatcgagaaagttggatgaagtgcaatatttgcctagaaggaccttagccaacaagaaggaagggttattgagcagtgtccaactaattttggctaagagggcagagttgaaggtttgaatatctctgaaccctaaccctccttctctaaaggactttgtcattgttttccaagatacccaatcttcttttcagtttttgtgtcccaccaaaatctagtaagtgctgactaaattctcttacatagattgtttggatcttgaaacaggacatggtgtacgatggcatagcggaaagaactgatttaagcatagtaagcttacccgcagtggaaaggaagcgtgaggaccagctcagagctcgttgcttaatccgaaccactatcatattgaaaagatcctttttctttctacaaaacaattcaggtaatccaagatacttccctttcccaccttctttttgaatattaagtactgcctgaacccgagtctttgtttcaggagctattttagaggagaaagtaatagaggatttctctctattggtttgttgtcctgaagcttggtcatacttgtggaggatttgtttcagcttggcgcagtttttgggatcagagcgggagaaaaacatcgtatcatccacaaacaacagatgattaatatgtgggctgcgtttggaaactcttaggccaattaagttaccttggctgagggcattgttatacagtccagacagcacttcactgcagataatgaagatgtatggtgataagggtctccctgcctgattcccctttcaggtgtgactagtcgtctagcctgaccattgaggaggaaagaataggtaacaaagttaatacactgcattagccattgaatcaaacgagggtggaatcccattctttcaagagctgcctggataaagtcccattctagcctgtcataggctttgctcatgtcatttttcactaccatgaagcaacgttttattgctcctgaggttttaaagtaatggagagcttcatgggtgattaaaacgttatcagatatagcaagctggggaacaaaaggtgattgattttaagagatacacatatgtaaaactggttgaagtctcttggctagaatctttgatatgatcttgtaataaacagagcaaagagtgatgggtctgtagtctgaaaccttttgggggcaaggcacctttggtattaacctgacatgggtgtgattgattcttcttggcaggacacgtaataaagatagcttggacttcagagatgatttggtcgctgatattgtcccagttagattgaaagaaactcgctgagaagccatcaggacccagggccttgtcaggatgaatagagaaacaaggagttggcattagtatgagtttgtcattcataacttgggagatacatggttttagggttgcattgacagtggatttttttctccaggaattgaggtaaagatttgttggtaatattcagaaataacatttactattttatcctcctcataaactggaaaactttgaatttaggtactttgccagtgtacttcgaaaaagagtacttttgttgctgaaaattgacttttctacccttttgtacttttattgctagtcgttttaaatgaagttcaaatgtttattgctgggttttttttatcgcttgttgcagggtgctgatgttccagtttttgccatagctggaaagtgggaatgttcacaacaaggaaagtgggatttgtgatagaaaatgatcgatttgccaggagcatatgcgttaattctgatatg

SEQ ID NO: 13312 - DNA, 3000 bp, Unknown
  misc_feature (1)..( 3000): cDNA_ID_3029295_gDNA_ID_2214615_Annot_ID_187507 3000 nt of promoter + ATG
taccctgacattacttctccatactaaccacaaccttcccaatcgatgttcttcataattagatagtagagaccagtctttaaacactgaactaactattcaatccgctttgcctgcctttatttttgtttctatcagacatccaaaatcaaatttcccctccttcatccagttcctaacaacaccttgtttactatttttattgaagcccctgatgttccagaagaaacctgacatcaatgattatttggagtgtgacgtttttttagaaaactaggtttttgagtcctagtattctacgttttgtttgatgagacgcatttgtgactatctttagatgctctcggaagagatatcctcagattccctgcttcttcctaattattagtaggtaaagttttcccctcctgttgggattcttcttccaccacgtaatcatcccccttatcctctacgtggtctgatttctctacctctatatcagcatatacttctccttcttctacttcttctcctttgtcactaagacagaaaaaagagttggacaagatggacacttctccataacgcagttcgttggctttgctaggactctttattgttttagtaggagtattccatgtcagagcatccttggactggtgttgtgagttctcaattaactcctctgcattattattcccatcttctttattttctttcaaactctgttccagaccattacttgtctctggctctagatctgccaccttagtttctactggtttggttacctcaactctattttctgcctttttccttgataaacaatctgtacttaaatgaccccatctatcacagctgttacatcttggaggtaaccatggataaacatattcgactactgtatctcctcctttttctgacttgaaagagaaacactttggtaatttcttcgtgaagtccacttctacaaatacttttgcctcctcaaaagttttgattgcttctgtatccgggtggagtttctttggcgttcccaatggacttgttatagcacttagcactttgcaagagaaatactttggtggcacattcttcactattacccaaagtggcatagttttaatctcttcttgatccatatcaactattggagtccatttcgatagcaccacaggaactccgcacaggttccacatacctcttcttagaactcgagctctagtacgttcatctttgattctgaacctcactgttgtgtggttcaccacaaacacatcaatctttaccgatttatctccaagtgtccatatcttattcactaaagcatgaatacccccaacaaaaggagcctttgccaagaactttccaactaagaagtcttcccataatggtttagcttccttgaaaacactatcgggaattcgagccgatggtactccatcaacctcctcaataatcaaaaccactattttagactcaactttgtttttaaccaccgcagcccaactcccatgtggtttccctattgactccaccttacgagcaggtactgcttcttctccaaatcaatatttcccacctgcaacgtaatctcagtagaactcatttccttctccaaaatctgcagaaccccctcatcccgcatcaacacttgacttaagtcattccctgcatcgaacattctccgctatgctgatcgttgtttttgttgtctccggcatcggaacttgcggaggaagcttaaaaccctagttcgcccttttttcgccctcagagcaaaacgatgcgttttagtttttagcaccgatattgacaacttcactttcattttactataatatattatgacatgtggatagcctatgtcaaaatttaatgaataaatattttatcccagaatcatttcaaaatacgagattgaggatgaagatatatgtctgacggacagtgcttctacacacacaatctctaaagatacaaaatacttctcctctctccaaataaaagactctggtagaagcgtgagtactatatatggccatgcaaagataatattaggcttcggcgaatccatttttacaatgccaaggggaactccttttaaagtaaatgatgcattatattctcctaagtctcatagtaacttgataagtttccaagatatccgaagtaatgaatatcatatagagactatcaataaagttggcattgaatatctttgcataaattttgagatgcatatatatattagaagaattgccaatgttatccttcgaattatattgcacaaaaataaatagaatcgcatcaaatgttacagtaaactcgagtgacaatcactcaagtgagtttactagtatatttaagatatgacatgaaagacttggacatcctgattcagtcatgatgccaaaaattatgaaaaattctaaaaccatccattaaaaacaagaaaatatttaaatctcgtgagttttcatgtaaaacatgttctcaagaaaaactcataataagaccatcgccaatcaaaattgggagtgaaagacctgaattcttgtcgagaagtcatggtgatatatgtgggccaatccaccatggtgggtttcgatgttttatggtattaattgacgcatccactagatggtcacatgtatatcttttgactacacgaaacacggctttcgcaagatttattgcccaaataatcaggttagaggcacactttcctgattatgccataaaaaaagtctggcttgataatgttggggaatttactttgcaagcctttaatgactattgtgtatcgaggggaatcgatgtagagcatccggtccctcatgttcatacacaaaatggcatggacgaatcattaattaaacgttgcaactcattgcaagaccgttaatattgagaacaaaactcccaatttttatatggggtcatgctatattgtatgttgcggctttggttcagattagaccaagcgcagataatcaatattcccatttacacatg

SEQ ID NO: 13313 - DNA, 3000 bp, Unknown
  misc_feature (1)..( 3000): cDNA_ID_3029313_gDNA_ID_2214615_Annot_ID_187502 3000 nt of promoter + ATG
ttatttatgcaagacatattttttgtagtttgattaattcgttcgttaacaaatttttaatctaaatttggtttctaatatgttgatataactattcttattagggaacaattcatagatttttcaaaagaaatcatgaatcaacgtcacaacatattccaaaaaatattccagaagctattctagaagatttgtcttcggatcctgccgataggaaacatattttggactatcatcctaatgaaagagataaggtaagacctaaatatctgattaaaggtccttattaacctcgtggacatgattttcctaaacactatcaggaaaaaaaatgagacgatttaatccagactggtttgatctctatagtggttggttggaatacagtgtaaaaaaggataaagcttactgtttgggttgctacttgtttagagattaccttgaaaataaaagtggaagtgatacgtttgcgacgaaaggtttcgatacttggaaaaatcctcagagtttacgcgaacacgtgggattggtgaatagctttcacaataatgcattaaaaagggctgattgtttgatgaggcaaggtcaatcaattgttcatgctttttataagcaagatgacatagtaaaaggagaatacagaatcagactgaacgcttcaattgattgttgtagatatttagtacgacaaggattaccttttcgaggccatgatgagtcagtggattcagcaaacagggggaatttcttagagcttgtgaaatatactgcagggcaaaatgaggttgtaagtaaagttgtgttggagaatgctccaaagaataatcagatggtatgtcccaaaattcaaagagatatagtgcattgctttgtagaggaagtgattagatctataattcaagaagttgatcatgatgtattttgcttgatggtggatgaatctgcagatatttttgataaagaacaaatggtagtggtttttcgttttgttgataaacatgcgacagtgaaagaaagatttattggtcttatccatgttaaggaaacattttctgcatttctgaaatgtgctattgattcattgtttgctaaacatggattgagtataaaacagataagaggacaagactatgatggtgcaagtaatatgaaaggtgaattcaatgggttgagatatctaattttgagagaaaatagttctgcatattatatccactgctttgcgcatcagcttcagttagtcgtcgtggcagttgctaaaaaacattttgaaattggagatttctttgatatgatttctgtcttgataaatgtggttgaagcttcttgtaagagaaaggatagggttcgagatgaatttcggaaaaagctggaggaaggaatcaatcaaggtcaaattaagacgggaaaaggattgaatcagcaactttcactatagagacccggtaatactcgttggggtactcactacacaacattattccggttagttgatttattctcttttatcattaaaatgcttgagtggatcgaagatgatggaactgatagtaccaaaagacgacaagctaatggtcttctcaagtactttaatacctttgactttgtgttctacttacagttgatgttgcttattcttggatttacaaatagtttatcagtggctctacaaaggaaagaccaagacattctgaatgctatgtcactagtgaaatccaccaagcaacatttattcaatctcagagatgatggatgggattcttttcttaatgaagtttttcttcttgtaaggatcatgacattgagtttgtcattatggatggagaatttgttgatccaagaaagccaagaaaaaaaagcaacatgaccaacttgcatcattatcaagtggagtgtttttacactgtattggatatgcaaattcaggagtataatgattgtttcgatgaggtaaacaccgaattacttggttgtgttgcttctttaagccctactgatttgtttcgtgagtttgatcagttaaaagttatgagattggctgaattttatccacaagattttactcgtgttgattggagatcactcgagcatcagcttggtctttacattgacaatattcgggaagatgacagatttgctaatttgaagagtctaggagatcttgcacgtgttatgatcgagacaaggaaacacctttcgcatcctcaggtttatcgacttttgaaggtagttttgactttacctatagccactgctactgttgaaagatgcttctctgctactgttgtgaagactactttgcgcaaccgtataagtgatcagtttctaaacgactatgtggtttgtttagttaaaagagaactatttgatacggtgataaataaggtagtgatcaaaagatttcagagtatggaaaatcgtatgatagctctatagatatattttattataaaacatttttttatattagtatttttgaatatcattttttaaaaatattgtgcctgaggttaaaataaatcatggattcgccactgaggctaaccaatcattaccattatcttttgtaatcatatgttttaatatatgaatttttaattttgtatttttttcttttttatggtatttaaaacgttctcaccaatacaaacatatttattagaagtattataaaaaaatttaaaagtaaataaatattataaataatattaagaaaaaattattatgtttaaagaaaaactatgcttacaataaaaagttaactactgaggaaagaaagatggcgcttgcgagagcgattgcgagggcgatgtacagttacttttagatttggttggacggttacttgacttggttctcggatagtttcgtcgacgtcgtgaggcgtttctgcgactccgattgtgcgacggttatctccatgttgtggcttcccccactacgtgatgcaactgccacgatttctgaaatgcggcgtcgcaacaccgtttccttctcatg

SEQ ID NO: 13314 - DNA, 3000 bp, Unknown
  misc_feature (1)..( 3000): cDNA_ID_1397919_gDNA_ID_2214615_Annot_ID_187501 3000 nt of promoter + ATG
agaaaccactgatcatctctttttcacatgccctcatgcaatacaaatttggcgggcatcggcaatacccatccatgaactcactgattcccagatcagcttggagacgaaaatgacggctctatttgaatggcaccaagaagtacctcgagaatctctacactcacagctacccttctggatattatggcgcatatggaagagtagaaacaaggtcatatttcagcgagagagtaacacttggcaaaaggatctacgaaacgcataccaagatacagaggagtggatactgaatggccacaaccaaggggatagtcgaacaacactggcaggaacgcactctactcgtacccaacacagatggcagagaccggaggcgggatggattaaatgcaactacgatggaagctttaccggacaaaatcaaagatcaacaggggcgtgaattattcggaatgaacacgaccaatacaaaggagcggggaagagttaaggtctgccggtttcaaattcactggaggcggaatgtaaatcactaatttctgcaatgcaacacctctggggtcacgaatacacaagaataatatttgaaggagattgcaagattttggtggatgccttacatggaaaagtgaatcgatttgatattctcaattggctgcatgacatcaaagcttggaagaacaagtttgccgacgtggagtttagatggacaataagagcttgcattgattttacgattttggcgggaaaatatgattttacaattttggcgggaaaatgtgattttatggttttggcggggaaaaatattttacggttttgccgagaaaacatgattttacggttttggtgtgaaatttgcttttgcgggttttggcgggaaaacatgattttacggtcttggcgggaaaacatgagtttgtagttttggcgggaaaacatgattttacggttttggtgggacacatgtttttacggttttgacagaaaatatgattttacggttttgagataaaaatatgttttgcagttttggcggaaaaacatgattttacgttgttgtcgggaaaatatgattttgcggttttggtggaaaaattaaatacaattttaacgtaaaataatagttcgtgatttcctaatttttagatgttttggtgcaatatggaattttaaaaaatattaaataacaaatttatagaaattggtattattacaaaggttatatttgttatttattcattttgactaaacaatctccatccaaatggtccaattaagtccatccaaatgagttttaaaaatttgcctaaacttacaaagtcattcaaatggatcatccaaatgattcattcaaatgatctgttaaattgtcaaaaacaaacatcatttttcatctccacctaaatgatccatctggatggagaaacaaattgagcctcaacctgctgacaaattagccaagatacaacttcgtaatagacaagattttatgttcaagaacaaacccaaaaaaatcctcaactaatttttttttggatgtttaatacccaattatttttggttggaaggtaaatacacgaagtaataaaatcttgcaatttaatacaaaaacaattaattgttgttattttcatactcacgatttcacaataaaaataaaattccaattttacccttaccatctcaattaactattaatttttagatgatatgatattaattttctagttttggataaaaattaattttattaatattttagtttatggtctctcaaatttaaattttcatttttattataattattttattttaaaatttaacataaaaattatagaaaatcaaaaatattttaaaattgtcagtaaacattcttcttagtgagaaactctcttttcgattgtatatctttcatgaatcaaattattttcgacaaaatctcaacctgaatctcatcgtatttctcaaaatttatcaattcataaaaatggcgaattttgtttttagtagcaaaatagctaatcttaacctgaatctcaatgaattagattaattttcgattttaaattttttcaaagagaaaacgactctttggtattgtgacgatagaataagattgtaaaaatgactattttaatataattttgattttctttaatttttatgttaaattttaaaataaaatagttataaaaaatgaaaatgaaaatttaaatttttagacaccataaactaaagtgttaataaaattaatttttatctaaaattataaaattaatatcataccatctaaaaattaatagttaattgagatgttaagggtaaaattggaattttatttttgttatgagatcgtgagtatgaaaataacaacatttaattgtctgggtgttaaattgcacagttttattacttcgtgtatttatcttcaaaccaaaaacgattggatattaaacgtccaaataaaaaatagttgaaattctttttgggttttttccatcttatgttcttctattatgtccccagatgtatttcatccttaattcacactgattacatacgttctaattaatgaaagttgagttaaagaaaaaataataatattaaaaaattcttttgtgatactatattgcccatgttctaagaacggttcatccggatgagatcttcacaacgaacatcatcgtagtatgattaaaaagaagatatttttaaggaggtccaaaagttataagaggtctccaatgttaattatgagaaagattgttgctataattgatattaaaaaaacttctcaagaaaaaaggaagaaaaaaaaaaatcattcctttacgcgtttcgtatctctcaccgaaggaagcttcgtctcttctatataaaaataatctcgatttttcaactccgatcaaaggttttgctaattcgtcgccttaatttcgttcaagcttctacaaaagtcccagatttgttcacctttttcggtattgaatcatg

SEQ ID NO: 13315 - DNA, 3000 bp, Unknown
  misc_feature (1)..( 3000): cDNA_ID_3029321_gDNA_ID_2214615_Annot_ID_187498 3000 nt of promoter + ATG
aacttttttcactcatcacagttgctttttggttcaaaaaaataaaacataaagctttaaaagcaaacagaggtatcaaaacagaacaaaagtatcaaaaaacagaacaaaagtattaaaaacagaacagaagtatcaaaaccaacaaaaaccaaaagacataagagaggatacataagttttaagcaaacactactgagtaaatatgatcctgcttgcatttttccctgcaaagtcatccatcacagtcgcataatcaatcttttcaagcattgctctctcaattgataatatggctaacccattgagcctatcctgtgacatggtggacctcaaataattcttgatcaacttaagcttagaaaaacttctttcggctgaagcaactgacactagaatagtcaataatatccgaaacgaaatccatgtgttaggataacaaccctccactcttttcaaaaaatccaacactttaataggtttcgtaacttcatttggtagcacttctcgtagaacttttagttccataaacaagtcagccccatctatatcagaatgctcaccatgcttaagggatgattcaagattcacacatgatgccatcaagttttcatcatttgcatatgtcaatttttgtaaatcaaacaaaaatccaaaagtttgttcatacctttggaattgctcaaaccttgactcaagagaaattagagcttgatctatgagtgtaaggaagtaattaattctgaaatcctcctctgttgacaatttcatattcccatgatcaaaatgcttctttcttctaatgatcttcttctttttcacaggaaattcagcttctatatccatagcctctgcaattcgtatagcctcagactttgctttctcaaatcatgtctctctatatttttgtaagtatgaaactaatcctttcagctcaagaatagcaacatcaatatcaatgtcatcagcttgtaaagtcttgctcactctgttgacaacagttagaagtcataccaaataatcataccaaaaagaaactcaaaccctccaataccatgtgtttctattcagcatcacttcgtgtttttggatcgtcggtcttttctgccaagtaaagtaaagcatctctgatttcaggagtctgaaaccgtattgctttgacactttcgagatgactctcccaacgagtttgagataaggatttaagtgttaaaccttttaccatctctttaaatatatcccacctgtttgttgaagatgaaaacaaacagtataaccgctgtataatcccaaaaaaagacactgcctttgtagaagaagatgctatatcacaaagcacaaggttggggctatgacaaccacatggtgtgtaaaatgctcttggattaatttccagcaatcttctttgcactcctttgttttttcctttcatattagacccgttgtcatacccatgtcctctcacatcatcaatctctaactccatatcaattagtacttcttgaatcgtagagaacagcccttcacctgttttatcattgacttccaaaaatttcaaaaagaattcttcaaccttaattggtgttgaagaaatatccacacatcgaatgagaatagtcatctgttctttatgactaatatctggagtacaatcaagaattatggagaagtactttgaagcacgaatcgtcttcatgatcataagtctaatctcttgggccagcatacttatcaactcattttgaatcttgggacttagataatgagaatatatctcacctgcaccaatttttctgatatgctctctcatcactacatcaaactctgcaatcatctcaataaaactcaaaaaattcccatttctgtcttcaccaatctttttattttctcctctaaatgctaagttatttttagcgagagtcttcactaatgcaatgatcctcactagtacttccctccaatgaatcttttctttgtttatttcttgttggacatacttatcaatcgttgttttgttctgtagtctagactctaactcagtccaacgagtcatacaaataatgtggtcatggctgccttcatgttcttcgagtcgcttcgaaagatttctccaatcattgtacacactagttgctaagtaaccacaactcttgtcatgtctaaacaatttacagcaaaaacaaaagactttatctaatgtttttgagtaaatcagccactttctatcatgtttctctccatttttctatcataaatcagtagaatccgtgagagaaatgtcttccaattccatctttagcaaaacgatgactagttgataaccttgccactggatctttttcaactattaaaactcttaatctcaaattcatgttatcccaattcgccggataagaaatattggaaggaatgtcttcattctatcgacttttcttcttttcaaagacaacttcagcttgttcttgttgtttattctcaaattcattctcatccacttgaaccacttcatccaaattgtccactttattctctggatccacttcatcagctcgttcttgttggttattgtttccatcagaattaatgacttcagaaattgtaggattttcaggttttttcatgtacctaagaagagaattagcctgtgatcttaccaactcttctcgtctcttttgcaattttcttttatcacatccatgaggttcctttttgatccctaaaggaggcatcgttcaaagtctcaactcaacgctctaacgtacgtcggtcgcttgcttcttcacggcagatggaattaatcagatttttaatggaggaaacctagaataagagaattggttgatgggctttagaagtcttgggttgaaaatcagattttttcttctcaactctcttttaattaagcctcgttggactttaaaatttttgggccctaagccaccgcttatatcgcttacgtcacgggccggccctgcatgattgtctcaatctatttctcat

SEQ ID NO: 13316 - DNA, 3000 bp, Unknown
  misc_feature (1)..( 3000): cDNA_ID_2713416_gDNA_ID_2214615_Annot_ID_135807 3000 nt of promoter + ATG
ggggcgtgaattattcggaatgaacacgaccaatacaaaggagcggggaagagttaaggtctgccggtttcaaattcactggaggcggaatgtaaatcactaatttctgcaatgcaacacctctggggtcacgaatacacaagaataatatttgaaggagattgcaagattttggtggatgccttacatggaaaagtgaatcgatttgatattctcaattggctgcatgacatcaaagcttggaagaacaagtttgccgacgtggagtttagatggacaataagagcttgcattgattttacgattttggcgggaaaatatgattttacaattttggcgggaaaatgtgattttatggttttggcggggaaaaatattttacggttttgccgagaaaacatgattttacggttttggtgtgaaatttgcttttgcgggttttggcgggaaaacatgattttacggtcttggcgggaaaacatgagtttgtagttttggcgggaaaacatgattttacggttttggtgggacacatgtttttacggttttgacagaaaatatgattttacggttttgagataaaaatatgttttgcagttttggcggaaaaacatgattttacgttgttgtcgggaaaatatgattttgcggttttggtggaaaaattaaatacaattttaacgtaaaataatagttcgtgatttcctaatttttagatgttttggtgcaatatggaattttaaaaaatattaaataacaaatttatagaaattggtattattacaaaggttatatttgttatttattcattttgactaaacaatctccatccaaatggtccaattaagtccatccaaatgagttttaaaaatttgcctaaacttacaaagtcattcaaatggatcatccaaatgattcattcaaatgatctgttaaattgtcaaaaacaaacatcatttttcatctccacctaaatgatccatctggatggagaaacaaattgagcctcaacctgctgacaaattagccaagatacaacttcgtaatagacaagattttatgttcaagaacaaacccaaaaaaatcctcaactaatttttttttggatgtttaatacccaattatttttggttggaaggtaaatacacgaagtaataaaatcttgcaatttaatacaaaaacaattaattgttgttattttcatactcacgatttcacaataaaaataaaattccaattttacccttaccatctcaattaactattaatttttagatgatatgatattaattttctagttttggataaaaattaattttattaatattttagtttatggtctctcaaatttaaattttcatttttattataattattttattttaaaatttaacataaaaattatagaaaatcaaaaatattttaaaattgtcagtaaacattcttcttagtgagaaactctcttttcgattgtatatctttcatgaatcaaattattttcgacaaaatctcaacctgaatctcatcgtatttctcaaaatttatcaattcataaaaatggcgaattttgtttttagtagcaaaatagctaatcttaacctgaatctcaatgaattagattaattttcgattttaaattttttcaaagagaaaacgactctttggtattgtgacgatagaataagattgtaaaaatgactattttaatataattttgattttctttaatttttatgttaaattttaaaataaaatagttataaaaaatgaaaatgaaaatttaaatttttagacaccataaactaaagtgttaataaaattaatttttatctaaaattataaaattaatatcataccatctaaaaattaatagttaattgagatgttaagggtaaaattggaattttatttttgttatgagatcgtgagtatgaaaataacaacatttaattgtctgggtgttaaattgcacagttttattacttcgtgtatttatcttcaaaccaaaaacgattggatattaaacgtccaaataaaaaatagttgaaattctttttgggttttttccatcttatgttcttctattatgtccccagatgtatttcatccttaattcacactgattacatacgttctaattaatgaaagttgagttaaagaaaaaataataatattaaaaaattcttttgtgatactatattgcccatgttctaagaacggttcatccggatgagatcttcacaacgaacatcatcgtagtatgattaaaaagaagatatttttaaggaggtccaaaagttataagaggtctccaatgttaattatgagaaagattgttgctataattgatattaaaaaaacttctcaagaaaaaaggaagaaaaaaaaaaatcattcctttacgcgtttcgtatctctcaccgaaggaagcttcgtctcttctatataaaaataatctcgatttttcaactccgatcaaaggttttgctaattcgtcgccttaatttcgttcaagcttctacaaaagtcccagatttgttcacctttttcggtattgaatcatgatgaattcaatcttcggaaagcgaaaaactcccgcaggttcttatcctcctttctctcgatttcgtctcttgtcggatctgtgttgcttattgagtttgtaattagtgaaatattcgatgatcgcaagttttgatcttgtaatttttatacttgatttgaaattagatcaatttaggtttgattctgaggaatatgatctcttcgttgattatgagttcattaggttacatgttgttcaattgtttttgtaggttatatgtggttttgaatcatgtatagctcagtgtaagtaaaatggtttggagttataaagcttttgattgatttgatgattatgagttcatttgttttcatgtgcatagatcattaggttacatgtagtgcaattgtttgtgtagcttaagtgtggttttgaatcatgtatagagtaaaatg

SEQ ID NO: 13317 - DNA, 3000 bp, Unknown
  misc_feature (1)..( 3000): cDNA_ID_2713441_gDNA_ID_2214616_Annot_ID_135812 3000 nt of promoter + ATG
gggttttaaatcttttttaaaatcctttaaaacccttgttaaccatataaaaatctttcaaaaacacttgtaaatcatttaaaactcttgtaaagcctttaaaaatcttttaaaacccattgtaaatctttttcccgccaaaaaggtttttgtaggaaaaatatttttggaaaaaaactttgggcggactttttttttgaaatgttttttgcgggaaatttatttttgtaatattttaggcgggaaaaatcaatatttcgatggtctttttaattagttaatgcatgctagatttatttaattgaccaatatcacatgtaaaagcaaatttgttaatgttcgtatgtaattttctatttttttttctataataaatgaagggttggtccccctcaccctaccaaaatttttttttgttaattttcctattggttaatcaaaatattatatacatatatatagatataaaaattagtatatgtaaatttgtttacttttttaggtttttttatttttataagagaataaaaaggtaaatctttaatgacatatgtaaatatctgattattagacttgacacgtgacaccattatgtgagttagtaactttcaaaatggtactttatataataagatggtgattaaataaaactagggaaatttgcataaataaccaacaaaaaattataaattaaaaaactaacatcaaacaaaaaaaaggttgatatattatgtattttttgtattaatgataactttgccctctacactacatacaccttcttttttcccctcctctgttgcatttcatgctgattctttcattagattctcccttcttcatctaccacgaatgctaaattttatagtttccccaaaggtctcttctacctatttgactcttttatttgcaacccattgaaaacactaaacctatttataacacaatatttgggagtttgtaaattattagtattttgctctggttatttatttatcaatacatgtggatttttctttctccctttctctctagctagtaatctcatcttctatatatatttttatattaaaataaaataaaataaaaaactagtttataattaccattactaacaagtaacaattattactacactaccatcccaccgccactaccgtcattgccgctaccatcatcatgtcaccactaacaattaatattaccaccatcaatgtcatttttagtgccactgccaccactaccatcatcgttgccaccaccactattaccatcgtcaacgtcaccggctcaccgctatagtttaccttagttacttggattgccaatattgtatctcatagggatagtattttttttattagagcggtttaactcggccttttgaattatctacgttttgttctatactattttatttgtgtggtttagacaaacattgttccctaatttaaataatttgtattagattttaaaaatttaaatcatgttatactcaaaaaaatctatgttcttataaaattattgcaaaatttataagactaaatcaacaagcaaaattatttggggtgatattaatttagccatgtcattagtattttgggaatttgcatgtataacttaaaaaaaattacaaattaagaaactagcctattagaaaaaatttacactataataactgtataatatattatattataatttcgccatcacaataatcaccattaaccaccaccacaacaatcatcactacacccactaccgccgccacagccaccgtcatcaacaccaccgtcgccgtcggagctacccccgttacgagaacgaatgacatcaccagagcaaccaccccatcgtcggtgttcccattgtcaccggagcctccaccgtccctggaaccaccgccggaactatcgctggagacactgttattgtcggaattatcgccgaagccaccgctatcgccggagccaccaccagaactgtcaccggagccatcgctgtccctggagccaccgccgtcgccggagccaccgccgtcgccggagccactgccgtcgccggagccaccgccgccgccggagccaccgccgtcgccggatccaaaccaccacctatgatcatttaatctaccatttaggttagttagttaactgatacatatataatgttatattcttaatattttagtaaaaatgtgttagttttgcaattcctctttattattctctctacttttttacatatatcatcatatactctagctctgaatggatgctgatttttgattcagtttttgagtttagattttagtttatagattttagattttagttttagatttttgttattatatttttgttttaaaaaccccaaaaaatcggtttttggtttttgagaaaaataacgttgattgaataaaaactagatttcctaaattttaggaaaactaaaaaactaaaatcatgaatggaaaactacaataaaataaatttactaaattgtagggaaaccaaaattttaaaatcttaattggtataaaaataagtttttaaaaaacaaaaaccaaaaactcttacaaaatctacaaaacattcaaaacctcttctttttttttattgtgcgtgtctttcactatacaattttatcttttcactaatctaattactttcttaatatttttcaataagattttatattttttattttacattagattttgattataccgcaaattcacccataaaactatagatttaaaattttgaaaatctttttgttggttttaaaggttgatttataaaaaaaagacggcaggaggctcgggtgattgggggttgggtatccgctgaggatccgacccgaaaattaccctaaacagcccaggcaaagtgttccatcgagcaagacgaaacttataccataagtagcaaaaaaaaccaattacgagagattaaagcgattttcaagtttcctgagcaacaacaacaacaaacgatg

SEQ ID NO: 13318 - DNA, 3000 bp, Unknown
  misc_feature (1)..( 3000): cDNA_ID_3029366_gDNA_ID_2214616_Annot_ID_187546 3000 nt of promoter + ATG
ctttctgatcttctggtgcaaaccgttctgttgtgaaattttcgtcctccttgatagctagtgcattttccatcttctcaaggtcaataccatttgaaaattttttaactcttttttcaaagatccatagttgatctttcagcttcatcacccttgaagataatccttctatgactcttctttgccatttatttttttttctcatctcataccagttatcttctgtaggatattcagtctgagatagcctttctgttgctctcttcttgtggtcaaaagttctcttcagcttgctaagttgagaagtatagttgacttttggtgaagtttcagcttctgtttcttcatcaacatccatatcttgaattccaaaactctgacctcctgttgttgatttctttgaagcttctctgatgtcaaacttcatcttgatgcctttttcaaggttcagattaatttttccattcctgacatctatgactgctccagctaaagctaagaatggtctgcctaggatcaggggatccttgccttcttcatctatgtccaataccacaaagtctgtaggtatctcaacatttccaatcttgacaggcagattttctattagaccatgaggatgtgcaacagaaccgtcagctaagagtaaggctaagttgcagaacttgaattccatgatccctagcattttagctgtagagagaggcataaggctaacagatgctcgcaaatcacaaatgcacctattaaatgtcaatggtcctagagagcatggcagggtgaatgaaccgggatcatcaagcttttcttggatgactttcttcttgtatgtttcttgagtgctggcactgctaatcatctcttgattctgctcttgcttgagtttttcaattttgaacttttttccagaatgttgagtattcagcaaaggtgtgtgctctattgtccagaagaattgctgggtggcaggtgcatcaatttgagttgaatccccccccttcttgaatcatactgtcctcagtattgggagtctgatgacttggtggagattcatcttcttggtggatggtgatagaattagcagtaccatagtcctttggattctggactgctttccgtggaagttgctaaggatgcttcggagcagaagttgatgcaaattgactctccacatacttgatttttgaattcagagtttcaaacttgagattcagatcgttgtaggaacaatcgatcttgttgtgtaattcagctatcttcttttcaaaagccatggctccagtagcttgtccttggatgatttgttgaatgagttgcttaattttaggatcttgagttgctggggcttgttgtggttgttgagtgaaccctggtggtggattctgctgttggtagcctccattaaattgttgtttagggacataaccttggttgtactgaacaaatgcttagactgattatgttgaggtggatacacttgatcttgggggttagcaacattagtgcttctgtaggagtgggcttgtagttgttgtagcccttgttaaatcctccttggttctgaatgtagtacagctcttcagtttaatcattcccccctttttgcatttggaagtgctcttcatcagtgatgtagtgtatctgcatctattgagccagcaacagcttgtctaagttttcattcagagccttgatatctttgctttgtttatcctcagttcctctagttcctctcattgagtgatcatagtcttcattgtagcacccatcagattgtgctagatttttgaccaactcccaaccttctacacatccttgttcaggaagttttcattggaggcagtgtcaagtagcattctgatctttcgtaaagctcctctgtagagtgtgctcaataatgcagcctttttgaaaccgtgatgggggcactgagtggtgtagcttttaaacctctcccaagcttcacagaaagttttattgtttttctggttgaaacctgagatctcgttcctcaatctagcggtgcgagcgttagagaaaaacttggcaagaaaagctttcttacaatcgtcccatgaggtgatggagtctgggggtagagtcttctcccagtggtgtgccttgtctcccaaagagaagggaaatagtctgagcttaaacatatcttcagtgacaccattaatcttggtaaggccacaaagcctatcaatgctgtcaagatggtctagggggtcttccataagtagaccatgaaacttgtttccttggatcatggagatgagaccactcttgatctcaaagttgttgttctgaacttgtggtggcactatcccttgtctttggtgatgatttcttggggcatcaccagcaccaatgttttttggttgatcaacattaggtgggtcttgaatatcaactggtctgtaagtggtctagaatgatttacaagggattttaaaaccttacaagagggtaaaacatgatttacaatcgttttcaaagcataagtaagtgacatagaatgatttacaagggattttaaaagctttttaaagggttaaacatgatttacaatcgtttttaaagtgtttactataaaacgtgtaataatagtctctacattgtcttttattcttacatgaattcaatgtgaacctgttaatagggaacttcgacgaaagggcaaagatcatgtaaaagaaccatacttttgggcgagggaaggagtatatactcttggtgatctcgaagatcgattgtttccaaaaactaaggaaggtgaacctgctgttgaaaatgaagaaaagctgtgtcttggtgcagtattgttgactgaaggaattctattcacaccatttgaaagagagaagatacctttgttaagattgcagcatgcttctgattttgagatgtacacagcccaaccatggggtaaagaagcattcagtgttctatcaaattcaattctgagaatggacgagaaaacttgggcaaaagatg

SEQ ID NO: 13319 - DNA, 3000 bp, Unknown
  misc_feature (1)..( 3000): cDNA_ID_3029368_gDNA_ID_2214616_Annot_ID_187545 3000 nt of promoter + ATG
agaaaaaacaagtgagtttttgttagtaagatagtgagtttttttaaaaatataacagtcattggtgacagttttgttgttgtaggccactatcaatcgcagaaaatattataaatacaaagtggtttacaagcctagagacgccagggaaagcaataacaacaacggtatgtctaaaaatccttgtaaaattggttttcgaagggattttaaaagcttttaaaagggtaaaacatgatttacaatcgcttttaaagcatcagtaagtggcatcgaatgatttataagggattttaaaagggggttacatggtttataaacggttttaagagattagaaagtggtaaagaatgattcacaagggaatttaaaaagtgtttacatggtttacaatcgtttttaaaggattagaaagtggtaaagaatgattaacaagagattttaaaaatttttaaaaggggtttacttgattaacaatcgtttaagaaacataagttagtggcataaaatgatttacaaggaattttaaaagcttttaaaagtgtttaacttgatttacaatcgttaaaaacatatgtaagtggcatagaatgatttacaaggtattttaaaaagggtttgcatggtttacaatcgtttttaaagagattttctaatatgataatttttttatttttgttgtgtttagcatgttgatgcagctttggagttattgaaaacgaggaaggaaagcaatccaaaaatcttcaaaaacaaaacagttgtatttgttggatcgtttttcgtaaatgcgattgatgagtcatacatggagtttttggattttaaagagggatttcagtttccatctgaagaaatctgtaagctgataatagaggaagataccaagtgcatattggctcctttctgtatcaaaggaaaatgttgggttgccttgctaatatacttggaacagaatacaatttgtatatgggaatatgcagcttcttatttaacagaagaagtcaagaaaaaatatgttggtgcctcctctatagctatgccatacattgttcggaacatcctcaaaaaaaaagacatcgatgtctctccatttagcatcaaagtcctgaccacttttcctcaggtaacttctttaatatatcatagtcctagaaatgaagattccttaagtcttgacctctttgctcaagtaattcttttggtttttcgtggtaggctcctagaaatgaagattccggtatatatatgttgaagtttatggagtgttactcaatgtataccaaccattcaaaccttgaaggaaacattatcggaaactcaaggaagaaattggctgttgacatcatcacagaattagggtcagtcactatgcaggagtagcagattcctaatcaaaaagtagtggagtataagatagatttagcagcttttgtttcttatttcataaaactttgtcatttgaatattttatgaacatctgtatggaacaaattttatgaagtttatttagtacaactcttggttaacacaattattgtataatggttgtttgggttaacaggtgctttgatttgaatggaaagggctttaaaatgttaaacatgctttttagcaggtttttttaatgatttactagctgtttaaaagaattttaaaagtgttgaaaaagatgcaatagctgttattatgaaaagatttacaaccgtttttaaaaggatttacaaccgttttcaagggtttttgttttgaaactacaccaataaatagattgatgtttgggtttgtggtttaatttatagatcctcacttaattgatgggttaccagttgattagagttggtttgaaaaagggtttattggtttctatttttggcggctgtgtgcttttcaaagatttaaaatttcaaaaaggtctttgaaaaggattatgaaggatttttaaaaatggttttacaaggggttttaaagtccttaaaacgacttgtaatgactgtgtttatgtttcgaaactacacatgcataatagatttacaatggtttttaaaacgatattcaaaattgtgttaatttaaagactgagttaatgtatttcatcaggttttgagaaaatgagtacgaagaaactgtacttccttaaaatgacttgtaatgactgtgtttatgtttcgaaactacacaagcacaatagatttacaatggtttttaaaacgatattcaaaattgtgttaatttaaagactgtgttaatgtatttcatcaggttttgagaaaatgagtacaaagaaactgtacttccctacaagactatttcaactaggcagagaaatagataatgttacaagggtatcaaagcattcatcaaacaaaattgtcttgaaggccagggaagcattaaagccgatagagtacaagacattaatggacacgttcttgggtcctgtagtggaattcgttgaatgcaatgacatagccttttcaagccatatcgtccatcatttactcaaaagaaggatactaaccagcaatgacgaattgtggtttttatttgctgatcaacctatgtgattctccctgaaagagtttatcataacaacataacttccaatagatgatgcatcaggaagcagtccaaatgtgaagagaagaagatagaaaagtggtagatagaagataatcagactttgaagaaaagcagaaaaaagatttgtggattaatgataaaatgtgatttgtcgatcttacatccaaaaaaatgctgccagaaggagagaatgagattggggggtttgttactagtggaggggatattgctagctcaaaatccgactaccttgctgccaattgagaatctgcagagagctagtgatttcgaaaagttctgcaagtatcgatgggcgcagattgtttactcatatttggtaactgaagtgaagaaattcaatattgacactttgttaaggaaacaatatagtcgatttgtttctacaattcacatatg

SEQ ID NO: 13320 - DNA, 3000 bp, Unknown
  misc_feature (1)..( 3000): cDNA_ID_3029350_gDNA_ID_2214616_Annot_ID_187551 3000 nt of promoter + ATG
caggaaaggaagctaaccacaggtctgactctcgggagtctcagagacgtagttgtttattgaaacgttctctagtcccgcctgctaaaaacccaagtccaaaggacaaggatggcgccactagcactcctaggtctcgaagaccagctctacaacatattgtgcagttaccagttcaaacttgggaaggttacaagaagtagtcttctagtatgcacgggagcctagtcatccatctcctccttctagaccctctccgctttctgattctcatcacaccctcgctgttcaggaaagtagagttgtggataatagagtgcatacttccctcagaatgggacctcagttggattctatcacaattacggttcccgaggaaatgtcaaatacaagagcttcagggaaaagaaatactccaaatcaaaaaccaaagccaccacaaaagattggaccaaaacaaaagcctggaccaaaaccaagagtaattcgtagtccctccaaggggtaagcctaagaaagcagaaggcaaccactacttgggcctcttcctccaggaaaaagctccacgttgataatatacctgactttcaggatggcgaggcagctgtggcccttctgcaccgcgtatactgcctataatccctgctattaacagagcctcggtggattttcaaattccaccaaacactcttccttagctattgtagcttggaacttccaagggttgggaagcaccctaacagttcctagattaaaggaaattcgacgcagtctgtttcgtgatatcttttttctcatggagaccaaaaatcaagatgacttcattattaaatcttttgaggggatgggttatcacagcatgtttactatacctcctctagggttaagcgggggtttagctctcttctggaaagatggagactgcccacatcatggtttcagtgaggtacaactctttggtaccttcttcagatgagtcgattggagataccagatggctctagatgcagcgagtaatggtaacttcaacaccgttacccagctgatgctacagctctaatagagaacctcgcttgcagcaaaagtgattataggtttttagtcaattatcctaaaacaccaatcatgtcgttgtggtattttaggttgtcaatccaaatagatgtgatgctaacaatcaagatgtgatcagaagtcactaagtcaagccaagcaataacagggtttggtgtgttctagcagtcctaagtgaacatgcagaaaacagaaaatcaagcagaaacagtaaaacactcgaccaacacagctcattgttgagcactgggtgtggtcgagtgacaggtcgagtaataaatagaaaatataacaggaatactcgactgcacagtgtgttgccagacaactgggtggtcgagtacgaggtcgagtaataggagagaaatgcaaattctaagcaaaaggtaacaagatgaagtaaacgatagtagagtaaagaattaaatcaatcagataaagaattcccgaggatggggtaattgagtagtttcgtttcctcagtttataggtgattgacatgctcaatacaacaagttcattaaccaaatctaagtgccaccgcaacagagaccctcaagttaaactagtcccagactcaatcaccactgacgagagctaagctaacaggcattacgaatcaacaagttaaagccaaaacgaaccctgcaaccaataccttggtatagagccacgaatctctggaattagtggttcaaacatttcatcgaacaccttttgggcgcggaaatgtctgggctcaaattccagttgatcagaaagcaataggcattaagaacaactaattgaagggatctatcaatcaaactcaaccacctagcataccgagaattctaaacttctctaacccatcctaggaaacctattcactactcagacatcattgcaaagaacataaacgttgaatagaatgaaaacatgataacaacagagtaatagcaagatgataacaggatgaacaacagtaaacgaaatcaaaagcgaatgctgaataccgaataaattaagagaaatccggattacaaaaagtcaagaacacagtgtctgcggaataaaacttagataaacgaaaatataaagtacatgctacttatagcgaaatattccaaaaccctaatactcaaaacgacgtagtattacgacggattaagaacggcactcgacccaggtggtcgagtgagtggtcgagtgataagctggagtcttcttttcttccttctgctcgagtgtctggttgagtgcaaaatggagaagactctgaagctggcagtcgagtatgtagtcgagtgatagggatggtggtactcggcttggtggtagagtgatcgagtgaaggtgatgaaggtactcgaccacgtggttgagtagtgtgatcgagtgaaggtgatgtggtggacgtgatgatactcgaccagggggtcgagtaatgtgatcgagtggttgtccaggtggtactcgaccatggggtcgagtggtgacgtgaagtgctgaggtcttctactcgaccacggggtcgagtggtctgttgatgtcgtgaggcatctacttgactagggggtcgagtggtttgacatgatcaggtccgcttcttccaattagctggtcaacagctccaaatcacctgaaatcaacacaaatatgcaacatgcatgcaaaactatcctaaacatgcaaaacacttgtgatatgatgcaatagtgataacaaattgatgctcaaaacatgtaaaatacacacttatcaaacagtaccaagaatgctgacttttagagtaagaagattgatggagccatttcaggcaatcagatagcagaggtgaatgctaaggtggattcagttcataacttgcttacagggaagaagcatgtccactttgcagctgaggaggaaattattgagcctgagcctgagtcaggaagtacatag

SEQ ID NO: 13321 - DNA, 3000 bp, Unknown
  misc_feature (1)..( 3000): cDNA_ID_2713437_gDNA_ID_2214616_Annot_ID_135813 3000 nt of promoter + ATG
tctatcgtttctaatataaagaggatgagattgtattgttctagaagtggagacttgcttataactaagcttcaaagaattggttgaactatctattcgaaaattctctacaagaatatcaaccaatgcgtgataggtaatgtgctcatcaatgagcactaaagaagctcccatttcaatgtctaattcaaattcccaagtcatattgtttgtcaacttccacaaaccacaaacagaatactattctatcattataacctgataagataaataacaacaaaatcaatacccacaaacattgtcactacagagagaagcatggtttacaattatttttaaagcataagtaagtggcatataatgatttacaaggaattttaaaagctttgaaaatgggttaacatgatttacaatcatttttaaagcataagtaagtggcatagaatgatttacaaggaattttaaaagctttgaaaaggggttaacatggtttacaatcgtttttaaagcataagtaagtggcatataatgatttacaaggaattttaaaagctttgaaaagtggttaacatggtttacaatcgttttaaagcataagtaaatggcatagacctatcacgaaagcgtaagtaaaggggtaaacactaaatcaaaaccaaaatttatcacggaacaatataacgaattcaaatctatcacaaaacagtataacgaattcaaaaggaattaacgaattcacataatcaaccccaaaatcgaaagcaaaatagtagaatttacaaggattttaaaaacaattcaatcattaaatctcaaacaaaattcaaattcgaagcatcaacaaatgtcaaattgtcgattgaatcaatatcacgaatcacataagcaacaacaaaatcgaaaacgagacatttaggctaaaattacaaattcgaaatcgattccatgagagaaaaacaaacatggggaaaacaagagattgaaatgaagactgagacggtgaaatcgataacacgaatccgacaatctccgacggccacgacgcaatgcgacagcgacaattaaaacaatctccgacggcgatgacagacgaagaatacatatgacatcaattgaaattagatcgattagtctctgtagttcactaagggtattttggggataaaataattaggtggggtagaaataaaaatggctaaaaaatgggtaaagtttaaaaggagcatcatgaaaagggcattagaaagaattttacataattatataataaaatatgttttccttataaaaatggtttctatcactaactctttaaccatcaacaacctactattttattaaatgacattgttttttccttagattcttattggatatctcttctaagtcgttaatattcattttctttatttttgaattagtatttattttgcatttttctctaaactacaatatgttgttgtatgtttgtctttgtttgaggttagtatattttttactcatcgctatttgccaattttcataattattttgaatcaatggtggagtatttattaagatattagtttgtttagtgacaaagtatgagataatatatttttttacaaatgtgagtacttacaatttgttttcttataggattaacaactgattgtataatttttttaatcctttttctatttttcatatttttcttgtttagttagtaacttataattaaaacatttagattaattttctaaattctatagttttagaaaataaacatataattttattatatataagtatagtttccttataataatctttttatattcttcaaactgtttaaattgtataattttgttgtaattatttttttataattttttaattgttaaatacaaaacttttgtttgcgacataacaaaaatctcctatgaaaatataggtattaaaattgcattgatagatttgaaatttcgtgttttttttagttgaaatttatcctcttaattatatgattttaatttttacttattttgaaaatctgtacttttcattttttatgcatatatcaaaatagagaagcatttccatatgtacatgtgtgaaatctcattaataaatggacataactttatacttttattttttataatattttttattttttataatgcatagtttcattataattatcctctatcttttataatattgttctaaaaaatttattttttatacatgtcaaaatctaagatctctaaaattgacccgtgttataatctcctgagttactatcaaaaccgtactttgtataataagatccctttaggtagacaaatatttgtacttttttatgttagtatccaacattatattttgttgcctaaactgaacattattaaattgttaattataagatttcacctatagtataccttcccgtattaatatcgatccaaactcgtcccaccatataactatacaacactggttatttagaatttcgattgccctttaaggataacaaaagaaagaaacaacaaatgttgttttcaaatagatattccaaaaccttgtctagattaattaaaatggtatgaattttttatttatttaattacttttacatattaattattctacacaatttatgaaatactaattgttttttctttagtatgtgcaggttgacccattaacgatccgatccaacgcttcttcacctgaaaatttgcttggattctcttcgtttaaaaacaataccaaataaacaaacttttgcctgatgaaatcaatgaccgatcttggatgcaagtttaaagagtctttcctcatcgttcgttcagtttcttaatcgcttctttgtattttcaaattcgattgatattctgtaaattccctcattttggtcaattgctttaatgtaacttcaaatttgagttttttcattctcttcaaactctgtttttaatggatttgatatggtgaaggagaatacactaaacatgg

SEQ ID NO: 13322 - DNA, 3000 bp, Unknown
  misc_feature (1)..( 3000): cDNA_ID_3029433_gDNA_ID_2214616_Annot_ID_187524 3000 nt of promoter + ATG
gatgtaaaaggtcaccttttagctgtagttggaagagatggagataagaggattgttcctatagcttgggcagttgttgagatagaaaacaatgataattgggactggtttttgagacagctctctactagtttgggactgtgaaatgcaacatctagttatcatttcagataaataatcagttaattttatcatcttttgcttcagtttaatgtcttttatgaagggtttacgcttatgtttttgtgttattttacagggtctagtcaaagctatcaataccatacttccagaagttgagcatcgacaatattcaaggcatataatggacaattggaagagagacaaccatgagatagaactacaatgtctctttgaaaaacaatttgaagctacactgaagaagtgttcatgaataatatggaagagctaaagagatacaatcctcatgcgcatgccactcgcaacttactagtccaatgacatggtcgagagccttctttagaattggacacgttgcaatgacagcctcaataatcagtgtgagtcttttaataagactattaaacaggctaggagaaagcctttgttggattagctagagtacatccagaggtaatgcatggtcataactacgaagacgtatatcattgctgacaaattgaagacaaggttcacaaagagagcccatcttgagattgagaaaatgatagttggggttagaaattgcgagagatatatgtccagaaacaatttgtatcaaattgatgtgaatggtgttagctactatgttgatacggagaagagaacttgtggtcgcaggaagtggtagatggtggggatcccatgtatttatgcgacacctgtgataataggaagaagagaaacagttgcagactatgtgagcaagttttacacaaaggtaatctggcgaaaaacttataaagatggtattagccttgtccaaggtatgccattgtggcctaaaaccaataggctccctgttttgccaccaccatggacaaaaggaaatgttggaagaccgagtaattatgttaggagaaaaggaagaaatgagacttcttcttcttcaaataagaacaagatgccactgcaaaagagaatcatgacatgctctaactgccttcaacaagggcaaacaagcaaagctgcaaaaatgccactattctgattccaccaaagagaccaagaggtcatccacgaataaatcaggtttgtattcttgtttttttttatatgttttacaactcacttaatcatgcaactgttcagactgtcatatttaacttaggaggaatcacaagtgctaagatcacaacctcatcaaagttcacaatctcattaaggatcacgatctcaagtgctcgaatcgcaagagcaaatacacggatcacaacctcatcaaggatcacaatctcatattcgatcacaaggaccaagggcaacaggcggaacatcagaaagaccaagggagacaggtggagcatcacaagtacaatcccaaacagaaccacaagcacaagcacaaactgagccacatgctcaaccacaaggacttggtggatttgcatcatggtttgagtgttcaagacaagattagtcacaagtttctttttgttgttgtttgaacttaagctttctcataagtttatttttggtggttgacataatggatttgtctttatgacataagcttagtatcgatttcattttgtggtttcgacttgtctttgtgacacaagttttataatgtatgaatgagtttcattttggtgattctcattgttaaacaagcatctagtagcatttcattacaatcacaacactaagacaaaacactaggactgattatcattgccaaacaaacatttcagtaccataaaaacattttattacaaacacaaaacactagtaaccaagaacaagcttatggtttttggtcttatagaacattatgatcataattgcaatgactgttatacaaaggcacaccaagcacaatttggtcatcgatttccatatcttcaattccattttgctccacatttcatcttccttcaattcttggatcaaaacctttaattctgcaatctcgactacaacctgaaatttgacattgtttatctagctatcaatcatagagattatcagtattgcatctacaacctcttcatacacacaatcttcgactcacttaaacaaatggtcctgcatttacaacgacaactttttaccgatcaaacaccaaaaaaaacaaattcaaatctacttacatcttgatatgttggacaacagaagaaggatcttcttgggttcttcgtcgagcttgatatatagatgatgaaatctctcccccaatgacactttgaaggaaacccaaggttcccacttcctccttcttgaacactcaaattttttaaactcatatctacacaaaatggagattttgagctcaaaaaaaatatatcgagaatagttcaaattttggggattatgaagaattagggaatgaaaaatcgatttgggaattttaaggtttgtactcatcacaaaaaatcgtttggtattaacggaagacgactaacgtctgctaacgagggttatcagatccgttaatacaagttaacatttcggaaattttggccaggcaaactttatgttttgtttaaatagcggatcaacatttttatcatattttatttgatcgatctaaaagtttacatataaaatgaccattcttaaaaacatcacgtataaaacgatattttcccgttttaaaaagtaggttttgtttccgtttattttgtataattattgttcgtttatttcacgtttgggaaggtatcaaaacgaacaaacaacaaacggtgcgttttggaaaggtattaaaacgtaccgtttcttctctcttgctattcgtaaccccgtgcaaaaaaaactgaaaaccccaaatccaacctctctcactcaaaaaccatg

SEQ ID NO: 13323 - DNA, 3000 bp, Unknown
  misc_feature (1)..( 3000): cDNA_ID_2702687_gDNA_ID_2214617_Annot_ID_135822 3000 nt of promoter + ATG
atccaaccttatttaaaaatcaaaataaatagaaaccaactaaaaacacttaacctaatcctaatataacatagcctttccattactttgctaactcaaccacaaaacataactcccttatccttttttcatgctgcttcttcttctttttctggatttgttttattttttattttttatcctacatttccttttttccatcatcatcatcaacaaaactttagatctcttcgcgtttctcatcgacctttgttcttgtcttcttctccatcaccatagcttcacatatgtgagatccaacgacaaccttgatctagatttaaggttttgttgtagaatcggcaatagtaatagagataaagaaaggtcatcaaattacagtgacaggcgataatcagtaacgctgatagaaaaataacagtgctatggtttaggaattataagttgtttcagtacttaggccaagtcaaacgtcacgggaaaacgttaaaataacgtgggcatgtttactttttcactccaatcagacagtataatttgcactataatagtgtggttctctttttttgtacagtgtaacactatatttggtgtactactgtagccacgacaaatattaaaataataatttttcttttgtgttaacattattatatattaaaatagcttatttagttacaatagattatatatgatttgtaatgagatttaagtaatctaattaaggcttgtaactaaaaaataatttataagtactattttgtaatctttaatttaataaaatgatggattagtagaaaatattaaaactaatacagaagttgattgaaaatacaataaaataaattatacattgataacataattaaaaaattaaaaccacacaaacataaaaaccaaatgcaacaagataggttttaaaaacataacaaaagcttgacaaatggttaaggaaaaatattttcggttccgctaagataattataatattgggtaaaatcttcttggttatttggtgatctttggtcttcaccttgatccggttctccttgaacttgttttccatgagatggactttcttgataatgagatgctcgatattgagatccatgatattgagagccttcaccatcttcttcatgttggtttgtttgtgctcttttttccaaaattctttttctctcattttcaatatatgcacgagaggatggatcacttatagaattcaaatctgcaaataatattttattctcttctttcattctatctacctcgatcttctgcctttgaatttcatttctttcagaagtacctttagtaatagctttgataagtttatcattttgctccaaaagttgttttagctttgttttttttaaacccataggtcttgaagataaactaaaattggcatcttcactatccatatttagatcaattgaattcataccaggggaaggtgatgactcggtattgattaaaaatgatgaagatgacgtaacatcacgaccttatccttggaatgcagcgggtgtcatcatgttatcattagcaaatttctcaatacctttaagaataggccatacatgatcaaatttgaatcctctcttgtatttttcatattgagttaataacatctttgcttggtttaactaattacatattgataagaaacaaataaaaataagttagcatgtgcaaataatttaataaagataagttagtaagcacaagaatttataattgagtacttataatatcttctttggaagcaccgctaggatttttattctcaatttggttaacgcatcctctcagctttgagactgcagaaagaattgacgtcattcgagtttgtaaagatctttttggtcttcgttgaagacgaaaaggatcggatttatgatactcagcttcaactcttgtccatagttgatctcctgattggtttatttctattattggattttgggaaacatcaagatacacacgacacaattgtatatcttcttaaatagaatatgacaaagagcgacttgaactcatttttgaaaaatataagaagtaagaaaaagagttggagatgtgtgattattcatagagtagtatacatttatatagagaatagaaagcaataccaacggttagatcttggtaaattcaacggtcaagattaacttatttttttctaaagaagtgatacttgatatagacatgaaatgactaatcaatgcagtggtaagatcttgatcaaagaaattcaacggctaagatgaactcgtctttttctcatgaggtgataattgatttgcgatatgaaatgactaatcaatgcaacggttagattctcttcaaaaaaaattcaatggctaagatgaactcatctttttctcatgaggtgaccattgataaaagacatgaaatgactaatcagtgcaacggttagatcttggtcaaacaaaattcaacggttaagatcaatttgtctttttctgataagatgaatatatcaattccatgcttttctatataatgggcaatatgtttagaactaaaataaatatcactatcatcttctatttcttctcatagaagatgagttttaactacggtagtttatcttatattccgtcttctttttcttcttcttcttcttcagataataattattacgatgatatagaaaagcaagtggtatctcaaattactactaacaataattttctttgctctcaacacctatataactcagaaggttcgcatggtggatctattcatggtcatgtagttatcaatcgtgatcgagaaaatgttgctcgcaatcttttcatagattattttgcagagaaacctgtgtttcctgagacaatgtttcgacgaagattccggatgagtcgttctttgtttcttcgtatttatgatgctataaaaagacatgacaattacttcgtccaaagaagagatggagtcggtaaacttggcttgtctggtttgcaaaaa

SEQ ID NO: 13324 - DNA, 3000 bp, Unknown
  misc_feature (1)..( 3000): cDNA_ID_3029439_gDNA_ID_2214617_Annot_ID_187573 3000 nt of promoter + ATG
aagtagtggatctgattgttcatagagtagaagactataaaaatcttaccagtttaacaaagagttacttcgctgccttaaccgatcgcatgttgcttttgttatttcattttttgagtcctttgaaaatattggaagtgtaagcagtaaaagttaaataacattttaagtatcaatttcagttattgttagtgtgtatatcgtattgttttcttatgcaggaggtttacataccactgcccaaagaattagaccatatgtctgtttaagtttaccagcttcttagatgttttggtatgataaatggtcttcatttttgggaagcacaagatctcaaggggaaataacgaggagtggaaagttacattaaaatgatatggatttctaatttatatctcactcattgagataaaagagtttcattgtacgcccgaaaaacctaagttgaagttcaagcttattattattgttgatcagattttgtacaaaagttacgttaaagccagcagggatcattgtagaatggatctatgatttatcttgttgtagatttgaacaaatttatggcgatttgaattatttttttcaattaccgttttaatttctattttttttatatataaaaatattgattagttagtttttaggcaaaaatattagtaacaaagattttccttaccattccaatctgtaatggctttgattaagttgtaaattaaaaatttgaagtagattttctatttttttgaaagattttatctattatattgtatatataaaatttgtttaatgattggtttatttatcttgctatatttgttctatttataattcagttagagatcaaatagtgatttgatacctttttaattttctgaatttttgataaatatagatttgttagttttaggcaatatttaataaaacggtttgattacgttttttgataaatatatctttattgttttttattacgttgaatcagatttttatttttgttgtaagatatcgtcaatgattttatcagaaaaggtagttttaagattgatttaatggtcttgctctatttgttatattttataattcggttagagataaaataatgatttgatttgtcctctttataattgtccatgatgacttatttcagattcatagttagcacaaaactttgaacttttttgcctatataagaacaaatcaaacaagaacaccatctatatttgctagataaaaataaaaaaccaacagtggcgacttgaacatcagagacaaaagaacgacctcgatttaatcaaattgtgggtaaaataactttcaaaattgacccatttaaaacagatggtcatgatataaaaacgggaaaaatgtcgtttaatcccccaactttccaaaaatggccaatcaatacgtcaattttgtaggaggccatttaaaacatcaacttacaattgactaacatttaaaacacgaactttgcgttgactaggcctaataagaccgacgttaaatcgattaacagatccattagacgacgttaagaactgttatcatctctctgttagtgaagaaacgacgacgttttaaagcttaatagataacccgattgtttgtcgaaaatccccaaatcaaatacttcaaatccctaattccctaattctcttcttcttctctaaattctccatcaaaagctgaagaaatgagttgcaaatctgggaattctaactaatggcatccacgaacacactttcaagatcgttggagataaattagggtttgtttttgatttggggatgaattcgatttgaggatttcttctcgacaaatccctaattgggttatcaattacgcctaaaacgtcgtcgtttcttcacaaacagagagatgataacggttcttaacctcgtctaatggatctgttaattgatttaacgtcgtgttttattaggcctagtcaacgcaaagttcatgttttaaatgttagtcaactgtaagttgatgttttaaatggcctcctacgaagttgacgtattgattggccattttttgaaagttgggggattaaacaacatttttcccatttaaaaactggccaaaaaccaatgactaagattttatttgatcatcgggtcaaaactcacaagtatcgggttaggcaaccccctcgttcttcaaataaaattatttaaatgaggtttgatatcctaaaacgtttataaatttgattataaaactttagcatttgcccatatgtttgcaaattcattaagacattaaattcaattgtaacaattatttgcaaatgaataatcaacgtaatccacatatttataattttatatgcaaaataatcaaatacaaaatattttaacaacttacattattattagtatattaaaaatataataatattgtctaccacataactataactattttaaaaaaaaatcttaaacaaacttaaaaacagatttttttttatccaacactgtattatgaaagattaaataaaattgtgtactacacaacaacaccaacaattatctaactaaaataaatatttaacaagaataaaataaaaatgtattttttctactacaataacatctagtaaaatataaattcacaatttcgaatctgaaaaaaacattaattattatctagtaaaataaattagtcttacagtcacaataaatcacttacctcacttttagaaaaatagaactttaaaagttgagataagtatctaatggcccagcctcggcccatttacccaattctggatccggatattatcagcatcactttcgtttttttgcaagtagcagagcattctccatgtttgagaaacccaaagttccaaattccaaaattggtcaaagctcgataacgtgtgtattgcttctcttagtcaatggtgatttcgattcattgactgggtttaaaaaccttgctagttctcaattctcatgactttgcttttagtcttagaagtggaaa

SEQ ID NO: 13325 - DNA, 3000 bp, Unknown
  misc_feature (1)..( 3000): cDNA_ID_3029443_gDNA_ID_2214617_Annot_ID_187572 3000 nt of promoter + ATG
ttaaatacttacaattctttttctaaaagttaaaaaatgcttgtaaagactttataagagttttaaatggatttacaaatgtttaaaatccttttcaaactcttgaaaaactcttgtaaatcatgttttacccttttataagcttttaaaatccttgtaaatcattctataccacttacttatcttttaaaaacaattgtaaactatgcaaaccttttttaaaatcccttgtaaatcattctttgacacttacttatgttttaaaaacgattgtaaatcatgttaaacacttttaaaatcccttgtaaatcattctatgccacttacttatgctttaaaaacgattgtaaatcatgttttacccttttataagcttttaaaatcccttgtaaaccattccaatgtcacttacttatacttaaaaaaacattgtagaccatgctaaccatttttaaaaatccttgtaaatcgttctatgccacttacttaggctttaaaaatgatagtaaatcatgttttacccttttataagtttttaaaattccttgtaaatcattcaatgtcacttacttatgctaaaaaacgattgtaaaccatgctaacactttttaaatcccttgtaaatcattctatgccacttacttatgctttaaaacgattgtaaatcatgttttacccttttataagtttttaaaatcccttgtaaatcattcaatgtcacttacttatgcttaaaaaacgattgtaaatcttgtaaaactattgtaaaaagttttaaaatgatttacaaaggtttaaaaggcggtttaaaagtatttatctatgtttttaaagactttataaagattttaagaggttttaaaatgatttacaagggtttttggcaactaccaaagcttttaaaaaatttacaaggatttttaaaagcatttttttggttgggaaaaaaaatttacgagaaaaattttggcaggaaattttttttttggcgggaaagttttttttttggtgggaaaaaaggtttggcggaaacttttttttggcgggaaaaataaatttggcgggaaactttcagtttccaattacatgttcttattagatgagggtaatttggtcattctgttcaagggaaatgatatttttaaaaataaacaatataaaagggtattgttgcaaaagagtagtaaaaaaagggtaattttgaaaatctcccatatttttgacccaaatttattcaaaagtgattagatacctataaatattataaatatcacaaaatttatatattttgacacaaattattacaaatataaatattaataataatatattattaatatttatattgtggatatgtacagaaacccgttggaatcggatttgggtttattttttttggatttggaataaaactgggtattttgaaaatttgggttcgggttggatcaggttattattggattcggatcgggtgttgggtttggatattatgcccagcaatggtgagtactcctctcgccatcatcagtctttactctgttccaagtcttccttctttggctcaaatggggtccacgatcatcaatccaaatagattcgactttttgttctggggtttcgtcgagaattcgatttttgggtttctttcgaaacttggtcaaatgtcgaatacgcgttacaaagaacaaacctttctctttatttcgtttgtcttcgtcaacggctgaatcaaccaaatggtccctggaattaataaacctctaataataatggctttgcttttactctgatgacaagttcaaaaatggaacaaagatcactcctttgcttcctttatctgctcctactattcaatttcactctcagagtcgctggaaacgctgaaggttcttcctttttctgctactctcatgaaaagtcccttcctttttggtggttgttagatttcgaaagttcataactttttttgtttgtttgctggtttggattatgaatatgtgtacaggtgatgctttgactcagctgaaaaacagtttgtcatcaggtgaccctgcaaacaatgtactccaaagctgggatgctactcttgttactccatgtacttggtttcatgttacttgcaatcctgagaataaagttactcgtgtgtatgtttctctctctctgtcttcttttttgctctctgtgctggttttgtctgaatgaatggttcaataatccctttgggaatctactgtttgatgtttgcttagtgaccttgggaatgcaaaactatctggaaagttggttccagaacttggtcagcttttaaacttgcagtacttgtaagccatctcttcctcaatgtcgattaattctatagtgttcaagatggacttgaatttgttatgcatatcatatgcttcatcttacttgtttaatgactgtgacatagttgtgtttttgctttcaaaagagaattgtggataaacaatttttttctcagagtagaaaactatgtgtgtgcgctctcttgtggttgatgcatctgaaatatatatatatatgtcgatttatttttgatatcgttggtaatcaccaatcagtgccattttagatctctttagctaggcttctcgagccttgttactggaatcctttataatcatctttcagctagaaccatggcattatgaaagacattttattttttgaattctctatgtcaaatgttctcatttaactctattagataagtaactggagagtttggatctggtatttctctacaggtgatctcaactctacatatttgtgttgcggctgcaaaatgtttttttgaaaatattgcttacaaatatagtttccacgttcatgtatcttagctgtctacgattattatagttcttcatattaatgggtatcttgtttattacatacttcattatgttttctgtagcctgaatttctggtaaaataattttagagattttccaatcgacaataattaagcaaagctta

SEQ ID NO: 13326 - DNA, 3000 bp, Unknown; identical to SEQ ID NO: 13325
  misc_feature (1)..( 3000): cDNA_ID_2702694_gDNA_ID_2214617_Annot_ID_135824 3000 nt of promoter + ATG

SEQ ID NO: 13327 - DNA, 3000 bp, Unknown; identical to SEQ ID NO: 13324
  misc_feature (1)..( 3000): cDNA_ID_2702690_gDNA_ID_2214617_Annot_ID_135825 3000 nt of promoter + ATG

SEQ ID NO: 13328 - DNA, 3000 bp, Unknown
  misc_feature (1)..( 3000): cDNA_ID_2713486_gDNA_ID_2214618_Annot_ID_135829 3000 nt of promoter + ATG
aatttgtattgttttaatgtacatgcagaaggataaaacaatattgatgaatgagaagaaggaaatcacgattcaaattgaatcattggagcaacaggcccaacttcgtgatggtacgttatcttaatttctatcaatactctagcaaatcttttagttttgcaatctatagtaaaagtttgagttttatgggttaaagttgttattaattacgtaattgcatgaactttgtttatgacatcacccttaaagtaatatctcatttagaaacagctttatttattctagacattccacttattttgcagttagcatgatagtacttacaacaccaagatattctttatgtgcagtaatttcaatttagtaaaatagatgtaaaatatattgcataaaaaaaaattaaaaacaaattacgcgcgttcattctagattcgttaacgttttttgatatacagagatttaatggtaatgtgtaggatgtaaaataatttattattgcaatgtataaacgtttatacaaaacattttgggatgaatgtaactatcaaacgtttgttttcatttctctattgttgcagctttgactgaaaaattgcacgtagaaattgaaaggctaaaagtaataactatttcgaacgaaaaagggagtgtagaattacaaaggctcaaaatggaaacatgtgaagtattacagtaccgtcgcgagtttgacagatcaaacatgcaaggaatggacccaaacatgttcacttggtctcagccaaaccttggtttttatggacagatttaaggaagctgtggtaactttgacaattccatgggatcaatgattgaagttatagtcctttacaatgtattagtttatataatttatgttcatgttgagagtaaaaatgatagtaactgtgtgaggcttccttcagacgatatatccttttaatttcttatttctatatcaatttatgttatttttccataaaattatgtctcgttttctttaactacatgtccaatactcgcccatacatgtcaatcctacttgttcttttcagctttctttaatttaacttaatcggtttctttaacttaatcagagttgatattgttactttatatgtaaattaaccatggaattatttattctctttgtcaaacattcatatctgaattagttttcttaatctatttgtcttattcaatatgtcaaaacactataactacattgcctattcagtacgaatagattctttagatatgattaattcatagttaatttacatataaagtaacaatatcaacactgatttttttcagtcaattataaactatagtcacatttacatatataaagtgacactaaaaaaaattatgtgacttctaactaccgaatttccatatctggttgcaatgggaaatttaaatattaaagatctgtaagtttttagaaattacattagatgtcatagactataaagtatcgacgagtaattaaagggattcaagaaaaaaaaaaaatgtcaaattagacatggaagaaaatgtgcattttaggttttactcttattcgatttggagagtattcagatcatataatcttcaatcttctatcttctattaacgcagccttagatgcttcaattgtgaattatagtattgaagaaaaggtttttacctatggttccggtattacagatcaatcttactacactaatacaatatacaaataggaggcataggggaagaagcactacgccgagaaatcaacaacacaaaaactttcttaaaaatgattccctttctttcttcttctttgttgggattgggactaatcaaaatggttggaacaataaacatccatctcgttcgtactttggatacccgtataaccattgaagaatgttgaagggacaacaaacacgaatcatataactttaacttgttattagttaaaataatgtgatgtgcatcatcaagataatagccaattacaaatcatctatatgaaaataggctatctcttatcatatacttgacaagtcaaaacatgagaacttgccatgtgtcaacataaattaaaaataaatagacagagtcttctcatttaaccctacctagcaaaacaagtttgactatctgtttggttgagggaatatgaaacatcttccatgtcttttattctcttcatgtcgcaagcaatataaggatttacgtaagcgatttagagagacttagcacatgtctgatgtattcactaataaagaagatgcatcaccaaaaaataagaaggaatcaagagtgacaccgtaaagaatcgcttcttcctcttgacgtaaaccatgaagatatggtttcaggctttacaaatttctctttacacttctgaagccctatttggctactccgggatcaaaaatcgaatcgaaaacaaaaaataataattacaattagatgcatatgaaacataatgatgtagttgaaaattaggataaaacttacttgtttttgctgctcactaagtaactctctacaacgcggtgtagttgtgagagtcgaaatcaacacaatggaaattgtatcttagggttcttacaaagaaacagtcttcgcgagaatctcaaagaacaacagaatcggtaagtaaccacggatggtgttcttgatattattgataagaaacgatgatttgatcgtacaagtgtttagaaaagtaaagaataagtgtttttagccttcaaagtcatagcgttttgatagcctgaagttgagagcctttttctgtgtaccctttttgcgaagtccttgaggcgccttatataggtcttcgcaataaggagattttccttatatttcgggagctttagaaaaacttccagatttgacaatatcctcgaagattcttcattatcatttttgggtttttcggaaatggtctttggatcctttttataacatgtgcaagtctttgcttcgggcctagtgaccgcctcctcctatgag

SEQ ID NO: 13329 - DNA, 3000 bp, Unknown
  misc_feature (1)..( 3000): cDNA_ID_2713482_gDNA_ID_2214618_Annot_ID_135830 3000 nt of promoter + ATG
ctttccccttatgcatgatgcaatgcaaatgcagttagagaaataatgaatagggagttgcgatcacgtatcagtaatcgccctgaagttctcggcatcgttagcttcctcggacagctcataaactcgcggtgccacggcctgccgcttagggggaggtggcaacccattacccccgcgattgtccctttgtccggcctgcttcttcgcagtaagcttatggcactcccgctttagatgtccaaccttcccgcaatagaaacaagtccttgtctcttcaccgagaaccttggactgtcctagttccattctcgggcagctttggatcgcatggtccttgcttccacaccggccacatacacctatggccttccagcaagttccgctgtggctcttaccacatgtcacacattccctggtcttagcatcggacttggtgttatccaccttgtcaaatttccttttcttatccgcgggtttggtgtgctgattgttccggatcagagctttctcccgattcaagtacctttcttactcgatcccttcctcaatcattgttgccctttcaaccgattcggaaaccaagttgaatgtccggaccaaacaatggttgcggatctctattcttagtccgcggataaatcggcgcaccaaggcttgttcctcctcaagtttgcgtcccacataacgcctaaggcggttaaactcctcatcatattcacgtaccgtgcggttcccttgaactaggtcgaggtacgcacattcaagcctatcccaagcctccggtggaaagtacttcttgttaaactcgtcttcgaaatccgcaaaggaccggacctcgtcccctctgcattttttgacgcttaaccaccaattatgggcgtctccttcaaggaagtggactgcaatgtccctttggtaatcctcagggcagcgagtagacttgaatttcctcttgagtctactcctccactcatcggccacaatcgtattcgtattccccatgaaatgtctcgtgcctagccttgagacatgttcgagaaggctcagatagtctcccctttttcgctcatgattcacatccacaacttctgagtcatcatcctgttggttatccaccctttaaaccaccagatccgctacaacggccttggttaatgtggctagttgcgccatcattcctttcatcaaatcccactgttcttgggtcgttgaagtattgttccggttatccgtgttatcccttgcatcgctactttccggtgcttcctcatttatagacttcttcccggcctcatgtccggccgagtctgtctcatcaagcattgtcccgactctggttttcttgttgatcattgtttcctcctcaaccaaagtctccttaacaatgcccttgtccttcttgctctttcccgttttgctgctcttactcatctgcgaaaccttcaaagttaatccacataactcatagtaaaatcgcaaaagagtaaagaacaactaccgcgagattctcaagtcaacgagtggtgataccccttaacccaacacctagtcctagaaccaagcatgctctgataccaacttgaaaggccccgatctagactgcctaagtccggacgagatctcccgccccaagccactaagtgactcggccttaaccgtttatgaggttcattcctagtgtaatccgttttatatgattctatgattcaatatatgagacgaatagagtaaacaacttatgagtttgcatataagctattacaagtcatataatcgatccctagactatccgaactatcaccacccatcatcacgaccttgagtctctcgcgcctaagccaagtccttcccacgatcaccattcgttcctgaaagtcatagagccataagtaatctcatttacttagtcatatgcaagtccatgcaatgctctataggccatacattactcggatccgtagagaggattcggagaggggaagatcgcacatcagtccaaccgatttccagtaggtcaattaagacccgccgaatcaacacatccgttccttgcatctttccgaagagttgtatatcttcgcccgtaactgctcgcccttatccaccctttgggcaagtaaccgttcgaccataactgcccaagtaaccgtctggataaccgcccagctggtcgaacagtcgaccagctacctcgagctcaaccgtcactcttccaactgcctcgagcttaaccgtcactcgtctggctgcccgagctggactgtcactcggcccaagtaaccgtcactcattccagctgagcttgagcttcagacgaactgacccgcatgatttcccctttgtctgagcttatggccagctccttcccacttgtccgagtctccaccttcttttcttggaccaagtcctagccaacgatcctattgaggatcgtgggcgttacatagttgcccaaagcaaagacttgcacattttataaaaaggatccaaagacaatttccgaaaaacccggaaatgataatgaagaatcttcgaggatattgtcaaatctggatgttttcctgaagctcgcaaaaaataaggaaaatctccttcctgcgaagaccctcagtagccaacttaaagataagtagaaatcttctgagaatataggatgaggcggtcattaggcctatatatgacacataaaaaggctctcaacataggctataaaaacactccgaatttgaaggctaaaaacacttattctttacttttctataacacttgtacgatcaaatcatcgtttcttatcaataatatcaagaacaccatctgtggttacttaccgattctattgttctttgagattctcgcgaagactgtttctttgtaagaaccctaagaaacaatttccattgtgtagatttcgactctcacaatttgtcgctagaaggaggtgaaatttgagatttctcttactacaagaataaagaaccatcaaaccaagcagcaatg

SEQ ID NO: 13330 - DNA, 3000 bp, Unknown
  misc_feature (1)..( 3000): cDNA_ID_3029500_gDNA_ID_2214618_Annot_ID_187589 3000 nt of promoter + ATG
cttaagtataggatttctcggcttctccggtaatttttagctctaggccgagagtttcgcggaacaccacttgtttttctaatatcatagtttgagttcgagattggtgcgataaaaacctagctattaatcgatctactaatcatttgtttcatgagaataccataagcctaacgcttttatgatcttgtcgtacaacctcaaaatctgctattgcttactttttgtttctttttatttttattactattttacttagcttaattcgatagtcattagtttactgcgtgatctgagaactttgtgaattcgatccctaagtgctgcaactgacctctttatttgagagagtggtcttaggattaatttgacttatatcgtcgttgccaaagttctctgtgattcaacattagactaagtgtagaatttagcctaagtgtttattttctttattttgttactcacgcgttttctttcttctttttcttgtgacaagggaactacaagatggaatgtaacaaactgctggcaaatttcgacgacagtgtcgaacgacaccattagggtgtcgatcgacacaatttgcagaatagaccagctaccataggcgacttcaacagagctgatcttttctactccaatcgatcaacgatccagctacctccttttataagagaagactttgccattcaccctgcctactataatcttgtttcacgaggaaagtttcgaggtgcttctaatgaatcaccagtagatcatctagaagtctttgaagacttagtgtcctcaatcaaagcagatggtctaccagctgattatcatttttgcaaactcttcccacactctctcgcgggcagagggacattatggctgcgacaactagaaccaggttcactaaccaattgaactgacacgaagaacgcattcatgatccacttccttgattattcagtggacgaattactgagggagaagatctcttcgttttctcaagattcaacagaaggtttgaaggcagctttgatcagattcaaatcatatcagagggattgccctcaacatggtttccaggaaagccagctcatcaacatattcttccgcgcaatcgataagcagtatcggttttgttttgatggtgcaagtgatggcaatttcatgaaaaggactccaagcgaagcattggtacttataaacaacgctatcacaagtctctcaacttaggacatagaaagtgatcggagaaaagcggctgaggtttccgacaagtgcagagcagaacaaggatctacacacattgcttctccatatatcccttcttacatccaagcccacccaccaaccgttgctcagagtagaactgaagccatgctagaggaattactcagactttcaaaatcgttttttgaactgaaagcaaaagccaggaaactccaggagtctgcttatagaaatgagaatcgagttgattttgacagtgcataggtagagtcgacccacaccgaccttctacaagaaaagtcacgttgtgacaacgctatcacgaccaaagtcggccccgacagtgtcgaccgacaccacctgggtgtcgatcgacacaagtaccacacagataggctagtgttgacgtttgacagagtaggatcgatgccaaacactagtgtgacccacactcacctagtggtgatcgacactggacttagactgcaccaatatgccttgaatctccacctattactagacaagtctacacaccagaagtgtaacgtccgtgaaccggaaaatcggttagggtttgtatttaaatcgcccggttcaatcggttgggttaatgaaaaccctagagtgtgcctttaaaagaaggaaactcgaaattagggattttgttagccacttttcgttttataaaggagaaaaagagagagaaggagaaggaccaaaatcgttagggtttgggaggaaacagtttcgacataccaaatcgttgttaaaggtaacgaaatttggtagagttattcccaagtcttttatcgtcattctcctttttacagaagtggatttggatttaaattcgttgagttatttgcagtttcgtgagacacgttttctcagacgcgaattaggactagcgcggattgtaactgtgatcgtggtctcatctggtttccgatcaatacaagattttggggaagcttcatgacatctaaggatagtgtttcaacggagggatttgatagttaacggttggtctttattttagggattcgtctttgagactgtttgtttctgtttttcagtccagtttgcttcaactttgcttttggttgtgtgacttgttgtatgacatttctgaactgttttagatgcaaggagagtcttgtaacatccccgatccgaactaggatcaaggggaagggctgggacgagacttgtagagagtcgggtgagaaaactcgtcccaagtcctgaagaagggcggccaatcgggaaaaacacgaatggccaagagcccgagggaaagaagatggagtgaatagctcgggaagctaagtaggaagctagggcagctcagcaaaactcagagaaggttggggaagctcggccaactcaaagggaagctcgaccagctcaccggtaagctcgaccagctcgggagactactagctagctccactagctcgacctagctggatggggagtgaggcggttactcggcggttacccggacggttgccgaacggttcccccggcagttaccttgagcggttacccggcggttaccgggctataaggatgcgccacgtgtgtggttgggaaggaagcgcactgaaggatccagaaggacctagaggcgcccgttcgcaagaacggttactcgccccttccttataaataactcgcccttcggccaaggaaagaacacaagtccatacaccgaaactctcaccaaactcagaaaagaaacgtgatctttctaagggtgcgagagaacggaacaag

SEQ ID NO: 13331 - DNA, 3000 bp, Unknown
  misc_feature (1)..( 3000): cDNA_ID_3029509_gDNA_ID_2214618_Annot_ID_187585 3000 nt of promoter + ATG
cccgagcctcttcgatagctttttcttcagctcagcccaacttagcctttttgttgtttgcgtcgggtgttcactcggtgatggggtttctgagtttgtgcgttgccataaagcacattcgggcattcttctgatttcacgtcctcgagcgtggggtgtatcagcttggtaattttgggcctaggagaagtttcgcccctcgtgatgcacgaaggttctgtctagagcaccctttttctggctcagagtgctagattgggatttatcagcctgaggtgtttgctttgacgggtcgtgcctttttgacagcaactccatctcctcatcatgggaaacgtaatctgaggctcggtgcatggcgtctcggatcgtttgtggttttgacatatttaactcttttcggaattctaacttgtaccacaatgtcttcttcaagggagagagctctgcgacgtcgttgattccctcgacctaggctagggtcaacctaaactttgtgaggaatcctttgagtggctcatttggctgctaagatagcgaccaaaggtcagcgtctgatgtgcctggatcaatcaacactgagtattgtttgaggaaaagtgttggcagctcttggaaactgtcaacagaattctcttcaagttttaagaactaatccaaggccggccccttcaggtgctcgacaaatagatgaaagagacaagcgttcctctcctttggcttgaacttggctcgggccatagagattataaatgactttaaatgccccttgaagtactcgatattgagcttcctcgggtctaaaattattgcgttggagatcttacgagtgaaaggtgtgttgtgggactcttccagaatgtgatcgatgttttgagacgaggagactgcgctatgcagctgcgatcgaacaagcttcatctcggttttttccttggctagggagagtttgatggcatttatttcttgttcctatcatattcctcagcccttggcagcctcggctcaaggaatgtaaaactgcggatcggtttcctccacttggtttgtcgcgttcggctctcccaaagctgttggttttgctcggattccactgagcgctggcacagttcatcggactggcctcgtcgtgttaccaggcgtattgatcacgagcctcgttggattgaggtctgccgctactcgccgatcatgaaaatgtcgcacgtcaaagcgggtggtcatgatctgcccttggaaggtagccgccttgagctgctgggccaaagaccgattcgcttgttcatgatagtccaccttcttctgaagttgtgccatcatgcttttcatttctgctaggactgcgggagtggcgaccttaggagtgtttgtctggactggaggaatcgggtttccctccatgtccattgtgttagcggggacctgattgttggtcattgctgcttggtttgatggttctttattcttgtagtaagagaaatctcaaatttcacctccttctagcgacaaattgtgagagtcgaaatctacacaatggaaattgtttcttagggttcttacaaagaaacagtcttcgcgagaatctcaaagaacaatagaatcggtaagtaaccacagatggtgttcttgatattattgataagaaacgatgatttgatcgtacaagtgttatagaaaagtaaagaataagtgtttttagccttcaaattcggagtgtttttatagcctatgttgagagcctttttatgtgtcatatataggcctaatgaccgcctcatcctatattctcagaagatttctacttatctttaagttggctactgagggtcttcgcaggaaggagattttccttattttttgcgagcttcaggaaaacatccagatttgacaatatcctcgaagattcttcattatcatttccgggtttttcggaaattgtctttggatcctttttataaaatgtgcaagtctttgctttgggcaactatgtaacgcccacgatcctcaataggatcgttggctaggacttggtccaagaaaagaaggtggagactcggacaagtgggaaggagctggccataagctcagacaaaggggaaatcatgcgggtcagttcgtctgaagctcaagctcagctggaatgagtgacggttacttgggccgagtgacagtccagctcgggcagccagacgagtgacggttaagctcgaggcagttggaagagtgacggttgagctcgaggtagctggtcgactgttcgaccagctgggcggttatccagacggttacttgggcagttatggtcgaacggttacttgcccaaagggtggataagggcgagcagttacgggcgaagatatacaactcttcggaaagatgcaaggaacggatgtgttgattcggcgggtcttaattgacctactggaaatcggttggactgatgtgcgatcttcccctctccgaatcctctctacggatccgagtaatgtatggcctatagagcattgcatggacttgcatatgactaagtaaatgagattacttatggctctatgactttcaggaacgaatggtgatcgtgggaaggacttggcttaggcgcgagagactcaaggtcgtgatgatgggtggtgatagttcggatagtctagggatcgattatatgacttgtaatagcttatatgcaaactcataagttgtttactctattcgtctcatatattgaatcatagaatcatataaaacggattacactaggaatgaacctcataaacggttaaggccgagtcacttagtggcttggggcgggagatctcgtccggacttaggcagtctagatcggggcctttcaagttggtatcagagcatgcttggttctaggactaggtgttgggttaaggggtatcaccactcgttgacttgagaatctcgcggtagttgttctttactcttttgcgattttactatgagttatgtggattaactttgaaggtttcgcag

SEQ ID NO: 13332 - DNA, 3000 bp, Unknown
  misc_feature (1)..( 3000): cDNA_ID_3029528_gDNA_ID_2214618_Annot_ID_187580 3000 nt of promoter + ATG
tagataaatgtcacaaagcatgataaaaaaacaaaaaaaggacaaataataatttagtcatacaagttcacttaccttctgactttcttaggatcagatacaatctcttgaagtttggtactctttgcaatatcttgaagtttggtactctttgcaatcttattcaattcatcatcagtataatcactgctaccaaactcgagccaggaagcatcctcttctccatcaactgaacttgaagaggaaaagttacccggagaaggaggcaacttcagtaagtaatgtaacaactatccaatgaaacagtcctgtaatgtctcctcaaaggtgccatgcctttggctgctcttctcttcacacccaaagggggcaatgaaggatttttattaaccttaatggaagagtctctactctccacaggagctgacggagaaaagctcatcgatggtaatgaattgcgacggaatgttgacgaagaagggctcaatgggggcaaggaggaggaggcaagtgaaggctgagtcatagaccgtgatccggaaggagtagtgatattgtcggatccattcattgttaaggattggagaagaccaacaatggagtataaatctgcatcatataaaacaagtcatgtttctacgtataactcatttttttacatgcaaaaaaacaaaatatcaaatagaaatgggaaaatgataaaaattaatatgatcaaagatattttgttttgcaccgtgacgatatcgagattgtcatcagttattggagaaaggagaacaaaaacacaattgaaacgtttaataagcaataaagagttgagaaaaacctctcagaaacttatgtttgtttggatggagaaaggagaatattatgtatgtttggatggatagtttgctcgaccctctttttatattggttaagaacaacacttcagtctcatgtttttatccccaattataaaaatttaatgattttccttcttaaatccataagtttgaatcttatttttgtgaaacaaataacatacaaattttgaagtcaacacatttgatggaactctgtgtctttaagtaatataatgaaaatatatttatatatatctaaggtaattacgtgttgctattgactcaatcttaatttaatttatattcttggcatgttaattatttttggctagtgagtgattttagagtgttgtttacttttgctagtgagtagttattttgacatgttgtttattttcctacttagctattttggtaaaacatttatttgtatttattgcaaagttattttggagtattgtttactttttctattgaggtagtttggcaagttttttagataaggttattccgtgttatttgtaagggttgacattttttttttgcgagagatgggaggtatcgtaaaacaccgtaccaccatatgcacccaaacaaaaccacctaaagatgatactaaaccaaattaaccgactacaaccaaacctccaaaaaaatgataacaaaatattttaaccacctagagatgatacaaaaaaaacatcaagtcaaggatccttaatccacataagatggttagtacctattgccaatatttaaccacactaaatctgctcaaatgttttgccactggtaactacactgagttgcaaagagttacttagtgagtgtttttgtttttttctccaaaaactgatccaaaacagacccagattagacatttatccaaactgtatagttataagatccaaacgggtaataaactttcccacccgaagaattctaaatccgaattaacccaaaccgaatctgaaccaaagtttgaatatataggcttagatagagagtatgtctttttgccctagtcaatccattttaacgtttcaaatggttgttaacgtttaattaatatataaaataattacatatgaagttgatatataaacgagtacaatttaaaagtgaaaatattaaataatatttttcctatcaaagactatatattattaaatttattcgaaatggttagtcacataagacggtcactccagaaggagcttacatgaaaaatgtaaccttgtgtctcaaggcttttgaaccatactctaatttgaaaattttatttgtatttcaggacatacctatctttttaacaatagtcaaaatcagtattatgttgttgtctaatatacattctaatttttctgtacttttttgttcgtttatcttcatattcaaaaactttcttgtatataggctctataaaccgaatcacacgtggatgctaaaatcctaatacctttcaaattttaagttccttaccgtattatttaaaaaataagaattatatgtttacactaaaccgtctttgaccaatgttaaaatattatcaatatgagcaatctagtaaaatagaatatgaaaaaaaaattcttataatttgtttagttttaatacacttggattaagctttaataaaatagtaaatttggataaagctttaatagttttgcatatttatgtactttaggggtttagtaaagctaagcctaaatgatgcaactgaaaaacttaaatttaaaacgcatatttaggtttcattagtctaaagagacatcttgacctccaaataatcaaattgaaacgatggtcttgatttccgcaccaataacaatggcccttcggattcacttggtccgttctcttattcggacatccattggaacgatgcccttcttcgctgcagaaatagcatgtgatatatgccgtcgttggttgggtaaccacatggcaagatcgtgcgaaatgtcccaattttccacacttgtaacatgcccttggatcataatcgtttctcctcctatcattgttatagctcgcccttgttctttctcgatcattgtctctctcttgatttagtgtgaatttaggagccatcctcaacggacgagccatcatcgacggagaaaaataaggcaattgagggagaatg

SEQ ID NO: 13333 - DNA, 3000 bp, Unknown
  misc_feature (1)..( 3000): cDNA_ID_2713470_gDNA_ID_2214618_Annot_ID_135833 3000 nt of promoter + ATG
atctactcgcccctcctactcgatcctctacttgacccatttactcgatcaagggtgacaaactctacaagacttgttgagctatcaaagcgtcttcggatcctcctcattctccactcaactagacatctgagcatacggataggagaggaagaagcatctactcaaccaattgatcactcggagcatagacacaaaggcgcaaactttgaagcaccctccttactcgatccccaagatcgagcattcgaccaaaccgcctgaagtctcttgtcttctagtgaatctagggtttcaacattttactataaatatatcatttggggtttgtgcaaaggatccagcttttatcctttagtttttctttgtgtttatgaatcttcaaaacttaattactcttaatctatttcgtttttgcatttacttgtttaagtaaagttgtttagcttgtttagatttacattttggtatgatttcagtaatttctgggtttgtgttcttgagaatgttgcttgagtagtgattagggttcttgaggatggattagattagggtattctctagtttagttaggtggttaagattaagttagaacccttctggattcgcttggcccctatgcggttttcgctggctaatgtggaaattcgatcatagacgtctagagtccaaaagacgttcaaatggatgtcttatctacgagttccagagatttgtagatccgaccaagacattggcttgtatgcttattggctttggtagattgtttcttaatccctgctctgctatgtttcatcaacgacagttgagattaggaagtggtagagttatgggaatctctatcacgacagtggattgacccggtttttgaatctatcgtcaagggtatctacctctcacctattagccatctgatgaaccctagagttgcccttatcaatgaatccatccttaggacttctattagatttagttgtatcccctgttgattgcacttttatttacctgttatttgtatcccctatttgtatcccctgttgattgcattttgattatgcctgttggttctactcgacccaatgatcgagtagggcttttaagttctcatttttacttgtttgaatcctgacctaggattgttactagaaacccaccatcattataatctggcttgacttagttgtttctgtacacgtcttgattgctagcattaacagtgaactggattgaaaccccctatagctgcattgacatgttagtatttgtaggggaattgaactgaaccacacccttcagcatataagtaggcctaaaaaacctgattattaggaactcgcatactggatcaacatcctcggcttatttacaacctttgtaattgatcattcctaataatgtataataatggggtcatagtaaacatttctacccctataccctaccgaaatcatatcaatctcttgctttctttctttttttaataaggggagagaaatacttttttttttttttctcattgctctcaatatcatgtatgaacaaggaaacaaattctattaacactaaccgtttgatgaggtaaaaggaagatcagtgagattagctccggccttaatggattgtgttggaaaccaggatatcctcaagtttgttggtttgccatctggattttccaatagtcgaattgagtcgcacctgtagcattaatcaaccaggcaataatctaaagaatagagatcataattcctaacaaattttaactcaataaaacgactcaaaaataagaaaaactaggatttcacctgtggtacaccacggggcaaatgttttatttatatacatatataataatattaaattttattatttttaatttattaaaattatataattttatattaatgttgtaactaaaaaaattggtgatgataaaataagaaataatattttaacatgtgttatatcaatctaaaccgtcttgctatatttcagatcaatccaaactcgtcccgctatttaaaaataataattgtttttgactttaatgtgatgacattttttgtaaattcatactttataactcaaaagtactttaaaaaggtacttcaatttttttaatatatataatgctatttttttgaaaattattatatataaatacttagtttaatcataatttgggattgatatacttgtgttttttgactaacttttattattattttaatagcctaaatttgggcattttgttaacattatttgagtcaccaatatcagtttaatacatgtccaatttatttttaccaaaaaagaacaaaatttcataaaaatatggaaagaaatttttagggagtgataattatattgtacaattgcaaatttaaaacgaaaaaatgtggattgggaaaaaattattgtttcaaattttaaaatgttatgtaattaattttttttacagaaaatattgacgcatatattgtaatataaggtttaattaatttattaactgaaaataaatgatttaaaaggaacaattattgttattaatgctaattgatccttaaaaggaatgttagtgtgtagtatattgtagtttagatttagaaagatttaaattatttttgtgattttttcttgtagtttcctaaattttagtaacaaaatcgattttatatttagatttaaaaataaatttgttaaaacattcaatgtcagtggcatgacattgtaaataagtttcaacttgaggaattatttggtaaaatagttgcaaaaatgtatatgtagataagagtaagaataagactcaaaaaagaaaaacgtagttagtaactgcctcccctagacttaaacgtcactgtccctagtggcattcaaatccggagtaagcgagaaaaataaaaaaataataaaaaaataaaaggaaatgaaaaacaaaatcataccagtgagttgtcacccactaagcgcttgtttatagtcaataacttgactttgatg

SEQ ID NO: 13334 - DNA, 3000 bp, Unknown
  misc_feature (1)..( 3000): cDNA_ID_2702716_gDNA_ID_2214619_Annot_ID_135835 3000 nt of promoter + ATG
ttacatcaccttatcgtcactcaaacgtaattagaagacaaattaatgctgaaactttacaagatgattcgtaaaatatatgtttggattcgtcaacgttaattagttcaagtagcaattaaatcagagacaagtttcttccacttaaatatgcattgacctacttagtcaacgtccttccactaaacaagtccaatgcattctttttcttatgtatccttctcttttatttggtttctcacttctgttccatttttaatttattttatcataggctataattcaaaattttacggccgtaccttactttttcacgcatgtaaatgaatgtaacattgtgcgctaaaaatgttagttcgataatcattcttctttgttatcaaatattttaataaaataatgtgactaaaatctcacattttcggcagttttgcaccatatctcttgtatttcctccttctataaatagccaatctctaaagtttcaaagaacaccaacacaatctcttatcaaataactaacaattcacaagaagaaacaatggtacactctcgttttttaaacgttgttttagtcctagtgaccattgcttccatattctccacatttgccgaggccaataggggctttgggtggggttggggtggacactccaacaattcaagtggttcaggttcaaactcgaggtccggatggggttggggttggggtcaaggctccaactattcaagtggttcagcttcaaccccagggtcaggatggggtttcggctctagtcgaaacggctcaggctggggttggggttggggcggggttcccaacaatacacacagctcagggtctggcggctcgggttggggcatggggcctaacaacaattacagctcgggatctggcggctcgggttcgggctggggatatggaggtcattcaaaaaactataatgccacctacaatggacctagaaagatcatagtcggtggagacaaagagtggacttatggattcaattacgctgactgggcttctaagactgctccattctttctcaatgacatacttggtgagtcattttagacattatctcgcattatttaggaaatgcatatacttttgatggcggtcgagtaatctattgcgagaccacttgatttttggggcggataatctatccataacattttgtttcctaaccgtatggataacaaaaaatatatttacgtatccacacataaatacgtttaggttccattccaatgaagtagtctgccgtatacgtttctacacttatagcaattttaacaaaaatattcatgcggatgcagttttcaaatacaacccaccagccccgttcacgcacagcgtttacttgcttccgaacccatcgagttatgaaaagtgtgacgtgaagaaaggcaaaatgattgcgtctccgaagcaaggtgctggaaaaggctttgagtttgttctaaaacagatgaagccttactacatttcgtgtggcgagcatgacggtgctcattgcagcaatggtaccatgaagttcaccgtcatgcccatgctaccccgttggtaatttggtggtattaaatccaatgctaaagtatcaaacattaggtttttgttttgtttttgtgtcgtcaataaatgagattaccattatttacgtgcgttataccatattcacattttgttggaattgtttgtgcttctgctttatgtctttatgagatcaccattgtttgaatattaccatatgtttatggtaagatggcaaggtttggtatttttgtgacgaaaaatgacaaattttaatatttgtttgccgttatccgttaacaatgttagaataatggtacaaacctcaaaacatcatgcggtcagaaaaatgcgactgttgttcattagagtattattaggggttaaaatgggtcaagtttatgggtaaacacaattcagctcaacgcaacgcatgaactctaatgagctaaatttttttactcaaataattagatggatcaaatgaattgagttacaatggattagtggtttacccattaacccaccaattttggctaaattgaataaaccaacttaaatctctaaagtaatatcaatttgagtttaaccaaaacctttaaactaattgcatataactaattttttccaaatagcttatcaacccatcaatttattcattatcaacattcaacacaatatcattatcatattaccatcaccatcgcaaccataccataatcatcatactatcttcatcatcataatatcaacataccatagtcatgatagctatcattttaatctaatatataattttgaaatttatttatcctttgttgaattgaatttacttgttgatcatttactttctcctattacatgtagacgtcgatcttaatctcgtatataatttttaaatttatatacgtaaataagacttaagatggataataaaaagacattcatatagaaaactttgaagaagtgataaaaactaatttatataggatgtcaaactaagtacaacacagaagaagaccatggtggtacactcactggtgcataaagcacatgcaaaacaatgtggtatacgttgattatagttaactctttatactgactagataattaagttttgagttatacaaaattaatcatgcgatatttaaggatttcctctctttttttttatagtacaattatcttttgttggttgacaaaagaaaacatcacatagacgcaagtaattaataattactcgtagatgtgataattacacgaaatataaaaaagaaactgttgtaaattatatgttctactcccaaatcaatcgggaatatacgtcttaattaggttatctttctctataaatacgtttctcacataaccaacacagattatcgcagttcacaataagcaaagcaagagtcacacaacatatactaaacaaagcacgtaaaaagaagaaaaacacgatg

SEQ ID NO: 13335 - DNA, 3000 bp, Unknown
  misc_feature (1)..( 3000): cDNA_ID_2702722_gDNA_ID_2214619_Annot_ID_135837 3000 nt of promoter + ATG
atcttcaagcatactaatcacaggcttcttcctagcatcccttaatccgttatggccctgttgaaactctctgataagttattgcaaacatcctcacagcaagaatgcccactgaaaaaggctctacaccacgtctttggctctgttttaagcaaatcctcataagcaagcggatcataacttttcaaagctctcatgttgtatgtgtaagtaccatctgttgagctgtaggcaatggcccagaagtaactctcatgacagtagtccccgtaaaccttcttccaattggaatagatgtgcctagcacaatgcctatgttcagcctctggaagcaagtcagcaactgcattgagcaaccccttctgcttatccgaaataactgtcagtccattacccacacctaactccaaatccttctttaggtgatccacaaaccaagcccacgagtcattgtcttccaccctaactacagcccaagctatagggtagattctattatatgcatccctctccacagctgttagaatctcacccttcaattctcatttcaaaaatgacccatctagaccaatgataggccgacaacaatttttccaagttctactaagagctttaaaacatacataaaacttgtcaaactgttgcttaccacactctcttgggatggtcacaatatcagtgtggatatccttattagacctttgaagttctgcctcataatcccatagctttccaaactgaactttctgagtttctaccaccatgtctaaagccattcttcttgctttttggcatatccacttagacacagagagtgtgtacctcatcataatctcatctttgatgtcagtccatctcaaaaaaggccgccttcttgcttcatctctgaacatcctagcgatgactccctgtttcagcatttttgctttcccactcttagcatggtgatgcttatcaacataagtttatactctccatatacctgaacgcttatgagtggagcagtatatcttccactcacaattttcatggctgcagattgctgccaacttatttgcaccccatctacacaacttcacatcataattcatcttcaatacataccgcaagagttgatccttaacctcttaaccactattgaaagtctgcaacatccaaatgtatggaggtttatccttcgaaaacttctgtcgagatgatgatctttctgcttggtcatacgcatcccattcatcatctgtgtccattgcatgatccggacgctctacatcataacactgtctctcaaattcatcttcatcttcaacctcttcagcaacggtttcttctggtactgtgttaatgtcttcagctgcagcatcatcaacaacatcatctgcagcttctgtaccattgtgaatttcgtcaaagaaagcctcaaaccgaggatcatcgtgccttctttcttctactggatcttctccattagcttgtactctttcagggcactcattagtttctgctgcaggctcctcgtctatgatatcttcggcatcatcatcctcaactccaagttcctcgtcttctacaacatcatttggaagcggaaaagctgcaggtacagagacggcattgacgatgtatatgtcaacttccccaccaatcatcgcctcacgacataactcccttatcccaccatctttgtcggcaccgataactcttgctgaatagatttcctcttctggaagcttgtaccaaatcgattcgacttcaccattgactccattttctttgcaagaatcgtcgaatatagaccatgtcatcagatcaggatccatcaccatgtctttcgcctcgacccctccagagtaatcgaacccttggtccgtgaaggatacatcgcctctatagtttatgttgagtttcaaacactcgaaatcactggaaaatagaaattaaccgattagtagtggtaaacaaactataacctaactgattcataacccctaacccaatttcaaacaaacccagaaaatttcaaacttaagaaccctaaaaattcaaatcgacagacccacaacacacaaatcgacatacctcatcttttcgactgtttaccaactggatcgaacgcagatatacccgatcaaacgcttcgaatcatcgcctctttcaatttctaagttttttggagagaaattagaaatttggggagttagggtttctcaatcccaaatcgatttgggggaaaacaaatgagggtactgtagtcttttagttagtcaattaaaccgcggattgttaaccattaaccccggtttagtgattccgtcagccaaattaacgtctgttaacgcgcatgaatgatttaaccacgaacaattaaatagtgtttttcttgaacaaaatttaatattttggaactttaggttccaatcaaaaacaattgggtattaaagttttaaataaaaaatagttgggttttttttagattttttccctaaaaaaaaagaataatattttgcaaaaaaattaaataatttttaagaaaaagaaataataaaaccaaatatttattgtgtagtggccatagtgggcaatcacctactatccactcttatggaatgtacccgaagggacgagtaataaatttcttattttttaattttggcagcaagtaataaataaattaattaaaagttaaaaataaataaaaagagacaaaatttgttggaggaagaaagtgggtcctagggttttcttctatctgtcgttttgatttctgcgtttaataagagacaagtccccgtctacagtcttttagagacggaagctactgagacagagattcacaccattgttctttgtctcttcctctgattctttctctctctctctctctctctctctctctctctctctctctctctctctctctctctctctctctctctctctctctctgtctcgtctttgtttcggtttcaagaaagcaagaggaagaagaagaagaagaagatg

SEQ ID NO: 13336 - DNA, 3000 bp, Unknown
  misc_feature (1)..( 3000): cDNA_ID_3029601_gDNA_ID_2214619_Annot_ID_135839 3000 nt of promoter + ATG
catctgcaccctcagggatttctccacagtcatggatcacaacatcctgagaaggacaagactgttcctctatgctaacatgctcaatcgaccgaacaacacccattcctttcgtaacccttccaaacacaacatgtttcccatctaaatgagaagtgcgagttgtcgtaatgaaaaactgagagccattagtgttgggaccagagttagccatagagagcatccctttcctctcatgtttcagctcaaaattctcatcgtcaaacttcaagccatagatagactcaccaccagtaccatcattagctgatatatccccaccttgtatcataaaccccttgataacacgatgaaatcgattcccctgtaaacaaatacaccaaataccataagtacatcatcctatagtacaatttcaacctaaagttttgatctttacctcaccactacaaactacagtaacctaattgcaatactgaaacaaagtcagaagctattcagcaatacgagcaaaaacccattaaacctcaaatcataagcattcagaaccattctatagtacaattgcatcctaaagttttgatctttctttcacaactaattgcaaatttaaccaagttttgatctttataaaccccaatgacgaatgacccattaaaccacaaaccctaaatcacagaaacaacaaatacccatttctacatttcatacataagagagtataaacaaagatatagagagaaagagagaaccttgtaatggagaggtacaccagtatttggacctaaacccttctcaccggtacagagtaatcgaaaattctcagcggttttgggaacaacatcatcgtaaagctcaataacaatccttccttcaagctcacctccaatgctaatgtccatgaaacactttgacctacccatcttcttcttcttcttcttcctcttgctttcttgaaaccgaaacaaagacgagacagagagagagagagagagagagagagagagagagagagagagagagagagagagagagagagagagagagagagagagaaagaatcagaggaagagacaaagaacaatggtgtgaatctctgtctcagtagcttccgtctctaaaagactgtagacggggacttgtctcttattaaacgcagaaatcaaaacgacagatagaagaaaaccctaggacccactttcttcctccaacaaattttgtctctttttatttatttttaacttttaattaatttatttattacttgctgccaaaattaaaaaataagaaatttattactcgtcccttcgggtacattccataagagtggatagtaggtgattgcccactatggccactacacaataaatatttggttttattatttctttttcttaaaaattatttaatttttttgcaaaatattattctttttttttagggaaaaaatctaaaaaaaacccaactattttttatttaaaactttaatacccaattgtttttgattggaacctaaagttccaaaatattaaattttgttcaagaaaaacactatttaattgttcgtggttaaatcattcatgcgcgttaacagacgttaatttggctgacggaatcactaaaccggggttaatggttaacaatccgcggtttaattgactaactaaaagactacagtaccctcatttgttttcccccaaatcgatttgggattgagaaaccctaactccccaaatttctaatttctctccaaaaaacttagaaattgaaagaggcgatgattcgaagcgtttgatcgggtatatctgcgttcgatccagttggtaaacagtcgaaaagatgaggtatgtcgatttgtgtgttgtgggtctgtcgatttgaatttttagggttcttaagtttgaaattttctgggtttgtttgaaattgggttaggggttatgaatcagttaggttatagtttgtttaccactactaatcggttaatttctattttccagtgatttcgagtgtttgaaactcaacataaactatagaggcgatgtatccttcacggaccaagggttcgattactctggaggggtcgaggcgaaagacatggtgatggatcctgatctgatgacatggtctatattcgacgattcttgcaaagaaaatggagtcaatggtgaagtcgaatcgatttggtacaagcttccagaagaggaaatctattcagcaagagttatcggtgccgacaaagatggtgggataagggagttatgtcgtgaggcgatgattggtggggaagttgacatatacatcgtcaatgccgtctctgtacctgcagcttttccgcttccaaatgatgttgtagaagacgaggaacttggagttgaggatgatgatgccgaagatatcatagacgaggagcctgcagcagaaactaatgagtgccctgaaagagtacaagctaatggagaagatccagtagaagaaagaaggcacgatgatcctcggtttgaggctttctttgacgaaattcacaatggtacagaagctgcagatgatgttgttgatgatgctgcagctgaagacattaacacagtaccagaagaaaccgttgctgaagaggttgaagatgaagatgaatttgagagacagtgttatgatgtagagcgtccggatcatgcaatggacacagatgatgaatgggatgcgtatgaccaagcagaaagatcatcatctcgacagaagttttcgaaggataaacctccatacatttggatgttgcagactttcaatagtggttaagaggttaaggatcaactcttgcggtatgtattgaagatgaattatgatgtgaagttgtgtagatggggtgcaaataagttggcagcaatctgcagccatgaaaattgtgagtggaagatatactgctccactcataagcgttcaggtatatggagagtataaacttatgttgataagcatcaccatgctaagagtgggaaagcaaaa

SEQ ID NO: 13337 - DNA, 3000 bp, Unknown
  misc_feature (1)..( 3000): cDNA_ID_2702734_gDNA_ID_2214619_Annot_ID_135840 3000 nt of promoter + ATG
gatgtaatgggaagaaggaggattaggggaggcagagtatgagtagagaccatggcggagtagagccggaggaggtggagaagattgccttaagaagattgtgacggcgtcagccaccaccaccaagaactccattgttatcttcgtaatctctatgcatagctcgattttctttatcaccatcctctctttctttctctttctctattttgttttgcttctttttttttctttcgtctctaccgtcaaattcttactccatcttcttcggtatttatataaagtcaaacatgcatgccatgtgaatattctatctataacttgaaagaaaaactattgtataacgtgttttgacttttttttgaataaagtattctaaattaaaaagttgaaaatttaaaataattggctgactgtttctgtgggtttacaggttttaattattcgcaactataagaaaatcttattatatttcatgagttttcggaattacaaaaaatatattcattcttccaattgcattccttaattatttttccactttttgtggttcatgaatcctgacaacaagaaaatactatttgatttgctttttttgccttaaagcaacgtccctctctctctttatctaaatcttgcaccgtcctaaataggggaagacccatgcctctcgtgaattttagtcttgttcggtgcatagtttacgcgactaaatgtgacagaggaaaaacaaaataattaacactgttgcgtcttatcttttgactcttggttactttagtttaactgcaacgtaagactttctagttctattttagaagaagaggttatatttgtccccggccgaaattccaatggtatcacggcttgcagcgtttcactaccgtgatatttgttttccagaccgtagtcccggcgactatgcattaaacatggccttcatcaaccaaaacaattgctagatgtgacttgtgagaaagctaaaataaacatatataggtttttagaaaaaaaaaaaaaaaaaaaaaatacaaaggctccaaaaggagggtaaaaataattcattaaagaaattttttttaacaattataagtgacaaataacatttgtattgctaactttatccatatttgtattattttaaacagtaaatatcaaatatatatttaaaaatggaaaaattacatcgtatgccatatttttcaaaatccttatgcaatttgccatatttttctgggccttacaattcatgccacatttggatgggaaatgtcaattttgtcctcaccatttcttctctattttatctctctttcctcgaaatccgtgcactttgaccatacaccattattttcccgaagactaaacgaaatgcatttgtctctctacatataactttcaattaaatttgtctcccaattttattcatcataaattctttgttgtatctagatcttgtccccgatttcattatctttcaaaattatcatataagatggcgaaaatagatggcaaaaaatagatggtttcagcatctatgtgaagacaataacgctcaactaatctgtggaccaaaatagatggcgaaaatctaaataaaattcaaaattcttaaatgagaacaattgcatataagatgtatgattcataataatagagcaagataatgaaatcgaggacaaaacgtagatgcaacagagaatttctattcggggacaagatctggagactaaaacaaaagtcttactccaattgttttctgctaacaggtaatcatgttccctaatgcattatatattacgttgtcccccggtatcaggtaatcatgtctcctaatgtattatatattacgttgtcccccgcagaattttaaatacccaataacaacagtagaaaccagctgttcttcactattctgtcccctaatcctttatgcttccacaatgatttttcgtcctgtatcatcacatcaggcaaaagctgttatgtcaccatcttcgtcagagcgctgacccaccttaagggtaatttcgtccactgaattccacgtagaccaaaatgtggcaaattttgaaaggaatttcagaatatagcagaaattgaaagaaatagagtgaaatatggcagattttgcaagattccctttaaaaattggtttgaatgataaaatattgagaacaattttagctaacaaaatgaaattaagctgtcatgatgtgatatacaatatttgggtccacgaaaaaaaacatccaaaggagtagcttccggcattggcattaatgtatagtctcgaccagtccattagaagagtgagtgtcggcccaaactttttagcaagtaaaaaaaaaaaaaaaattagctagcccatcaattcttttaaattatcaacagtcgccgaagtaatatgtcacctgacaaaaaaaatatatatgtcatccgttaatactataaaaagttttcatattttttatttttgataaaaagttttcatatattcgatgttttttaaatcaagaaaaatatgattaaaatcctccacatatttaaaaagttgatttaaatctttaactttcgacaaaacaaaataaatatcaactttttattgagttttcaaataaatatctaacatttattatttaaataattataaatcttagttacatttatattttaagccatattccaaattataactagaaatgggtgagtaaaaaaaatcataccgctctacaagtaaattatttaattagaagttaatatttaataaatttaaattgtagttttaattggtaattaaaatttaaattagagttataacacacaaaaaaactaacgaaaaattaattttgtacaacatgtcaacaagaaataaactttcaattttagtttcgaacatgaactatacaaaaattgaaacaaccttaaaaataaattttaaaatatgaagaataaaaagtaagtcaaataaaaaccaaaataaaagtagattaggcaatg

SEQ ID NO: 13338 - DNA, 3000 bp, Unknown
  misc_feature (1)..( 3000): cDNA_ID_2702746_gDNA_ID_2214619_Annot_ID_135844 3000 nt of promoter + ATG
cggtataccgcgggttaaaatctagtatatatatatacatacatatacatatttagatatttttgttattattgaaattacactgcaccgtacatttctacgcgaaacatgagtaaaaatgtcatgtttttcttcgttctctaattcttttgtcatttataaaaaattttagactgataaatcttatatttttgagtatttataataaatgactatagatttgaaaagaatgtacaaactaaccttgagtcacagtatcttgtcggaaacatgttggaaaatacgtgtaattacgtaaatgtcctttgtaacatgttatttttccgaaatacatgcgataacataatatcctctttttatcttgttattttctcttattacatagtatttataaaaagcacatggtattttttagaaaaaacattctattcagtttaatatctctttttatcatgatattgtagtaatacacgttttttattaagatcacacgtgatttctttaaaaatatattcttatttttttagtaatacatggtttttattaaaatcacatatatatatttttcttaagattctgttcatgtaaaagaatttcataataactttttttcttaaaaattcataacgttttttgaaatagcatgtttttaaactaaatataacatgtgaaattttaatgttacatgctattttgaaaaattatacggatgtatttcgtttactgttcatcttacaacaaatgaaagatacctttgttatttcctttcttccgacaacgtggtccatagttattttgtaacaaaaaactttctctctactagtttcttaatttatatgttttatttggttatttactaatattaccctatatttttcttcttcatccctaaaaaaatgttcaattttgggattgttttttcttctttcgccttaagtcaacgaaactaaaacttaatttcaatcttggtgtgtttgatttttatctgtttgatcttatcactttcaaaagagaaaacaaaagtttaagaaaatgaaaaacagtagtgggagctatcttcattcttctggcccaaagtgtaccaatctaagatattttacaatcttatctaaactatacacaaattatttaaatcaacggcgctcatactatgtgccatcattgatatcatcactcgaataattcactttataactatctccgtcactatcaaaaagtgttcaaaattaaaaaagaatatctcaatccttatccacttcatcattcctagcttccaagttattattatataactcaatttttctggcttaagagttttgaaaaatatcttcactagagatgataaaatcagtgactcttcgttcgtttcatctcccaattgagtttaacgacaccaaattcgtctcacggccttgtttcctggcgagatccttcccggtggttcgttgttcaagcaccagagacgtacctaagcttgaactcttcagccgcggaaaattcgaccggattcttcaagatccgccacttattgaaaaagccgaatccgaactctcaggtacaacaatttcattcacttcctatacatagacgaacactgattcagataagagtatcaacgaatcatgtttgattttgatttcagattactgttcgacgcttgaaggtgatgactcttacagttgctggagagcttactttgaactcaaagatctcgaagtaagtaattctatagttttttttttcaatttgagaatccaaagaatttagtgatagtgactagatttggttatgtgattgcagagagagaagccaaaggttgaagttgagaatttgattttgcaaacaggtggtttgaaatcgttaatcgggtgtttacatggagttgcttcaatggagaaagataacaaaaccaagaatggtttacatgtaggagaagaatcagatagagagaaaggaatgaatttgcacattcatattcctgatggtttaccaaaatctgaacaagagttggaggaagaagagaaatcgaaaatgccggattcagctttcactagattgcttagaagtaaaggaactatccctgcttggttctctcacgctcctgaccacgaaaccgactgaaagcggattacggattacggtacctttagaaagttgttatcttatcacagttatatgtaaatatagttcttggttttgctttagttcatgtagtctatcttttgttaagatgtgatcatattgccatagaaatgtggttgttattacttgatgttcgccaatgttgaatttgtttaatgctgtgtgcctattatagtactacgcggttttggtttacgaagagatttctattcttgataactgaagtggattactacggtacgacctatagaaagttgttttcttatcacatttatatgtaattatagttcttggttttgctttagattatataatgtctctttgttaagatgtgatcatattgccagagaaatgtggttttattgcttgatgttcgccaatgttgagtttgtttttaatgtcgtgtgcctattatagtactacgcggttttggtttacgaagagatttctgttcttgataacggaagtggattactacggtactacctttagaaagttgtttcttatcacatttatatgtaattatagttcttggttgtgctttagatcatatattgtctctttgctaatatgtgatacatattgccatagaaatgtggttgttattgcttgatgttcgcgaatgttgagtttgtttttattgtcgtgtgcctattatagtactacgtggttatttggtttacgaagagatttctattcttgatgatgtttgttctccggatgtgaagctaaatctttgaaaggaaaacaagagttttctaaatatagggaaaagatttgtttggtgatgcaaagatgaaaattgtttgacattattaataataaccctttggtgttttcatcgaaaccttttctatg

SEQ ID NO: 13339 - DNA, 3000 bp, Unknown
  misc_feature (1)..( 3000): cDNA_ID_2990239_gDNA_ID_2214619_Annot_ID_135845 3000 nt of promoter + ATG
ataatatcatcattataaaaaaataattagagttttttcgcatattccataattagaatttttttaaacgaatatacactattcaatacatgaaaaaaatattataacgggtgaaaaatagatttaagaaaactttctactgagtaacgggtcataatttgaaatatttatattaaatttcatacatattatattgaaaatttataatcttatatactataataattaataacatattagatttttttatgtgtatgatgtaattcaatttttaatacaagctggaaaatcctagaattgacgggtttagatcgatattaatacaagatggtatactacaggtgaaactcttaaattaacaatcaaactacaagtgtataatcttaaacactaaacaatatagataatatcaacaaaacatatacaactcacagtttactatacatttaaaatcaaataaaataatatcatatatttttaaatcatctttacaataaaagtttttagtttaactaaaatataagcttacatgcggtatactacaggttaatatctagattatagggcttattggatctaaagacgggtcatcaaagatttcctaaactgaagcaaaatatactgaatactcaaatatctatctgttaccaaattataaacaaataagttcgtaaaacaatttaatattttatatacaaaatcaattaaatcttaatcacataaaaattagcacaaaaaaaagtattcaacaattaaaattttatcaaatctctgtgttatataagttttgatactatattcgaataaagtgtaatattccttttcgatttgtattttttaactaacttaagctaactaatatatttactaatcttatacctatcaaaaccgactatcgtttcttatctctatagtatttttgcaagacttttttggtggatttgggtaaaagtgcattcacattcccctattaaataaatatggtgtactcctatgttattagctaaaatatttaaattataattcagagtcatatcattagtaaaattaatattaataaaataaatggctttttgcaagacagatttggagtgacgggtttttgaatcaacattaataaaaaagtaaaatataattaatccatcgtttcaatacgggttaaatctttaatttattattttttaagaccactaatattaaacatatcaaatcatcctaatttagaaaagattatataaaaccaaaaatgttatgtggtatgtataatgttactatatataaaattaaattataaaatataaatgtattagagaatgatataatttgtaaaacttttatatataaaaaataattcttaaattttaaaaattactactttaaaaaaaattcacaggacgggtaaataaattatagaacaggttttattttggaattgggttatatggtggatgtatttgtatcaatatttataaaattgtaaaatattattaatatgttgttttaatagggattacaacttcagttttttaacaattgtctcatggattcgtggtatagcgttacttaataacaattataaactgtaaaatataaatattttataaaaataaaatttgcaaattttaatatatattacttttaaaaaaagaaatcgtcccacggtataccgcgggttaaaatctagtatatatatatacatacatatacatatttagatatttttgttattattgaaattacactgcaccgtacatttctacgcgaaacatgagtaaaaatgtcatgtttttcttcgttctctaattcttttgtcatttataaaaaattttagactgataaatcttatatttttgagtatttataataaatgactatagatttgaaaagaatgtacaaactaaccttgagtcacagtatcttgtcggaaacatgttggaaaatacgtgtaattacgtaaatgtcctttgtaacatgttatttttccgaaatacatgcgataacataatatcctctttttatcttgttattttctcttattacatagtatttataaaaagcacatggtattttttagaaaaaacattctattcagtttaatatctctttttatcatgatattgtagtaatacacgttttttattaagatcacacgtgatttctttaaaaatatattcttatttttttagtaatacatggtttttattaaaatcacatatatatatttttcttaagattctgttcatgtaaaagaatttcataataactttttttcttaaaaattcataacgttttttgaaatagcatgtttttaaactaaatataacatgtgaaattttaatgttacatgctattttgaaaaattatacggatgtatttcgtttactgttcatcttacaacaaatgaaagatacctttgttatttcctttcttccgacaacgtggtccatagttattttgtaacaaaaaactttctctctactagtttcttaatttatatgttttatttggttatttactaatattaccctatatttttcttcttcatccctaaaaaaatgttcaattttgggattgttttttcttctttcgccttaagtcaacgaaactaaaacttaatttcaatcttggtgtgtttgatttttatctgtttgatcttatcactttcaaaagagaaaacaaaagtttaagaaaatgaaaaacagtagtgggagctatcttcattcttctggcccaaagtgtaccaatctaagatattttacaatcttatctaaactatacacaaattatttaaatcaacggcgctcatactatgtgccatcattgatatcatcactcgaataattcactttataactatctccgtcactatcaaaaagtgttcaaaattaaaaaagaatatctcaatccttatccacttcatcattcctagcttccaagttattattatataactcaatttttctggcttaagagttttgaaaaatatcttcactagagatg

SEQ ID NO: 13340 - DNA, 3000 bp, Unknown
  misc_feature (1)..( 3000): cDNA_ID_1008994_gDNA_ID_2214619_Annot_ID_187621 3000 nt of promoter + ATG
aaagtgtaaaacagattgtccactttcgtgtcaataacacaattatttgaaaacaccaatcaaacttgtcatggttttgcaagtccaaaagaccaaaaggccctattctttgtctacataaagctcacatgcatctctctctctctctctctcgttcataatgagatattaagatcaacaaaaggaaagaatggcaaaagctatggagctttgggtgggagagatgaagaagatgagtgagaagataaacactagaaatccattgatgcaaaggaagaattcaacatctgttgtgtccaaacaacaacaaggatcagaagaagaaagaggacttattaaccaaaagattagagagaaaaatgaagctgtaactatgtctgagctcactgtttgtcttctcatggaccgttttgttccttggtgatctttccatacccaactacttctagatctcttctttggtgatgtgtatatatatatctagaaactacatgtagtatgtctatatatcagattttgtttgtgcagaccatgtttttaagtttccttgtaaacctgtgaaagtaatgtgtttgagaaacatatttttattactttaatcaatagtgttcaattattattaaccgggatttatatgaagatggaactttctattcactctgtaattaggaacattcgcatcattcagtaagaaataaaacaagaaatgattataatttttctaataacgtaggaattctgagggaacccaaaactaaaatttgattgaaagattttgaagtggccaatcatgaatgagattgctggaagatatcatcaatattcaatacagataacgatttttttttttttttattgataccaaatgagctttcggcttttggcccagacggaaacaacggttacaaaaggtttgggctttgggctttgggcttttgatccacatgacgatcatatagttctttccttcaacacaaaacacttgaagtgtatcttatcaactaaactctattccagcaaaattatttcaaaattagatatatgggagaatttttacaggccattctagattttcattaacgctgtgatttatccgttaataagtacgattaagagtaaaacgacgtcgtttgcaattgaaacaaaaatccccaattcagaaataagaaaccctagatcctcaaatctcttcttcttttcttcttcgaattcactcctgtattttgaaatcaaagtgaattgcaaggcacaaagttcatgctttaaagcactgcaaatggcgaagtcatgatttatatggcatttttcctgtttttgtttcaattgcaaacgacgtcgttttgctcttaaacggtctcattaacggataaatcacatcttctaattgctctgtttattcagttgatgttgtgactaatttggctctgtcaacgaaagttagtgattttatctgaagtcaacacgtaattgatgattttaatcacaaagtacaaagtttatgtttaaagcaccacaaattgcgaagtcgtgatttaaatgacatttttcccgttctggttaaactaagtttctattatttaatatggatattgtggagcgtagtgtcagcactcagcagcttatttaacgtgatactctttaaccgagtaacaactagtgaggtcatattcaggaccgatccaacaatattgagggttttactccaagtaaaattttagttttatttttaattatcataaacgacataaatataatatggaaagatcacaaatactgattaaaaactaaaatcatcaaaacgaaaaagaaaaaagaaaaaattgggttcaactctcatgagttattaaacattttaggttttaggcttaaatctttaaaaaaaatcagaactgaaaaacgaaaaattctaattttattttggactctgattcatagcttatgtcgcttatgtagttatgctagggatgaatctgtatttcgttaccgtaatgagagttcgatactctcttacttgttacgattctggagcatgttacatttttttctttccgtcaacaacaactttaatatggtaaaacaaaatttatttttatttggctggtcctactcaagacaaatcttctgccgacatcacataatcatattaaaaaccataacttctgccactctgtttttttttttttttgtaaccattaactgattggattttgatccatctcatctgattttttagctcaacaatttacttgcacattttctatttggttttatttatacttagttacatatatgattatcgaactagtatctctttataattaagtatttttctatttttttttaatttagatttttgtgaattcatttacagtagaaaactgtaaaaccatatggtctaattatagaatgaaaacttcaacgaatccatacaacttattggctaaatataataaatctgcttgaagcatattgttattatttagttggatttgacgatctctgactttaatgtataccgacataccctatgatttagatgttgatttttcccattcttaatatatccatgttaagagattccaccataacatatctaattatttgcattgtaataaatattatcattaaaaaaaaatacaactggacagctggctcgtcccattgtttcttacgtccaccaattacatttgttaaagcaaacttattagaacgttcatgtgtgagaagttggtgtcgacatgtgtctaaggtctatgtcagaaatcggattagcttattaagtaaactatactatatcattgttaatatagataaaatatctagttcgtccaaattaaactattttcataactgccacgtggcgtaaacgtatccatcgagtcacttgtaatatctttataaccaaagtcttccaacacattcatcaccatctatctactctttactctcttctcttctcacatcaattattcatagttctctcttctccggcaagaaaag

SEQ ID NO: 13341 - DNA, 3000 bp, Unknown
  misc_feature (1)..( 3000): cDNA_ID_2702754_gDNA_ID_2214619_Annot_ID_187615 3000 nt of promoter + ATG
agctttgaaggtgtcctgttgataaggaaaacagttgttaagacacattcacccaatagagaaagtggtacctgagattgaaacatgagagcctttgccacattaagaatgtgctgatgtttacgttctacaaccgagttctgttatggagtctctggacaagaatgaaaagccataatccctttctgttgatacaaacgtgtaaaacgcagttatggagcattgtcagatcttacaactttcactttaaccttataatgattctccacttgcttaatgaaatcagaaaatattgtaagaacttcagacttagttttgagcaaataaatccatgttgcacgagaatgatcatcaactattatagttgtcaagaaatatttataaccatccactatttcaactgagaaaggccctcaaatatcaatgtgtaacatctcaaaaatctcatttcaaacattattctgagaagggaaagacaactttctctgcttagctagatgacaaacatgacaataatctgatcctttattcttgtgtttagtagttcccaatgattctgaaataacatccagtctttgtagagaagcatgaccgagtctgttatgccacgtactgatatccacaattgcattcactgaaacatttgtatcttcaacatccatgacataaagattagccactctcctaccgtgaccaagcatccggcccttgataagatcctgaatttcacaagcatgttgattaaatatcactcttgaaccaatatcatctgtcaatgaacttatactcatcagattaagacaaaattcaggtatgaataaaacattcttgagaagattatcatcattgagtctcaaagtaccaactccactaatcttcacagtgggaccagctggtaaattcactgagctcaaaacagatgtattcaaagtcaacaacagattcacatgatgtatagctcctgaatctatcacccatgttttagaggaaagagtatgttgagcaacagtcaaaatcccaataaaactataggtggaaggagagaaagaaataccaatgttatcagcttgagatgagctagctactgcagaattactgtgaggttgaggctgaagttgagagctaaacatagcaatgaactgttgaagttgttctttgctcagattgcccaccaaactctttagaccagaatgagtatcattagattctgtcgtagccaaagcaacattagaagcaacaggttttggtttctgtgttttatcaccaaccttacccttaggagtaaaacgtggaggaaatccatgcttcttataacatctctctgcaatgtgaccaaccctattacagaaagaacacatcgatctccccttattaggaccattctgaacatagtagatagtgggatcaatgctattagtaatagtgacttcagacacttggaaagcagctggtcgagcaaccacatttgaaaatccttgttgactattgtcttgatccacaatgtgatacacctctgctaaactcggaagtatcttcttagcaataatctgtctgcgaataatagcataagactcattcaaaccagctaaaaacttcactatcttagctcttttttgccttctgttgcagacgaagagctttaccacacgtacaaggatcatccaactcctctgtactatctaattgatcccacaatgtcttgagacgagtatagtactcggacaaagacaaagtaccttgacgcaaatcctgaatctcttgagtaagattatatgtacgtggaagattagtcatattgaatcgactattgagatcacgccatatatctgaagcatcattcatacgaagaatacttctacagatctgaggagacacataattgagaagccaagattttaccatgctattacatctagaccatagacaaaagttcttatccgtttctaaaggacgaggcagagttccatctataaatccagatttgttcttaacatctaacgaaatgagcattgcaacattccaatctccatagttcgtttcatcaagacgatgagagatgatattcaaacctggatgatcggcactgtgcaagaagaacggtgattgagttggatcacttgatttcggtgaaacgatgactcgcgaagctctagaagtcttggatctagcaacttgaggagaattcagaggagaatcatcaatgccggtggatcgcgactgtttgcgagctgaacttgttcctgacttcgatcgagttgattttcacgtcactcgagctactgtcaccattggatcttgagcttgagcaatggagaagacgatcgtgagcttgaaaatgaagaaatcagatcgagaaacaatggagtttgagcgttgatggctctgataccatattacgattgagagagatgagagagtttgttagagattgatgaaaatattttctcattaactctgtaaaatgtatttgtacaagtatatatactatgactatacaacctgttaacataaccgaaatacataatcaactaaaccacataaataaaccaacactctctgatagaagcggaagcgtttggaagcgtaaaagcgagtttttgaaaaaatttaggaagcgggtacgtgtttgaatcgtaattatatatacatatcaaaaataaaatcataaattagttgaaaactaatttcaaaatctaaacgttagggttatataatgtaattaatcgaaattaatacaaattttatttgttgtgtagtggtactagaggattttaagacttcacaggtggccagttcgaataactccgcacgaattagttttttatttacttaaaacgaataggggtaaatttgtaattttcatcgaggagtcatcttcttcttccccctaaaaaaacctaatcgccgtttcctcctgtttttttttcccgaacatagctaacgctggaaacgcttccaatctatacatacaacgcttctcaatcggaagcgtaagcgatg

SEQ ID NO: 13342 - DNA, 3000 bp, Unknown
  misc_feature (1)..( 3000): cDNA_ID_3029569_gDNA_ID_2214619_Annot_ID_187614 3000 nt of promoter + ATG
ccgtctttagatccaataagccctataatctagatattaacctgtagtataccgcatgtaagcttatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgtcaattctaggattttccagcttgtattaaaaattgaattacatcatacacataaaaaaatctaatatgttattaattattatagtatataagattataaattttcaatataatatgtatgaaatttaatataaatatttcaaattatgacccgttactcagtagaaagttttcttaaatctatttttcacccgttataatatttttttcatgtattgaatagtgtatattcgtttaaaaaaattctaattatggaatatgcgaaaaaactctaattatttttttataatgatgatattattttttcgcaaaaatagaatcatataaagatgagaagtgaattataataattaataaaaaattaatatgataatttagatatcaaatctaatttgttgattttaattggttactttttttgaaattaataatgtatttcatttttctaattatatcaaattaattaaaaattagatatcaaatcttatatgttgattttgattgtttattatttttgaaaattaataatatatttcgtttttaaattaaatttaattaattaaattagtatttgactttttaattcttaaagagataaattaatttactctttaaaattttatttctaatggcatacctatgtaattacttataaaaattaaggttatatttaaaatgtacttcccaaataatatagtaggatatatattaaaagtatttaaactgcactgcactttatccaaagttgagcgacacatttctatttggagcattattttcttagtagtaattaatcggaatcgaaactaatatatagttttttgacaatttttttcttttcttaaagaaattaataaaaatattatcatcatcaaaaaataaattgtattcttctttttaatatccaagtacaaatcaatcataatcttttttagctaaatatttaagttatcaagttataagtttgactcatagtgttcacttattagatttctaaaagtaagttaaatagcaaacaattcaagtgtcttataaaggattaaaagattgagcaaaaaaaataatatatatatatatatatatatatatatatgtagttacagcatgaaattatattaaactcattaattaacaatagatagatatttagaaccagaatataaaatggttttatttaatcttaaaacatgcagctaaaaaggtcagaacatttaatattaccttctacattttgtttttatgtaaacattaccaatttaccatatactttccttgtacatatttagctaagaaatcgtggactcgaaattgtattttgattttagcaaattaattttttttctcccttgattgaattaaagtttacatttttttcttataatcacttgtgtgataccactattaagtcaaaaccagattttgtttttcaactgaaaattacttatatattttttattctaataatttggagagcatgatgatcgtctctgtccgatctcttcaactactgcttcttttagtgatgttactgttttgccgacgctatcactttacctcctcaaaagttttcccatgtatgctcttgctcttcaccctctaattcttatgagatgggaagttggtagagtttatggctctggttttgaggattttgatgtagctcattcggtttcgatgggcttggatacttgtgtttctacatttgtgttcctttgcttttatcgttttgatgcgatcatttatagcaatattcggattatgtatttatttgcttatgttaaaaattgtctcgttgcagtttagaaaagttttttgagtttagacaaccaaccacttatcctagtttattgaggctttcaatagccatttctgctttatagatcttgttatccttctaaatactttatttgtgtttagtgataatgttataaggagcattgtgtgcaagactattctacttgaattagaagcgggcattgttgttcaagactgttcttgtccaacatttattggccatatgatgttgatttgcttcctcctccttatggttttgacaaagacttccaaactaaaaagtgtatgctttattgaatgttcttggttagatgatgttttggtagaacttgtaagttcacccctattccgaaatctcaatttgagtgttattatttatgttagcttgtgcttatgcttattcttaacctctatgttaatcgatgttttgatttatttgactcttcgtaggcataatgtatcctgtcaggttaaacttctttctaccagaggataagtttgtcaaaaaaattgtttttttgtcgaaggtgcaactagagaacatgtaatcgaatccgagacaaaacgacatcgttttggtgtccgtgctatgtccaggacaattgtctccgcagtctaataagaaaaagaaaaaaaagattccagcccaaaaaaaaagccagataggttgaagaagaatcctccatgtttgatcatcatcattactcttgattcaaatctctacgatcttttgcccagcttcacttcaaatctcccaattctagcatttcaatttcatccccagtagctagggttttcaagacgtcgaccttctgagattgagaaagctaaatttggatcaaatttcctgactggtaatttcgtttgattagtctccaatttcggcgttttagaacgttctaagaagaattgaagacgaag

SEQ ID NO: 13343 - DNA, 3000 bp, Unknown; identical to SEQ ID NO: 13339
  misc_feature (1)..( 3000): cDNA_ID_2990239_gDNA_ID_2214619_Annot_ID_187613 3000 nt of promoter + ATG

SEQ ID NO: 13344 - DNA, 3000 bp, Unknown; identical to SEQ ID NO: 13338
  misc_feature (1)..( 3000): cDNA_ID_2702746_gDNA_ID_2214619_Annot_ID_187612 3000 nt of promoter + ATG

SEQ ID NO: 13345 - DNA, 3000 bp, Unknown; identical to SEQ ID NO: 13337
  misc_feature (1)..( 3000): cDNA_ID_2702734_gDNA_ID_2214619_Annot_ID_187602 3000 nt of promoter + ATG

SEQ ID NO: 13346 - DNA, 3000 bp, Unknown
  misc_feature (1)..( 3000): cDNA_ID_3029601_gDNA_ID_2214619_Annot_ID_187600 3000 nt of promoter + ATG
tttaagtacctggccttgtcgaaacaatgctttaacattgttatcttcatcacgcatagcaaattcagtgtccaacaacgctccttttgcatctccgaatttgagtttgcaggcctgccacaacagccagttacaatacaatgagataacatagtaaaaaaaaatcggttatacaggcacaacaaagcaattaagttggacaagtgaaaacactggcaacgtaaacagagatgcaaacaataattcatatgagcaatgtatgtcccacaagcataatctcagagaatattatcctgcttatgtcaaggtcaacctaccctactttttcccaagaaattaatcaaacagcagaaaccaacataaatgacaggtctgcagtgtagagcacttcaaattaatttttagttcacaatcaattgcttatcattctatcgacggtacagctcatccgtaagaattaagcagattcaacaaaaaaaattgtaatgttaaaaacccaacagagtaagaaatttaagttcttttggaaaaatcaacgactccaaagacaatcaatcttcagatggtacgtaaagcacacacacatataaggtagatatgttcaacttacaagaaaagatatcaacaaggatgtatgtagctttaaaaaaggtgtaaaagcatgatgaacttacagcactattagtgaagatctgcgactttgtcttacgcaaggcagtactcgtctctacaagatcccaagtagagagtgagtgggaacattggtatggatagtataaatattttttgagatgaagtaagtggaaacatatatagagagaaaaactgataaaccaccttcatcaatgccctctttctcccagcaaatatccagatagcgtaaagccttacggtactttctaagagccatcttatagtcttgtttctgagagtaaatcaaggtcaaaaacagatcagactcacagaaatgaaaatatggaacagacaaacgtatatattcaatttaaaacaatggaaaaagcaccttaaagtgctcattcccatgagccttgacaaaatcaacagtctccatccaccaagataactcagctgggctttcattcagatcaataggccagtcagggtacacatcaccatccttgaaaaagtcacaaatcccatcatctgcaccctcagggatttctccacagtcatggatcacaacatcctgagaaggacaagactgttcctctatgctaacatgctcaatcgaccgaacaacacccattcctttcgtaacccttccaaacacaacatgtttcccatctaaatgagaagtgcgagttgtcgtaatgaaaaactgagagccattagtgttgggaccagagttagccatagagagcatccctttcctctcatgtttcagctcaaaattctcatcgtcaaacttcaagccatagatagactcaccaccagtaccatcattagctgatatatccccaccttgtatcataaaccccttgataacacgatgaaatcgattcccctgtaaacaaatacaccaaataccataagtacatcatcctatagtacaatttcaacctaaagttttgatctttacctcaccactacaaactacagtaacctaattgcaatactgaaacaaagtcagaagctattcagcaatacgagcaaaaacccattaaacctcaaatcataagcattcagaaccattctatagtacaattgcatcctaaagttttgatctttctttcacaactaattgcaaatttaaccaagttttgatctttataaaccccaatgacgaatgacccattaaaccacaaaccctaaatcacagaaacaacaaatacccatttctacatttcatacataagagagtataaacaaagatatagagagaaagagagaaccttgtaatggagaggtacaccagtatttggacctaaacccttctcaccggtacagagtaatcgaaaattctcagcggttttgggaacaacatcatcgtaaagctcaataacaatccttccttcaagctcacctccaatgctaatgtccatgaaacactttgacctacccatcttcttcttcttcttcttcctcttgctttcttgaaaccgaaacaaagacgagacagagagagagagagagagagagagagagagagagagagagagagagagagagagagagagagagagagagagagagagaaagaatcagaggaagagacaaagaacaatggtgtgaatctctgtctcagtagcttccgtctctaaaagactgtagacggggacttgtctcttattaaacgcagaaatcaaaacgacagatagaagaaaaccctaggacccactttcttcctccaacaaattttgtctctttttatttatttttaacttttaattaatttatttattacttgctgccaaaattaaaaaataagaaatttattactcgtcccttcgggtacattccataagagtggatagtaggtgattgcccactatggccactacacaataaatatttggttttattatttctttttcttaaaaattatttaatttttttgcaaaatattattctttttttttagggaaaaaatctaaaaaaaacccaactattttttatttaaaactttaatacccaattgtttttgattggaacctaaagttccaaaatattaaattttgttcaagaaaaacactatttaattgttcgtggttaaatcattcatgcgcgttaacagacgttaatttggctgacggaatcactaaaccggggttaatggttaacaatccgcggtttaattgactaactaaaagactacagtaccctcatttgttttcccccaaatcgatttgggattgagaaaccctaactccccaaatttctaatttctctccaaaaaacttagaaattgaaagaggcgatgattcgaagcgtttgatcgggtatatctgcgttcgatccagttggtaaacagtcgaaaag

SEQ ID NO: 13347 - DNA, 3000 bp, Unknown; identical to SEQ ID NO: 13342
  misc_feature (1)..( 3000): cDNA_ID_2702750_gDNA_ID_2214619_Annot_ID_135846 3000 nt of promoter + ATG

SEQ ID NO: 13348 - DNA, 3000 bp, Unknown; identical to SEQ ID NO: 13341
  misc_feature (1)..( 3000): cDNA_ID_2702754_gDNA_ID_2214619_Annot_ID_135847 3000 nt of promoter + ATG

SEQ ID NO: 13349 - DNA, 3000 bp, Unknown; identical to SEQ ID NO: 13340
  misc_feature (1)..( 3000): cDNA_ID_1008994_gDNA_ID_2214619_Annot_ID_135852 3000 nt of promoter + ATG

SEQ ID NO: 13350 - DNA, 3000 bp, Unknown
  misc_feature (1)..( 3000): cDNA_ID_1838125_gDNA_ID_2214620_Annot_ID_135856 3000 nt of promoter + ATG
tttatagatcaattaaaaaattacaagggggagaaaaagaaaatagctcttatagatcgatcaatcggatcactaagaattgtcacaaataatataataaatgaacacaaatcataacatatatggtgttatatacatctacttaaagtagatgaccggactattagatctcaaatcccacattccactttctttaaggtattcatggtatctagagaactccggtttagccgtcgctttcttcttgttatggcggcgataaccatcaaataaactgaagattggatggcttaatttgcttgtcaccactgttttagttggtttttggcgtggaagcttttccaaaatcacaggaaaatctccaccaagccttatcgatggagcatagtatggaacgctcgttgacctccttagctttgctccaagtaggctgaaggtggaatcatcgcttacacgctcatatccgccgcgacgactcctcgtcctcgtgcttaagtttcttagcatttgcatttctggattagttgaaggtttaaattgcttggaagagagaagtgacgaaggtaatggtggtggtgagaaagagataggcgtcaagagaagtgtattgttgtttgtggttattgtaacgagagagtctttgattgtctttatatagtttttttctatagagagtctttatatggttttattgataatataagaattgtaggtttaatgattttgcattatttaagttaggttgccattttggaaaattcaaacttcgtcggtcgtatcctcttttctattagtaataatatattttatcttccgttaataaactaaacatagactaagacttgcattgcatgataaacgttgtgttaacaatagaataaacacatacttattatatatgtgtttataaacacaattaataaacaaaagaaatgacgacaagcacatggttgattggtttatatattagtccatcacgtaaccaaatgattgaaaatatttgtaattcatgaatagctacaactgtaaaaagaaaattctgaattacacaaaaagaatttggttaaatttaaaggatagtatatgcacagagaccaatcttttgcattttcaaatcggtcaaagcatcagttgctttcgaatcgttggaacttggaagctgctaagcgctaactagagaaacttgtctttcgaccgataaaatttaaaggatatgaaattcgtgatacacacaaatttataaatagctgttaacatttactgaccaaaataatataagttatgtgaaaaagtttgaaaaataacacaatatttttttttgttcactaaaatattataaattatgcgaacattgagttttttattttgccatttaaaatgttcacagtggctaacatgattgaaatcttagtagtaagactcaaagttagtcattcaactaccatagtgaatcttttaaccacgaaaccaccataatcagtcttcctgtaaataatcacctaatcggatgttgctacctaataaaaaattattcatttaactataaaatttatctatcacaaaacgaaattatatatccgtttgggtttactagagaggattaatgattatattttatgattaaacaaaattagctatctgtttggatttataaacgagtttatattttacaagtaaatgaggttaaatgtcagttaagatttataaaagaatttagattttataattaaacgagattaaatatcggtttgagtttagaaaaaacggttagatttaaattttataattaaacgagtttaaatatcggtttgaatttaaaaaagagaattagagtttagattttgtaatcaaacgagatcatatatcatgtttgatttatgaaaaacaattagaccattcacattgcataacctctcatgtatgtcttaaagactaaccatagttaaaattaaagacatttccttttggatgtcaaaaatatcttccttaagatattttagacatctaaaaaataaaatgtttttaattttaatcatggttagtctatttttaccatggttggtcttggagacattaataaaagattatgcaatgtagatgcttttagtatttagaatggaagtgaaaaaaagaattcatcgtaaagatgaactcaagaattgttcgataatatatgtgttattttcaaaaatactttaatttataaataatgaatatttgatatcttttaagtaaataaaaaatgtggtaaaatgaaaataactaaacaaaaaaaaacttgaaatatacaagggattgggaaatgtcatgcataagatactttggggtttgatgacatagatgaataaagattttgaagaacacatgccggttaaagcctaaataattcggttaaacactcgcaaattggatttttggttaaaccaattggtagacgtgtcaaacctaaaccttccattgcgctaagacgtttcgaaactcacaaagataaaccctaaaacaataaacttttcctcagacatcagcctcggcgaccacgacaacaacttcattttttctcgtcgagtttttttctgggaattgcaggtaatctctcgttaacgtgcccctctggtttctcaaatttgggaactctgtttttgttctgttctgggaaagtagaacaattcgaattacggttcgaccgaagtcaaaccgggttttgtccggttaaataaattgaaagaaaaaacaaaggaacactgtaataaaaaccctctcctaaaaccctaatttcttcttctctccgtcttccttcttgttgttcccggtgcgatttctttcattttgatttcgatagtttattcttctccttgttttcactgtttgtgtgattgattctctccatgaattgataattcttacactattgtcttttagctcgactcttaaactgatttgttcttgttaccattgatggttttaattgcaggtggatttatcagagtgttgtgctaacaa

SEQ ID NO: 13351 - DNA, 3000 bp, Unknown
  misc_feature (1)..( 3000): cDNA_ID_2702784_gDNA_ID_2214620_Annot_ID_135857 3000 nt of promoter + ATG
tatagtatattttactttgatatccttagtttgtatcctttcttgcttcgcctatcaccacgtcgagatcagtacctgatctactgttcgcatctaatcttgtttttcatttccctgagatgaattgctgctgctgggcctatcatctccaccatcacccttctgtcaaaaacatcagcacaatctatgttcagcactcttaactttctaaagcagagattcaagactatccaaaagaaatcgaatacaaatcaccccgttgcacgatttaccttgagtcttaaaaaggtcaggacactgtttacaagaaacttgagcagcttcacaggctttcttacatcgaaaggaaagtatctatacttgaacatgtgcacgattaagcgtttcatagttaaagaatacaaaaccaaccagtaacacaacaagatcggccagaacacaggcacatccaggaaagagaagaatgtcatcacaaatgcaacaacaaatgctttagtcgctgcatacctgaaaatcaaaattgacaaactttcatgagaattcaaaccctaaagcagaccattagacctaaatcagttctcatacgaattcactatcataacaatcatcaatcaaattgtctcaaaagaagaaatctaccagaactttaacaatgaatggtaaaaacacaaacttttcgacaaacctaaatcaaaatcatccatcatcaaaagtaaaagagaaattttaccagaacttgaactcaggaagacgacgaacaaagggcttatactcatcagactcatcaacaggtaaagaatcaggatccaaagcttcaagttcaggatcaactttaggggaaaggaaaccaatcaagagatttaagatataagtagctaagccataagagataacgaagtatccataaacagagtaaaccctatagatatagatcactgcagcgactaaagtcacaagccatcttcgaacaatgttaggagcagatctgtctaagtaattctgaaacgatttcgagaattcgattctccattttgcaagtggtgaagcaactatggtgtctgcttcattttcgcttcctggttcgtcttccatggaaattgaacacaaaatctgctttttcttcacctcaaaaactgggtctggttataaattctaatcacaatcactgaacttcgaatcaacttcaaaaatcgattcaaaacaatctactcgatttaggatgattttgaaccaattaaattgaaagtttctcagtttcgtctgaatttttcttagtcgtattaaagtcttggtttttctggaaagaagaggaagaaactgaatgacgtggggagaaggaacatgacacgtgtcgcaaagtaagatacttttgttaaacatgttgggcttcataaaatatttgtttaagcccagtagggaaaatatgttgaactttttttggtttttacatggaacgattcgatattctgtgaggcccaaccagaaagaatccaaaaccgaatcttttttgtttctctgggaccttaaaccgaattttaacgttttgcgtatgattctctagacttgtaattctagttgacagtcaccaaaaaaacactgctcgatggtcacatccatacgacacagtttttttggttgtggttaaccccacagctcaataatgatcattttttcccatttgacatattagatacttatgaaaaaagaaaaatatcaaaagtggtaatttgttattcaacttgtttttgtgacagaataatgaaaacaaaaaagaaaataataaatacacagaataatgagtgactgattttgagtgaaaacaaaaaagaaagaaagaagaatgagtgatataaattcatttctttatcctaagaaaataataaatttgtttgccaaaaacagacaaaataaaataaggaattcactgaaagaaattgcctaattttcaggacacgcgtcatataacaatttgttagtcggatacttttttggtacatcactgtcgtctctttttcttttcgttcaattaaaaggtacactaactatttttttaagaaagatattaaaatcttgaaaaaccatggccgtcagatccattaacctttcaaattcaacggacacgattcatcgtacgattgacgatgaacaataaccgaggaaaaagtgacgtcagcgtcttcttcctcctccaacgtcccataaagaagcgccacacacacagtcacacgaaaactctactgtaactgcaaaatcttgttgttttcttaaacgaagagagaagaaagaaagaaaaaaacgttacggattctctgcttcggtttcgcgattgaagcttgagatttcatctgtaagatcatcttcttcttcttctctcgtttctttttttccttcgaaatccgtcgattaggtcatttttagtttatcttctcctgttaatggtacttgttttgatcacttcttgttgaatcgaagcgatttcgtttgattttgctattttcttgttggtttcgtttcgttttgagcgccgagtacttggattggtcttcacagatgatcgattcgtcgattatctttcatttgtttggattagttctgtttttcgattctatttcagtttccaattgatgtagcttagactagttggtgatttgagtgttttgatgtgtatttacatgaaatcgatgatggatctatgttcttcgcatatctctgatactttagcctttcgcgttgttagatatttgcctaagatgatattgagttgcattagaacagtgaaccatcgtagaaatgtgtgcttcatttctctgctcggatttgaacagtcattttttatggtttataagattggattctgctggaatgttgaaggatttgtctggtggttattgtatgaaatggttaagtagtgagaataatttatatggcctgttttgagtttggtatatgattgaatgagactctccttttgtttgcatattatagtgaacatccgatatg

SEQ ID NO: 13352 - DNA, 3000 bp, Unknown
  misc_feature (1)..( 3000): cDNA_ID_1807296_gDNA_ID_2214620_Annot_ID_135858 3000 nt of promoter + ATG
gacggtgagggggaagctctttgatgtctctgtagtgacggaactcgggatcatcagcacatactgcaatgatcttgtcgtctttctcaccctgcaagtttcagaacaaggtgattcctggtttcttactaaggtaatacattacatagaggtagaattgggtttaagagtttttgttacctgatcaatcatgggcattagaccaatagcacgggcacggaggaatgatccggttagcacaggctcctgcacagtattttatctcaagtctgttatttcactgcctgtttacatcaagtttgtatgaacatgaaagctaagatgaggcgagagaaagcacctgcatcagtaccaggacatccattggatcactgtcttcacagatagttcgagggatgaaaccgtagttgtgggggtacacaatggatgagtagagaacgcgatcaacctagagaggaaaactttcagtgatcagagtttttcttcatttcgactcttacggtgaaggatatttagttggaatgcataaaatgtgacttatgatatatctagcaacaaagaattcctcatataaccgcataatcagactatatattgagggatcagaagacaggttatactcaatcaaagcatatatgatgcaagcagagactgccaaagaacactgtaccttaataaggccactgttcttgtctagctcgtacttaacctttccacctttgctaatttcaacaacctgacaaagaattcaagcacatttaacaatcacaagaccagcactaactttcttaatatgatctaatcttccgcaatgtagaagaagataaaacttacacagttgaaaacagtaggagcttctggacctgaaagattcaacaaacaaaacacttacatcaaacaatcaacacttgactcacatgactattcaaagtaacaaagacaaggattcttaccaatctccaagtcatgccaaggatgagcagcagctgatctgtgagtgaaggctgcaaagtttctctcattcagcgtaacattagggttcctgagagggaaagcatagcccttggcgcttccttcatccttgatttcagccatatcggatgttcactataatatgcaaacaaaaggagagtctcattcaatcatataccaaactcaaaacaggccatataaattattctcactacttaaccatttcatacaataaccaccagacaaatccttcaacattccagcagaatccaatcttataaaccataaaaaatgactgttcaaatccgagcagagaaatgaagcacacatttctacgatggttcactgttctaatgcaactcaatatcatcttaggcaaatatctaacaacgcgaaaggctaaagtatcagagatatgcgaagaacatagatccatcatcgatttcatgtaaatacacatcaaaacactcaaatcaccaactagtctaagctacatcaattggaaactgaaatagaatcgaaaaacagaactaatccaaacaaatgaaagataatcgacgaatcgatcatctgtgaagaccaatccaagtactcggcgctcaaaacgaaacgaaaccaacaagaaaatagcaaaatcaaacgaaatcgcttcgattcaacaagaagtgatcaaaacaagtaccattaacaggagaagataaactaaaaatgacctaatcgacggatttcgaaggaaaaaaagaaacgagagaagaagaagaagatgatcttacagatgaaatctcaagcttcaatcgcgaaaccgaagcagagaatccgtaacgtttttttctttctttcttctctcttcgtttaagaaaacaacaagattttgcagttacagtagagttttcgtgtgactgtgtgtgtggcgcttctttatgggacgttggaggaggaagaagacgctgacgtcactttttcctcggttattgttcatcgtcaatcgtacgatgaatcgtgtccgttgaatttgaaaggttaatggatctgacggccatggtttttcaagattttaatatctttcttaaaaaaatagttagtgtaccttttaattgaacgaaaagaaaaagagacgacagtgatgtaccaaaaaagtatccgactaacaaattgttatatgacgcgtgtcctgaaaattaggcaatttctttcagtgaattccttattttattttgtctgtttttggcaaacaaatttattattttcttaggataaagaaatgaatttatatcactcattcttctttctttcttttttgttttcactcaaaatcagtcactcattattctgtgtatttattattttcttttttgttttcattattctgtcacaaaaacaagttgaataacaaattaccacttttgatatttttcttttttcataagtatctaatatgtcaaatgggaaaaaatgatcattattgagctgtggggttaaccacaaccaaaaaaactgtgtcgtatggatgtgaccatcgagcagtgtttttttggtgactgtcaactagaattacaagtctagagaatcatacgcaaaacgttaaaattcggtttaaggtcccagagaaacaaaaaagattcggttttggattctttctggttgggcctcacagaatatcgaatcgttccatgtaaaaaccaaaaaaagttcaacatattttccctactgggcttaaacaaatattttatgaagcccaacatgtttaacaaaagtatcttactttgcgacacgtgtcatgttccttctccccacgtcattcagtttcttcctcttctttccagaaaaaccaagactttaatacgactaagaaaaattcagacgaaactgagaaactttcaatttaattggttcaaaatcatcctaaatcgagtagattgttttgaatcgatttttgaagttgattcgaagttcagtgattgtgattagaatttataaccagacccagtttttgaggtgaagaaaaagcagattttgtgttcaatttcc

SEQ ID NO: 13353 - DNA, 3000 bp, Unknown
  misc_feature (1)..( 3000): cDNA_ID_2702769_gDNA_ID_2214620_Annot_ID_135859 3000 nt of promoter + ATG
atatagcaatgagagattactggagagactctataagacagtttccgaggaagtgcagtgcgtaaaaccgcagactgttgtccaattcagatatgttgtactctttgatccgagaaaaagatggtgtaaaccaaaatggaacatttcaaagtctgaaaagagagattgaatcagctccaaggcataagggaaacccgctaattcagcaagactgtttaatttcctataaatattctatttttattttcttttcagatatttattcatcacttatcagcgatttgacgagaagagctttttggtttctgcgaatcatccaaaatccgccatggaagcaactacaagaatcttgagtacttcttctgctctcaatcgtcttcttcttctcagtaagctcaatctaaaatcagatccccgtaatatcaattccacaaatcagctactacacaatgccgttacccgaaaatcctctatctccgccgctcgtatacggtgctcttcgctccctgcgaatgcgaatctcttcagatcactcttcttcctaacgtcaacgtttcgtctcgagaacaccgccgttcacgctaatccattccgatccgaacctaacgacggcgtcgccgtctggaacagagctccacggatcgtgaacggaggtggaaacgcggcgatattcggcgggaacgaggggaaagagacgacggtggttctccttggttggctaggagcgaaagctaaacatctaaggagatacgttgagtggtacaactccaggggaattaacgccgttactttcactgttgacgttagggatttgctccggttagatcttggtcggcggcttgaacgaaggatagctgaatttgggaatgaattggttaattgggtatcggagaaagaagatgatggtagagagaaatgcttggtgtttcacagtttcagtaacactggttggcttgtgtaggttgatgaaaccaaaatccttcaaaatcctacattgtgattgcgattgtgatttagtgttgatttgaattagatgatgaattttaagcatggtgggcttttttacttttggtagatatggtgccttgctagagagcttcattggtagacaagatttagtagaaaggattaagggttgtatcattgactcgggaggagcagatcctcttgatactaaggtttgttctctctttcatgtaaccaagagttttaaatgctattcaatggtttctccactgcttcaagatcttgtattggaagtggaaatgtcaatattgttgtgaagtgaaaaattctatttgagctatgttgtcctctttttcaataatgattcattttatgctagtgtgaaagctttgctagtttgagttctatgttgaagaactttgtatcgattacaagcatttgcagaaccatggctaggggacttttgattttgatatctaagcaattagctttgtagatagataactcagtacttagaaaagactatatagctatgagttaaaaccgctgatttcttttggttacgtagccatcactcacaggtttatagtacatcggcctatatatcttgtgaatgtgatcttgttctcttgcaagatatgatgtcttaggcatgtgaacaagataaaatgagcttcatagtatgtgcctgagtttgttctgaagccccttttgttgaaaattgcttaatcattgcgtagtcctaataagccatcataatcattcatcttgcataagattagcaatgcgtacacctgtgcagattttatagatcaacaattgaattctgttcttttgcagatttgggcagcggggtttaccgcggctatactgaagaagcgtagctccaccataaccacagaaccaaacagtcccataaaagaagaggatgcttcaacaccacaaaagaaggaacctttaggaatcgaaaacataatgctatcatctctggagaaactcttccccatcttcttaaaccacccagacgtcaatacgtaagcttcacaccacacagtagacaacccatctgcttcttctttgtatattaggttgattaatctgagttattgtttgtatcgcaggaggctaacaaaaatcattcaaaaactatatgagaaccatcctccatgtcctcagctctatctttacagctccggggacaaagttgttccatctcattccgttgagctccgcatccgagaacaacagaagattggaagaaagatacattctttcaatttcaagtcctctcctcacgtggatcattaccggaactttcctgacttgtattcctcacagcttcaaaacttcttgcaagaatgcttcacaccaacaaaacaacaagctctgtgactttggaacatctttttttgcagaatatttgtagccttggtttgtttgtttgttttctcctcaaaagttgtttattattgatgatagaacaagataatccgaaggagacagaaactccaaactgtgtcgacgagctactgagcagagatagtttctgaaactcttagattgttgttgctagtttggcttcatatgtgaaacttgaccgatgctcggacaaagaaaaaatgtaaacctatttcattcccttgttcaacggtgtggtctaccccttcctcaaacggctcgtcttatattaccttaaactacgtcgtgttggattctttaaacggcgccgtcttgccgtaccataacacgacatcgtaatagctttccttaaaacggtcgtatcaactttccttaaaatgtagtcgtaggaatattttgccgttttgtttgttgaaaaactacattagagaaagaaaacgacacacatgttaaagcagaatgggtttagaaatggtcagaggagagttgaggattttgggagtgggaatcgatttcttgtgtgtctgtagctacggattcgattcgagtgaccaaaggaactcgatttattggttctaaagtctccaaatcagaaaattcagagacgagccctaa

SEQ ID NO: 13354 - DNA, 3000 bp, Unknown
  misc_feature (1)..( 3000): cDNA_ID_1974419_gDNA_ID_2214620_Annot_ID_135866 3000 nt of promoter + ATG
tttataaaaataaaacttgcaagttttaatatattacctttaaaaaataaatcgttctgcggtataccgcgggttaaaatctagttaacatataacggagaaaatcactcatatgataagtgataacagttgattgaagaataaaatcattgaaagaatcgttattaatatacactcttccgtttgatttgttgaatcaaatgtgttaaacatccgttcaaaggacaaggccataagcgcctgttcaagtcgaggatcgcaaggtaagtttcctataccgctacatgtgtacgtgaaataacatacttaaagtatgaggttatatggtctgcgaatgcatgaaccaaaaccaatgaatgatggtcattatcgacgacaatgattttgaatcataagcgagcaagacatgacctcagaggtggcaaggagatctgagtatccgaacattgcgagtcttaatgacaatgtgagatttcacatggacacggtttctcaaaataattagtatttgttttcgtgtttttttgtcgttatatgttttcaatcgattatgtgtcaaactcatacagaaatatgatattacaatgcttagaacatggttataagtgataattataaaatatcattaaaaataatttaatattatttataatatttgtttaatagattttttttttttcctttttggtaaatgcgaccaatcagaggatatcacgtcacatgatactggtatcaaaaacatcattgagctgatcaagttcattttaattattttattaatataaaaataatttttggacttgtgatactatagaaatatcactcatgtacatggtcttagtttccccaaatgtacacttgtattattgaaactagaaaagaacccgtgatactagtaaatcttttatttattatgttgtaatttaaataaatatatatttagatattcaattcaacaattaatatctcttgcatttttatttatcaaaaaaaaaagagtacaaagcaaaatattcagagaaaaatagagtccataactccatatatgtttgttttcttaatgtcatttactcaattatttttcatatataagtaataaccaacatatagctgtcaaaaaaaaaaaacaacatggttggaaaatggtcacaaataaaacactgctaagtttgccaaaaaaaaaaaaaaaaaaactgctacatgcaagtggagctaccacgcaaagttagaggcttaaacacatttactaaaaagtaaaactttaggtacgaaagttccataacttctcaccttctctgtagtcgaagaatctgaggattgataaatgttttaaacaaagaagcacaacaagcgtaagaaaggcgcagaagatctctcgaagataagatcccaagatttggagaactagtccgattctctaaccatgttcaaaggtgaaaattaaaaagaagacaagaacacctgaatattctttgataaatgtacttcttttcacatctctaggccagccagtaacttcgattcaagaactcaatcatcccaagagatcaaagagatttacacaagatgaactagtttacaagaggctgcacaaaagaaaagaaaaaaatggtttggttagtgaggaatcatcttgattaatttttcattttaataaatgaacatatcattgtcaaagaatgttattccgtggcacccacgaatgaacatgttttagagggctaaaatctctgattatgccaaagtacatcttttttagtactgtgtgtcgtctgagatttgtcttattgtctaataattggaatcatgttctgacgtacacctactagctaaaggcaccagacataaatagtgtttaatattcagcaaaatcatcgtccttttctatagatgctcaatataaaccagtaaatgtatagattacccaagttgctcaacgatcttgaagccaataatggcatgattcgctttttgtcacactccggtgattaaagacttcaacagagctaatcagatcgaaaagacatctatcactgcaaagaagtacttaactatatacttttctcgatcacacaagatggaaaaattgcaagaaatattacacacaagcttaacaattcacctacaactacaacactacaacagatactcaataaatttcagtaaatataagattacctgaagttgctctttttttatttattgaataccatgaggttttaagccgaaacccgtaattctccaaagcccgaaatcacatcatgtaatattagtttcatctcaaacgtcactcgaaccggcgacctctaagcatgtaaattgcttaacgatctttggagccaagaatggcaaaatcacaatcccacaatggaaacaatataaaagttaactaagctaatccaacaatgcaaagaggaactctatagagattatattattttcaatcatacaagaaaaaaaaattgcaaaaaatattaaacacaagcttaacaatcacatgctttatgaatagtatcggatacgatagggggttaattcgacactaatgatgatgataagatccaaaatgctgaaagaggtaagggagggtccaatagttattggtaaactttacggacactagcaagaaaaaggaagcctcctaatttccttatagcaatggtcaagagaatctcattccactaaaactattaaacctttattatgtcctttaagggactagactctaatgatcattatcatatcaaagcttctatcaaaacttttgtcccttcactaaaattttatgtggtagctaaaagaatggtcattctaaaaatctctcatttcaaagtatatattcttccaactggcttataaccccacacattgcttttctcctcctacatataaggagctccacactccctcaaactaaaccaattcaagtcatctctatccgtcaacaatacaaaccaaccttctcaattcctctcttttcatccacattttcactagcta

SEQ ID NO: 13355 - DNA, 3000 bp, Unknown
  misc_feature (1)..( 3000): cDNA_ID_2713501_gDNA_ID_2214620_Annot_ID_187657 3000 nt of promoter + ATG
ggtaatccggacgatgattttggcactgatgctaataatacattcgagaacaaatggagagaacgctggacagctcaatctcagaaggcttcatattcgaaagactcgacagcgggatttgaatggagagaaggctggagctggaccactcaatctcagaggagcaaaagttggaataaagagtcttttgatgaacctttgaacgttgagtttaggtctgagaggattgttctaggattgcctcttgatggtcccatcaaggttgatgatgttaagaatgcgtaagtcttcaaattgcttccattgctcccgagaaaccgaaaaagagtgttcattgaaggtttcttgttttgcagcttccgatcttctgcgttgaagtggcatccagataagcaccaggggccttctcaggtatggttttttaaacaaatattggattgtttcagtttttttatttgaagttcatgtgttgataaattgttttcggtaatgctgtggaactcgcaggtggcagcgcaagagaaattcaaactctgtgttgatgcatacaagtccctctgttctgcactcgcttgacgttacacataggcattgatgcaccattttagcattagttgataaggctgcttctgaaacgttttcgagagatacaccggtttttagatgatgggtttgatttggttcatgagaatccaccagctacaagattgcacacggcacaccaatgtgtctctcgtccttttccaacatttgataacaaaaacatgtatgtgaaagatttatgctagtgcccaacttttagctgactgcttctttttttaaaacacactgatgtgaaagacaataacttgagaatacatcgtgtatacaaaacactattaaagcaatttattttgtacaaaaaaaaaaaaaaaaaaaaagagaacatcttttatgtattttgtctatgtccaagctaaaactagacttagacaaacatctccaaactctaaaattccaaaactttccaacattcttgtataagcaaaggttgatgtcagttagccagagagctccaattcagatttgatcgttggatcaaaactatgattcatcgacttcacacaggtggcatggcaaaggttccaactactgacctgtgaatagtctctgagtccagagttgttagcatatgtggaatcgacataccacccgagatgacgatttctgttgaaaaaagcaaaaatagagcaatgagatggatttgttaaggcaccaggggcgttttaagagttgctagatcaagtcacaagttacctatgccttcccggactgagagattaggtcttatgatgtcctttgagctaatgaggaaaatgtctccaaggtaaagatggttggtgggaacatagacacaacatagttcttctccaccagcacggcctcgaagaatcacagtcgatgtaatgaaaccaaaagcgtattctcccatatgaggatgtctgataattgctacctccttgaatgcacctgagctttgatctgatgaaaaaaggtaataaggttagtcttatgactcttattagtacttgttggtaagtaaggttggtaaaattatacctggtgagattgctccactaatttgtttagaagctgagtagatgtagcttacgagaggcatcttcttgataaaccattctccgatactgagaactgaagctccaagccatgaagacatgaacacaccaaccataaatatgaatgtgatggatgttacaaagccaagacctgcaaatattcttcaattagactgaagaaacaagtgtgtttaatctcaatgcagctagagtgatgaacgaaactaaccgaacatattgattccgagatgagtatagatcggggagaagaatccatcaacgaaatgtataaaccaccacgtgaagtagaatgtgacagcgattggtagcagaatgacactgtaacaagagatcaagcacaagattaaagcgttttcgaaaatctttgagaataattaacctagaaacagagaaatttctgaatctagttagcaacaaacccagaaacagagaaattttaacgagaaacttagagattaccatccggtcatgaactttttggaggcccagcttctaatgactttgtaaatcgcctgtttgtacatgaaacattgaataacttaacatacaagtaacttcaaactataggtcaaacttgcagaacatttcacaatgttgatcaaattgtgtgatccaaatgtgggaaattagcgaataagagaaatcctctgtaatagttgttactatcgcgagagagattaggaaatgaaaaagagagagagagagagatatacctctttgccggcgacgtggatcggagaagcgagaggagacggcggaacagacaaaacgacgtcgcgaggagaagctccggatttatgcatcgggatcaatcgttctagatctctctccctcgtttccatttacccaaatctcaacaccgatctctccagactctctcagaaagtaacactacagaagaaaattgctatctctctctctctctgaatcgatttgtcgatctccgatgtgtcttctccggcgtgacgtgagtgagcaacgaacctacctgaagttaagagtgtcatgcatttctgctgctaatgcataccgaagtatttcactgctgcaacattatgggctttataaaccccatttacttataaatgggcctcgtacgaatcatccgatgtggcgtttcgttgaccgttgaaatttttacacacttcgttacccggtgtaggggcaaatttggaatttcatgaacattttcaaattctttataccaaattggcacgttgagagacttctcgtaaaccaggtctagtggcaatttcgaaattttgcagctacattttcaaaatcttaaagccaatttatataaaacgactcttcttccatttttgggttaacaagttcgtggtgagtagtggacggagagatg

SEQ ID NO: 13356 - DNA, 3000 bp, Unknown
  misc_feature (1)..( 3000): cDNA_ID_3029658_gDNA_ID_2214620_Annot_ID_187656 3000 nt of promoter + ATG
aaaacaaataaaatgtgataagaaacaataaaaccattttgaccaaagttcttatagttttaatattctttaattgtcatttgttagtgactaataatattacattaaacctaatgtataaatagaagccccatcttctacgcctttataattagcaacaaccaaaaacattcatttgtcattttgtctcctcttttgttttctctgatcactagtatggctgtattcagagtcttgcttgcttctcttctcatatctcttcttgtcctcgacttcgtccatgccgatatggtggtacaattttaacaaccaaatatattttcttatttgattttattttttcacaacttttgtctacgttctaatggaatttttttcaaaatattcatgcagacgtcgaatgacgcccctaaaatcggtaatatctctatcatataaacacgtacgttgaatttctatatacgtgtgtttaattgaagttttggttggaaattgtatgtatttgtagattgcaacagcaggtgccaagagcggtgcagtctttcgagtaggccaaatctttgtcacagagcgtgcgggacttgctgcgctaggtgcaactgcgtggcaccgggcacatccggaaactacgacaaatgtccgtgctatggtagcctaaccacccacggaggacgcagaaagtgtccttaaaaactctgtcgctgtttgatttgatttcgtttataatactttacttttatgagagtaattgtggttattttcttgggaattattaaaaagcaaaagaaagagaatgttatacgtcatgtgcaactcttcgatctttgttttagtgtttatccaatttgtacttgttggtttggttcctggttaacattaggtctgaaaaggtattgtttttcattatacaattcactaaataggcatcgtacttgcatataaaataaagaatgaagagagaagtaaaagagttttctttttttactcatggaagttaggcaatgggtttaaatatggtaacaacagaattggaggggacttaatgaactatgacgtaaaactgagagcgattgaatatgtaacgttaccaacaataccaataaaattatgaaagatagtatatgaaattacgtttaattaatgtttccgggttgaatgtattatatatagaagtaacagtacgatttttattacatttttgtacaagattcctagaaaggtataacctctataaagttaataatagtcttgagtcttgactcttcgaggcaaataaattcaccgcataattaatcgttcaactattattctatattctatataacatgagcttcaacaaaagaagcatcaatcatatcttcaacagtatactgcagtgtaatgtaacatattcaagatcaaaccggacaaaaaagcaagataccgtcgaaacaatcaaaccccatgtatcataaactcccatcttctctttcctaaattccccgtcgcttgcacaatccgcaattcaaaagcaacacaacactagtcacgttaagcaaatagtacatcttccagagttcagtgtgggacaatcctgttgatcacaaagagcaataaaaaaggttgtttcaagcaggagggaggatattgaaacaaatggaagaagaaaatgtttctgttctttgaaaattaataaattcacgtaataataggagaactatcagtcgaagggtaagagaaaataaattaaatataatcatcatttcaaaagttgaataacttagtttattttaaaaatgacgaataaccagaactgggtggattcgaaccaccaacctctcgtccactagaagaaaacgagcgctctaccaatttgagcttacagatctatatcacgaataccctaccactacggcccacagccaataggaccaacacttgactctttaactctattttaatcacatattaaaaatatttctgtttttagagaattcaatatttaaacaacttctaattgaagaccaaaagatgaacttgactaaacatgaacggtgatgctaaactgttttcaagacacaatttcacgagaacaagagactagataggaaaattgcaataagcttttctcattatataaaatgttataatgattgttctcttccacaacaggccacaataaactaagaaaataaaatgtaatgaactataaatatcaggaatttttgacttagcacataaccagatactatcttttgatcaagatacctttcaagaacaaatcaacttcagaaaaaaccaacgtcagctttgcatagcttcaattccgtcgtctaccagcttcatagttactacaggaactggtggttacagacatatacaaactacgagcaaataaaaatgttctttaccatattctaaaaagcttctaaacggatagaactaataaaacaataccaatgatacatacaaagaacccgcaaaattgtttaacagcaattcttaataccatcattttcaatagattaaatgacaacttgtaaaacaataattgatcaataagataaataacaaaaccaataaaattaaaatttcatgattcgcataagcgttgatacaagttaacaattagggcaaccggattatggtttatttaaatccagaattcctcttgcagattatgtttaccttattatgctaattaagaattcgatttaatatggatatgagtacctgatttaactctcgaggttgttgggcaagaagatttgtaatcgcccactgctccatattggttacaaactctgcttatgatcggtttttgagtgtatatgagcatttaagaaagatatgaaatgtgaaagagcagggagagagatagagcagaggcaagacgacacacacagaggagaagagatcccgggaaaaaataataacccgtgcgacctcctctccaaaacccacaaaatcttttttttattgaggatcagttttttgacctgccatgcaagcgcacctgac

SEQ ID NO: 13357 - DNA, 3000 bp, Unknown
  misc_feature (1)..( 3000): cDNA_ID_1010524_gDNA_ID_2214620_Annot_ID_187652 3000 nt of promoter + ATG
gggaattgaaaacagtagatctaatattgaagcttcttagacataaaaatgtatatatgaaaatatatatgttaagaacttaagatagtagaattattattattattttttaaagatgatagaaactaaggtgaaatagtactgtttaagctaagaacgaaaataaaaagggtaaagttaaagagaattacgaagtgagattcttggcaatgatcaaaagcaacatcttgtgttctttctttggcttggggagcgagagattcaattgatcagtcaaagaagcaaactccaactcaaaatatttttaaagcaaaaaaagtacaaaagcgaataaactcaactggatatattacaccaaacactcaattgctacttctttttctttttttcttcttccttttcccaattttgggttatatacttagttcgttcctctcttaaagtagatgatgttttcgccaagacaagaatattagtaaataactaaatatcaagtctttgataagcttaacacgaaagcaagttggcttaaacgtaaggtgatctcttcaaatagtttttctaatgaaatatatatgcatttttggttgaaggaccaatgattaaaggactcgttctaaagttagagaccaaaattcgagttataattacaattataggtggtcaccgtatattttgccgtaaatatgaagaatacctttactttgtccatttcttattttcttgtggcacactccaaatatgaaatgaaattatactttagtcaggaaataatatgatcaaacaagattcaaagaatgttaaaagattcaacagatcgacctaaagagaggaagagtcaggctttaagcgaacatagagaatcaaatcggagttgctattggtgatctcttttgtttaactaggaggactaccgcttttaattaaagaacacatgcactttgtttcatgaaacaagaaacctaaataacgattaccccaagacattaagtattcggctttggcaataacgccgtttataaatcacataattatattgtttttttgttaaagaacgagataaatattttttgaatcatctaatattcaaatatacaatttttatgcacaaatgtgattaaaatgcatttgatgtcttacacactaatcatctgggtctgggatcggaatttacaaacgttaattttgtatttgaatttacttgttaaaaaaagaatttaaacattatacttaatatttcttcactttcattcttacaaaacatgtttgcaaaataaaaattgaaaatgtcaaactttcatttagttgcattaacaatcaataaataaatttttataagcatattaaaattgtgaatttagttaaaatatacatattaaattcaaacataaacacaaacaaacaatgaactcaaaaaataaaataatatgtactttattttgtacgtatatatcaaagatgcatgcatgcaaaaagaataagagattaaatatgatctaaccattaattatgttttttgtttgtcaaattactgatgattaactcgcatcttggatccgtactttatgatacggtccgtctccaacactcaaacaagaagaagaagaagaataaaacaaagagaatgacagcaaaacaacaaaaaagaaaaagaacaaaacattccctcaaaaggatcaagatcggattggtacgtgtttctttttctttgtttcttaataacgtttcattctcgagtttgaccgtttcactttctagatgacgtatggtccacttatcctcttcaggtgtatgttctacttctcgttttctaaacctatatgtttatagatgatttaaccttaagtacacaagagaaaaccaacctctaatccacaaagtgattcaaccgtagagggatcgaatctatatataatctgcaacgatgagtgttatattttaacagtttttaatgtataaaagtactctacgagattcaaaggcagagaaagaattttaccatctatgaaatttgtatataattaaacactatgtaaccaagtgattaattatatacggatagcttgagaaatcattttggtagattgagaaacttttgtctcctggttacggatagcttgggaagggtctctactttatacctattctggtttctggcttaaaagaaatttacaaatttctaccaaaacaatcatctctaattacgaatatgtagtgtgtttaatgtactgtatatatatttttttgagttttagaccaaagatcagattctaccaaaaatgactgtgattcttttaactatattgtagatgccttaaataaaagaaattcaaatacttttgagattagtctaacatataccccaattatcaaagaacaaacatattttctgcgcaattggcgtagctactcctttaggttattttgaaaattatcaaagaacaaatatattttcgttctaaagtttaatatccatttgattattttgaaaatttggttcggtttcggttcggttccggttctttcagttttaaaatttagttaccatttagttattttgttttgaatatttttggatattttgttattttgggatattattggatattttcggataatttttgcttatttttgagtattttattattttctatttcggttcggtacaaatttggtattttattattttggtttcggttcggtacattcagttcggtttatttgcccaggtgaagacgtagccactaaaccataagaacaaggcccatacttatcgcacatgggcttttaactgtttattatatataaaaagcccatcatgtggttcgttacaattttctgttaaaatgtttggcccattgtcgccgtagattgtcttctccgttcgaaatcgcatccatcgccgtcgtcgtcggtgacgaaaaccaccgcgtaaaaccgtttcctaaatcagatgttcaatcttagaagtatctcttagaagctctcttgtatgaaaaa

SEQ ID NO: 13358 - DNA, 3000 bp, Unknown
  misc_feature (1)..( 3000): cDNA_ID_1034834_gDNA_ID_2214620_Annot_ID_187649 3000 nt of promoter + ATG
ttgagatatgtttaggtacttattcgagttcggattcgggtttttcgggttttgaagtttagacccgttagactattttaaaagttcgggtctaggttcgcatcaggtttttcgggtcgggttcggatcggttcttcgggttcgggtattatgcccaggcctgaccaaactgattcttaactaatgattaggagttcataaatataagtttttgcaaaattaataaataaaaggtctcggtaggtataaagttaaatataaaaccacataccaatttttcttttttcttttacaaacatatatatatgactaacttgtctatcttttgtcgttagagtttgtaaaacaaagctaaaacgacaagatagctactagtacttacagctatactatagtctgattccatatttactatttatttttaaattattattactggaatttgtaatctagttatgacaagctctttatcgagctccgggatcaatttcgtgtccatatttgaccatatggatacttaataaagttgctaaatatgtttttaagaaaaattatactatagagagccagtggcagagtttgagtaggtatatacctcaatgaaatccttgaagagccgtttcgggaaccacatgggtttatgaacagcaagggtgaagagagtcttgagccctttaaccgaagttggtaacaaaagatccgccgacgacttaaatcctaactggttcaaattagactcactgatcgtatcagtcatcgcgagtatcgaacctgataaagaaaaaattgttcttagtgtatgtaagttttaataatgaaattacaatgtataaatataaaaaaaaaatagacttttagaataatttacggtatcttgtaattactattattgatatacgaaaagaggagtgttaaatgtgatcttgaactcgcggtatgggagtaatttccaagaccatggttttaggaaaaccgacacaccaaaactcgcaaaacattgtagcatgttttaaccactcgcaaaatattgagtcatccaaaatatagtaatcacctgaaaccaccatggcttgaaccatctcagggtactcctcggcgatcttgaaagcaaccatgccaccgtaactaaaccctacaagagtaaacttttcgataccgaggatacgaagagacttgactaaacagtgggcttgaaacgctggtgatcgatccgcgttgtcggagtaggacccaccaaagaagaggaggtctggtatatagactgagtacttcttggctaatgatccgacctggaactgccacgtcacgatcccttcggctgcaaagccatggatgaacaataggactggtttcgtaggtttttggggttccacggcaaagtttttgtcagattttttggttttttttagggtttcttttgggatccagaagttcatctttgtccctggttcaagctctacggtgtaaggaatgacaccggccaatttcatgaggcggtacaacaatggtttttgtaaatccacaaagttcaccattgtatgtactctttttcctttcgttcttgtttggatatatttagagggagagagatgtaagaagatgatcaatagcaaatggaaggtgaagattttaaagcttcttgagttgggattaattataatgtatctggtgttgggttcttgtttatattcaaccaagcatttattgttttacacattttatatacatatcttgtttgacgttttgaatgataagtgacaacttgccaaatagcataataaactcactagtaactagaacattttaataacaaaagagaccaaaacaaaaactgtttttcttcagtcttttatgtaaatatttaagttttcgaagtataagaataagttttgtaattgtaataatactatcattctattacacctgtatatacaaattttgtttgaagatttcacctttttctaaagttaccaaccaaaactaataaactattaaagtattaattatcaagggaaatcttgcctcattttaaattaaataaggaaaaattagagatgatggagttcttaataacttgctttgcatgtaatctctgaatctagtcagaattggaaatctgcacttcctacttgtatcggtatgctgtaaacaaaaattattgttctttttggggttaattactagatagtcaaaaaatgtttttgttaaaattcacaaaaaggttgtggctaaatcgtaaataatgtgcttattctcttcatttttgtttattttgttttctatgaaaagtgtgtataacatataaaaaataaaataaattataaatgctttattactcttttgtaaaataattatttacatcattgtaatattgaataaatatctgaaagacatatatcatctacattattcatcttcgttttgttccggatgttattggtccctttcttactactgcaaagaaagcccacgtcccatacctcctatgatttttatattctcaattggttttctgaaaatattttattataattattgagctatacgcaattagacaattacgcacatctaatttacgtactatataatttatctaatctactcctctgtgattaatattaatgaaccatttctagactaacctccaacacttaagtaattaaacacgtcatctttgagtgttgtagatgtagtcaccaattgtacctaaaacgattataagttgattgaatatggacaaacccaaactgacaagaaatctctataacctaactacctagatcaaataatatttatttttaagtatatcataccaaaatgttgaaacttatattttcatttcactccatcaacccaaactaacatctactaattctcttattttaatataaatttcctagtccgccatatatataaacgcttcgtctccactctacatatttagcaacaacaaagaaacccctaagatttttatttatttttttctcaatttcttcaacg

SEQ ID NO: 13359 - DNA, 3000 bp, Unknown
  misc_feature (1)..( 3000): cDNA_ID_3029670_gDNA_ID_2214620_Annot_ID_187648 3000 nt of promoter + ATG
aatttcaaactcctaatgaaatgtttttctatctacaatcttggatactataattgttgaaagagcttgtagtaatggtaattatgtctttggtgagtataaaataaagtcaactgcttcagaacattaacatgttcttgacaaataacataaaaatatgcttcccacctcagcaaatatttacccaaaatctcttgcaagtcgttctgtttttgggttttaaaaagattaaagaaaataacacggcgaagcttagaaaatgattgtgaatttcgtattactaaaagctgagttcgaaaatgattgtgaattttaccacgaatctattttatttgttaaagaaattttaccacgaatctaggccactcgaagtgacaaagagcagaccattgacaaatcgcctttcatattgagaaccgaataattgatacagtttatttttagtttgtgattcaacatagagccctcgtaaaatattcaacatcaagaaacgctgtgttttcatgactcatcagttcacaacactgtaatatccaaaccaccggggtaaatgattgcattgcatgcacaaatgcacacaaagacaactacacaatacacatgtacatgtacatacatgaagaaactaaatgaaccttacaacatgtgtacattcgcctacatatattatacggcgcctttattgatataaattgcgtacttaattaggacaagatggaccattgatcaatgttgagaatttctcaaccaacactgcaaaaacaaaatcaacaatgtattatttatttcagcttttataaagtttagaatttaaattaaacagacaaaattcaaaaatgttaaatattataagtgcataagagatacaaattatatcaaaattgagtaaaagcatattgttctaaacaaagttatggtaaacaaagtaaactatcatttgtttaatctattcttatactacctagagttagtatttttttttaaatagataaatcaggaaattagtcataacaacagataaaagtttcaaatataattatattcgttaacattatgttcaccttaagttcttcactataaagatagtatctcaaactttaatgcttgttagtttctatataaagttgaactaaaacacaagacactagacaactaaaacaatcagacacgatcatatcattcaaaacgtacgtagtgcagtcgacagtaggagaagcatcaacgggcaagctcgcaccacaattgctagcaagggcttgagccaattcaggcttcacggtaacactattagccactgacttgatgcattgacaagctgccttcttatcggcagatgtggtggttgccgccgctaaactcttaactccgtcgcaacaagtctccggagggtttccacttccgctggtcaagtagctcacacatggctgcaaatcctgtaacacaacactgcaagatatagcggattcagaataacgaggtatgaagaatattccgagaacggaaatgatcgctagacatttcaatacattcatcgttgaagaaattgagaaaaaaataaataaaaatcttaggggtttctttgttgttgctaaatatgtagagtggagacgaagcgtttatatatatggcggactaggaaatttatattaaaataagagaattagtagatgttagtttgggttgatggagtgaaatgaaaatataagtttcaacattttggtatgatatacttaaaaataaatattatttgatctaggtagttaggttatagagatttcttgtcagtttgggtttgtccatattcaatcaacttataatcgttttaggtacaattggtgactacatctacaacactcaaagatgacgtgtttaattacttaagtgttggaggttagtctagaaatggttcattaatattaatcacagaggagtagattagataaattatatagtacgtaaattagatgtgcgtaattgtctaattgcgtatagctcaataattataataaaatattttcagaaaaccaattgagaatataaaaatcataggaggtatgggacgtgggctttctttgcagtagtaagaaagggaccaataacatccggaacaaaacgaagatgaataatgtagatgatatatgtctttcagatatttattcaatattacaatgatgtaaataattattttacaaaagagtaataaagcatttataatttattttattttttatatgttatacacacttttcatagaaaacaaaataaacaaaaatgaagagaataagcacattatttacgatttagccacaacctttttgtgaattttaacaaaaacattttttgactatctagtaattaaccccaaaaagaacaataatttttgtttacagcataccgatacaagtaggaagtgcagatttccaattctgactagattcagagattacatgcaaagcaagttattaagaactccatcatctctaatttttccttatttaatttaaaatgaggcaagatttcccttgataattaatactttaatagtttattagttttggttggtaactttagaaaaaggtgaaatcttcaaacaaaatttgtatatacaggtgtaatagaatgatagtattattacaattacaaaacttattcttatacttcgaaaacttaaatatttacataaaagactgaagaaaaacagtttttgttttggtctcttttgttattaaaatgttctagttactagtgagtttattatgctatttggcaagttgtcacttatcattcaaaacgtcaaacaagatatgtatataaaatgtgtaaaacaataaatgcttggttgaatataaacaagaacccaacaccagatacattataattaatcccaactcaagaagctttaaaatcttcaccttccatttgctattgatcatcttcttacatctctctccctctaaatatatccaaacaagaacgaaaggaaaaagagtacatacaatg

SEQ ID NO: 13360 - DNA, 3000 bp, Unknown; identical to SEQ ID NO: 13354
  misc_feature (1)..( 3000): cDNA_ID_3029686_gDNA_ID_2214620_Annot_ID_187644 3000 nt of promoter + ATG

SEQ ID NO: 13361 - DNA, 3000 bp, Unknown; identical to SEQ ID NO: 13353
  misc_feature (1)..( 3000): cDNA_ID_2702769_gDNA_ID_2214620_Annot_ID_187637 3000 nt of promoter + ATG

SEQ ID NO: 13362 - DNA, 3000 bp, Unknown
  misc_feature (1)..( 3000): cDNA_ID_3029708_gDNA_ID_2214620_Annot_ID_187636 3000 nt of promoter + ATG
tctttatgggacgttggaggaggaagaagacgctgacgtcactttttcctcggttattgttcatcgtcaatcgtacgatgaatcgtgtccgttgaatttgaaaggttaatggatctgacggccatggtttttcaagattttaatatctttcttaaaaaaatagttagtgtaccttttaattgaacgaaaagaaaaagagacgacagtgatgtaccaaaaaagtatccgactaacaaattgttatatgacgcgtgtcctgaaaattaggcaatttctttcagtgaattccttattttattttgtctgtttttggcaaacaaatttattattttcttaggataaagaaatgaatttatatcactcattcttctttctttcttttttgttttcactcaaaatcagtcactcattattctgtgtatttattattttcttttttgttttcattattctgtcacaaaaacaagttgaataacaaattaccacttttgatatttttcttttttcataagtatctaatatgtcaaatgggaaaaaatgatcattattgagctgtggggttaaccacaaccaaaaaaactgtgtcgtatggatgtgaccatcgagcagtgtttttttggtgactgtcaactagaattacaagtctagagaatcatacgcaaaacgttaaaattcggtttaaggtcccagagaaacaaaaaagattcggttttggattctttctggttgggcctcacagaatatcgaatcgttccatgtaaaaaccaaaaaaagttcaacatattttccctactgggcttaaacaaatattttatgaagcccaacatgtttaacaaaagtatcttactttgcgacacgtgtcatgttccttctccccacgtcattcagtttcttcctcttctttccagaaaaaccaagactttaatacgactaagaaaaattcagacgaaactgagaaactttcaatttaattggttcaaaatcatcctaaatcgagtagattgttttgaatcgatttttgaagttgattcgaagttcagtgattgtgattagaatttataaccagacccagtttttgaggtgaagaaaaagcagattttgtgttcaatttccatggaagacgaaccaggaagcgaaaatgaagcagacaccatagttgcttcaccacttgcaaaatggagaatcgaattctcgaaatcgtttcagaattacttagacagatctgctcctaacattgttcgaagatggcttgtgactttagtcgctgcagtgatctatatctatagggtttactctgtttatggatacttcgttatctcttatggcttagctacttatatcttaaatctcttgattggtttcctttcccctaaagttgatcctgaacttgaagctttggatcctgattctttacctgttgatgagtctgatgagtataagccctttgttcgtcgtcttcctgagttcaagttctggtaaaatttctcttttacttttgatgatggatgattttgatttaggtttgtcgaaaagtttgtgtttttaccattcattgttaaagttctggtagatttcttcttttgagacaatttgattgatgattgttatgatagtgaattcgtatgagaactgatttaggtctaatggtctgctttagggtttgaattctcatgaaagtttgtcaattttgattttcaggtatgcagcgactaaagcatttgttgttgcatttgtgatgacattcttctctttcctggatgtgcctgtgttctggccgatcttgttgtgttactggttggttttgtattctttaactatgaaacgcttaatcgtgcacatgttcaagtatagatactttcctttcgatgtaagaaagcctgtgaagctgctcaagtttcttgtaaacagtgtcctgacctttttaagactcaaggtaaatcgtgcaacggggtgatttgtattcgatttcttttggatagtcttgaatctctgctttagaaagttaagagtgctgaacatagattgtgctgatgtttttgacagaagggtgatggtggagatgataggcccagcagcagcaattcatctcagggaaatgaaaaacaagattagatgcgaacagtagatcaggtactgatctcgacgtggtgataggcgaagcaagaaaggatacaaactaaggatatcaaagtaaaatatactatagccatgctggtggaataggaaaacaaagttcttgaagcttaacagaactaagaaatctctctgagttttgagtaatctcctgcattttccggtttttgcattgtaatgtgtaacagtgtattttacaattatacgtttaaatgaatttgggaatcacaagtaggaaaaagtattctttacagttccaggacttggatactactctggacacaactaatcacacaaagctgtgttgacagcctccaataccaagcactggtccaaatctctttgcagaaacagatacagattggtcatcatactcggagaactgtgtggactcgagtgtacttacttgacttcctaggttagtatacttctcaagcatttatgtctcttgacttctattggtttagatatcggtttggcaaatattcatagggtttatgcacaattacatttgcaacaacaacaaaatatagtgaaggatatagcaatgagagattactggagagactctataagacagtttccgaggaagtgcagtgcgtaaaaccgcagactgttgtccaattcagatatgttgtactctttgatccgagaaaaagatggtgtaaaccaaaatggaacatttcaaagtctgaaaagagagattgaatcagctccaaggcataagggaaacccgctaattcagcaagactgtttaatttcctataaatattctatttttattttcttttcagatatttattcatcacttatcagcgatttgacgagaagagctttttggtttctgcgaatcatccaaaatccgcc

SEQ ID NO: 13363 - DNA, 3000 bp, Unknown; identical to SEQ ID NO: 13351
  misc_feature (1)..( 3000): cDNA_ID_2702784_gDNA_ID_2214620_Annot_ID_187634 3000 nt of promoter + ATG

SEQ ID NO: 13364 - DNA, 3000 bp, Unknown; identical to SEQ ID NO: 13359
  misc_feature (1)..( 3000): cDNA_ID_2713515_gDNA_ID_2214620_Annot_ID_135869 3000 nt of promoter + ATG

SEQ ID NO: 13365 - DNA, 3000 bp, Unknown; identical to SEQ ID NO: 13358
  misc_feature (1)..( 3000): cDNA_ID_1034834_gDNA_ID_2214620_Annot_ID_135870 3000 nt of promoter + ATG

SEQ ID NO: 13366 - DNA, 3000 bp, Unknown; identical to SEQ ID NO: 13357
  misc_feature (1)..( 3000): cDNA_ID_1010524_gDNA_ID_2214620_Annot_ID_135872 3000 nt of promoter + ATG

SEQ ID NO: 13367 - DNA, 3000 bp, Unknown; identical to SEQ ID NO: 13355
  misc_feature (1)..( 3000): cDNA_ID_2713501_gDNA_ID_2214620_Annot_ID_135877 3000 nt of promoter + ATG

SEQ ID NO: 13368 - DNA, 3000 bp, Unknown
  misc_feature (1)..( 3000): cDNA_ID_2713545_gDNA_ID_2214621_Annot_ID_135881 3000 nt of promoter + ATG
cataaacggaaccaaaatctattatcaagcttgaagatccgggtaaattcaccataccttgctcacttggtgatttacaacttgatgatgccttatgtgattcgggtgcaagcgtgaatgtgatgtcacttgcgatggtaaagagtctagcgattaaagatatgaaccaccacacctcctccatcatgtttggagatgcttcttcaacaactcctcttggtttgattgaagactatccactcaaagttggtgattgcatagtcccaacggatttcatgagagtggagatgaaagacacacccacaaggttcctctcattctaggaactccatttctcaacaccgtgggagcaaacatcgacttcccaaacaagagagttactcttctccacgtgaatggtaaggtctcatatccaatcaagcctttctccacaaagttttgtggaacaatcactaatgaagaagtgaaaacaaagaaagagcctaaaagtttgaaggatcaacttgagatcaaagttgtgaatgtgaagaatagagaggctttaatggttgaacagaaaatcttggatggtgaatgtctacactttttgtttgatgagcaagaagaaagtactgaaaagaaggagttgagtaaagctaagttgggttttgagaagaacaagaggatgatgaaaacaacccaccctcccacccttgacaattcaccaaatcctacctcttctatgactttaacacctttgaggtataatgatggaattttagagtatagagtcaagtgcaagggtcgatccaaccctttttcatcggttaaagagattctcacaccggagttcaaagaaaaaggttcaaaaagtgttgaagaattgatgaaagaggtcctcacacttgcattcaagggctctacaaggagtttcacaactcctcctatcactctactccctaaggttcacaactagggccaaggtatggtcctatctatcttttgtatatactattttctttcattttgtctttgttttctgttagtttttttttccacggaattatcttcacaccgagacggtgtgaaataagtttgggggagagactaaccatctaatgttgtgttttgttttgattttatttctttgagtcttgcatagtcaataattaagttttgagaaaaatcaaaaatattttgaaaattttgaaaaatccaaaaaacaatcatgtaggtttgcatattatttttctcttttaggattgagtctagtagcatctagtttacatttgcatatgcataggggataatgatttaattaccttgtagaaattcaagtttaggattgaacttaaagcccttgatcacagttaatcgttgcttgatcatctttgaaaaaatggaaaacccatgcttagacttttgcgtttctcgaaagcaatttctacttgtgtgaagcttacatgacttttgaaatatctctatgaatttggacttaatttgatattgatttctcgcttatggatcctaaatgcattctcatggtagtctaaaagactcattcgggttatcttatacgttttgccaatcttttgttaacccgaatggccattctcacctttagaatggttttccctacccttaaccttaaaaccttttgtttcaagcctatgtattatttgtgagtgaggcctcttgtatgaaaatgctatagattttgaaatcttcaaagtattgagaacgacaaggttttagctcttgtttttagctagcttttggaacatctttggactagctattaggttgggaatgaaagatttaagtggttagattgaatacttgggattgggtttggaaaaaagaaaaaaaaaagaatgaatgaaaagaaatgtgtgatcaatggttttataggagtccctaggaaataagttataaataagaaagctctaaatctctaagtgtaaagagaaagtttaatatcaagctagttccccaaaagaaaagaagcttgcaaagctataagtatttgagaacaaagataaacttagaaaaaagattggaaaagagcaaagtgttaaaagaataagtcttccctaggtgactaacaaaagaggatttatcttgaggattgtggttcaaaaagaccaaagtttctaatgattggggttgaaaagaagaagaaaaaaagtttgcaagaagggtagaaataggagtttacatctaagacgggtagaacaacaagagctagactttgtatgcataaattgttcttggtcttagatggatttcatgattgtctagcattactttttttttaaagaaacccaccaaaatgtaaatcttttgaaaccacctccaaaagccttcaccaaaaccgattgagaatgatttatcttccatttgcgagaccgcgccaaacacttaaatgaatgttaaagagatgtttcaacttgattgtaagtctttgctaatagttggagatttaaaatagagctatgcactaagaagagtatggagaagtacaaaagagtatgatgattgattcaagcaaatttgaactatctttaaggactttgagttgaatccttcgtttgatattttgtggctatgaatccccaccttcaaacctctttctcttcttatctcttagttcttgcttgaggactagcaagagataagtttgggggagttgatatctagtgtttttggttgttttaaaacccctttttctcttagtttttgttgctttgcattcatattttggcatatagtattgcatttgcatttgcatttggttttcttaggtacatgagtggagtttaaagttttggaagtaaaatggagcaaatggagcaaacaaaggagctaaaagaatgcaaagtgaccaaagaggagaagctagcaggacaatagaccaagtggtcgattccgtggtcgattggtcaggaccagagctacggaggaatatgaatctaccaaagtggtcgattgcgtggtcgattagtcaggaccagagctatg

SEQ ID NO: 13369 - DNA, 3000 bp, Unknown
  misc_feature (1)..( 3000): cDNA_ID_3029728_gDNA_ID_2214621_Annot_ID_187674 3000 nt of promoter + ATG
aataatatgtatacccataataggtatctatttgttgagtcaacgtttataggtgtgcaataagaatcagcctatctacttaggtgaacttatcgaatttgtttagcatgcatgtcttaaattagggattcactggcacatcgctagggatctttagctttaggcatagtcaacagcactacacatcaccggttactctataattagggtttgagttcaggaacggttcgatcgcatctagctatttctagatctactatcatctatttcctgagaataccctagacctaacgtttttattatcttttcttacaaccaatcaatctaatatttgcttacttgctctctttttacttttctattatcatttagcttaatcttgacacttatgccttttgtgtgaacaaaagagctttgtagaattcgacccttaagtaccaacgacgatctctggtttgagggagtaaactgaaggcaattttacctacactatcgaccagccatcaaagcatgtatggtacaagcatgtaaaacaccagctgatcttgcctctaagatcactcacatgaaagctaagttgataccgaataccacttatggtacacaactaagcaaaacttactatgtagtttgatattggcattatcttatattcgaaacaagttttaagcatcttatttatatcatctcaatttcaagtataatgcacttgattttgtctttgagtgctagtgatggtacaagttccaaggagaaatgtgatgataaaaaagaagccacaacaatgttactctcggatcaaagcaaacaagaaattgatttcggtttaacacataaaaaggttcaaagtaacttaattaattatgtttatgaacgttccatgactgccttagtacacttgtcttgtgccaaaattgttgaaacacatgtagatcctaaggaggcacatacggatccacattaccgatcaacaatgaataatatttggcaacaatatctcatatgactattgtcgggcaagactcggaacttgaaccaacagagcagcttgtagcggaggaggagcttgtagccgaggggcagcttgtagcggaggagcagcttgtagcggagtaagctttggcggaaccaaccagtcctatgactcgttcgaagactagacttctcaaccaagctgttaaaggaatacttaaccacttgggcaaacatccaaacgaagtcattcaaaccgtttggaactcgatagcagcccaagacgattgggaatgggctatgtgttacttgggtactctttttcccttctaaggttttgtcccaatgagttttccttagtaggtttttaatgaggcttgagtaacacttccaaatcccccattatcattccggcccaagcccaataagaggagcaagaatttggaaggtcaagggtctatttttgttcacactttcatttatgattttttcttttccgagttgtcttggaacttgttccaagctaattcttccccttctcttcttctctatttaaactcttgtattttcctttgttaactcatctatcgtttcaatcaaaaacctttttaagttagatcaatctcttgttcttctctttggtgtgtaatatccaactatgagttcaagatcggtaaatcaaaggcctttccgcaacctttgtgtgaccattccccccacatcctttgatcctcataatctcccgattgctttggatgcaaagccatccactgttcaacctcaagagtgtcgatcttaggaaagtcatattaggtggtattagagcacattatagtacaagaaaacacggtttttacgactacatctggcgattgtataagtagtcgtaacatttagcgactattaaatgactattcagcgacagatctacgactaaaataaaaggaacgttcaatagtcgctaaatgacgactgtaataaatagtcgtccaaatagtcgtcaggtaacgactacgttacgactataagtaagtcggagaattaagagttgctaataagtcgttaaaattgtaacaataatcaacgaatttttatagtgttataattttgtgtatactaagtaaaattagatatgctaaagttagactgttagttttgtaattgtcaagatacaagtaaaaattctaacatatttcagtttaaagctttattttaaaaatgcattctttaaacaattgtacaaatatatatatcactctaattaattaattaaaagggataaagatcaatgaatatatagtgattgaacattattttggtatgaagggttaatcacataaataattaaaacctatgactttgtgtaaaaatgcactatctttaattaaaaaattgtacaaagtatatattacactctaattaaataattaaaaagggatatatattaatggatatatagtgatggaacattgtttttggtatgaagggttaatcacataaataactttgttttggatatacaccaaagttatgaaaacctatgattattaaaaaacattaatatacattgcgactgattaacgactaataagcgactacaatcaaaaaattgtgctgaattaaaacccgagaaaattatcgcgggccaaaattaacgaggcccaaacaaagcccaatatttgtgttgattagcgactgatgaagaaccctaattcatttgtcttccgcctctctctctctctctctctctctctctctctctctctctctctctctctctctctctctctctctctctctctctctctctctctctctctctctcgtttcttcgattcaccctaatgaatcttcatctctctctttcgtttcttcaatccttcctctaaatcttcatcaattgttctccttctgctttcttcttcttcgaatctctcggatctctctcacattgaatcgtctcctctagggtttgcaaacaagttcgatttgatgcctctagctaagcgaggaaggaagagaaaaatg

SEQ ID NO: 13370 - DNA, 3000 bp, Unknown
  misc_feature (1)..( 3000): cDNA_ID_3029726_gDNA_ID_2214621_Annot_ID_187675 3000 nt of promoter + ATG
ttgatcacgagtttgttgatgtcttttctctaatgcttcaacaaactccattgtgtggccatgaatatgccgtggatcaggagaacttgttaaatcaagaggactgctataaacaacttcaaacgggctgaatccggaattcctattagttgcatggttatgagcgaattcagcttgatacaagccagcttcccaagctcgaatgttatctccaacaaaccagcgttagatattaccaaaagcccgatttgtaactttggtttgttcattattttgcggatgatatgtcatactcatataaggactcgtatgtaattccaaaaagaatgccaaaaatgacttcagaagcttgtatcccgatccgatacgatagatgtgggaagaccatgaaatcggtaaatctcttggaaaaaacagttgagctatatgcaccacatatgttgtcttctttcaaggcacaaaatgagtcatcttagataaacgatccacaacaagaaatatagagttgttacctagttcagtttaaggaagtcccaaagtaaaatctatactccaatatgtcgtgggttgggtgagaaccagtctcgagaggtataaaacggcattaaaagctgttccttttgccaactgacacgcctgacaacgctccacaaatctctcaacatcacgttgaagtgtagaccaaaaatatgaagcaaaaacaagttggcgagtccggtcacgaccaacaagttaaagaaacccatccgcgagcaaaatgtcggaacaagaaccatctttaacttcgccaaagattggactaaaaatgtgtttgtttcataaagatccgagaaagacgcaaaacctcgaacaacaacgtgcattatagtcaacaaagaatgacgcctactcaatgcgtcggctacgcgattcaaattgcccgacttatggttaatagaaaatgtgaattgatgtagatatgctatccacaaagcaggtagatgagaccttgacttggctatctgatgcggacatccaaaccaaaccaaatcgggagcacaccaaactagccggtacatgtatcataccaattaataaggagcattatgcacgactcttgtccaattggagtctcaacaagcataaggcctagggttaattattcaccagcaaattaaccctaagaagtcaaatgatggttcaagtggagtcaaagaccaacgagccgagtcaccatattgtggaaatatgactgttgcattctttttctcttatctagtgtttgtcagaatgggtttacctagaaaggcttttaacgagacaacatcaagtcatcaaggaatcatttacaaaataattgattcgaagatatcacaagtacatataggtgatgaacttgttgacagaccggctcaactactcgctaatctacttgctgaaccacttgctaatctacacgctgaactaccttttgttgtaccataccaaatgaagctatacacaaggaaatcttacttattgtacattttgatgtgtctcaaagctttgtttggcagcctagagagtttctagatcacttagatgcttcactacaagctctaagatacaccaaaccacacttgatcaggcagatcaattaggagcaataattaccaaatttggacctgtttgtcatcattgtctcatggcactttccccttttgtttgagcgtctacttaagacattccagagcatcaagaatcgtccatggcgtcacaaatttctccccaagttgacaagatacaaggcacatctcacttgccttatttggacagatcctacaataatttccaacgaccatatttcattaaatattgcgatttgtttcttgttttagtgtagtagaatggtttatttgagcctatttaagctcattatttcgttcattgtaaaggacccttgatcatttaaaaagtatacaaacgttttctagtcaaagttgagtctttgtcagttgtttgtagttctttgtgagtgagtcactaagtactttagtaatctacggattaaatttgttgagttattcaacatctttaattagttcattgatagagtgtgccgattaccccactgattgagcgagtcaatcacccttctatccatctattccccttgaatgggtcccacacgagagaagtgatcgccatcgtgtcagatcaccaccttcattagcccaccttccgggtggcaagcttgaaactcttgatcatcaactgatctaaagttggatttgctccaattcttgcatcatcttggtatccgaaattcaaaaggtcctatccccaaggttgtatctcttcaacctatatcttttacgatttctattttgttatcaatttgataaccaactaaaaatttgtttcttgctttgttattgtttatttgcttcaagatctttatttaaaaaaaaaacatttttcttcagtttattatttatttttgatttattaaaaaacccacaaaaatcatattttgttgaatttttgaacttttatttttataaaactagtaaacaaaaataaaaattcgtttcacatttgatattttagatgaattttgtttttattttggcattgattttagaaaataaaaagtttcatattttgtcctctttaccttattttgttcatttaattttgatacagatttctcttatttgtgcaaagaataccacgaaaacaaaagagcaacaatgacatatttctctatgtacagaaggaagaaatcaaccaggagatgtgtttcaatgagagttatgaagaactatggcatgaatagtactctaaatcagattttgaggatgaatcttgccatgaagtaccggaaccagaaccgcctgactcatataataccaataaaggctattgtaaaccatgcaataaatttaatgatgatttttgcagccatagtttgaaatatcaattgactcgagatatttcttttcaggaaaagcgaattatattaagcagagagaagtcatg

SEQ ID NO: 13371 - DNA, 3000 bp, Unknown
  misc_feature (1)..( 3000): cDNA_ID_2713537_gDNA_ID_2214621_Annot_ID_135883 3000 nt of promoter + ATG
agtaagaatcttaagtaatctagccctaaactccatatcccaacatctaaaccatcctaatctaaccctaaccaaagaactctaggagactactcactcatgatcatgatcatacaaaagaattggtttgatctttgtaaagccataatcattagagaatagatgagaaatttaaaagaaatacttgatatagaaacttaagaactcaacattcatacaaaaacttataaagaaccttaaagagaagttttgatctccaaaacaaaagctttctttctctaaaactaggttaagagtatttatagtaatgagaaaataaaccggatcaacccggaacaaaccaggttttgacccgatttaggaaggcaatcgaccaagcaatagatcacttggtagattcaatatcgtccgcaacattaatccttgaccaatcgaccacgcaatcgacaactttggtagattcaaattcctccgtagctctggtcctgaccaatcgaccaggcaatcgaccacgcaatcgaccactttggtagattcatattcctccgtagctctggtcctgaccaatcgaccacggaatcgaccacttggtctattgtcctgctagcttctccactttggtcactttgcattcttttagctcctttgtttgctccatttgctccattttacttccaaaactttaaactccactcatgtacctaagaaaaccaaatgcaaatgcaaatccaatactatatgccaaaatatgaatgcaaagcaacaaaaactaagagaaaaaggggttttaaaacaaccaaaaacactagatatcaaatatatcatatcttgcctccgtgatttacttcttgtccttaattactgctattgtaatttataattattatcgttatttaataaaatttgtacttgtttctcaattcggtttttgagctcctatagtaagtcttcctatacacaataggctaaggaggtgcttggtcctgttatatatatggcctttatgaagaagaagaagaagaagaagaagaagaagaagggcagctcgaataaagagagagctcataagaagaagctgaaggcaggtcaaacacacataagagagaaagctcaagatgtgagttaagaagagatctcatgagagttgagagagacctcaggagtaataggcttatggggtagctaacttctatatgagaaaagtctatggagagttgttccataagacctaagtaagaggcttttgagagatgttccaaagatttaagttcttgagaaagatttagtttttagtaatttctaaatctatattaaagaaaagtcgttctttcatctttcaagttcttttgttgttgaactaccttgtaaatcattcagcgactaattctagatatgacgatcctgatttgaatcagtattagagcaagtcagcttttatctgaattggtataagatggtaactaagtcaagataaggtgatctttatttgaattggtattagaacttaagttgaagactcgatccaaggacggtggtaacggcgggcgagaatccacaactgagaataaagaacctcgaaccctaagcctggaggctataggaattcagaggccgttgatatatccctatttttactgtttttaactatgttttaggtataggttttagagtccttttgttatttctagagtcttttctagtctttttcaggtctttacatatttgggattcatttggagataatggagcattctggaggaaaacaaagaatttatgctgctgaagaaatccggagacgaaaaatgcacgtaggtgtcgagcgacaccaatacctaacggcaatttcgaaacacaacttattgatgttttgaagatttccaaattcggcccagaactttctcctatttctaaagaaggcccatcacgtgttttaggtcatatatatagtttttaaggtcattgtttagacctaagcttggagaggctattctcctcatctcttttgtactttgggagcaaaaccctgtggagactccctttggagaagatcttctttactctttctcttgctattattgatttcttattcagactatgaattgtgtttctttgattatgtctgagtaatccacttgttaggtttaggatttctcattagggattcatatggtttaatagattgccccctgctaggttatctgtagaattcttcatctttaattgttcttaatgctagatctagattgatcacctagaacttgaatccagacaatagatatgcccgccataggtatctgtagttggatctattatttgatgagcctggtttataggtgtgtaataagaatcggcctatctactaaggtgaacaaccaaactcgttaagaatgcatatttaggttaataatctctcggcttctccggttattcttagctatagatataaggagtttcgcggcacgcccaccggttattccataattagagtttgagtttaagaatggttcgataacaacctagctattattagatctactaaccaatagtttcaagagaataccctaagcctgatgtttttactttcttgtcttacaacctcacaatctgctattgcttccttttgtttctttttattttcattactatcttacttagcctaattcaaaaccttggtctattgtgtgatcccagagctttgtggaattcgacccttaagtgctacaatcgatctcttatttgagagagtggtcttaaggcaatttgacctatatcaaatttggcgtcgttgccggggttctctacgattcaccattagattaggattagaattttttctaagtatttatttttattttttttacttagtctttctcttttctttttcttgtgtgtttcaggtgtttgtctaatcatagaaccaggaccaaacgagaaacatgaacgagagtaagattgctgggatcatggctaaacttaacgcggtccacaatcaatttgtgg

SEQ ID NO: 13372 - DNA, 3000 bp, Unknown
  misc_feature (1)..( 3000): cDNA_ID_3029812_gDNA_ID_2214622_Annot_ID_135895 3000 nt of promoter + ATG
ttgttttaatcccaattagtctccttctcctttctctctgctctctcgttcaacgggcaaagtttttttcgaataaagttttggtttttcttttaacgttcccttcttcttcctcctcctcgcgaattcgcttatctgtcgatcacgatgagctcaagttcgaatccaccggtttgttcaccggaaaaggtcagatttttccctgaaatctgattagggcttttcatttcttgtgatcagattgttatcttcgcctactttggtgtgagttcatgggttttaggtctgaatcggaacacgttttaacgtgtcttggaacagggtctgaattggtttctaatgattaggattgtataaaccctaaacatccatcttgtgcttgaaagaaatcgactcgttttttttggtgagatctggcttctattttgcggccgttgagtttttagggttttgtgagttttgattaattatttgtataaagatacgttcttgttcattttgtgctcaatccatgtttttaacgaaaattctggattttggtgattttcatggggttttaggaggaaagaagtgaaatgaagattgagattcaatgtatggagaataagcaaccattagctgcttcttgctcctctgcatccgaaggcagtggctgtttcttcctcaagtcacctgaaatcgcaactcctgccacagtatcttcatttcctcggtacttttactatcttttacatttcatcttctatctgtgtgtttatacaacttattatgaaattgattgattggaaagactgtgctttgatgacttacaccgaactcattttgggtttctgcaatgttttaatgttgatctgcaggaggactagtggacctatgagacgagcaaaaggtggttggactccagaggaggttagtggttgcttttgtttcattattttgttggtgtctggagcaacctcattcgactatgtatcttgtatgtataaggattactgttcacttgaatgaaagaggaggctagcattattgtggtctgtaattggtttctatcactattcaggatgagacacttagacgagcagttgaaaagtataaggggaagaggtggaagaaaataggtaaatttcttttcttgaatctgtttcctgaaaaagtagtattgcaatacattagaatgagattataggtcttctaatcacactcttgtatgtatacttgaatgtataatttatacatttttaaaactgaactcgtatcttaaatctgctgagaattttgtgaatttttctcattcagtaaacatgatctctgctgtgcactgtgcaagagaaccatgatttcttttttgtctcttaaatgttaaagtagctggtttcggtcaatgttctgtttgtttgatttttttgtatttcatcttacagcggaatttttcccagagagaacacaagtccaatgcttgcacaggtggcagaaagttcttaatccagagcttgttaaaggaccttggactcaagaggttctcttatcattttcatgttctgaaactttttttggttttcattttacgtaaatatttggtagctctaaaattctcttcaacaagtttacagtggctccatcgttgaatccatctgtgtacatatgatccgttgtctgtgtatattaatatgggaaaaatgtcgaaaaaatcatgaacttgcaatttttggacgatttaatcttgaacttcaaggaagactaataaatcgtaaagttattgttaactttctatataaatgacgaagtttctgttgacttgtctatttagtcacgtcgttaaataggtttaatagaatcgattacgacgttaatactcccgtttagctgctctgttagaataaaacgacgtcgtttctttctcagacaaagcgagataaaacaacgtcgttttatctgttacccaattttaatccctaaaatccctaaatcaaatcgacatctctctttcttctcttctcaaactcgacatctctcttatcaatttctctgttcgatcgaaatggctaaaactcgtgggggggaagagaagagatccggttcgtcgatcacggagactgagtcaagcatccgccgaatcaaatcctactgaagctgaaccaattttaattccttctgtcgacgaggctaatcgaaagaaaagaaaaaggaagaaggtagttgaagtagatattgaggaagatcgtgagcctgtgagtggcgatgattgtgaggttgttggtgacgaagattgcgaagaggtttgctatgcagacaagagaatcgggaataacgaagaacatggtggagaggaacaatgggacattgacattgtttctgttcagcaagaagacgatagaagtgctgtcggggaagaaggaaacgttgcagctggggttgaggaagaaggaaacgatggaggtggtgttggggaagaagaaaacaatggagttggggtcgaggaagaagaaatcaatgaagttggagctgtaggtgtggaagaagcacacgttggacaagatgttgaagaagaagacgacgatggaggtctaggtgtggaagaagaagattgtgaagattttgaagcagaatttggagcacaggcgagagaggaggaagacgaaagcgatggtgacagtggtgacgatatctgggatgacgagaagattccagaaccagtgtaccatagtgatgatgaagaagttcatgacgccagaatttgacgatcctgaaaagcttttgaggttggggaaaacattcaataacccagaagatttcaaaatagctattttgaggtactctcttaagactaggtatgatattaagctatatagatcacaaagcttgagagttggagcaaagtgcacaaatactgatgttaagtgtcaatggagatgctattgctcctatgataaaaagaaacagaaaatgcaagtgaagatattcgtagatgaacattcatgtgttaggtcgggttactcaaaa

SEQ ID NO: 13373 - DNA, 3000 bp, Unknown
  misc_feature (1)..( 3000): cDNA_ID_3029812_gDNA_ID_2214622_Annot_ID_187695 3000 nt of promoter + ATG
agatagtagagcaaccttttacaatcttcagaatgccatcctgagacttgaaccagcatcctctatcttctagtgtaccaagagaaatgagattcctagtcatattgggcatgtatctcacatcagtaagaatcacttgagatccatcagagtttctaatcttgatactgccaattcccttaaccggagagtaagtatcgtttcccatcttgacataacctgaactcaactctttaaaatctttaaaccagtctttccttggagtcatgtggaacgagcatccagtatcaagaacccactcatttgcaatgctatctgtcaccaccaacgtttcatcagtagccagtagaaccatagcaggattaaaagcttcagtggacttagccaaactagactctccattatctgaaccctgctgttttgacttgttcctttctatccacttataacattgcttcttgaagtgtccttctttgccacagatccaacatactctcttaccatctgctgacttagaccttgacctattcttgcctttattcccttggttattgttcttaccatctggtcttcctctagcaaaatgaccttctacaactggtctattgttctgagacaattctctctctttatctcttgctgcaaccatcacatcatcgagtctaagcttttctctgctattactgtacttcatagtttcaaccaaaccatcatatcttgcaggcaaagaactcaacaacaatatcgcttgaacctcatcagttacatcaatctgaagatggttaagatctgcaacgatcttgagaaaatcatcaatattctcatcgatcttcttattttcttgcatcttgaatgtatagaaactcaattgagtatatactctatgcggtaaagatcgaatcatgaatagtcgatccaacgtttcccaagcttctgctgcggttttacatagctcaatctttctcaagaccttatctgcaacattcagaaaaatcacattcttcgccttgtcacagcgctcgagccttgctacttcatccgcatctcgcttcttacgtttctctggatcttcttcttcttcctcggttagaggtttcggagtggtcccaagcacaacgtctttcaaaccaatgacgctgagatgagccatgatccttgtcttccagagtgagaaatcaccggatccatcaaagatcgcgattggattaccagccatactccgattcgaactggctcaagaaccttgagctctgataccaatttgtaaggttttgatcaacacttagctcacaaaactctcgaatcaaacgacttaaactttgagaatgaatcgaaactttaaagagaatttaaagaaacaaagacacacacgatttaacgagttcacgttcctcaaccggaatcgctacgtctcgccggagaatctctccggaaatccactagaacctttctttacaatgtatctttacaagttttctctctctagttctctctagaacttgattacaattctctctttttctctatctccgatctaacagaattacagagaagaagaagaagatatagttacagagctcatgcgaaaaagaccaaaacaccctcaagcttgttatgaccttagtcagctcgcctcacgtgttatgactttagtcagctcgcctcacgtaagaaagtataacgcttaaggggactgaggggtttgtcttgagaggttcttggattgtataggaatccatgaacgttagagattagataattgtttgagtgaaacttgtaagtttactaaacagattttctaataaagaagctttttgttttgaagaaactacgtcttagcttgtgactcagttcttgaatcgatttccatatacataaatagctcttgcgttttcattaatgatatgcccaattcaaatttctgtgactccatgatgatattcttgaaactggtacgacgagttaggattaatctggctatgattcaaagaaacatgtagtttgtgctggcagtagaaaccaagttttaagcaatctagaaaaaaaaaaaaaaaaaaaagaaaccccaaaatagtcaacaggataaatttttccaatgatctgatggttttaagttgatcaggggacatctgcattgccgacgacgcgttcgatggtcaacgcattaagcttgtaactcctggactgaaacattaactttgttctgtaagttttatacaagttgtaaatatgaattgcaacttttttgtttgatcaacttcctttttttgtttgacaattgtaaacatattaaacgacttgtctgatcttatattatgactgaaaaataaaacagatttttatattatacacataataattatgtctaacgtgtgagagagtcagagattgtgatacttttttaattgagaaaattagtagaaagatttatacacattgatcaaggttagctgtgtgtttcaagttgaacatacgaaagaggagagaaggagacagaaaaaaatatcacaacatcgtttttagaagcaaccatgaacctagtcggtgaatttcgtgaggaagaaattgatgggaaaacgtttttcttatacaattcttcaacctcctccggtgaagacattcctctccaacctcttttcctttgtcccctcttacgtgtcaaatattgggccatatgtatggaccttatatgttttgggctttaactgtaacttatcgatgaagtctcataaacccttgtgtaaaccctagcagctttgtgtatataagcaattgtatgaatgatcaataaagcaagtcagttcgatatctaattctacatggtatcagagcttaagatctctcaaaaaaaaaaaaaaaaaaaacttaaatttcttccgcttgttacatcgatagtttcgattagtgtgttttgaaaaaaaaaaaaaaaaaaaaaaaaaaaaaaattttttttcgatagtttcgatctggttttctcttgaagttgtgttctaacaagag

SEQ ID NO: 13374 - DNA, 3000 bp, Unknown
  misc_feature (1)..( 3000): cDNA_ID_2713575_gDNA_ID_2214622_Annot_ID_135897 3000 nt of promoter + ATG
cgcataagcttatcagcaccccttgctgtaacactcttcaacgtcaataaaaaaaatgtagttccccacggatgtttaagaaacatatctagattttcggccatgtccgcatgtaccggagatattttgcttctacccgacgttgggcacaagacgccatcaatgagggctagagcagcgtaccgtagacgaattccttgatcttcaaccattcgtttcttcagcctaccaacaacccgctcaacagatacatcactccagtcaaataaggtgtactaatacttgtcaggaagtagtttttgtttccccttcctctctttgacatgagggagtttgtagcagttgagcctagttactcttttaaactcagatatcgaaaactgaattggggaaccagagaatattacccagattttattttgcttgctaacaactagctgcctcgttagcagaaagtgaataagctttccagaatacgcggctccctccgggatatcaaataattttccaaactgtgattcccttagaatcttcatgtcctcctcatctaaagcgtcggcgatgttatcgattaaagataactcacagtaagactggactctctcaccgtttggttcagatccaccccgaaacaaccgacgaggaatagggtggttcgccatctagaaacagtattagcgtatacaggtttcacctgtgacgacaagaacttaacttgcttatcaacaattactaacgaattaaaatttgtggaagatactaattgtgagcttaaaaatccagatctaacaatatttaccttcgggaatgatggattcgaccccgcatgtagcacaaacactcgaaagctgcaaataccttccacaaatcggcagattttaaacgggattccaatgtcgcatgtcgtttttttttctctccagttatgttcttcaacagagagagaaacggaagaggcgctaggattttctgtttttctttttttcgtctgaaggatttcattgattgaatgcgtttgagttatacatagccaaaaaggaataaaatccttttggagacaaagccggcgggtacatagaaacccccagagacatgaggccaaaaaaggcgaacaaacaaatcaagccttagaagaaaatatacaaagataacagctacagaagtaatagctaaagcctccaaagccacaacactgaaaactcctcccaacaagcagccgactaacacttccatagaacagtttggcgctgaggagaggtaactgacaggagtctcgaaaagagatttaatacgaccatctccacagcagaaacgaagacgacgaaacaagaagaacagaacacagaacctaaccaccacaaccgctttagcgccaatgaacatgagaaggcgaaggatcatggaagaccttgagatcggagaggggaaacgccaaatagaaccacttatccttacacacggaccttcaaagacccagctaaactacttcctggcaagagatcgacccaccataacgtccagaactcagccgggaaaccaaaagaggttccaacagagagctagtagatgccattataggaggctagcatccgattgaagaacccacaaaatagaaccttccaccaagtcaccacaccgaaaaccaagaggaggatagagagataggcagagctaggagtcaaacaaggctacccaaaagctgaacttgaggcttcaaaccataaccagtcaaaaaacacagcaaaacacaaaccctagaagtcactcaaactcaaaatcggaagaagaatccgcatacaaagaggccgttgctgcagtactaaagggataaacagaactaactcaaggaaacgaaacgccgactaaatatacgccccaaacgagacagcaccaccgcaaagccaacaaaatccaagaacagtactcaatagatccacatcagaaccagccggaacatacaacaaatcaactccagttcccaaactaacaagaacaagaccgatagttgagacattagaaccagatcagaaccacaaacctccataaccagatcggagaaacgtgacggctccaccggggaatagatctgactacaacgagcaccgatctgccacctatcctccatgatagtcaccacatcggaaccaccacgaaaaggagagacttgaagaggagacaacgaaactagggtttgagaaactaaatcaaaacaaagaagaactaagagagaagaaactgaaattattaagaacaggaccggcgacagtgctatggaagccaccaatcaccggccaaaacgaggaagaagatggccttgacggctagggcgaacaaggagaggggagagaggggagagaggtcgggggaaatccttgagctagggttttctgtttacagggggttttctgatatatatgtaaattattcattttcttgaaattgtagtctatatcggttgcgtcctcaaaccaactttgtgctccagatgatttcaaatttcaaaatttaaaatgatatgcctatgaagctatttgtcccctcaatcaaaaacctattgtagggagatgagagtaatttaaagttggtttccgacaggtactatacggccatagttagtttgtacattcttttcaaatccatagccatttattataaattctctaatttattttgattggtaagaatttgaagtttgatggcaagtattgattttagtttgttttataaaaggttagacacatttttatgttgattaaatggttgttttgtattcaaagttagtaaaatagaatttatatctaaatgggtctataggtttaaatgggaaaccttaatagaccttaaaattaaataagtttaaatggggtggggttaaattggtcggcttttaaatgggatgggcctttgaacttgattattcatgatgcattgtttagttttgggcctttgaacttgattattcatgatgcattgtttagttttggtaactaaaatgcaatg

SEQ ID NO: 13375 - DNA, 3000 bp, Unknown
  misc_feature (1)..( 3000): cDNA_ID_2713571_gDNA_ID_2214622_Annot_ID_135898 3000 nt of promoter + ATG
gaaacaatattcttcatcttcaccaatgtgtcacacacaaccgcatctacattagtgtcaggagctggaagatcggagtaggtgcctagctatcgtgttcctgtagctatcgtgttccaaaagttgtcagcaaccgtaggagacaactttgaaaactcaaccgcttctcctttcgtaaatccatacatgtcgtagatctcaaacattgtcttgttgtaatgttttttgttgagaaagaatgtgagtgttccttgactcgcttttgggttctctggatttgcgtacgtgaggcgacatgtggcaatgaactccttcacaagtttaggatatacatcctcatctatttcccgataccatcccataccgtgtgtttgaaacaccgtcacgacatcattgtacaggccaagtacctgtagagaaggtctgcaagcaactcgcgttggcctcacatcaatatgtttcaaagctgccaatagctttgtgtcctccttatcccatatgtcggtaacaagaagttttgttaggatcttcttttggcagtgccccggaattgctcgtacgtgctcgagcagtgcctgcagagtcgtttgttcgtcccataccttgcaaaagagacgaagtgaagtcaagaaatcacttaaaaacaaatcaaagaaattaatcattgcattttagttaccaaaactaaacaatgcatcatgaataatcaagttcaaaggcccaaaactaaacaatgcatcatgaataatcaagttcaaaggcccatcccatttaaaagccgaccaatttaaccccaccccatttaaacttatttaattttaaggtctattaaggtttcccatttaaacctatagacccatttagatataaattctattttactaactttgaatacaaaacaaccatttaatcaacataaaaatgtgtctaaccttttataaaacaaactaaaatcaatacttgccatcaaacttcaaattcttaccaatcaaaataaattagagaatttataataaatggctatggatttgaaaagaatgtacaaactaactatggccgtatagtacctgtcggaaaccaactttaaattactctcatctccctacaataggtttttgattgaggggacaaatagcttcataggcatatcattttaaattttgaaatttgaaatcatctggagcacaaagttggtttgaggacgcaaccgatatagactacaatttcaagaaaatgaataatttacatatatatcagaaaaccccctgtaaacagaaaaccctagctcaaggatttcccccgacctctctcccctctctcccctctccttgttcgccctagccgtcaaggccatcttcttcctcgttttggccggtgattggtggcttccatagcactgtcgccggtcctgttcttaataatttcagtttcttctctcttagttcttctttgttttgatttagtttctcaaaccctagtttcgttgtctcctcttcaagtctctccttttcgtggtggttccgatgtggtgactatcatggaggataggtggcagatcggtgctcgttgtagtcagatctattccccggtggagccgtcacgtttctccgatctggttatggaggtttgtggttctgatctggttctaatgtctcaactatcggtcttgttcttgttagtttgggaactggagttgatttgttgtatgttccggctggttctgatgtggatctattgagtactgttcttggattttgttggctttgcggtggtgctgtctcgtttggggcgtatatttagtcggcgtttcgtttccttgagttagttctgtttatccctttagtactgcagcaacggcctctttgtatgcggattcttcttccgattttgagtttgagtgacttctagggtttgtgttttgctgtgttttttgactggttatggtttgaagcctcaagttcagcttttgggtagccttgtttgactcctagctctgcctatctctctatcctcctcttggttttcggtgtggtgacttggtggaaggttctattttgtgggttcttcaatcggatgctagcctcctataatggcatctactagctctctgttggaacctcttttggtttcccggctgagttctggacgttatggtgggtcgatctcttgccaggaagtagtttagctgggtctttgaaggtccgtgtgtaaggataagtggttctatttggcgtttcccctctccgatctcaaggtcttccatgatccttcgccttctcatgttcattggcgctaaagcggttgtggtggttaggttctgtgttctgttcttcttgtttcgtcgtcttcgtttctgctgtggagatggtcgtattaaatctcttttcgagactcctgtcagttacctctcctcagcgccaaactgttctatggaagtgttagtcggctgcttgttgggaggagttttcagtgttgtggctttggaggctttagctattacttctgtagctgttatctttgtatattttcttctaaggcttgatttgtttgttcgccttttttggcctcatgtctctgggggtttctatgtacccgccggctttgtctccaaaaggattttattcctttttggctatgtataactcaaacgcattcaatcaatgaaatccttcagacgaaaaaaagaaaaacagaaaatcctagcgcctcttccgtttctctctctgttgaagaacataactggagagaaaaaaaaacgacatgcgacattggaatcccgtttaaaatctgccgatttgtggaaggtatttgcagctttcgagtgtttgtgctacatgcggggtcgaatccatcattcccgaaggtaaatattgttagatctggatttttaagctcacaattagtatcttccacaaattttaattcgttagtaattgttgataagcaagttaagttcttgtcgtcacaggtgaaacctgtatacgctaatactgtttctag

SEQ ID NO: 13376 - DNA, 3000 bp, Unknown
  misc_feature (1)..( 3000): cDNA_ID_2702818_gDNA_ID_2214622_Annot_ID_135900 3000 nt of promoter + ATG
gccttatttatataagaggtgtgttgataacctttttcaggagatgtattccagagagtgaagtcgaaggtatcctttacagttgccatgcttcagattatgaaagacactttgcctcattcaaaactgcttcaaaggtcctccaagctggacaacctacaagactccagttggaacaacgccattcaacctcatctatggcaaatcttgtcatctaccggtagagctagagtacaaagccttatgggctacaaagttgatgaactacgacattaaacccgctggggaacgccgccgtttacttcagctcaatgagttggatgagattcgtttgaatgcctatgagagttttagaatttacaaggagaggaccaaagcccttcatgacaaaaaagatcattttaaggaagttcgcagaaggtgataaggtactcttattcaactcaaagctcaagatatttcctggaaaacttcgttcaaaatggtcaggccctttcgtcataatggaaatgcgacctaacggttcagcaatactctgggataacaatggaaaaccgttttctaccaatggacaaaggctgaaaccgtaccttgctcattccactcttgaagagggcactgcagttcctctaacggatccaaataaggcataagagctcactgccgtcaagctaacgaccttaagcaagcgctccgtgggaggcaacccacaaggtattgtagatactttgttttccttctttcattttctttgattttggtttgattcactccactgtagagttcagacttatcgacccggctgttgagtcgatagagtctctgtatttgacggtgttgtgagaatgctttttgagtgcagaaacaccatgacgacattgcaaaaccaaggtattatcgagctccacttcatcttcttcgtttttgtttatcaagaacaccaaaatcactaaaccctaactctctcaattcttggtcgtttttgtcaaaattggtatctatttcaatcggatttttgcctcttttcatatctattgtctgttttctcgatctgcaaaggtatgagctcgaaattccccttttcggttccgttttcaaaggtgaaatatctctaattccttgaatttcatgatgtttatggattatttgatgctagcttcttgtctaggatggttttgggaacctttttaagtctttacttgctggattaaggcctaatttgagaattgaaaatttctcttttggtaaaaaacggacatgttcatacactttgggaaaaacggattttagggcttaaaatagtgatgttaatttgggttttaaatttgggctttagttgggcatttaaatcataataaatgcccatttagactcatttagttcaaagagtgaaataaatgaaaactcaaataagacccatttaaaatgtggaggccctattagcccatttatatatatatattttttttttgaatatgtttgagtttgatttctagatattaatttattgggtaatattagggggtaacgtaatttgacatcaatattaagaaaatgaccttagtgcagaaaagttgggtaactaacgtttttgggccatgcgaaataacgaatataacctcggtcattgggcgtcaaatctttatttccgacagtagggttctcggtataggatcaaatagggtagtagggatatgattacaccgatacgtaataaaaattcatgcattacagtaatcgatatttttatatgtcacatgttaccttactatgcaagagaacctagttagagctattggttactacaggctgaataaccggattttgaatatgacacaggctgtatataattaccttcagatgatgcatgaaattaaagagatggattactttcctcacacctgcaagaaatgattctggaaaaagagatgtgacgtttacattaataccaaaatactacaaatatcccacaaatatcaaacttcataacgtaacccgcgttatgtataaaaaacacgatgtacaaattttccttagcagcatgtattaatgtaaagtaactgaagtaaaagttttacttgggaggcctaactcgaaatgtactggactggattaccctaaagttgaatgggcttttgagaagaagatccggaaattagatttccgaaacagcataagtacaacgtaaacaacatgttttgttaaaaaacacagcaatcattgttctgccacttgcaaatataacatagtggaagaagtataaaaggaaacagatgtgacagtgaaaagcgcgtgcaaagaggagagtagatatgtatcccttgcattaaatgcggcgtcagagagtatcagcttccaaggtattaaactgttaaaaaatagaaactttttttcatgtgtaacaatctgaacacatgctatatatgtgcttctcacgtacgctacatcttagcgaatcatataggtgacacgtctcaactgacgtcagcgttacgactgagcaagtggacgacgaagatatagtgtatcttacctcaggacaagttaatgtgtaaaaacatgagtatatgataaatcatttggttctattgtcgataacgtgcaatacaaataaagaacaagtacctgtttgatgcgacattcgtgaagagatcttctcgccgccctcgggtgttgggagggaaatcataaccttttcaaattcacgtggctggaaatgggtcagcaactgttgcccaaaattcatagaccactgtagctctaaaaaaagttcaacttttctatataagataatagatggcaagatatcatctctcacacctcttcttctatctaaaaaacacaaacgaagtatccaataacatctcagaggtcgatcgttgttgttttggtatgcaattaatgattgttctttttgtctaccttggtgttgtattaataaatcgcatggtgattttatatggtatttaatgcaaccctattgatgtgtaggtaccaatg

SEQ ID NO: 13377 - DNA, 3000 bp, Unknown
  misc_feature (1)..( 3000): cDNA_ID_2713563_gDNA_ID_2214622_Annot_ID_135901 3000 nt of promoter + ATG
gacttctcagcttgaagcttctcatagtcagagactgatggaccacctagcttttgttgaatgaatctgatgacaaccaccggaaaatagagaatatgttatatgcaagatcttacattacacgtaaacagttagcctaatacgtaacaaatattgtaaagttgcattcgtgaacttgaacttgaagatctgttaacgaaagatcgacataggagattggcaaggaagaaaaacaaataaaattatatgtcaaatctaacagacatacctatcaattttcttagtatatgtagtccatgaaagaaaaagattataagtcaatacacaaaattgtttctatacaaaatctataatactcagctagaaactaatgaatgggtccagaaacttactctagagcagaggaaggcttgtcattctgctcatacagagaaaccagaactacaatcaaaatcaaaacctcgtcatgttccacaacatacaaaagagtataaagagaatcaaaactattcaattaaaaactgttgcaataggtgaagtaagattatacctttagtaagagaatcaagaactccacttgactccaaatacttcctgaaagcttccttcttcacctctttctcctgattcatgtagacacacacaaaaagaagttcaaagaacacataacggtgcatcacctaatctagcgaagaaacagacttgaaatcagaaagtactaatacctctttgtaccgcatcatctccttgttctacaaaacacagaagaaactttaatgtttctaataactgtatattaatcctcttctttttcctagctgcatgacgagcttggacctatttagatcctccaaagaataaaagctctctctctttaactaacaaaattacaagggtaagctttgattaagacaaaacataaacttcatcacacataaccagtgtcaagctttgattaagacaaaacataaacatctcccaagttcctaaaaccattccactctaccaaactttttcaaagtttcgatttttcttaagcgtatagccataaattggcaagagatctcaaagattctatctttattctccaaatccagtacaatagatccataaatttgatgccaaacaatccaaccataacacaaattagcataaacgaaatcgatacatttgtcaatacaactaaaccaaagacatctaaaatcaaatcaaatcaaaaccggaaagtaggacttaccttgctcaaagtgttggaaacaacgcggtcgcagacacaatttgagatccaaaacttgtgtcggttggtgcttcagttgtctctttctcaaaattttgctaaaacaaacctaaatattttttttttctattgtgggaaattaacgataaatacgctgattttgtattttttaggttgttcaaaacaatacatccttgatccttaatcttatcctttatcaatcatttatcttataaatcataaattattttatcagttgtatttgtgtcatgtgtaaagtcacaatttaaaaaaggaaaaaaaaagagaaaaaatcaagttttcttaaaatttggctaaacaaaactaccgttattttaaaaagataaatcaagttctttacgatctgtgcaatctactgttacgaatcatatttataggaatatgtatattttttttttagaaaaaatctcaaaaaatgattacctaatttttatttagccgtttaatatctttagttttaaatttgaaaaatacctcgtttaactttagatgctatttaatttttttgataaaattggatttccgagttagtaactgttatctttactaacagaagttctaactataattaaaacttaactcctggtatttacgtttaaatatacaatctttttccaaatctttacgaatatattgttttggtcgggtggttattcggtctatgatctcaatgtgttgacatgatcgcaaagcagtggactttgtattcgccgttctattagatcggatttgttgcttccggctagcacccagattatttaacccctcttccatgtctgcgccgataattttaatttcttttctaattgtggatgtttgtagaatatatgcgttatgcccaagttcgggaataccatgaacaaaaataaattttattattttatgtttttttcgtcgaaataccattatatttaagtaatcggaaagagaatctcttctagagagagccaattaagaaccgacttgcttacatgggaaaaaagactattacgacctcgtgctttttttgctaggcaatcagcacatacattatgaatgcaaaacaaaaacttaatactaaaaataggaaaaaaaacagacaaaagaaccgaaagtcgctatttcagcaacaaaggtaggccactccgaaggtttttccagtaaagagataagatcagcacaatcggatgagaaagagcaatccgtgacacctatcgagatcatacactctattgcccataacaacgaatcaacttcagcgtgtaatggtgataggctcttcggcgcactctttagacccaaatgaaggacattatcttggtcaactaggacccatccatgtccactcaaagtgtcatctaagtgccaagatgcatcaaactgacaacattccgagtagggaaaatattagcagggaccgcctgaggacgagggtactccaaaactgactcctttgaatttgcttctttccaaacttttgcttcttgaattgcaaaatctaaagtttcttgtggagattcaatcacgttttcgaagataaaccggttacgactcttccaaatataccagagtatccatggaaatatctcaagaatgtcttctcctatatcaaattctttccctcgccagagtaggaaatcaaaattctagaagtgagaattccgggggaagaggtactccgaagacgggataggggacaaggcccagatttgtctcgccggcggacataggaagagaagatg

SEQ ID NO: 13378 - DNA, 3000 bp, Unknown
  misc_feature (1)..( 3000): cDNA_ID_2702834_gDNA_ID_2214623_Annot_ID_135909 3000 nt of promoter + ATG
tcaggacagctacttaataccaaccaggctaattcataccttcacaagcgatccaagacaagctgttgaaataagaactccagggacagcaagtaacaccatttgtcccagacacctctaaagaatcatgcaagtattcagtacctatttctcttaacctttaagcttaactaggaattagagccagaggaataaaccttaatttggtgaacttccattgaaaacgaactctcgaaaagaagagccggaagaaaaacagctaaaagaagttctggatcgatctcattccctgcacaataacattgattctatagttcttacaaagccagccatggaagagaagaaaaattcgaaactaaaaacttacagatacgaattccatggccgatctttccaaggttatgtttagctccatattctgaaacaccaaacaacatgaattagcaattaagcatgattacgttgacttcaaggattaaaacagatgaagaaatcagaaattccatggaacgaaatcgaaccgagagatccaagagcaattccgataacgagaagagcgacagtgtaaggaaccctagttccacgaagcaagtgcctagaagcaataccgagtaccagagacattccgacgaagagaacggcgtcgacagggctagattctagtttggaagaagaagaagaagaagacgaatcggtcgcttcctccagaaatctatacgccatcgtcgcgtcgattacagtcgtcattttatttgaatatatctaagaagcaacaacacagaggaagaagaagaatgctcgttcactgaaaaaataaatagctgaaagagagtaaatacttatagagctatacatacacacgtgtatagtactgtagtgttaaattaaaattaaattttactattaattttgtttatgataacattatcatatttttctgctatatatttttcacaattttcagccgaccaattcttcaatgtttatattttttctgaccaagagtatattagaaccagaattagataaattaatggaaatataatgatgacaaaaaaataatataaatataatatatagtttgttttggattttatagattgatgtcatatagatgtgaatgtgactatggtatcttcacaatgaaattagtgcttaatttgtgtacaagaatttattgaaattgagtttatttgtaataagtattccaaaacctggtttggccttaaaaggaaaagaaatattcgtagttggttttttgacattttgggacatatttttcttatgatttaattgataagacctcttactgttgtacttttttgaataaacaattgcaaatgtaaattggctattttagaattagacgactagcctaccaaaaatacatttataatgtggattttgatatgtgtgtgagtgtgtttacttcgtggagtttgatgtgtttaaggtttcgaaaatatttgagaatttggattagcctgactctattcggctgatccaaaacattaatctgatacctttcaattcttcacgttaaatttataatattttttaaactttcaattatgcttagctgatgcacaacaacattttcaatttcgcatatcagaataacaccaattatcattttcatgctacccagaagcacctacaaggtatcaagtgtgcatgttaaaagactgtttgggttagtattgattaatcgaccaaccgtcgatcctaatgaaatgctcaaagatagaatccaacataaagaatctctattggtattcaagatttgcttatagagtagtgattgttagttagttagtttgttattctttgattttccaatcagcttacgaagatttttcaagagtagagatgctaacaacatgcataataatttgtctaatggtaaattctacaataggaaaagagtttacattgattactctatcattagtagttcaggggatagtagatgtttgttttgttctaaggcttatgtttatgctctggaaaactggttccaggcgagaagattcagagagaactcgttgatggattacatatcatggtcgctgatgagtgtatgattcgccaccaccatcaaagaaggtgcaaaatcaataagtatcagagctgttacaaaaataaactttataaataaataaaattattgtctgtgtaattaacatcttaattttatagtgttcttatttatctggtttggttgcaaaaaattgagtttagttaagataatcaggtatataaattactacatcattcattttatgtacaaaaaatttggtttatattccaattgataatactttttacttgctttgctttaatcaatttcataaacgagatactattgtgaaaaaaaaaaacgaggcactattgatcttttttcttttgaccacctttttatttgtatcttcatcatcatgattttgttaaagagtaaaaagaacattactgattgttatagtcacatggaatgcaataaaactcctataaatagtagaaagcacaagaacgagagaatcactctaccaatagaaaattgctacttattaaaaaaaaaacgacaattgtaacaaaaaatatcgattatagaaagttttatttgcttcagtttatatcacttgcctctgccattcacaagtttcttacgaaacgtattaaataatttaaaattttgtgaattaatacgaattttgtttagaagatttaagaaaacaaccaaaaataaaatatataaaaataatcatttcaatttctaaaaaaaatattaaaatgtcgcagattttattttcttacataatgctttttattcgcaatattttttcttaagcatttagtagaagaaaattcgttaaaaagagagataaaataaataaaagtaatataatcgtccttttgccataagcgttgctctcaaaaatataaagcaaactcagatctcacgattttcttcttcctctcacattaacacacatcatcatg

SEQ ID NO: 13379 - DNA, 3000 bp, Unknown
  misc_feature (1)..( 3000): cDNA_ID_2713615_gDNA_ID_2214623_Annot_ID_135910 3000 nt of promoter + ATG
ttgtccaccttcccaatgaatccccaaataggcaaatcatcataatacatctgaaagtaataatctttttcaacagctcttcgaaagtgttcaacttcttctctactaagcttctttttacagtacacctctgagtctttctcatctctaaagttaagcttgtatggagcactaacaagcctatccccattcaaaacctcaccaagagcttccttcttatctttcacaccctctacacaaaccaaaacaaatgcatattgacaccaaaatacacaaatccgaaaaaagtgaaaaaccacacataacagagacaacattgagcgtgctcgtacctggaatacaaaaggggagatcgaaatagcgatacgtctcactgcaacaatcatcaaacacaagtaaaaatcagtcatataacaatgcaatcgaagatctatcacattttaagaacacgaatcgaattttttcaaggtcagatacaaaaattcaataccaacgcaagcttctacagaaatttgcaacgatcaatttatcactcatcaaagagaatcacagatctaagctaccgacaaaggaactgagattagagaattggatttacctgggattgtgaaaggggccgaccttgttggcgtagagaggaacggagtcaccgtccttgtaacggtggtcggaggcatcggatctgacagtaccggcgccggagaagatgagagctccgataaagaggagcagcgtcgttggtaatctcatgatgatgtgtgttaatgtgagaggaagaagaaaatcgtgagatctgagtttgctttatatttttgagagcaacgcttatggcaaaaggacgattatattacttttatttattttatctctctttttaacgaattttcttctactaaatgcttaagaaaaaatattgcgaataaaaagcattatgtaagaaaataaaatctgcgacattttaatattttttttagaaattgaaatgattatttttatatattttatttttggttgttttcttaaatcttctaaacaaaattcgtattaattcacaaaattttaaattatttaatacgtttcgtaagaaacttgtgaatggcagaggcaagtgatataaactgaagcaaataaaactttctataatcgatattttttgttacaattgtcgttttttttttaataagtagcaattttctattggtagagtgattctctcgttcttgtgctttctactatttataggagttttattgcattccatgtgactataacaatcagtaatgttctttttactctttaacaaaatcatgatgatgaagatacaaataaaaaggtggtcaaaagaaaaaagatcaatagtgcctcgtttttttttttcacaatagtatctcgtttatgaaattgattaaagcaaagcaagtaaaaagtattatcaattggaatataaaccaaattttttgtacataaaatgaatgatgtagtaatttatatacctgattatcttaactaaactcaattttttgcaaccaaaccagataaataagaacactataaaattaagatgttaattacacagacaataattttatttatttataaagtttatttttgtaacagctctgatacttattgattttgcaccttctttgatggtggtggcgaatcatacactcatcagcgaccatgatatgtaatccatcaacgagttctctctgaatcttctcgcctggaaccagttttccagagcataaacataagccttagaacaaaacaaacatctactatcccctgaactactaatgatagagtaatcaatgtaaactcttttcctattgtagaatttaccattagacaaattattatgcatgttgttagcatctctactcttgaaaaatcttcgtaagctgattggaaaatcaaagaataacaaactaactaactaacaatcactactctataagcaaatcttgaataccaatagagattctttatgttggattctatctttgagcatttcattaggatcgacggttggtcgattaatcaatactaacccaaacagtcttttaacatgcacacttgataccttgtaggtgcttctgggtagcatgaaaatgataattggtgttattctgatatgcgaaattgaaaatgttgttgtgcatcagctaagcataattgaaagtttaaaaaatattataaatttaacgtgaagaattgaaaggtatcagattaatgttttggatcagccgaatagagtcaggctaatccaaattctcaaatattttcgaaaccttaaacacatcaaactccacgaagtaaacacactcacacacatatcaaaatccacattataaatgtatttttggtaggctagtcgtctaattctaaaatagccaatttacatttgcaattgtttattcaaaaaagtacaacagtaagaggtcttatcaattaaatcataagaaaaatatgtcccaaaatgtcaaaaaaccaactacgaatatttcttttccttttaaggccaaaccaggttttggaatacttattacaaataaactcaatttcaataaattcttgtacacaaattaagcactaatttcattgtgaagataccatagtcacattcacatctatatgacatcaatctataaaatccaaaacaaactatatattatatttatattatttttttgtcatcattatatttccattaatttatctaattctggttctaatatactcttggtcagaaaaaatataaacattgaagaattggtcggctgaaaattgtgaaaaatatatagcagaaaaatatgataatgttatcataaacaaaattaatagtaaaatttaattttaatttaacactacagtactatacacgtgtgtatgtatagctctataagtatttactctctttcagctatttattttttcagtgaacgagcattcttcttcttcctctgtgttgttgcttcttagatatattcaaataaa

SEQ ID NO: 13380 - DNA, 3000 bp, Unknown
  misc_feature (1)..( 3000): cDNA_ID_2713612_gDNA_ID_2214623_Annot_ID_135911 3000 nt of promoter + ATG
ttaccaatcaatgatgggccaaatgtatattcaaattattgggtgcagacaaatttttttttagctaaaggcccaactacaccatagcaaatcagcaccattcgatctcagaccattcaaacactgtaataaaaacatttttagttttagttttatttttttgcaaaacacgtataacaggtaaattattattctcaataaaaaaacgtattataggtaaattattattatagccaacctaattatgttgtcaagtttgaaaataaaaataaaagagaggaatatattaaagaaaccctacaagtaaaaatcaaattttagtttcttgttttttttagacaaacaaaattagtttcttttttctgcatctgaaaatactttcctattttaagtagaggccaattaaagaatgtgggtccccgcgaataatatcggcgcaaattttttcgtcttttataaatgggccccacaagcgtgcctacatttgggcccattaaagaaaataatcgtactcgggggaacatgtctagaaactgataaatcgataaaagtaatacatactgacaaataatgaaggaaacaatataaatgaatagtagtatagttatagaaagaaatattttttaggttttaaattgacattatgattatacactcaatcgcattagacacactgtagtcacatcactattttgtacagttcgaaatagttaattgtctcgtggttctacaaaagcagttttatttataacattttcttttgttaattttgttttccgatcaaaatttttggattttacctacaaaataaaacatgaagcgaaatgaactcaaaagagtttattatctcattacaatatcatataattactctacctctaacaatattcacccatactaaaccattactatatattatgataaattcatcgtctaataacaacaattctaatacactaaacgaacacgaccaaacttattctatagtgattacattgcttcaacagtttccaccattccgaacaatttcatcatcctatcaaatcaaatcgataaagtcaaaccatgtcaaaaaatcatatatgaaaacaaattgaaataaagggatgtaataatggaagaaggtaatcgtgataggacgtgacacgaccccaccattgtgaagaatgaagaaaagcatacaaaagaagaacggttgttcaccaaatcagaagcaaaacagaatcaagatctataataagctagacagaatttcttctatacatgacttttttgatcaactaaagaagaagaaaaagaagatattacatagttcattatttttgtttgaaactgaggataatggtttaatgaactgtgaaatacatcactttttgaaaatgtcatccctaatttctatgacttaacaatccaattacaacaaatattgttaatcttgactgaccatatatatgttctttttactcatgacgttgatatcagtaaaatgtaaaacattaaacgttatataacagtaaaagttataacttatatcagcaaaagttatatcagcaatattttaccactgagctaacgttagtaaaacaaacacaacatccacttcataactcaggaacagtgaaatgaacgtgttttatatcctttttttaatcatttgtaacaactataatttgaagatgatcttagattatgtgcacatagctcattacacacatgattattaattccgaaaaattgattacttaatatttttttaaaatgatttcacaatattgttaataacatttaatcacgcaatcaaccattatatatatttaaatttcaattacgtttaaaaattgccgacattatttactattcacatgtgatattttcttattctagtttaatcttgtgtgagtcaaattataagattatttactaaatttgcttaaagcggaacagtaaaaataacagcatgatgtgataccataacctttagcattaaggtcccccatctaaccaaaccctaacaaaattcaaacacatgtacggagttagacaggaacatctctaatattaacgttgaaataataacaaaattgatacatttgttttttgaatttacgaagttagataacatagatcacccgaatacttgtttttttttttttttttttttttttttttgtgtgtgtgtgtcttttctagtagttaattactattgaaaccatccaagtagcggagtcacataaatttaatatagtatgcagattatgtaattgtgaccatatgatatatggcaaacatattactaatctaaatatatatacatatatatatatatatatatatatatatattattgcatggttataatatataacctaatgattgtgtattaatctcggggttgtgtatccatccgaaaaattcaaattttcataaaatgtgtgtttgttaaagagaaaattttttttagcacctttacatttctcaaggaggaaaaacactatccatccaacatttcttcttttgctttatttctttttccgttgactgtattgagtacaaattcgtcttcatcttctaaacctctccactactttttacttaactttttttttcttccaagtttattgtttattctcagttacattcactttagacacacaatccaccaacataaataggcagtgatataagttaatatcatagaaaacaatcagaaaataattcagaagagaaaacacaacaaaaaaaagaaagaaaaagaaagaaagaagaagagatgagtgagcttctctactctctccccacttgggatatccataaccttggatcactcttcaagcccgattttaatcttggtaatatatacattaatatatagacacaaacatattttgtgttttttcaatcgtaaaatattgatacatatacgcatatgtaatatatgaatcgacgcgcatgtatttatttacaagttattcaagaactttcttattaaagtgtaatatg

SEQ ID NO: 13381 - DNA, 3000 bp, Unknown
  misc_feature (1)..( 3000): cDNA_ID_2713604_gDNA_ID_2214623_Annot_ID_135913 3000 nt of promoter + ATG
ggcaattccataataagccaaccgttcgcagcattcgtttgctgcaccaaccaaagcatagatatcagtttttggagattaaagacagaacatgagagaatacaacaagtacattacaagtgaaataaaacaaagtgtttaccaaaaatgaatggacaagctttccagtttcctgttgtctgcttcaatggtgggtttccatgaatatctattgaaccatcttcagcatataattttacttcttcctggagaaaaacgaattagtcaacaaagatttagaccccaaaacactaaagaaacaatgacaatgaggttgaacctgtataagagattcttcaacttcaagaagtgacctttcttcatcaatggaagccattttttactttctcctcaacatgacaattttcacgtaaagctgatttaagcttctcaacgaaggatcaaataaaatgatcctcccactgaccaagttgttgttggtggtgtgagtggtcactcaccacagaaccacattctttaaaaaatgttataaaaaaaaagagggaatataaaaccacacaaactttattaatctgattagacttaagcattaagcaaattttgagccatagcacacttttcccctaacacaacaaaagttatcaaacaagttagagacttcaagttttaaagaagacatcaaacaaatcttacgaaacctttctagccaaaccggtaaattaacaaagccaagacagaccaaaagccaaaaatagtaatcaagatgaccgttactaaggttcattgtcgtgaaatatgcaacaagtgtaagaatcaatgagccgagtgaagagtccaagcactacacaaattttgcatctagagattgttcatagaaaaaatcaagccgactaagaaagaacaaaacgctagatgttcccaataaagatatattgagggatatgccaaaaaatgctcattggaacagtgttaccactatcaaccagatcgttggattactcttgtctctctcgaagtcgagaagttggtggcggtgaccactggaccataaaatgtgttcttgttaacaacacgttttaagaaattgcaaaattgagtggacctattgggctttaaatattagtgggtttcctaatttgtacttgttgggccaattttatgacctccacaacttggatataaaatatttggtaaggaattaagtaaataaatactattttattttttgaagcaccaaatgcaatttatggtgttaataaagttttatgataataattaattaatgcaaaataaaaatagttttggggtaaattgattttttttttttgggagaccaacagtcttcaacctcaaaaacgagaagctctagtaaatcatgatcgttttgtaatttattggtttaccaattgattttagtgatatagttttcgaaccgcttaaatgattaataaataaataaattaaattatggattggtgattttgtctctaaataaaaatgttgaatatgaaaggaatagttttgaattgtccttaataatttaacgttgaactattgaatagtcaataattcggtcgctaatagttgactagtacaaacaaaaccgaacagagcatgtattaattggccatttcaaaattcgtgttgcaataattaaggaaagtcagaactttagagaagtaaaccggtggcggttacccataattgccggttcggcgagtggcgtctcggtctccatttgccggttcccattgactaacgcgttagagagtgactgatgggtcgacttttgacttttactatttttcttcttttgtttcttactgccagttatgccccattccctgcctcttaattacgtatgagtgccactcacaaatatttttatttctgaaaatcatttgggggagacaaaaaaaaacaagatataacaaacctgttgttttacttttgttactgacaagtccttcagtcaaaaaataaaaacaagatagataaagaaaatgaaaactgtatttaataatatcctgaatagtcaaaatagaattgtctataaaatctgattttttaaaaaatataaacatatatgatgaagtattcttgtttcatgtatccattcgaaaatataagtaaatcctatgtacaattgaaaaaaaaaaaaaaaaggtaatctagaaacaatgctgatcaagctgtagtattcaacgtaattaacccaagctagggctagtggattctagttttcaacaaaattaacccaagctagggctattctaaagctagtctaaacatgtgggaggtttgataaatcgcctaactttatttgtttaattaggtcagaccatgggtttgatgtttatttgaatttttatactttagagatggtaatatgagatcttacaacaaaaagtcaatgtcctttagtggtgataccaatataagttcgaatttggtttctagcttattggtataaattccattgacagcaaaaaggaatcacgaaaacaatataatctagtactatattcacattttacgcgtaacgcgtttgtaatattcacataattatgtaagtgtgaaattgatcaaatcgcgggagatgctaaataaacaaaatcaaaatcactaataaaatgttcacgataacttagaaagatccaataaaaagatgacggtcggaatttgtatacgatagtaataaaagtattcgtgtttctaaaagttagtaattcattggtctaaatattataatgaggaaaagtcattggtaaggaaaaggtttgaaaaaggagcacataaataaggaccagcgatgcttcctttcacgatgcaaaacacgaaatgaagagacacattctctctactatatataccatttgctcctcttcctctaattccacacattcttcttcaactacaaaacaaaaacactactacacattctttcctcttgttcatttcaaacccaaaaatcaaagttcgaagttgaaagaagacatg

SEQ ID NO: 13382 - DNA, 3000 bp, Unknown
  misc_feature (1)..( 3000): cDNA_ID_2709779_gDNA_ID_2214623_Annot_ID_187726 3000 nt of promoter + ATG
accaaagtcaaatggattttcgtatgattactacttttgtaaccaaagtcaaatggattttcgtatgattactacaagcttgtaggtcaaaaaacacatgtcacctctctgtttagtataataaaccaattttataacatcattctttttatttgctagtttaatcgtctaaataagtgacccaaccataaaccatatcagattatgaaattttgactttacgatagtttacgtatcctcaaattcctcacgtatatgtcatgaacaattcttaaacaacaaaattataactctcttttaattaatgtagttttttcgtaagaactcaaattgatatttaacaaaaaaaatgaatgaaacatttctcaagttttaataattattttttggaattttgcaaaacatatatagagagataataataagtatgaatgaatccaaaaagagacaaaaagaatagatggaaaaagagacagtcatctttaagaaagaagccaaaaacaaaaacttgctcttttaatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgtaagtttattatactttttttctcttcaaatcttttgtgaaaaaaaccaaacttttgtgtgtttgtttgcttcaaacatcctaaagttacgatataactagaaaaattggacttttctcattcttttgtctcaatcatcgtaaaaaatcagtttttgaataaaatcttcacacttttgttactttgtttcattcttatcttcaaagtttggatttttatgctaaaaaaaaggtttgaagtttccttattgtgttgtttatcttcatcatcgtaatgaatcatctttgtcaagttaccgagtcaaaaccttcacgcttttgttgttttgtttcattcataaagtttgagtttttgttttttttcataaagaatcatcatagtcacctttttgatattttgttgggtttgatgaaacaggagcaacaccaaaacttgttcttaagatgatggatgtgaagggacttaccatttcacatgtcaaaagccaccttcaggtaaatagtaattaattttaccaaaaacatcaattttgttttcttctttattcatatttcattcataacaccttgttttgattgttttgaacatatatataaacagatgtatagaggaggttcaaagctcactttggagaaaccaggtattatttttttccttataattatgaaatgaatcaatgatgatatttggaaaaagaatgggaccgttgattttaatttgaactgttaacatcaaacacataataatggatggaatttaattattttactgtatctgtttgtagtatgtactattggtctagtgtcatgattcataagacaaatgtcataaatacatttatatatttttcaagagtaatagaacagaaaataagagaatattcattaactagtttttattgtttcttacacagaagaaagctcatcatcttcaataagaagaagacaagacagtgaagaagattattatcttcatgacaacttgtctttacacacaaggaatgattgtcttttgggttttcactcttttcctctttcttcacattcttcatttaggtatttatttttatttataattgttttctgacaaagttttttaattttatttcagtaaaaaaaaaaaaaaagtgttttgcttttttgtttgtctgtatttgaattgtccttttactttggtgcagaggaggaggaggaggaagaacaaaagagcagcagacttcagagtctggtggttatgatgatgatgctgactttcttcacatcaagaagatgaacgatacgacgacgtttttgtcacatcatttccccaaggtataaataaatttctcttttgtcaaccggtttggaaatttaatgttgcaaaacaaaatcaagtccggttatgagttctaaccggtctgattgagactggtcaaatccaaagggattgagtccggtttaagtactacttgtcattgaatctaattagtttcatataaatggcatttaaccggttttagtccggtttggtaactaattttgtcttttggttcattagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaacagagccaaacgcagtgttttgatctttgaaggataacccctaaacgcagcgtttctatatcaagatcctacggtttagaatgttcattgttattttggtcggcaatcctacggtagaaaaaataatctcgcagataaaacccattaaacgctgcgtttcatcgttggagggtaaactcattaaacgccgcgttttacattcaaaaaacttgaaactaccttataaccgcccagacgatgaccaacgtcgtcaacgtcggcgaag

SEQ ID NO: 13383 - DNA, 3000 bp, Unknown
  misc_feature (1)..( 3000): cDNA_ID_3029834_gDNA_ID_2214623_Annot_ID_187723 3000 nt of promoter + ATG
atgtttgggcctttgtgttgcaaactgaaatttatggccctctgttttggctttaggatatatttacaacataataaattacacaattccaattagagatttgttcttagttttgaggctttttgacttaaaatttgagccatgaataatctttcttcttttttcatcatagataatcatagatagagtatagaaatattatatttgatttttttgtgtgtgtttaaacctgaattatatttgatctaagactaactatttcaactgattatgagtccatcaagtgaaactacctataccacatacgacatttatggttttttttttaatcaaacaaaaaaaattattgtatattttggttaagagatatgaagtgaaatcacgtgtgagtaagaagaaagagacatgaaatcatatattaattaattattgtaaattttgcacaaaaaaaagaattaattatatataaatatatatatatatatatatatatatatgtgtgtggtatctacataattaattattcttcttgtgattgtaatattttgtaatatttttcactatatgtaaatatgtgtgagttattcgacatttatggttttatagtttccaaaggtatcaatatcactgtttggatattgaagctaaagtaaagagagaacgtaaacgaaagagtagagagaaactaactcagttaactaataaaaccaattgtacaagtagattgattaattcaagaaaacaactaatttgttaacaactccgtttaacaaactaacaaactcacaaaactaaaactaaaacaaatttgttaaattattatatatttttaacacttttatgtctttgtagtatatattattgaattttcttgtcaagtaaagtttttggatttgtttggataaaactgggagtttaggaaaatagagcaaatcagcaaaatgcatcaaatgaaaaaagattgaagatcacgaccgaccttgacaatcgtaagagtcagtacataagatgtccagaactgatcggttacatacttgtaccgatcattataaaaaatgtttcttagtttaggattccgactcattgcatataaattcttaacactttgtaatcgtataggcagattgttttgtttttttttctgtgattatctagtttttctatataaaattttataaacaaaatgatcgtttgaagaattagagcatatttgtcatttgttattttgactaatccatctccattcaaattgtccaattatgtttagtcaaatgagtttgaaaattttgcctaatttaatcatccaaatgagcaaaagaataaagccacacattacttactaataatattaaagcccacattaaaataatttctcacgtaaaaaacaaatacttacacaaacctatataatctagactctacttcacttgtttgccctaaaccatctatcatctctctttcaattcatctacaccttatttttatatttctcaaatacttttcgagaaaattatataccctttttaatatacgacgaatgaaatcgcaggaagataatcttctacttgttcttctactcgaggggataaaaaattacggacttaagagatgggataagatactagcatcacttcttctatcccagcgaagtatcgctaaatgtaaaaaaaaattctaatctttcgttaaacgaaaggtaaattattttctcgaaaaaatttgtgtatagaattaaaggttttctttagtcaatagctaatcaatcttatcatttattttctactagtttcttatttgcacaatacatttgagaaaattatgttatgttttcaagagttttgggtttttgtagagtattagataaaatcaatattttctctcttgagactagtttcttctttgcaccatacatttgtgttctttttcattttctcaaagctgtttgttttaccgaattttctcttgggttgtggagaatattttttttttttagtttttataacaccttatcttatataaaaacaaaagagtttgtttttacaagggatgatggatgatgaatctatagatggtcgtagtaccacactctctatggactcaagttgtggagaatctttttttttttagtttttataacaccttatttgatatagaaacaaatgattttgttcttacaagagatgatggatgatgaatctatagatggtcgtaccacattctctatgcaccctatgaatcaagttgtggaatcaatcaaagttggccacatatagttatgaaatgattttgtgataaaaacacaaattaatttctatgtgaatcacaaagaaaatatatatatatatatataattcccatttgaagtttaagcacagaccttagaaaaatatgtaaacaaagccgatgtctatagtccaataaaaacaaatttcgccgggaaaaggaatataaaaaatttgtcacatttaccaaaaaataataggagagtttatatagtttcaacgtacaattaatgatctaggttatcgagttttaatttccatttctcctaattttgctgacttgagctacatattattgagcattcttgttctttcagggtttatagagagattggctgataattactgtttgttatctgagtccccaaacgatttactgatatcaacaacgtattgatgatgtattgttttagaaacacatatatgtaaaaaaaaaattcttgattagagtgatatcaacaacttgagacatggacaggtaacaggttgatccacaattctatctttacgtcataataataacaaaaaattcgtaaaaagatgagttttgttaattacttctcttattataatcaaagttttgatttttattttccaataagtcgccgggaaaagtaaaataaaaagccgtcacgtctccgataaataatagagtatcgttagataggtagcttcaacgtaaggaatctaaattggttcagctcaaaaaacgaaaacg

SEQ ID NO: 13384 - DNA, 3000 bp, Unknown; identical to SEQ ID NO: 13381
  misc_feature (1)..( 3000): cDNA_ID_2713604_gDNA_ID_2214623_Annot_ID_187720 3000 nt of promoter + ATG

SEQ ID NO: 13385 - DNA, 3000 bp, Unknown
  misc_feature (1)..( 3000): cDNA_ID_3029858_gDNA_ID_2214623_Annot_ID_187716 3000 nt of promoter + ATG
caaataggcaaatcatcataatacatctgaaagtaataatctttttcaacagctcttcgaaagtgttcaacttcttctctactaagcttctttttacagtacacctctgagtctttctcatctctaaagttaagcttgtatggagcactaacaagcctatccccattcaaaacctcaccaagagcttccttcttatctttcacaccctctacacaaaccaaaacaaatgcatattgacaccaaaatacacaaatccgaaaaaagtgaaaaaccacacataacagagacaacattgagcgtgctcgtacctggaatacaaaaggggagatcgaaatagcgatacgtctcactgcaacaatcatcaaacacaagtaaaaatcagtcatataacaatgcaatcgaagatctatcacattttaagaacacgaatcgaattttttcaaggtcagatacaaaaattcaataccaacgcaagcttctacagaaatttgcaacgatcaatttatcactcatcaaagagaatcacagatctaagctaccgacaaaggaactgagattagagaattggatttacctgggattgtgaaaggggccgaccttgttggcgtagagaggaacggagtcaccgtccttgtaacggtggtcggaggcatcggatctgacagtaccggcgccggagaagatgagagctccgataaagaggagcagcgtcgttggtaatctcatgatgatgtgtgttaatgtgagaggaagaagaaaatcgtgagatctgagtttgctttatatttttgagagcaacgcttatggcaaaaggacgattatattacttttatttattttatctctctttttaacgaattttcttctactaaatgcttaagaaaaaatattgcgaataaaaagcattatgtaagaaaataaaatctgcgacattttaatattttttttagaaattgaaatgattatttttatatattttatttttggttgttttcttaaatcttctaaacaaaattcgtattaattcacaaaattttaaattatttaatacgtttcgtaagaaacttgtgaatggcagaggcaagtgatataaactgaagcaaataaaactttctataatcgatattttttgttacaattgtcgttttttttttaataagtagcaattttctattggtagagtgattctctcgttcttgtgctttctactatttataggagttttattgcattccatgtgactataacaatcagtaatgttctttttactctttaacaaaatcatgatgatgaagatacaaataaaaaggtggtcaaaagaaaaaagatcaatagtgcctcgtttttttttttcacaatagtatctcgtttatgaaattgattaaagcaaagcaagtaaaaagtattatcaattggaatataaaccaaattttttgtacataaaatgaatgatgtagtaatttatatacctgattatcttaactaaactcaattttttgcaaccaaaccagataaataagaacactataaaattaagatgttaattacacagacaataattttatttatttataaagtttatttttgtaacagctctgatacttattgattttgcaccttctttgatggtggtggcgaatcatacactcatcagcgaccatgatatgtaatccatcaacgagttctctctgaatcttctcgcctggaaccagttttccagagcataaacataagccttagaacaaaacaaacatctactatcccctgaactactaatgatagagtaatcaatgtaaactcttttcctattgtagaatttaccattagacaaattattatgcatgttgttagcatctctactcttgaaaaatcttcgtaagctgattggaaaatcaaagaataacaaactaactaactaacaatcactactctataagcaaatcttgaataccaatagagattctttatgttggattctatctttgagcatttcattaggatcgacggttggtcgattaatcaatactaacccaaacagtcttttaacatgcacacttgataccttgtaggtgcttctgggtagcatgaaaatgataattggtgttattctgatatgcgaaattgaaaatgttgttgtgcatcagctaagcataattgaaagtttaaaaaatattataaatttaacgtgaagaattgaaaggtatcagattaatgttttggatcagccgaatagagtcaggctaatccaaattctcaaatattttcgaaaccttaaacacatcaaactccacgaagtaaacacactcacacacatatcaaaatccacattataaatgtatttttggtaggctagtcgtctaattctaaaatagccaatttacatttgcaattgtttattcaaaaaagtacaacagtaagaggtcttatcaattaaatcataagaaaaatatgtcccaaaatgtcaaaaaaccaactacgaatatttcttttccttttaaggccaaaccaggttttggaatacttattacaaataaactcaatttcaataaattcttgtacacaaattaagcactaatttcattgtgaagataccatagtcacattcacatctatatgacatcaatctataaaatccaaaacaaactatatattatatttatattatttttttgtcatcattatatttccattaatttatctaattctggttctaatatactcttggtcagaaaaaatataaacattgaagaattggtcggctgaaaattgtgaaaaatatatagcagaaaaatatgataatgttatcataaacaaaattaatagtaaaatttaattttaatttaacactacagtactatacacgtgtgtatgtatagctctataagtatttactctctttcagctatttattttttcagtgaacgagcattcttcttcttcctctgtgttgttgcttcttagatatattcaaataaaatgacgactgtaatcgacgcgacg

SEQ ID NO: 13386 - DNA, 3000 bp, Unknown; identical to SEQ ID NO: 13378
  misc_feature (1)..( 3000): cDNA_ID_2702834_gDNA_ID_2214623_Annot_ID_187715 3000 nt of promoter + ATG

SEQ ID NO: 13387 - DNA, 3000 bp, Unknown; identical to SEQ ID NO: 13383
  misc_feature (1)..( 3000): cDNA_ID_3029834_gDNA_ID_2214623_Annot_ID_135916 3000 nt of promoter + ATG

SEQ ID NO: 13388 - DNA, 3000 bp, Unknown
  misc_feature (1)..( 3000): cDNA_ID_2709779_gDNA_ID_2214623_Annot_ID_135918 3000 nt of promoter + ATG
tccaatccttaaggatgaaaagtcaagagttgtttggtcctacttccaataattatgcactcacactactctaaaccttttcacataaccatgcaatgtctatatctatccatgtgtacattgttgtatattatattctctgtcttgtaatttatatattagttgtgtaatttttttggtggcccaaccattcccaaatcaaacttttaaacaactctctttcacttttgtttaatgttattttaggtgtgaaaaggctaattcttctctgttctctctaggtgtttcatggattacaccttttatattactttaaccatcttagaatttgccttgttcttgcatgtgctatgattgaattcaatcaatgggtgatgagaaaattgacccaatagaataataaattaacattgataatcgtcgaatggttcggtgagatttgcacatccaaattttccacacacaaaaaagaatgttatgttttttatagtccaaaatccagttgggttacattatcttacatgtatgtacaaagttttataatattaataaaaaaacaagcaaagagaattattgaatgttttgattgtggtaaaagccatgaatcatggacctccacagtcaattactcattcaatttctcttggagctatttgtctctgccagactcatttaatgtattattttcatttgcttccactttctctcatacatgtattagtactaaccattttgatttttgagacttgaactctcggttagacattttatccatccatgcaattgtgtttatcgatcaatgatcatcagtaggataataaaaggctttattagtgaatatagtaaaattgtttcactgataaaaccttttggaatgtgtttacttgattattttgatcaatgatcataacctaggtagctttttgtattattcttctagtcaatatataggtaatataagcaactcgtgtgtctttgacaagctggtgactgaatattatattttaattaccgtctaatcaaacactaaaccatttttaaaatcgttaaagcgaattttggcatatatgcagagaattccacgtttttataataatttagagaatgtgcataaatgagaagaaaatgcaaagcacaataggctacattttaaaggtcaatgacctcactttgtgtgtagattttattatttgattgtttttttcgttgggtatagaaatgtctgatttatgtgtggaataaagacgacgactttgttaaattataaattattaaattttgttctcttaattaatactcaatcggctttttcttatttttttattattatggctgataccacgtaaaccacgagtaagtatgtagtacaaatcaattactttctaatactacataaaaattatatactagtacttaatttcttacaagaaatacatacatcatttaaaaacagtatttgatgttaatataagtagttaatagtagaatagctgataaaataacgtgatttatgtccacaattcgttgattaaaatattgaatccatggttggaaaaaactggcgaaatcagtaattattgtcggctaccatatagggacatgatggttttggttcgtcttccatgtacaccaaatcagcaatgagaaaaagaaaaatggggaaaataaataattcttgttataaatattatcctaagatttattatcacttattatgggagtgaaaaagaaaacaataagaaggaaaatgaatgggaaatgggagaaaatgtaaaggaattaggggaatgaagtcaaaacggtggtccaaaagacataacgaaggaccattgtaaaattgtgtgatttatttgaaatcagaaagtttaacacgaaaccctaaaaaaacaaaacaaaaaacaaaaataggaataataattatgctatatggtcaaagctaagcagttgggctattttcatttaaatttattcgttttggtctaaaacctatcgtgaaaaaagtgagaaagtaaagtttgaggtactgtggaggaaacttcttcatttgggtaaatcccaaatccctataaggtaaatattatgtgttcttacaaaatttggtttttctatgacaagtatattcttttgaccagctaagctaacaaatgtatgttcaattggttatatatcgatcggggcaagggtaatactcgaatctatgttcttttcatgcaagttatgtatgtagccttgtgtagttctctggtacgttgatatgcaatgattctctcgaaaactatttaaaaaaattatttaagataataatgaatggggtcacgagtcaagactaatgtaaccaaagtcaaatggattttcgtatgattactacttttgtaaccaaagtcaaatggattttcgtatgattactacaagcttgtaggtcaaaaaacacatgtcacctctctgtttagtataataaaccaattttataacatcattctttttatttgctagtttaatcgtctaaataagtgacccaaccataaaccatatcagattatgaaattttgactttacgatagtttacgtatcctcaaattcctcacgtatatgtcatgaacaattcttaaacaacaaaattataactctcttttaattaatgtagttttttcgtaagaactcaaattgatatttaacaaaaaaaatgaatgaaacatttctcaagttttaataattattttttggaattttgcaaaacatatatagagagataataataagtatgaatgaatccaaaaagagacaaaaagaatagatggaaaaagagacagtcatctttaagaaagaagccaaaaacaaaaacttgctcttttaatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgat

SEQ ID NO: 13389 - DNA, 3000 bp, Unknown
  misc_feature (1)..( 3000): cDNA_ID_2713631_gDNA_ID_2214624_Annot_ID_135920 3000 nt of promoter + ATG
agaagaggaagatgacgtaaacgtagtgctctttgggctttgctctgaatctgtaatcagcgagaacgatattccagaatctgcagttatactggagggattgctcaagtgccagagattggaaacgaagcaaagcatcatagacgctacaaagaagctgaaatgctggaaataaaaacattctttattatttcgttttaaaaagacgtgtgagatatatttctgttataagttaagattgaaatttttgagactatattatatacaatacacctagtttcgtccatacgcaaatggaaaatgaagcgtggagtttttttcataacctttatgattgttagacctaccaacttattgaagcattcaatttggatgatagtgaagttggaatgtaagttaaacatcaatgtcttgattaattttgtgcatttttgggaactatccgtattgtttctgatttgagtgatcttccttattgttgctaagaaatgctcgaatggtgattagcataattgctgtttattcattggagctataataattatggttgtaatattgtaatttgggaaagaaagcctttgatacaggccgattttggtacgtacgtaagagagatataaattgaaacacctaaaccaaaatctggtcgccgcgaagacaaaagaaaaacatttgtggcaaagaaacaaattcagaaaccgcgtgggtccgatatggaacgctgatcaattggacatttgtaaacatttcaaatattttgcatgtaatcaatattgttgttatattttttgccttttagttatagttaggtttgttttttctgtttgtttggttagattcaactatttgtttatgcttttcaattttgggttagtatttagctgtttactttggagaaacaaaagaagatagattctgttccatataaacaaaaagctgtgtcgttgaaacttgaaaatgtgaatatactcggatatcaaccaaagggtacgctgcattaaccaacctccctcgtagaaaatttcaaagaaaggataacaaaacaagaaaaagcacaaagttgaaaaagaagtgacagatgcagaagaattggtcaaaatcattttgacaaaactacataaaaaacaatcaaatgtcactttcaaaattattagcttatttattattttattatgaaaataatgaaagcgacttctatctgggactggtaaaaggacctctctcaccattggttgtacattagctgtcaaatttttacatttccattacattccctaactccaaatatatacactaaactaaattcttcaagttacttcctaattactactatagtaattatttcctaaccgtcaaatagtactgaataacacatataatatagtttcgattgattaagagatttgaattaaacagaataaagttttacgattatatattctaacaatttatttgtctcacaaaaaaatctatagatttaatgagaattaaatgaagaggacgaaaggaaaaacaaaatgaagaaaaagacatatgaaacgtagtcccctcttttctttgctttcttctctacataaaactaaaactcctctctttcacgaccctttaagtaacgacgccgttttcatccaaacacaaacctctggaatcgtgtcaccgttggagctccggcttcattaatggctttcttcaagacctgaagacaaaagaaagtaaaaatatatatacactagagagaccaagatcctcgtttatgggtttcatcgtgtcttgtgcttagggtgacataaatacccatttagagagcttagaccaagaagttttagagtttgtgaagttacttgttggttagtctgctgtttctggcaaatgctgagtctcttctctctgtaagttcttttttcttcatttactctgttttgttccccatttttggtctttttgacttaacttagagtattttaaggcaaaataaaatcatgaatcttttggtattttttgttctcatcttcttgtggggtttttctattgaagtttgcttagctttgaatcttgtctaatggagctaactcgatccaaaataaaaacacgtataatgattaactagttctgctcattagatgaactaaattaatgagttaattccgtagtttcatgcatcctacaatgtattgtctatgtatggaagcaaagtatgatatcatatttaaacatctatgattgtgctactaaactttaaataatactttaagctgatgtgatcttatatggataacctctgaccattatctactttctttgaccattgctcttgttttctaatccaaaagtcgtatcttccaatgcattagttggtccaaacctagatttgcatcccttaatttgtagtagttaacatctaattttgatgttaaaaccaagacaccactttgtttgtctggtctgagaatatctcaaggcgtatagttttgtccttatgacgcttgcaaaagcaagttgttgagttgtaatcttatgtttttttctgcaacttgccttggatgaagccatgagattatctttataaatggtagcaagtaaaccggtttcttatgtcgaaaaaccgatcatttttgttttgtttgatgacaaggaatggaatactctagagactcggcagagatgatgatggagactaagcgcaatgtctactcgcttgaagataacaaaattaaacgacacaagtcatctgatctctctttctcttccaaggtcttgtgatacatcaaaatcaaaattcattgtggctatgaagctaccggacatttctgtaccagcatgctaatgatcttgaaactttgttgttctgtggtttaaacaggagaggaaagacaaattagcagaacgtatttcagctcttcaacaactagtttccccttacggaaaggtactacttggtccgaaataatctttcttacacgctctttgtcttctctagccatgttcaagtctctatctatg

SEQ ID NO: 13390 - DNA, 3000 bp, Unknown
  misc_feature (1)..( 3000): cDNA_ID_2713627_gDNA_ID_2214624_Annot_ID_135921 3000 nt of promoter + ATG
ataattaagaaaaatacaataaacaacaaaactctaaagttgagaattacctcgacttcgagttcgtcgaaagagttaaccaagaagaagtcaatgtcgtcaacattcacgaactggctactaatgagctcaaacaacggccggcagagattgttatcgtacagaaacaccggtaagtcattacccttcagcggaggcattgcaggcaaaacgacatcattttgaaactccttaaactctccacgcaagaaatgaatataggtcgcgttcacggtggaggactgagtgaaaaacgacgccgcagcaacgccaggatgtttccggcaaacgtcgaggacataaggcaggcacgagtcgtaaacgacggcgtttggttttgggtccatcgaggagataagctctgagaggcttcgagatacgttttcttggaactttgcgaagtagtcgggagatgtgtccgtagatgggtgatcttcctcgaatccatcgtcaatggggacaaaagagagaggaagagcagtggctccgccggtgatggcacggcggaggatggagttgtgggtggaggaagtggtgaggaatgtgacgttgacgtttttagagagtaggcgttttgagaattggaggagagggtttatgtgaccttgtatcggaaatgagaagactaacacatttgctttcgctttctctcccattgtttttctcttctttttgttgaaatttgttacatacaaactcttactctgttatgacggaagtatttatcggatatatgcaagtatgcaacgtagaaaatagtagttataggcaactttaatataaaagatttgtttctatatgtctctttaccaaatagaaaagttaaaaggggttggtgggttagtgatttggttaattataaggtattcatacaaatggcctaaggatcgtaaattcttaaaattagtggtggatactattttagatatagggttcaatatatccgccagctagattcctcctcctcgatgggttatttttgttttttatcaagcagatgtcgactaaagaaaccatttatcacttatcagagtacataaaattaaaataagctaagatttggatttatgctattggatgagtttgtcaatatattataccatctattgcatatatcttctaaagtttatcttaccattaaatatatttttagaatcgttggaaggaaactttctttttaattatatatatagatgatgttttgactatatgttatatcttaagacactcacgaggataaataatggtttagcaacatccatccttagacttgtattttcaaatggtaccttgttttcgaagcatctggaaaatgaattaaaataaaataaaattaatcatagtcttttcatggtaatatatgtccttctctcgtaacgtttagagatttattacattaagaaccaacatttttaagttccaaacattcttgacgggataaataaagtaagacaatcgtgtggctcagacccatgtaagtaatcatctttcacaagaaactaaagaaagaagagaagtattttggatgtgagtttggtttgtgaaggtatatatatcaatgtcatgccatgtgccgtatgctttttgtattcgttaggtttgctctatatatcaatacaatgactctgacaacaaaacagtgactgcccacaatgtatgtccatccaaatgaatgtgcaatttaataatgacttaacgagttacaaaaataaaactaaaaaatgcaaaaagaaattaggtaacactttttttattttttttaccaaaatgtagatggaagttcgggtgatttccgtattgcatgccaagtctgcacgtccaaactacgaaaaatgacatatcgtttttttttgttttttattttgttttttcatcgtctagatacctgagtttcattagcatttagaggatgctatgcatatatcggtatcaataatatggtcttcaaaatgaaattctctatgttaaatcatttatgatgtatccttttagttacgtcataaccaatgtgattcgtttttcgtctccgattaaacacatatatttttcgaagttttcaaataaaatcttttgacattaaatattcgaggtgaaatgtgacaataatcttttcaaataggttaacttttgtcttttatacatttttaacgtatttagatataaggatcgagagttgtataatgtgacaataatttaccataactttaaatatacattcggagtaatgattgatgatatgttgtttatatcgaaaacaaaagagacttgacttgatatacctgttcatatattcttgtcatcttcggagaagagagacactgccatcaaattatagctattgatgtcattgcttatgtaagcatgaaaccccaattgcaaaagtgagaataactaaaaactaaaaacctttcaattcaacttttggtttatctaatggtaggtgccaagtttttcttgaaaaatgaacaatttagcatccatatatttgatggcagtgtctctatccattatgacaaaaaatgtatccatatattatataaaacaaaaattctgatataaataaattcactttcgatttacttaaaaaatttatgattctagatagccgattataaatttttgtttagtcaaaaaaaaagaaagtttaaaccgattatgagaattcatgatttatcaatcaaaacacatatgtatgaggcccaaatattttatcttcaacattctgacccaatttaagcccacagcagactctgactcgatggttttggttagctttccggttcggtttggtttaattgattagtttcgattcgactttgaaccaaatttaaaccgtactccgacttcagcatccaccacctccaagtcttcgtcagtcgtcaccgtgtggtaagtgtaaatccttaagtctggaaaattagggtttttgggacttgggtgtgtttccatagcagagatatg

SEQ ID NO: 13391 - DNA, 3000 bp, Unknown
  misc_feature (1)..( 3000): cDNA_ID_2702865_gDNA_ID_2214624_Annot_ID_135925 3000 nt of promoter + ATG
tgtagaagatgggaagaagattaaatggtgtccatcaccgggatgcggatacgcggttgaattcggtggaagtgaaagtagtagttacgatgtttcttgtttgtgttcgtataggttttgctggaattgcagtgaagatgctcacagtcctgtggattgtgacacggtttcaaaatggatattcaagaaccaggatgagtcggagaacaagaattggatgcttgcgaattcaaagccttgtcctgaatgcaagcgtcctatcgagaagaacgatggatgtaaccatatgacatgttcagctccgtgtggacatgagttttgttggatttgtcttaaagcatatcgtcgtcacagcggtgcttgcaataggtttgttgtggagcaggcagaaagtaagagagcattgcttcagagtgaaatcaaaagatacacgcattattatgtaagatgggcagaaaatcaatcgtcgaggctaaaggctatgagagatctggagaagttgcaatcggtgcagcttaaggagcttagtgacaatcagtgcacgtctgaaactcagcttcaattcaccgtagatgcatggcttcaggtcagtaaaagtatttaaataactctttgattatactaacattacgaaactgtatatatatagcaagcaccgtagaaattagtaaaaacgatttcatgattcaactaaagttgtaatttatcaaaagtcgaacttagagtttcatcggtaaatcaccatgatgcgaataaccaatgaatttccaattttgacgtttgataaattagaacattgttgttgaacatttattgacatgtgattgattttactgtggtagatcatcgaatgtaggagagtcttgaaatggacatatgcatatggatactaccttcaagatctccccaagcggaaattttttgagtatttgcaaggttagttttcgttaaggaaacacttaaatatgtacgttgtgatcataatttgtccattgtagctaattaaatttttgttgtcaggggaggctgaatcaggtttggagaggcttcatcattgtgcagagaatgagttgaaacaatttttcattaaaagtgaagatccatccgatactttcaatgctttccggatgaaattaactggtttgactacagtaaccaaaacctacttcgaaaatctggtgaaagctttggagaatggtctggttgatgtgacacataatgaattccccccagataatgagaccaaatcaacacaagaaaaatacgaagaatatcaagattacgaagacgattttctcgaaacacaaaggctatatgatgaagctcttttaagtggctgctactacgattgagatctctctcagcctcaatttaatcccttcgttttgctagcaatttggatattttttttttctttttatcaaagcaatttggattttttttttgatacttgacttttgaattttgattacttgctctcgcctagtacaatttgcaatggatagacatgtacttcacaatccttgaaaccgatattagaggccacccacgtcgtcacgacttggcggcaaactatacccatggaaaaatttacaatttaaaaaaggaaaaaacattgaacttggttccgtataagaaatatatgcagcgggatcaaatgttcatgcttttgtatttgtcaattccttagatttggttttaaaacctataattttttttgttaatgtaatgtttctaaacacgatgaacacaactaatccaaatagtgttaaatattttttcttaagtataacaactaatccaacgctaaagtcaagtttacttgttcgaccgcagatctcgattagagcatatgcaatggaagaggtttgcaaagtctctcaaattatattattttaagacacatatttttttttttttgttaaatttgaagtaataaaaaaagaatcaaaccaattatatgtcgacatgggtaaaagagtctctcaagaggttctcatttgaaatcccatgctcatctctctctctcttactttctattttttttttttttttattatccataaccattgttagaactccacattgcacatgctcttagaaactgttaattatttatttaaaatatgggaaatatttttgaaaaaattagaaagaaatttttgaagatttactttttttttggtaagttgggaagatttacttctatataaaaaaataaatataaatatttcaaataaagaaaataatgagaaaatacattaaatgtagattttgtttgttataaagatagtagtaaatatgacttataatgattatttctttatccttaatgtactattttattttttattttaaaactaatagcatttgatgtaatattaaggatagtttaatgttcttcagctagtttaatgactatttttaatttaaaaactaatattaacaacatttgatgttagttctatatatatatatatatatttggatttgttttttttgaaaagttatttttggatatataaatcttcaaccgaaaaaaaaaattccctcaacaaactttagaaccaatattatatatttggcctaaaatccaagagaaaactgagaaacaaaatttgatgaatttttttacacccgaaaatgtgaaatagatatgatacaaataaaacatgtggggcccagagaaactttaattttcgtaattgttatacttaacactagctgaagaacgttccggtgttccgagatggaaacacgtggaaaatgcttattggctataattttgagttatcctctcttatgttgttttagcaccaaggatatcctaatgataaccctaatatctgagcgatgattagaagagagcttctacaagtataaataaaataacgatcgagatcttgttagagcaaagccctagtttaccaatgagacttggcttcatttgcctcctttaaatctcaaagtcgtttaaggttttttttttttcagacggtc

SEQ ID NO: 13392 - DNA, 3000 bp, Unknown
  misc_feature (1)..( 3000): cDNA_ID_2702869_gDNA_ID_2214624_Annot_ID_135926 3000 nt of promoter + ATG
acgacatcatcgatatcgaatcaggagaggaggatttgtacagcgatggtggtaacgtatccgatgactacaaccctgtggacgacacaattagtcgatctgagaaaagttacgttgttgttaaggaagaagacattcttaagcttcaaagagacgatatcgaacaagtttcgacggttctctctgtaagccaagtggaatcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagggtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatacgcggttgaatttggtgtaaatggaagtagtagttacgatgtttcttgtttgtgttcgtataagttttgctggaattgctgtgaagacgctcactctcctgtggattgtgaaacagtgtcaaagtggttactaaagaacaaggatgagtcggagaacatgaattggatacttgctaagacaaagccttgtcctaaatgcaagcgtcctattgagaagaacactggatgtaaccatatgtcatgctcagctccatgtagacattatttttgttgggcatgccttcaaccattgagcgatcacaaggcttgcaacgcgtttaaagcagacaatgaggatgaaactaagagaaaaagggctaaagatgcgatcgatagatacacgcatttttatgaaagatgggcattcaatcaatcctcgaggcttaaagctatgagtgatttggagaaatggcaatcggtggagcttaagcagcttagtgacattcagagcacaccagaaactcagctcagtttcaccgtagatgcatggcttcaggttagtaaaagtaacatttacaagaccattgaaaatgtttgtggaaacgacggaacataatggaattactaccatagtagatatataataaacgacaagctttcttgaagacgattttatgagtaacttatcattgatctgaactgatgaatagatagattacaaaaaaagtgtgtataattttcaaactggcaaaaatcatcccaccattatgctagccaccaatgagattctaagttagattttgttacttacattgtaacagcggaacataatctgtagtagaaaaaactagaaaagctttattaaattgaaaaatcatcttaatgacggttaactttccgaaatggtgaaaccattccaccattatgcatgagaactaccaattagactctaagttagttacggcattaattatattctcattccaccattatgcatgagaactaccaattagactctaagttagttacgacattatattaattcttgttgacatgtacttgattttactgttacagatcatcgagtgtaggagggtcttgaaatggacctatgcatatggatactacatacttagtcaagagcgcaacaagcgagtatttgcaaggtcagtttttggtacggaaacacttaatttgtgtgtaatcttaatttttccattaattgtagcagaactttttcgttgtcttgttgttcagctgaggcagaaaatggtttggagagacttcatcattgtgcagaggaggagttgaaacagtttatcgggaaaattgaagacccatcaaaaaatttcggtgagctccgagcgaaattaattgatttgactaaagcaactaaaacctacttcgaaaatctggtgaaagctttggagaacggtcttgttgacgtggcatataatgagagccagtcaatagaagaacctgaatcttttaccaaaaggtccaagacaaggaaaataaaaactttaatttagagttttagtaacttcaatattttctatggtttatgtgtttgctgcgaaggactgtagatttttttatgcctttttttttaaccttagacctcaaagttttatttatttacaattaaggatttgcgactttgctgcttggttgctttatatttcatagtgcaattttggtgaccataatttgtatttattgtctgaaaacttctctagattaagagctaatgtaatatccattcaaacatcggatgaaacctctcctaacatgacaaagattaaaaataaattacatgaattgtgagaactcaagcatctataattctattttcgttgagctcatctatacaactctttctgaagtccaacaaattctaaaataacatgaaaaagtatgatccacaaaaaaagaaagataacataatgaaatcaaaatttttatcggacccacccacctaatctcctcccttcatggcttcatctacccgccacgtttattatatggcatagtaagaatctttttttttttaccatcacaatgtcttaatcgtcatagattgctctctacacatttcatagaaatcaatcctgaaatactctcacgcattgcatacaaacttattcacaaaaaggaagcatcaatttataatgaatcattccttcaaatttaaaaccaaattaacagaagaagagaagaagaagacgaaaaagaagaattgacaagtattctaaaaattataataacttttatccaacatcgtaaataatgagacatgtatataacactatattcacttaacttacataggagacacaatatcaacaacttattgttcctttggttcgaacaattttaccaaaaaa

SEQ ID NO: 13393 - DNA, 3000 bp, Unknown
  misc_feature (1)..( 3000): cDNA_ID_2702873_gDNA_ID_2214624_Annot_ID_135927 3000 nt of promoter + ATG
attgattatgccagacggcttgaatggaaaaacaagtgtaactcgtgtaatgcaaaccacaatctgaatttttcatattgctttttagcaaattcatggcacgaagttagatatatagcaaagaactctcttacatcttcgtcagtgagaagtccccagtgagcgtcgagaatacgatgtaccttggggtcaaaaaatggctcaacgggataaacatctccctacatttaaaaagataagataacttttaaaaattagcaaactcggaaatccttcagtgcagccagggagaaaaacaaaaaagggcatgcttcaaatgttgattccaggcagccaccacatagagggaaaaaaacacaggcatctatagttctgtttaactttatcaaatagccaaacctactataatttatgcaaccaaattttttgaaaggaaagtgaggaacttcaagctgaagttaaacaatctaaggagcagagaagcacacacccctgctgatgtttccttttgagggacaatggctccttttttgctacttcgaagaacactaacaggcgcttgctccttgagatctggataggatgctgctgaaaatcgccaaaatggagcagttgcacccatcttttcccttctcagtgctatctgttatccaaaaatgtcattccattttccctaaattagtgaaagtccctgagatctatgcctttgtgtccactcaaagatgtaactactacatacatacattagatagcacaaactagatgatattcaaaagccataaaatctagtaattccaaacatacactacctttcctgtccttacaatctctctgatctgaaactttttcaaatttctttctacagcaatcatttttccaggatctccagttacctgcaaaatagcttaaaaatgattactaaagagctaaaataggtaaatcagagacacccttttttttactccactttctcataatcaaggtaaaaagaacaatatatttaaggttatgcttctctaactttcaaaagtgaacactgagcattcccacagaaatttgcacaggcaatacaactcagaatacagattataagcatagggtaatcaaaggtagcacactgttgaataactttctcgttatattaaattcaagaagttgcaccaaaagtttcaaataaactttaatacacatcctataatagagtcctgcatgtggatcatcatcagtttcaaaaggcaacgaaaatccaactaatagatataaaagttaaaatgataccctccataatatttctgatgtcttccaacgattagtaagatgttcaaacagaagtctgaaacccacaggctacagtgcgaaacaaatatcaagaccaacacaaatcataataagtagatgtacctcgatagtcaatgcatgttccgctatatctacaactcttgctctgaatgtgtcaactagccacatgatctgtgaattcattaaaacagaagcttaatcaaatttagagagaaaactaacaccacctctgccctaaatcagaagcaaccagcaagtacagtaaactctaatttcccataggcaaggaatagtacctctgccctggattctggatgtgcattcacttttacaagcatcagctcacgctccacttgcggctcacttgagatatcttcaacctaattcatgtccaagtcaatgaagagaatggaaaaggaaatcgcaaatgtaatcttcaaataatgaataagcaaattggctgatgcgtaaagttggtgcgaatgaaactatagtcatgcagaaactaataagtgcgatctaacaaaagaacaacctttagaacattaacgagcttctggagttgctcgatgacctgctgaagtaccctttcagttccacagacaactatggtgaatagagccttgtctctgttcagaccaacagcaagactctcaatattgtatcctctccttgcaaacactcctgcaatcctattaatcattccgctttcgtctccaacaaatactgaaattgtgtgcttcctcaccctgattttaatgcacaaagaatcaatcaaagcaaaggccaaaaggaaacgactttaagcaaatattattcacagtacttcgattttggagtcgcagatgaagcttcggagaaagacgcatcagagatcttcccatcgacgcttctaacgaatccttccattctcttacccatttcatcgccacggtgcgaagatataccggagagatatgaaatcttcgccgggaacgatacacgcgtcgaggatacaagagcaggagaagaatcggaacatgccgatctcaagcagcgaatagatggtgaagaacttacagaaatggccgccattgacgagacgaagccgaaggttttttgctactgaagaagactgacgacgacgaaacggcaagtgaaaaagaacgtatatatgttggttagaccggtcaaaccgtccggtccggttcggttgttgacgaccttagaaatcaatggctttaagaaaagcccaaaaggcttcgagtagataagaccaacacgtcagctccacgtataacaaccttttcgagtcaactattttcctaattttgctaaaaagtatcttgggttcgtcggaactaattgtaattatgagaagtttagggtaaaattcataatttaggaaaagaaaatgattttaaatccggtaaagccaccgaaaaaagtggacaatcaagaagagtccatatttacgcgggactcgccaaataatgattgaaaggaaaagtcaaatcaaagtcaatcggaaacagacgtcgccaataatatcttcacccgtcaaattaaaattaattatttctcgataagcaacgcgctagagacggatctcacataatcaccagatcaattttctcgagaaaaagaaaatgtgattatccattcgattttttcgcagaagaagacgaaagagagaagaagagaaagagatttgaaatcatg

SEQ ID NO: 13394 - DNA, 3000 bp, Unknown
  misc_feature (1)..( 3000): cDNA_ID_3029896_gDNA_ID_2214624_Annot_ID_187754 3000 nt of promoter + ATG
ttcagcaatacaaataatgcggcttcaagacgtaacagatcatcccatgctacactatttgggagattggttcaagtaagcttggtaaagtgaacctccgattaatccattttttaagagcctcagtaatagttggtaacaacattgtagggaatgcaaccatcttcagtgggattggaaacatccagcggttacagtgggatggctggaataccaaatgaccaacagatggtcgaagctaaatatccggctttactattcaagcaacacttagcagcatacgttgagaaaacatatggaatgatccgagacaaattaaagaaagagataaatccattactaaatctctgtatccatgttagtacatcattcatcaagttaatatggaactcatcttaaagttttgctaatcgcgtatgttaataatgtgttatatgtgagatgtaacaggcaccaagaccaacaagagccaaaaccttgcgagatgtgactaaaagcatccacttgaccacaattgccaagcaacaagcatcatatgtacagtggcagaacattgtcaacaagcttgaacataccttgacttttatggcagagaaccatgtaaaacaatgcactttcgaagatttccagctcaagcttaaatttgtcttttcctgtttcttgactgagccttaatgatctccaggtcccatctatgatcacaagaaaactcttccatcaggttttctcgtacatcaatgtgcagctctttaataggtacaaaaatatatcgcataggacacaagtacctatgtttggttatgacgtagcttgacttgtaaagtttatcttctggcagtttgttgcttcgccgagagtgttgttcagttagcaatggagaatacctaaaaatgggcttgcatgaattagagcaatggtgcctgaaggcagatgacgaggtaggctataaagcattaataaccaaatcatgcaaagatgaaaaataagacaaaagagattaacttacataattctgttcttttttgtctcctacaggcaacacgatcaccatgggatgaacttcaacacataaggcaagcagtgatgtttctggtatagcatcgaaccatatctgttggttaaagtacaaaactagtgaacaaaattcgatatttgatatacactatcactctacaggtctcacatcaaaagacacagaaatcattggacgaaatcgcaaaagagatatgcccggtaaagaccttaaaccaaaaatttctgcagagcatatagaaggatcttaatatgacacaattatctattagtggttactcctgaaacactatacagttggatacatgagcaaacgggtgaaagatcttatgaaagtaaaagcatctagagaatgacaagatggcataactaaaccatcctacatttctacttccagtcactgtcccctgatttgttgatttgttgctcaggtactaagcattccacaagtatatcgaatcgggactatgttttgggacgacaaatacggaactcaaggactctcccccgaggtaagtaatggatcaacctaactaactccagaaattctcttcaaacaccatgaaccaggattgtatccaaattacacaaaactaagattgggctcatgatccaacgatttgtgccgataataggtgatcaatcagatgaggaaactaatgacggaagattcagcgaacatgacttacccttctttcttgctagacgtcgattcaaggtacgcaaaaaacaaaattctcgctttcttctcagtttctctccctaattactctcaatgcatgtttcagcattcctttctcagtggaagatgtttcgcaatccttccacggcggtaacattagcctctccgacgtcgatccatcgccgcttctccgccagcgatctgattttcacttcttattccagacattgccggaataaaggaagagaaacgtcggagagaaacttctctgtctcatagaaggttacaacagctgagaatcttttataatttattaattaagccacgaattttccatatattacagaaatggaagcttttcaattttttctttcaaattttttttttctgtcacatgaagcaagaagcttctcctcttttatgattcctttaatttttcatttggtttggggttctttgctttttatcacttaaaatttacattgtgtatagatagagttttgattcatatcgtacatggtatactcgtttttgatacacatgatgtaatgaatattatatgtgttaatgtaattggatttgtaaaattttgaatttgacacaaaaggaatatcaaaaaaccaatcagtgctacatttggtccttattaggataatttgtggatctacaattttttttcccctttaaatataatttaacattaaaaaaacactacttactaatataatgatttgtattagtattttcgttgattcgttgtattaccatctgaatttagattcacaaaatgcatattgttgacaaaaaatgaatgttgaggtttgtgcacttcggattagtacttgattccatatgtgtatgatcaaagccgtcgacgagactaagctaataaaacttctgtttgcggctattttttgattatatacaagattagccatatttttagcaaaattattaatgtagattagtggcaaaaggcatggtggcatagtttgggcatggtggcatagtttgagagtttgagttttttacctctattttcattagttttatcaatttaaatcatgatagtaatatctaaaattatttatttatccaaacaaaatagtgggcatgttctataataaggcgatttttgagggatcactaagataattaatggacatcttttattagtgctttggtttgaaagcaaactcgctaagctagcaagagggtttagctaaaacccactctctgttaaaaatcacagcactgccattaaaattctcagatagaagaagatg

SEQ ID NO: 13395 - DNA, 3000 bp, Unknown
  misc_feature (1)..( 3000): cDNA_ID_3029900_gDNA_ID_2214624_Annot_ID_187752 3000 nt of promoter + ATG
gaaccagaagcatctgttcatcgaatccttgatccatcaacttcggatcaatcgcaaggctaggattttccgatgttattatgttcctcatccactttatcagactcatctcgtcagtatgctgaaaaaactcatctgaaggaagcttcccaatcaccagaatcccaagaatcactccaaaactatagatatcacatttatctgtgaacttgtgggtttgataaaactctggtgctatgtatcccacagtacctgcaacatgcgaggttgtaatatgtgtgactgcatctggcattgcctttgccagtccgaaatctgaaattctggcttccatgtcatcatcaagaagaacattggctggctttaagtctctgtgaatgattcgtgggttatgatccatgtgaaggtactcaagccctgcagctatacctaaagcaatcttgtgcctcgctggccacattagttcttgatttccagcttgtacgtcagtcaatatatcttgcaaactccccttttccatgtactcgtaaacgaggtagtggcactcgggtcttgacacgtgtgctaacaatgggagaagattccggtgccggatatggccgactgtgttgatctcggatctaatttgcctcattttcttgttcagaaacttggaatcttcatctgttagttcatcggcgtctttaggcggttggatcactttcttcacagctatgatcttcccattgcttcctggtagttcagctttgaaaacttctccacaacctcctcttcctatgatctccagagaagctaacgcttcttcattctccaagaaagctaaatcttcagctttcttgatcaatgggctgaatatggaaggacctggtggtttttctgatcctcttattgcttgaataatcaatttgaacaacaccgagaagacaaacccagagattgttcctcctatggctccaacgacaaaccctaagatccatgccgctactttcttcttcttgctcttcttcttcttcttcttcaacttccctggttttggagctccctttggagcttttgatgtagtgctgttgttgggtttgttcgtgggacttgaagttggagtttcagcaagaatgtgtcttgtttgatgtggagatgtctgaagcttgatactgctcataaccggagccggaccttccaaataccggtttccggagaaatcaaagaaccggagattgtggaacgacacaatttgttccgggattttgcctgagaagagattgtttgcaacagagagattctccagattgcgtagattcttcaagaaattcaagttcccggataacttgttcgaagagagatcaaggattcgaagacggctcaaactagaaaagtttcccggaatctgaccggaaaatctatttttccgaagatcaagaacttcaagttgcttacagcttaagatatccaccggaacagcgttgaccaactggttattagacaaagtaagttccttgagctccgacaacattccgatgaccggagagatagtccccgtcaagctcctggatcggtagacgagcctcgtgacacggagaacgtattctccggtggtggcagagtgccgtctctcgcagaaaactcctcggcgaccgcaagggttgacatcactggccgaagaacgttgactgttgactccgagctctgtttcgatgacctgaagagctttgagatctgaggaatcgatatcgagccactcaacagaggagacgaatgaagagagaagaagaaaggagagaacggcgaggatgagaggccggagaaagagattggcgcttcccgtgggaacagccattttaattagagaaagtttcttcttgtggatgttgtcggagtctacactctgtctatttatggtcagcaactggtactaatctattgagaaatctttacgtgtttcgtggttttttttttcttctaaaactttatttttgaagtgacaaaatatatttgacccaaaaaaaataaagttacaaaatatattcacaagttaatttcttaatattgttatacacttatacatataattggtaaacttaaattaacagtttgaaaaatttatggtttgttcaagggatccatccaagccccggtttcatatcgaaaaaatggggttttctattgctagtattttatttgattagtttgatattaatgatagattactgaattcttacataagatctcctaacaaaattgtattttatattatgatatttagttatcaatggttttggagaaacattgattcagcgtatactttttgaattatttgtatattcttaataagagttctgtttttaattaaagtctaaagaagaaaaaaccattataaaaactgataatcctgacctgtgaaatgggctaaattgtacattttttttttgatttaaattcttccaggaagttttatgggaaaataataaagtagaaaatgtgaatatagaaagttgcaaaactgtattattgatatagcgaattttgttattgacttgactatgtaagcgttgataagtcaaagtctacgctgtgggttccatagtgagccaccgtttcctacacgttagaaaaaaataaatgttatgttacacacaccttctattttccagtcactttcttttagcgttttccgtcaatacgttcgttgtctgtatcaagattccaaactggtgagtgtgaaataactcgaaactggcttttaacttaaaatgagttaaccagatagctaacgaggatgttattgccactaaaccaatacattaccgatatggttcaagttccaacttcccggttctacaaaaccggtttgcctttcgccttcgcactcttgacttttttagattttttactccgggacttgagtatcttctagcggcagcagaatcttgtcgcagaagcgattcgtaaacctgtttcaaaagcaattgagaacagctgtgagattagaaaaatcgaaaaatg

SEQ ID NO: 13396 - DNA, 3000 bp, Unknown
  misc_feature (1)..( 3000): cDNA_ID_2991745_gDNA_ID_2214624_Annot_ID_187748 3000 nt of promoter + ATG
ccaattggtagagaatgtaggactaatgataagagaggaagtttactacttatatagattttaattgcttcttactctttttcctaatcaattcctttgtctttattttttattttcacaaaaagtaatttaatttgtctttttcgtatattctgattggttgttcttttcttttattgctaaaatatattttcttttaacataattaatgattttcaattatgttttagtcaaacccgaaagaaaaaggaaacaaattttttatatttccattcatgctaaaaagaaatgaaagtgtcacgaggtccgacccaaaggtcatacatgctaagcagcttatggttacttattcattttatgctttgcttatcaccaattttgttttatgattatggtaccaaatttgtttttactaaatagttgttgttcataaatatctgatactattttttaattaatgtgtggttgacaaaaaaaataatagaaaaaggtcatgtaaccgttttttttattcggacaactatttttattggaccggccatgcgtataacttccctatttggcaagttttggtctaccattctatcccaaataacaaaacttgggttttatggtctggtctacaactcacaaatcacaagcatagacaaatccgatcatgtggcaaattcaagcttcagattgttgttgccacacaccaagttaatttgttgatttttaaatttaaatttgttttcttttcgcttcttaactatttctttttggttgtcttttttcggaactattacttaattattactactactacacatttggatttgaagcactccataacctaaatcaggttttgtttttcattcactacatgaaattataaaacagagaaatgttttgtatggatttatattgcgtttgggataggtcggaattggttatataggatggaagaagctgatcgaatattcgaactagaggttaagaagcaacatgaaaacaagaaaccctaaattttgtttgtttgatatattggcttacctcgattaaatctgcatgatagcattgattcaacacattaattttaagcaacaaatctcgaactggtttcagataattaagaaagaacataaactagtttatggatccttttattaactctcaaaggtcaaagcagttgaataaaaaatttaactctaaacaacttattccctacccaaaaaaaaactctaaacaacttattgataagacacgaaaagaattgtaaaacccctaaaattcaattttgattttcataattcttaagtttttttttttagttaaagagataattctaagacttgtaaatactaattttaataaaacttgattgacacggaaatagagctacaaagtccacaataaacagagattaatcacaaatcatagctattctgttcgttgacataaaagcgaaattaaatcgaaaaaactatataggacaaaacgaaaaaaaaaaaatgttgaaaatatcctgaaatctactgcaaataagaaagaaaaaaaaaaagaaaaaacttttattgctctttttttacctctcaacgcaattgaataaaattttaatcctgaacaactaaattcacaagaaacacgaaagaattgtaagaaccctatgtagaattaagactttgattatagatgcaagattataaaagactattcttttattccttcgaaaacttactcaaaacccaagttcttacaatctcttaatctctctctcaaccatctaaggttttccacaacttggaaactcatatatttagagactaacatatccaaaacttactaggattgtaattagataactccaaacttttttttttccgctagataactcctaacttatcctttagatatctcctaaagatttaatataatcctatttaaactaaatcacttatatctcaagttattaccaagcttagtccaagaccctaaaactcaaatttgattttaataattctaagttgcaaactcatgacacggtaatagagatatagtccgaatacacagagattggtcacacagctgagccggagtcggcagtggagctacaacaacaacaggatccagccggagccggtgacggaactggagctggaaccgagttggatccggtgctggagtcggggctggagcaggagccagtgctagatccagacaatccagcgtcgtcctgacggagaccattgagtctagttgcaacaaaagctggagctgaagttggagcaggagtaggaacagcggaagacaaagctgaagcttgacaatccagggtcttcctctctgtgactgagttcctcctgcttctctttctccttggaacatcatcaaatattctccggcatctctcacgatccattctccgcgtacacctagctgactctgacaaaagaaagtgttgtttgctccacaaggaacagataataagaaatagattgactagggtgaatgagagaggagattatatatgttttctgttttgtaaatagttttttttcttatttattctttctctcagtcctaatttttaggcttttatttcttttatttacaaaagtatatcagtgattctaaatgtaatatttaagataagttcactaccattagtccgttaccgacttaccgtcctgtgttattagcgaaaaaaaacaaaaaaaaacatttttgagttacaacaacaatatgttcatgacgtgtcattttcttatttgatagtttttagtctacgattctatcccaaataacaaaacagaggtttctatagggttttaagtgttttgtttttgctgctggggaagaagaagaagcagtggcaaatacagttctgttgctgggtttgttgattttttagtcaattctttttttttttcttggcgatttaattttggaattgaacttgaaaaatctcattgggttttcgattaatttaatcttgttcattttgtttcaggaggaatg

SEQ ID NO: 13397 - DNA, 3000 bp, Unknown
  misc_feature (1)..( 3000): cDNA_ID_2702881_gDNA_ID_2214624_Annot_ID_187747 3000 nt of promoter + ATG
gtttcacgtctttccataggtcttcaacttgtttgacataatcagagttccgtttgaaaaaaatatatgaagctgacttggattttccatcttaatctctatttttttgcttttgtgttttggattttgtgctgaaatttgttggctgtgggtatagcttactggggatctagacaagatggttgcactgcaaaggttattggagccctatggtatatgtgaggtttgtttcgcaatctactttcatctcttagtgaatgcataaccccgtgaattcttaatttcttataatgatactccaattgttcggataaagtcccaaaatttagttgtagtctttacgacttagaaacagagtagtgaaatctaactctctggtaaaatcaataaccaaagctggacctagttacatgaatcttcttctggttgtgtgtagaacaagaataagcttgacaagccatgactactttcagattatgcatcgtgttgacgcttattatgaacaatcaatcacaggttgcaagaaccggtcgtgtggcattggctcgtgaatcgggagtggactccaagtaccttcgtggatactcctttcctttaacaggctaaaccgttgcagagtgcatccatcgaacatcagaaacttttgaaggtaaaagtttcattacacagtctatgaaccaactcaaagacagacagagagactgcgtagatatatgtttgtgactttgtttatgaaacaattagctgattttggcttcatttcgattcttttctttttgagataagaaaagttgttaggattattaatattcgttcgtcttattttcccaatatttcccaagttattattatgagatggctaaaagaggaaacacaaatggactttgtaaatgttatagtctagagagtcaaaagtcaaactaagtaagcgttgactgacccggacgtgtacctaaaaatgactcctcttctacaaattcgattcttacattggtaacttcaataacgattactcctgacaaaagtaattcaataattgtgagtccaaataagatccatacgactcatatcatcatctcttaaccttttcaataaatgtcacttctctaagaatatactttcaagtttcaaaaaatctaaccattttcatgattattctgtatttagaatcggggaaacttagatttggaaaaatacacttttggaaagaaaaagttgtgtttctcttcgatatgcatatgtaaaagaaaaagtttgagaattgcaattatagagccgaccatgtgctttttatgctttactcgtttattttaatttgtctgtagtgactacaaaattttcgggcactatgaatggatcgatcaatttatttatgctttatcggcggaagatataaattattcattgaatcataattttgtaatctccttgtttcttaatttattttgtactaagacagttctcaatttaaccacagtttataaccgtaattttgtactaagatataactgtattttgtagttagtgtagaattttgtctctccagctataaaaagctagagttaacttttgagaattttttacaacacttttccgtattttgtaatatgatcatattactaagctaagaaaatccggtcaaacaaattgtttaatcatttaattagaaatgtgaataagttaagaaatgcaagttctttttagtcgtccttagttttgtgtacaagacattaaattacaacactacacaaaaaggagaattcgttagttaactaacaaagtgatcaaccaaacaaaaccctaaccaaatgatactgacttggacttttaactagagcaagtaagtaaaaacgactagttgtatcgtcttacctttgtttagacttttaactccgattaggtgacatggcaccatccatagattagtcaatgaaaagagcattagagacctccatcaattattcaatttcttttatcttattagactcaaactgaaatatctaacacaccatagagaaaaagctttccactgtcgacacaaaaagagaaactaatactaaaaagtaaaaagtaaaaactttattatcgcttaagagtgatgcttgcataaaagcgtgttattaataaaaaagaggcactaacaaaaataaaacaagagtttgtggctgctgaaattcttcaaacccaactgatggtgatgctgatgttcttcttcttctgacattctctctctcttctctcttttcgcagcttcttcttcatcttcggcttaacaacaacaaaacttcacacacgtggtgagagagcacacaaaggctcaagctttttcaaacccttgttgaaattcgagctcttttggtgtttctcttttttttgttggtatcaatttggtgtttctcttggtcttgttgaggtactgaatcagcttcttcttcttctccgatcttaatcgattctaagtttcttcacagcttgggacgatttgacatctactctccaattcatttcccgtaaagttgtttttttttcttcttgttgcttgcaatacatggattcttcgaggtgataatcaacaaaagcttatctcttttgttttctcaaggtttgtgtattagagattagtgtttttgttagatttggggataatatatagataatctgggtttaggtattttagttgataacgacgataaattggagtaataggatatgactataatggaggagaagcagaacaacagtcctgtgggagagaagcaacagagctttaatggtataataataaaccaaacacaagagaatcagacaaaatcaatggagaaacaacagagtttccgatgtgtggtggagaatcaaccgagaaaggcgagagctttagagaaacaagtgagtttccaaggtgtgaatgtagagaactatcagcaaagcagactcggaagatcaatggagaagcaacagagttttcgaggtgtcaacgttgagaatcataaacgtggagtt

SEQ ID NO: 13398 - DNA, 3000 bp, Unknown
  misc_feature (1)..( 3000): cDNA_ID_3029912_gDNA_ID_2214624_Annot_ID_187746 3000 nt of promoter + ATG
ataatcagctagaatggttgagaaacagaatgaagtacttttagagagcatatagaacagtgagtggaataaaaccagactagatacagccatcaagaaatgccgaggagcacaatgtttgaccattaacgtaactaataggtaccggatataagatgacaccaaaacgtatgaatccataaggtactacctcatataatacgacaccaaaagagtaagaatccacactcctgtcaaatatttcatctttgtaaacctcaggtgccatacagtaatctgcaaacaacaaaaaaaatcatctgtttaaactattgcctcatggaaatggaccattcttataacttatgagtatatcaatagtagaaacagtttctatacttaatacttgtatcaaagtttctcaggaggaaataagcatttaggacttacttgaaggatctatatgggccccgtgattaaggatttttgatttatcagatgataactttgcaaaacttatcaaaccaaatcccgccaccttcagatgtcctccactatcgagcataatatttctggcaccttacaagaagttgcaaaaattagataacgagggtccaaatatatgttctcgaaaaacttaacgtgcaaatgcttctttatttagttatcttacttgggttttagatcacagtggattactggttctggtttacactcgtgaagataattcattcccctgagaagagccaaatgattcgttcaaaagattattaaaaaaaatgtagttgtaagttgaatacaatcttgccaaaaaagtcacatgcctggctatatcgagggcaaatcttagaactttggctggagaaagacgaccttttttttgaagatagctcccaaggtccccctgcaagttaccaccaagtggacaacattagttcctaccatccaaatattgcttaatgagggaaaaatcttttaaggtgtaaaaagagggagaagcttactttaggatgatactcggacacaatcatcatggggacattttgagtaacagctccaacaaattgcacaacattaggatgacgtaccttctcgaataaagtaagttcgtgtttgaaggcatttctgtgggtacataataaaagtcagatgagaagattgcagaacaaacgtaatatatgaaaagaaaaacaaggattaacacagagggaatgaagtggattccagaaaatattactggaaatgcacaattccaacatagaagattctataagaactatgattgaataatgttacagctcatatcatcatcactatgaacataacaaagatgatttcaacgatctatagcttcactcaagaagaaattcaaactccttcttgacctgttagctaacatagacatattactcactgaagagaagagtaatcttacatagtgtcagaatccttgtagagatccttatcaagtatctttacagaaaccttagtcccattccatttagccacttgatatattccctggcaagtggaaaagtgatgtagtatcttgttaaaaatctataaatggaaactaagacattattacaggaaagtaaagcaaagagagatcttgcctttgagataccatcagctttccgaacttgaagttcctgcggatttaactcgtactcaggaacttcacgaggattcgccacaaccatgggtgtccttttggttttctaaaaccaagaagaaaatgtaactataaacatattaagatatgaaaagaacagagcttgaatcaatgaaaaatgcagcaacataccggaactttagctccacgggctttcaaaatgttgaaaacatccatgttaccataatacttagcatcagcagctgcctatccacacaacacaaacataatttcaaaaccaaaagcacaaaacctaaccaataagagacaacaatagaaatttatcacattaccgtgcttccccaacgatcacgagcatcaatattagccttcctagtaagaagaagcttgacaacatcgacatgaccttcacaagcagcgatatgaagagccgtacgaccatcaagatcgatactattaacatcaataccttcatcaagcagatcctgaacaccttcaacatcacctctacaagccacaaatagaagctgcatagtagcgtcgagattatccggtacagcaagctgcggaccgttagaaccatcaggactccgacgaatcggatctaaagacgattgtcgaccaaaactaaatcgcatattgttccggcgaggatcatgtgaagcttgacgcgtgaattgacgactaagcgtacgacgaagcgatccagttgagaattgtctcgagattcctcgttttagctgtcccactacattcgccatgatttcaaatctctttctcttcttctctctttcgtcttcttctgcgaaaaaatcgaatggataatcacattttctttttctcgagaaaattgatctggtgattatgtgagatccgtctctagcgcgttgcttatcgagaaataattaattttaatttgacgggtgaagatattattggcgacgtctgtttccgattgactttgatttgacttttcctttcaatcattatttggcgagtcccgcgtaaatatggactcttcttgattgtccacttttttcggtggctttaccggatttaaaatcattttcttttcctaaattatgaattttaccctaaacttctcataattacaattagttccgacgaacccaagatactttttagcaaaattaggaaaatagttgactcgaaaaggttgttatacgtggagctgacgtgttggtcttatctactcgaagccttttgggcttttcttaaagccattgatttctaaggtcgtcaacaaccgaaccggaccggacggtttgaccggtctaaccaacatatatacgttctttttcacttgccgtttcgtcgtcgtcagtcttcttcagtagcaaaaaaccttcggcttcgtctcgtca

SEQ ID NO: 13399 - DNA, 3000 bp, Unknown; identical to SEQ ID NO: 13392
  misc_feature (1)..( 3000): cDNA_ID_2702869_gDNA_ID_2214624_Annot_ID_187744 3000 nt of promoter + ATG

SEQ ID NO: 13400 - DNA, 3000 bp, Unknown; identical to SEQ ID NO: 13398
  misc_feature (1)..( 3000): cDNA_ID_2702877_gDNA_ID_2214624_Annot_ID_135928 3000 nt of promoter + ATG

SEQ ID NO: 13401 - DNA, 3000 bp, Unknown
  misc_feature (1)..( 3000): cDNA_ID_2702881_gDNA_ID_2214624_Annot_ID_135929 3000 nt of promoter + ATG
gatttgccgcaactttccaagctgttattaactttgtgaggattttctgcaggtccatgatcttactcatttgccattttctgaaagagaactgatgctgattaagattgccgtgaacgctgctgctagaagagatgtcctggacattgctagtattttcagggctaaagctgttgacgtatctgatcacacaattactttgcaggtaaaatacatttctcataaatgggatttttatgtagctgttattgcatctcagatgagaaatcctttcaattggagatcttcaaagtttcacgtctttccataggtcttcaacttgtttgacataatcagagttccgtttgaaaaaaatatatgaagctgacttggattttccatcttaatctctatttttttgcttttgtgttttggattttgtgctgaaatttgttggctgtgggtatagcttactggggatctagacaagatggttgcactgcaaaggttattggagccctatggtatatgtgaggtttgtttcgcaatctactttcatctcttagtgaatgcataaccccgtgaattcttaatttcttataatgatactccaattgttcggataaagtcccaaaatttagttgtagtctttacgacttagaaacagagtagtgaaatctaactctctggtaaaatcaataaccaaagctggacctagttacatgaatcttcttctggttgtgtgtagaacaagaataagcttgacaagccatgactactttcagattatgcatcgtgttgacgcttattatgaacaatcaatcacaggttgcaagaaccggtcgtgtggcattggctcgtgaatcgggagtggactccaagtaccttcgtggatactcctttcctttaacaggctaaaccgttgcagagtgcatccatcgaacatcagaaacttttgaaggtaaaagtttcattacacagtctatgaaccaactcaaagacagacagagagactgcgtagatatatgtttgtgactttgtttatgaaacaattagctgattttggcttcatttcgattcttttctttttgagataagaaaagttgttaggattattaatattcgttcgtcttattttcccaatatttcccaagttattattatgagatggctaaaagaggaaacacaaatggactttgtaaatgttatagtctagagagtcaaaagtcaaactaagtaagcgttgactgacccggacgtgtacctaaaaatgactcctcttctacaaattcgattcttacattggtaacttcaataacgattactcctgacaaaagtaattcaataattgtgagtccaaataagatccatacgactcatatcatcatctcttaaccttttcaataaatgtcacttctctaagaatatactttcaagtttcaaaaaatctaaccattttcatgattattctgtatttagaatcggggaaacttagatttggaaaaatacacttttggaaagaaaaagttgtgtttctcttcgatatgcatatgtaaaagaaaaagtttgagaattgcaattatagagccgaccatgtgctttttatgctttactcgtttattttaatttgtctgtagtgactacaaaattttcgggcactatgaatggatcgatcaatttatttatgctttatcggcggaagatataaattattcattgaatcataattttgtaatctccttgtttcttaatttattttgtactaagacagttctcaatttaaccacagtttataaccgtaattttgtactaagatataactgtattttgtagttagtgtagaattttgtctctccagctataaaaagctagagttaacttttgagaattttttacaacacttttccgtattttgtaatatgatcatattactaagctaagaaaatccggtcaaacaaattgtttaatcatttaattagaaatgtgaataagttaagaaatgcaagttctttttagtcgtccttagttttgtgtacaagacattaaattacaacactacacaaaaaggagaattcgttagttaactaacaaagtgatcaaccaaacaaaaccctaaccaaatgatactgacttggacttttaactagagcaagtaagtaaaaacgactagttgtatcgtcttacctttgtttagacttttaactccgattaggtgacatggcaccatccatagattagtcaatgaaaagagcattagagacctccatcaattattcaatttcttttatcttattagactcaaactgaaatatctaacacaccatagagaaaaagctttccactgtcgacacaaaaagagaaactaatactaaaaagtaaaaagtaaaaactttattatcgcttaagagtgatgcttgcataaaagcgtgttattaataaaaaagaggcactaacaaaaataaaacaagagtttgtggctgctgaaattcttcaaacccaactgatggtgatgctgatgttcttcttcttctgacattctctctctcttctctcttttcgcagcttcttcttcatcttcggcttaacaacaacaaaacttcacacacgtggtgagagagcacacaaaggctcaagctttttcaaacccttgttgaaattcgagctcttttggtgtttctcttttttttgttggtatcaatttggtgtttctcttggtcttgttgaggtactgaatcagcttcttcttcttctccgatcttaatcgattctaagtttcttcacagcttgggacgatttgacatctactctccaattcatttcccgtaaagttgtttttttttcttcttgttgcttgcaatacatggattcttcgaggtgataatcaacaaaagcttatctcttttgttttctcaaggtttgtgtattagagattagtgtttttgttagatttggggataatatatagataatctgggtttaggtattttagttgataacgacgataaattggagtaataggat

SEQ ID NO: 13402 - DNA, 3000 bp, Unknown
  misc_feature (1)..( 3000): cDNA_ID_2702885_gDNA_ID_2214624_Annot_ID_135930 3000 nt of promoter + ATG
tatatctcaagttattaccaagcttagtccaagaccctaaaactcaaatttgattttaataattctaagttgcaaactcatgacacggtaatagagatatagtccgaatacacagagattggtcacacagctgagccggagtcggcagtggagctacaacaacaacaggatccagccggagccggtgacggaactggagctggaaccgagttggatccggtgctggagtcggggctggagcaggagccagtgctagatccagacaatccagcgtcgtcctgacggagaccattgagtctagttgcaacaaaagctggagctgaagttggagcaggagtaggaacagcggaagacaaagctgaagcttgacaatccagggtcttcctctctgtgactgagttcctcctgcttctctttctccttggaacatcatcaaatattctccggcatctctcacgatccattctccgcgtacacctagctgactctgacaaaagaaagtgttgtttgctccacaaggaacagataataagaaatagattgactagggtgaatgagagaggagattatatatgttttctgttttgtaaatagttttttttcttatttattctttctctcagtcctaatttttaggcttttatttcttttatttacaaaagtatatcagtgattctaaatgtaatatttaagataagttcactaccattagtccgttaccgacttaccgtcctgtgttattagcgaaaaaaaacaaaaaaaaacatttttgagttacaacaacaatatgttcatgacgtgtcattttcttatttgatagtttttagtctacgattctatcccaaataacaaaacagaggtttctatagggttttaagtgttttgtttttgctgctggggaagaagaagaagcagtggcaaatacagttctgttgctgggtttgttgattttttagtcaattctttttttttttcttggcgatttaattttggaattgaacttgaaaaatctcattgggttttcgattaatttaatcttgttcattttgtttcaggaggaatgattcttccattttcgacacagttcacttgccctgttcaggataatggattcagcccttcttcactactttcccattgcaaaagagatcgttttgaagttacttcgttgagatatgactcttttggttcggtgaagactgcctcctcctcggttagtttctgattacctaactctctaattttgattacttaagttgcgaattggctaatttgaaaccttttttgctctgaggtattgctagaagtggaatgttatgaggtcgaggagaaatgtgaaagcttttgggttagttgataaacttgggaagaaggtatggagaaagaaagaagaagatagtgacagtgaagatgaggaagatgaagtgaaagaagagacctttggcgggaaagaagcgagtctcgatgatccagtagagagacgggaatggaggaagacgataagagaggtgattgataagcatcctgatattgaagaagacgaagagattgatatggttgagaagaggaggaagatgcagaagcttcttgctgattacccacttgttgtgaatgaagaggatcctaattggcctgaagatgctgatggttgggggtttagtttcaatcagttttttaataagataacgattaagaatgaaaagaaggaagaagaggatgatgatgaagatagtgaaggagatgatagtgagaaggagattgtttggcaagatgataactatatacgcccgattaaagatctcacaacggcagaatgggaagaggcggtgttcaaagatattagtcctctcatggtccttgttcacaaccgctacaagaggttggtggtaacagtttgtcttacttatgcttgtcaaaatgctacacattttgttgattagtttttatgctgatcgctgactttggttgttattgggctgttttgtttatggattcaactcactttagtgtttagaagtttcaacctttattgtatctgtagataggtgtctctggctctctattcttgctgatgggatctttcaatcctgactattgtagttctagctgtgttgttgaaatttgatacgagtactggttaatttcaggcctaaggaaaacgaaaagttcagggaagaactagagaaggcgattcaagttatatggaactgtggacttccttcaccaagagtaagttgtggacatctctttaccatttctaaaaccattattgaatcttgctgtatgttgtggtctgtgcttaaacctcctgggtcattattacttccagtgtgttgctgttgatgctgtggttgagacagatttggtctctgctctgaaagtatctgtcttcccagagatcatcttcactaaagccgggaagatactataccgcgagaaaggtattgttcgaggaaacctgaaaccgttcagtacctgaatctctaacctttgttgctgtacttaaaatcaatttaacttatttttcaggcattagaacagcagatgagctttcaaaaatcatggctttcttctattatggagctgcaaaaccaccttgtttgaatggtgtcgtgaattcgcaagaacagattcctttagtcgatgtaagtgtgaattaagcataagcctttgtgatcttatgtaaagtagtttcttctctagtctgaagaaaatgtatgaactgaagaagtaatcaatcttttgaatgtgaaatatatgtttttcgaaattgctatttatagaacatgataaattttatgagtctcagaagcagaggcttcgcgtccgtaaacacttgatcaccatgtttctctctcttgcaacgtgctctcttctccctttctctctcgctctctctcaatctcccaccatctctcatcctcatttccccttcatggttggttttgttccgatttccaaatttcttcatttggcaaattcttttgatcttcttccatg

SEQ ID NO: 13403 - DNA, 3000 bp, Unknown; identical to SEQ ID NO: 13395
  misc_feature (1)..( 3000): cDNA_ID_2702896_gDNA_ID_2214624_Annot_ID_135934 3000 nt of promoter + ATG

SEQ ID NO: 13404 - DNA, 3000 bp, Unknown
  misc_feature (1)..( 3000): cDNA_ID_2702904_gDNA_ID_2214624_Annot_ID_135936 3000 nt of promoter + ATG
aacaggcaccaagaccaacaagagccaaaaccttgcgagatgtgactaaaagcatccacttgaccacaattgccaagcaacaagcatcatatgtacagtggcagaacattgtcaacaagcttgaacataccttgacttttatggcagagaaccatgtaaaacaatgcactttcgaagatttccagctcaagcttaaatttgtcttttcctgtttcttgactgagccttaatgatctccaggtcccatctatgatcacaagaaaactcttccatcaggttttctcgtacatcaatgtgcagctctttaataggtacaaaaatatatcgcataggacacaagtacctatgtttggttatgacgtagcttgacttgtaaagtttatcttctggcagtttgttgcttcgccgagagtgttgttcagttagcaatggagaatacctaaaaatgggcttgcatgaattagagcaatggtgcctgaaggcagatgacgaggtaggctataaagcattaataaccaaatcatgcaaagatgaaaaataagacaaaagagattaacttacataattctgttcttttttgtctcctacaggcaacacgatcaccatgggatgaacttcaacacataaggcaagcagtgatgtttctggtatagcatcgaaccatatctgttggttaaagtacaaaactagtgaacaaaattcgatatttgatatacactatcactctacaggtctcacatcaaaagacacagaaatcattggacgaaatcgcaaaagagatatgcccggtaaagaccttaaaccaaaaatttctgcagagcatatagaaggatcttaatatgacacaattatctattagtggttactcctgaaacactatacagttggatacatgagcaaacgggtgaaagatcttatgaaagtaaaagcatctagagaatgacaagatggcataactaaaccatcctacatttctacttccagtcactgtcccctgatttgttgatttgttgctcaggtactaagcattccacaagtatatcgaatcgggactatgttttgggacgacaaatacggaactcaaggactctcccccgaggtaagtaatggatcaacctaactaactccagaaattctcttcaaacaccatgaaccaggattgtatccaaattacacaaaactaagattgggctcatgatccaacgatttgtgccgataataggtgatcaatcagatgaggaaactaatgacggaagattcagcgaacatgacttacccttctttcttgctagacgtcgattcaaggtacgcaaaaaacaaaattctcgctttcttctcagtttctctccctaattactctcaatgcatgtttcagcattcctttctcagtggaagatgtttcgcaatccttccacggcggtaacattagcctctccgacgtcgatccatcgccgcttctccgccagcgatctgattttcacttcttattccagacattgccggaataaaggaagagaaacgtcggagagaaacttctctgtctcatagaaggttacaacagctgagaatcttttataatttattaattaagccacgaattttccatatattacagaaatggaagcttttcaattttttctttcaaattttttttttctgtcacatgaagcaagaagcttctcctcttttatgattcctttaatttttcatttggtttggggttctttgctttttatcacttaaaatttacattgtgtatagatagagttttgattcatatcgtacatggtatactcgtttttgatacacatgatgtaatgaatattatatgtgttaatgtaattggatttgtaaaattttgaatttgacacaaaaggaatatcaaaaaaccaatcagtgctacatttggtccttattaggataatttgtggatctacaattttttttcccctttaaatataatttaacattaaaaaaacactacttactaatataatgatttgtattagtattttcgttgattcgttgtattaccatctgaatttagattcacaaaatgcatattgttgacaaaaaatgaatgttgaggtttgtgcacttcggattagtacttgattccatatgtgtatgatcaaagccgtcgacgagactaagctaataaaacttctgtttgcggctattttttgattatatacaagattagccatatttttagcaaaattattaatgtagattagtggcaaaaggcatggtggcatagtttgggcatggtggcatagtttgagagtttgagttttttacctctattttcattagttttatcaatttaaatcatgatagtaatatctaaaattatttatttatccaaacaaaatagtgggcatgttctataataaggcgatttttgagggatcactaagataattaatggacatcttttattagtgctttggtttgaaagcaaactcgctaagctagcaagagggtttagctaaaacccactctctgttaaaaatcacagcactgccattaaaattctcagatagaagaagatggagtgtgtagttccattccggcgatgcttctgtctcaatccgccggagacacgccaccgtatcgttaaccacaaccaccgaaatctccatatttctctctcctcctcctctttcgcatcaggtcgtcatttcatttcctcttctcttcttagtcaatcaacccagctttatatcctgactcgctcttacgtcaattccagggattttgcctctttctaataagaagtatcgatttgttggtcctctagcacagaggagttccttgcatcgccgtacggactctctcaagcaccttcctttttccgtggttagttctcagaaatttcgttttttttttttccttttcatttcagagatacttgaaattttcatataagtatgtgaatgaggagttgttgtggttgcttttattgatttagtcttcatttgtatgtgactcatgatg

SEQ ID NO: 13405 - DNA, 3000 bp, Unknown
  misc_feature (1)..( 3000): cDNA_ID_2702853_gDNA_ID_2214624_Annot_ID_135937 3000 nt of promoter + ATG
ttgcgtacacctaacaaattaaatatggttttcgttagtactataattcagtaactatgcgtgtgtgaggaaaaataacacaagggaacaaccatatttagttaccagatttggaaaaaatcgccattccaaaaatgaagagaatccaagtgcacaaatcagtaacaacggctgcacacattgcagtatgtcccatatccgtacgcaagagcttgagatccgcaagaatcctagcaagatcagggaaatttgtacagccaaatgcgatcgaccagtacatacaacctgctaggattttgtcggcctctccgttactgggaaggtagtataagccagcaccggcaagtaaagccgcaaggaggccaacaatggctatgatcactggtttgatgtctttgatctttatcatcctcaagtccaagccgagaccgaggaggaaaacgttgtaaacgagagctaagtttgcgaatgtctcaagaagcattgtatatttataagggaatataagtttaaggaccacttcgttattgccgagcacagtcgggctgaacagtaatccgcactgtaaacaaaataatcattacaattattataggatcatattataaattatgtacgagattaatttgaaaaagatccaataatataaatcgtatgttgcaagtggacaaatcttaaattttttatcattttggttttatcttaaaatcaccgttttcgaaaaaaaaaagaagcaaaaagctgaactttcgttagaacaatgaagttaattgttagcaaaaatttaatcaagaatttgaagatgaagactctttaggacatagctaacaaagaaaaaaaaggaaacataggtttgcaatagttgtgggtaataagtaatgaaaaaaaacagtttaaagattgataatggttagttaaatatgttttcaagattgactactcacaagtatttgagcgacgaaaggaggaagacatagaggcttaagaaaatagtagagtatgcggtaggtaagattagcgacagacagttgcgtcataaagaaaggagctgcggctgaaatggtgttgcttccatgcattgccgtttggttataacatacgactctcccaaaccgcgacgaacttgcatcaatagattcagctgcgggatcggccatttattggggggattttccttaatagatttaaacgggattctctcaaaaaaaacccaaggttttggccttttccctttcacaaaatctttgtgtttcatcatctgttttgttttattgcattaataggtgagagctacacaatctgtttttccttttttttttttttctctaatcttcttctttgtcattgctaattatagtttttttttatgtttgatgtcaaatagaaaagtactagtaatttagctgtctttgtattctcttttgcaaatgaaattagtcaattttggttggttttcttgtttagtctgttataaagggattataaaatccaattacatgctgttttccttgttatcaaataatagtactacatgatatcagtgttttttggatagatgagttaatatctcccttagtgatacaatgatatatttttatttcatttaaggaaaaaggctaaaacacagggttgcacatgtaatcatgatgttcttggatcaagaaattagacagataatgatgcaggtttgaatatttaaagattacttaacaaaactaaaataaaaactttcgaccataaataaaaaaagagagggaaaagaaagccaaacctagctggaaaagttaatccaaatggtccagtctcagaaaccggccttaaccgccaccggagattctccaccggccattaccttcacacaccccagaaaataaataaatggaaaaatatgtaactttctataagatttgacaaagtctacacttttaaggtgatgacttcaagtttaagcaccacacattggtgaaaggccttttggctctgcagtaagagatggaaacaaacgtaaagggcactattgtcttttaatgaaaaagaggaaagaagttcactttcacagcgaaacagtacctggccatggccgatcaagagaaaagttggtgcagtagcaatatcaaaatgtaaagcagacaactttattgttctaaaagcagagatttcacattttgttcaacgtacgaggaccccattcatactcaaaaggaagcatcataaagctttgaaaaggagaaacatatgaagagtgtgaccttacaccaaacagttttctatggaatgcatggttttcaaagcaaatgacctaagagagaatatctgaaagaagttgatttgccgccgcctttactgcatcttaagctctaaaacctgcaaaaaagagttaagagacttagtggagacgagaggtgactaggtgagggaaaagtcactttctaagttaagaatctccagtatcttctgattcagagtcgcctatttttttatgattcatctctttcttcttaccttttcttttgatctatctctctgttctccaactgctgcagattctcagtgtaagagcttggaagagcttgagttatggtaagcctccccattaacctcctgttgcatatactatcttttcttcttactgtgactattgaaaagctttctttgataaataatgttaggggactcctgtaaatatcacactcggatcacatgtctgggtcgaggatccagaactcgcatggatcagtggagaagtgactgaaatcaaaggcaccaatgccaaaatagtcactgcaaacgggaaaacagtaagaaactaatattcattacatataaaaccacaataaatggaaaagattatgatatttttaccatggacctttgcagtaagattcacagatttttctagaagaattttgagaatagattatattattacaggttgttgctagtatttctagtatctatccaaaggatacagaggctccgcctgcaggagttgacgacatg

SEQ ID NO: 13406 - DNA, 3000 bp, Unknown
  misc_feature (1)..( 3000): cDNA_ID_2713634_gDNA_ID_2214624_Annot_ID_135941 3000 nt of promoter + ATG
ggtttgatctaagcatgtcgaaaagaactcgaaaaccatggtctagtctcatcaacgatatgcatcaccatgcaatatgcacccaaagctcacaaccaaaaccagacaaagaacaagagcaaatcgaagacaaagagattgatcgtaagagtttgaacaatctgatgagatgcgatgagaaattgaatggagaagctgatgttaacaacaagagctctctagatcaacatttcgaggatggcgaggggatcaagccgacgatgcaattggtggtgaagaaagagaagcaaggtggtttgaaattcaaaggtatggtgggtcgatatgttaaggtctggagcggtttgataaaggccaaacgtgaccacaaatcgccggtctttcggtttaaaacttgaatcctatatacgtacgtttcatatacgtgatcacatatatatatattatacgattagttattagagataagctgtagactaggcagttttttggaatgttttgcgtacgtacgtattattgatgtgcacgtttgttgttggcatattggttttgacttgagattgtaattagcactatatacatgcaactcttgttttttttgttaagaatctcactacatgagttttgctttgtgttttgagcttttgccaaaaaaacaaatctgttaaagtcttttcgtcgtcagatcttagggtgttacggttgatcttttttggtttaacggtctaaactgtagtcgttctttgccaactagttacgattaggtgaactttaggtttatacataattgtaatatataacttttgatatttttgtagctctaacaatttgaagtgttttttataaagaaaaggcaaaacataaagagaaaccaaagataatgttttaaaacataaaatatgttcttaaatacaaccatttttgtttttggataattgttttacttctgttttccaattaatattcgcgatattataacccaataaaaaaaaaaatcttaaagaaaaataaaacacgaagaatgaaacaaatttaagtgttgtggctcggattgtgagttgtgagtttttgtatttttcatatatatcagatgacacatcgtgacatagatgaacaatttaactgacgatgtctgactaagacctatcctcattttctgccattacaatagttacggggttaactaattgccaaatgtttaaaatagtttataggtaagtaatcttctcagtcaatcaaatattatttttgttatactttttttttttttggttttaatgttaagggtttgttttactttatacgtaatacaatacaatttctttctaatttaatcaacattgcttagtttcaatccaaattacataatataaaatatgcagaagcgtggcgattttatagctatatatataacctccaaattagtgatgctttaaattcatttcctaagaagataacatataataatatcaaaatatcattgtaataaataactttaacactctatgtagttcatccatatgatttatcatatactaaaaaacgagtaaatactcaagaagtcacatgaataattaacataattaaagacagtttttgatcctcgaaaaacatatatagtatcaaatttgaattcttcgttgttagattcagttagtttgtctaaattaaaaatatatggatgttgtttttttttgtttttttataatcatgtagtttacgaaatgtacaaaacttctcaaattcaatagttaacaagtttttttgtttttttttaaacaaaaaaaaaaagacaatacgtaacaagttgacatcatgaaactatatttgacgatattgtttgttgctcttacaatatgtcaataactatagcctaaaatctttgtcgttcaaaattttcctgctctttatttccctagggctttcacaacatattttccggcttatcgagtttttattgtcgtatcgtaccgactactaggcgggtacgcataacaacgtagtttttttttgttcacaaataacaacgtagctaatttatttatttttcttatattatcatagacttttgttggttaaataaaataaaataaaatgagaacgtatcaggtgacctcagatgtaaggaaagggtcggtagtacgtggcatattatcattgggtatcttttttaccaattaaattggagatgcatcatgcatggcctcaccgaccatgttaagtaaccttgtggcaccgtcgaaaagcaagaatctttaactaaagtgtccagtcagctctttttcttttactttatttcggctaccaaacattattatacttcacaaaatatacgccaagtaatttttttttttctgcttaaaagtagatttctgcaattataacttttaagacaaaaaataaatgttttaacaaatgttttaagaaattttaagcttaaattttgtccagttttgatcccaatttttgtccagttttgatcccaattatgtaccaaaattataacttaatatttcattatatcaaactgtatttcaatatatatacaaaaatttgttgctcatatcatcatatcatatcaataaataaacatacgtcagattacatttatagttatatatatatataataaatttagatctcatattctcattgttattttgattaattccgttagttcatttaacactcgcttaatccagtttgattcataaacctatctgtaaatttaaataatatattacgttatccattgtataaaattaaatttctattactgaatacaaaagaacgtatttaattacatttttgtagaatccgaattccgaagcaaattaaacattaattgttaattaatttctctttataaaacccacctcatcctccaacttcttcatcaatctcaattctcaaacatcaagaagtctctacaaaaaaaaaatctcacatctaaagaaaactctcaatagaaaacaattaaacaacaatcaagaatctata

SEQ ID NO: 13407 - DNA, 3000 bp, Unknown
  misc_feature (1)..( 3000): cDNA_ID_1397500_gDNA_ID_2214625_Annot_ID_135945 3000 nt of promoter + ATG
gcatgtgtaggtcagccatgaaatgcaagccatacatcaatttgaacaggaagaaccacggtggtacccacattgttttcagagaggtcaagggatgaaaggttggaagaagaatcaagaagtgtagagaaaaccatcctcgcaaaatatctatcgaggttgctatcgccaaaatgtaaggaatgtaaggtcctgaaagaaaaaagatgctcactaaaagtaaaatgaagaaagaagtacataataataatattacaacatttatgaagagactttgatagccaaatgagcaaacatttaacaagacacgttttggcatcagtccatatatatacctcaccgacatcaggaatgaaacgaaagcggaaggcgcagcaagtggatctatctcaatgctagatgtctttatacagaaacgttgcatcccagttgtgtggatacccttttcatgaagagaagtgcatattgcactgatggaactcaaagaaagcttgcagtgaataagttcaagcgaagttaatgtttctcggctctgaatcaagagcttgcacaagggctcaacctggagttcatggaacatcagcaataaaattccagctaactaaatctaggagactaaatagagaaagcgtcttacatgcttctcggatctgatccaacgtagaaccaaacttcgcaatttacttgtcctcaataactcctacagtaacaaagcctaaagattatttctgtcctccctctagaggttgaatgattgattcatcaacaaagatacaaatttgaagttctaagagagagataaacatcgaaagcaatacaacatatcacggcgatcagtggatactgaaacaaaaataaaacaaagatgactctatttacaaacacagaaacacatcaaaacgtcagagcatagtttaattacttacagaagtttctgtaacgcatagcacattcagaagcctcagacacctgcaacaggtaagaatgaacgcaaagaagcataagtatgttagagcattaaatcagtccaaaccagatatctcacgcacaaccagttatgagcgatataaaagtaaggcaagctgaaagtagtacagtgtatccgtatatacaaggaaaacgtgaggctatgaaacgattaataatcagacacacatgaaatgttactcaacctaagatatggtccaaaagtttggaaatgaaaagatagttccttgcagacacaattttgacaagtcatgatgtgctcttcatggcaaatgtatctcaatatgttatctgcaatagaaaaatacaacaaaaaaactgaataatgattattacacaactgaaaaaatcaaacccaagaatttcattggaacacataccagatacattaatggaacaaatccgaccactaaatgtcggacgcagagctacctcagctgcttcatcaacacaactgttactcggataaagatacaactcaaaaggaagttacataagcaataaaaaacaaatcatcgatcatttcaatagaattggcatacttttggagatgcttttcccagtaaagctgttgccaatcagctggtgattccacacggtcaacaaaatcaggccaccgcagcttaaacaacaacttccaagagctaccaagtacatcatttctgcagatgaatttaagttaaatctttctcagtctgtcttctcaattcgaataacaaaacagaaatcaaaagaagaattcatcaaaccttgcacgttttctcccagtaatcaagcagcaatcatctccagattcataactatccaagcaatgaaacggcctataccaatagaaaaatgtaaatgaaataagagttgtatcatcttcatccatataattcgtaaccctaactaaacctttcaatttgtattcaaaacttaaatgaaaccaaagagtgtactgacatgttggtctgaaacttctgcaaagcaagagcaggcaagtgagcgacaatgccatcaagtaactccgatggaagctcgtataaatctggaattggattatcgcctggaattacacaaaacccaaactcaaattcagcatattttggaatcaaattggcgcaacaaaagctttgttagaattactttctagaagctgaattttgagggattggatgcagagaaacgcaagagaaggagctttcgtcatccaaacaaagagaagagagtgccaatcgcaacgcaaccaaaacttcccgctgcagctgctctcggctcgctgtttctttcttccaaagagggaagagcaaataattcgttatgaggtctctttcataatgggccgcttagtatggcccaattcataattattcatagataattaaatctttttgtgaccagtaaaaaaacaattaaagttttaaaaactttgtttaaaaaaacatattttcatgagtagtgtaaattattttaaaaagaaatggaattataaggaaattttaatcaacaataattttataatggaatttaaatgttttttttatataaaaaaaaactaattgtgagcattgccatccaaaaataaatggtaaatttatttgtaattaaaaatagaagaaatatcaggatcatataaatcattaaacacatgcagccaaaaacataataagtgtacaaataaaattttaaaacagttccaaaaagcatcagataagagcgaaacaaattacaaaattgaattacacaataatgtcctctaagcgacgactaccggtgaaatattttataagaaaacaaaaacaataattaacaaacaaaggcgacacctttagattcgacaagacgaccattttagaaaaagcttctcaaattctctccttatccccaaaaattcaaacttttttctctttggaaaattctgaggcaaaaatgcggcgtaattgctgccatgtttcatttgcttcaaccctcaagatccttaattttgtccaagctttcattggtgtttcgatcattatctactccatatgg

SEQ ID NO: 13408 - DNA, 3000 bp, Unknown
  misc_feature (1)..( 3000): cDNA_ID_3029968_gDNA_ID_2214625_Annot_ID_187789 3000 nt of promoter + ATG
agtccctttgctggagaaacccgaacatgctatcttctatcccaagcagaaaaggggatccaatgagtaagaaaaatggcaaatgcagatacctaacacatatgttttgtctttgagtgactgttcgggtttgagaatgtttacctccattgcgaacagctttgagatgcaagattcctgtgccttgtggtccaatcacagggaatgaacaagacactgagtgcctttggtgagaaacagctagtgaagcattgtaccatggccctttctcaattggctctccgatggcttcaatcatcaccttactattcatcaccttctccatcgccttgctgaaaattaagcatacaaagactttttgagtaatcgccaatgcagatactacattcttgaaaatcatgtccatgttattgatttgatgatacaaggagaagatcatagagaaattcatgacagaatggacaacaaataacaaaatggtgcgtatagaaatccaaaaaaaatatgtttgttctggatattacggctgacttttcactcgattcctaacgaggacaggtagaagaagtatcattactttgtaaagtggcggcacaagcacaagatagactaccagactacacatctttctcttcgtttgcttaaccagtttcactaaagcttgaagccaaaatcgaaatatggagacagcatcaattcacgtacatgtatcactagcaggagaatttgagtttcgtttgttgtctttcgaagttgatcctttaaaccccaacccattgataacaaaatatggtcaaagaattgatggtctcagccaccacttcaacaaaatggtttaaacattatctaaacctgttgtccaaacgagtctcttgctaataaagccttgtcaagactccgaatcgattcacaattcaactatcagtgaaggttacacacatagtatgtctattgcaatagctaaacttcaatggaaagataaatgcatttttgatgaaacgaatatgtgatgggagattacctgctacatccacgatagatagaaagatcatcgagagcactcaaagcaacaccaccagtgactgtaatcaagacgaaagacactgccttgcgaccaaaagagcccaatgtcccagctgttttgtccgggctgtttcaaaaacattcttcagctcattttcactcctaaacgaccatatataacataaatcatccaaattttgaatctaatccatataagctcaagtcaataggtgtaaatgggtatatagatcatttcaccaactagaaaaactaggtcgattttgaaatcgcgatagagatggaatgaattcagatgcgcgaagaagagaaatcgatcggattccaatttgtaagatcgcaaatcaaaatccgaaattggatttttcacggtcaagaattgcaaattcaagcagaaaaatcagagaagttgcatcatttttgggtaccttgaggttgaagatcctttgaagaacgaagtgaaccgcctcgcgaacatttttctcaggtgaattttgacccgactcgctgattcgacccgaagcagcgaggtaggggatgatctgtagggttctgggttttgcaacttcttatttagattttattatttttacttttttcgttgaaataaatatagattaaaagaaaaacaatagtatgtttaaaaaacccgaaaaataacatttttaacctttaatgtttaacgtgtcatttaacagcattttaatcttcaatataattttactaaacattataaaacattttgtaccttaaaactagttttcttgtttgtaccgccataaaaaaatgacggaaaataacatctactaacatgaaatagttaaattatatttgtttaattttaattttaattaatttaatttcaatttatctatttaagagattaggaatgccatctctcctaattaatactatgatacagagcaccatttattttcgggctaatcttaggtgatgaatattaaattgccatttttatatgtgattatgacctctttaattcatcttttctgatgtttttctttacggaaatctgtcattttttatagtgtcacaaacatgaaaactagttttaaagtttagaatgataataaaattattttgatggtttatagtgttttagtaaaatacagtaatatctacgtttaaagtgttaacactttgaaaattaaaaatatcacatttccacgaaaaaaacaatacaggttttttttccaggtataaatgattttaaatacgagttgttactaaatatttttattcccatgagatttgttatcttccggataaattcaaatctttgatcattgttagtaaaatcatcattttgttatataaaaaaaaaacaattagtgagaaacactttgggctatttgaaaaagccccagcatacaaaatttgttaaccattcagaacattccacgtaggaaaattagtggcatttgcacgcgccgttctactcgcgggagagaatgatgactgatcatctcttttaacaccgagccaccatcgtctcgacgctaaggagggaaaagaagagaacaaagcgtgagagagatagagataaatccggttctagaatcccggtttaaccgccataccggtggaagattctgctttactacgctctccgcttcttcttctcctcgattcgattctcctcatgggtttatcatgaatttttaggtgagaatttcgatttttgtaatttgatagtcttctctaggttggagcataattggcgttaggtttggtgattggtggattcagtttccattggtttttgataatttgtgctggcttttggccattgattctgctttttcagttttcttaatttgtgtgtggattatttgctatctgacagtattatcctctgctctcgcaatttggacttgaggaattttacattgatgaatttgattttcttaggttttgagtaattcagaaactcgagtg

SEQ ID NO: 13409 - DNA, 3000 bp, Unknown
  misc_feature (1)..( 3000): cDNA_ID_3029980_gDNA_ID_2214625_Annot_ID_187786 3000 nt of promoter + ATG
tcctcgagacttcatggtgaacaaagtcccgttccccttaccctctcctcagatcttcaacctggatcaaatcaatgcacttacaaccgatacacttgtatctgacaacggttagtcattattcatagaagtgaaatgagttattttccttgagttaattgagtctcactttttattgtacaacaatggctatttcagccttgaagtttcaggatctggaccttgtcccccataaattgaagggatatccggtcgagtttcttatccaatatcgcaagggtggtcctaacttcggttctactgtcagtgaaaagataccaacagacttctacccttgatgctgcttctctgctcaaaggtcatttcctggactaattttttcatgcaagtgtcacaatgagattgcggaaaccagatttgctatgttgatgactttcatttacttctgtcaataataaacgggtcctcctctttgttgtgttcttgaaaaaattataacacatcaacatcattataagttagagaggggacaatatatttcttgatgtggttggtcccttaggatttatgcaatgtctggttcgtttcgaactccatgtactacttcccttgagtaaaactaaagccatatgctttcatctttgcattacatatagctcggtgttgtatgttttacttacgacaaaacgtatcaacatgcatctgtatgcaatagaggttaaaccctgagtaatttgaagtttcctttacatggtcaagaaggtatttcgactccgttatctcccagtaatgaaacattgatgtccattaacccatcttgaggccttcggtatccttaatttaggggtgggtaaggaatctagtttatgcaaatcgtagaataattcactttgcttctggctatagaaaaagtaaagaactttagggaaccccaagaaccaagcaaagcatatagagcaaatatcatctctggagagacaggatagactcatttttgcagtctgtaccaaaatggaagatgacggagactatcccgaacccgaatctggcagtggtggaataaacttaaacgggagaaatgttggtgcggtgatggtggcgcctagggatgtagacatagcgagtcaaagtggttgcaggatcaatatctacgtgaacagcaatgttcaagcaacatgtggttcagctttgatcggtagcaaggttaagctaagagatcctggtgttcatctccatatagatgacgttaaaatgacccgcgacgataccatatctagacagaaggagatgaccttgattaaggttgggttatgtttggtctgtctttttaacatgtttctagtattcattctcttcctctcctcttggttccggaaggaaagtggttccgtatagatctccccatcaaccgatgatcatgctaagaagtaagaacgatctcgcctataattgtttcctcgatttagttatacttatctatgtcctaatttgtagattattccagaaagttcctatctataacagtcaaaaacacaccatatgttgtcttaattcatatcattccagattaaatcgaagattaatgctatagtccaatcatataaactatgtagtagtctagtgggacaaacgacgtgacgatatcaagagggtacaggattaaaagctatgaagtacgttaccaattacaatctcaagattctcaaccaccggattataactacaagtaccgatttggcgatttgacgaatacagatctatcaattagctagaaattttctttccatgcattttcccaccctcccattagatgatgatgattagaagaccacgatctcattggtgttcactgattcaagagcatttcaagagaatataattcttaattatgaatttgttcaataattaatccccaccccacttttccaaatcacccttacatgttcaccaattgtaacaaataattaaagaatcaaaagtgatttcttttttaatacttattgttgggaaatacttaatgctagtccataactctcttcaattatttaaaggaggagtaagtaagtttttttgcaagtccttttgtggtatccatgtgagttatacattggggagcacaaacttccccactcccacaagccacgtttgtcgcttaaagtttctaagtttttttaattttcgctctttttggtttgttatttatgagtgtatggaagtggagtctcccccttgaacacttcaacatttacactactaatcccgacttagacgacaaacattttttctaagttcgaatgtaattctcctaattcgctttgacctgtttttgaattttatactattcaattttaatttagatatttatctactttagacttgtagaaaattgttttcaatacgagcatatttattacctactatggaaccatttacggatttaccaccataaattagacaccagtattcatataaactatctctaattttgaatttaaacaaacgaaaacaaaacttaaatcttcaactggctaacaaaattttactcatcaataaaacaaagcagtgcattttgttttgcattctaatgtctcttttctcttattcgacctacatcaatagtttcatacaaacaaagtcattttggagcatttttggtctttgtttagacttaattatttatgtaattaggtttgcaaaaaggctagtcatctgctttatgcttactgtcaatccgtcatcattagttggacatcatgcacgagatttggtctcaacaaaaatattaacctatttctacacaacattcaaactaaggcagtcaaaacttatgtacttattgaaatactaattgattagcagagagacgttaaacaatgagcttgaacttgaagtaatcatgttacaacgtgttttggttcatgcttagtgcttaccatcaaattctgcgatttgtgttatttccaacgtatagcatgctacaaaccactcacatgattacac

SEQ ID NO: 13410 - DNA, 3000 bp, Unknown
  misc_feature (1)..( 3000): cDNA_ID_2702935_gDNA_ID_2214625_Annot_ID_187782 3000 nt of promoter + ATG
taagtctatgttgcatgaaaactctttccgcagtgcgtttcccatttctgaaacgtttcgaaaacgaaaactctcgcaaattagatgaaaacttacgaaaacgcgttttctaaaattctatgtttggaaatatgatggaaactcacgtttctgttttggaaatgcgaaaaatcttttttattttattttgggaacttaataatttaaaagtttggaaatattaagatttaactacttgtatgactcgagttttaacatctttctctcgacaaactagttttcaagtgctttctatgatttttgatggaactaatgtaaatgatggtctaaatatttgatattaagtcttttaatctttattttttagaattttagtttaaatatttgatatttattttttggattttgattgtttaaagtatatatatgtaccgggatgtacctcttattaaggatgtatttataattggattgacttctctctttttctttaatagaaatgtgaatatatatcatattaatgaaagttttttgatatacatattaaagaaagttgagggtttacaaaatagcttaaccaaacgtttgtaatcttgccaaaaataaaggtaaaagtcaagagatacaaggtattaggtgtgttgagtgtgaatcaacaagtgctaccggatccacaaaatcatcagacttcttaaacctacgatattcgatactccaatatgatttgttccatcagtaacatataatacatattttgatttgtttacgaccaatttgtcacgtgaattatggggtcctatatattttagacgtttgtagacaaaggaaaataattgaattgctgtcttttaacgtgcgttcaaaaattttaagaaccatcatcacattctcacgtcttccaacttaactgtgtcaatattacctaatgatttttgagccagtatggcgtttcttaagactttttaaaaaattacgcttcatataatttttagtttgattttcgcttaaaatggattaagtgttatttatttgtatatttgtatgatgcatttacatgcagatatgaaatgtttctcgatttaattcatattatctagatgtacaatagtaaatggatgcatttttgaaaaggaaatgaattttggtgcataattgacttaaaaagaaagaaaaacatagacacacaatcccacatgcatgcatatctcattttcgtctccttttatcgtttgatgttaccgaaccaacgtatttttgttccatgcaaattgcaattagagattgcggaatgagggaataagaaataacaaaattacatatatgtgatatgccactactgagtttaattttgctagttctcttttaacaaaagactgatcatttaatttccgttgagtttagttcatatttctaaaataaaattttatctttataaaaggaaaacagaagagaaactaggagaaaataacaaatgtaaactaagagaagtagagaatgaccatataccatatgacattatataatcatttggaccacgtgaaatgacatttctcttttcttaattatcttcagaaattgattttggacccctctctcttcgacttccaaaatcattttttatgatgaatgacttccaaaacattactagagctatctattcctcaatcttcatcatttttcctttgatcacatcagatcatagtaattaaactgcatcagataaaccgaattaatttcaccattccaattaagataacacaaatgttcgagaaataatataaacaacatacagtgagaatatgtcatttttataagaaagaaagcgtgtgtttttggcatgaaacatgtgaatgactcagtttttattgatatgtttcctagtggctatctttctctaaactatttttttccaactcactctcgtttaattacttaaaacaatgtgacgatccttgtagaaacctttttgacccttaatcaaattttctcaaaactcaatctttttgtgattaggtcgaaccattataaccgcatgaatatttagtggacaattcggatacgatgtgtcacggttgaattggccatcgaaaaatcaccctcagcactatctgacaaattacctcagaaattggtttggattcattgcgaaactcttcaatgtcatagttgactgagtcatagttaataatgtattttagaacatgagaaaaagattagaccaaaaaaaaaaaaaaaacatgagaaaaagatgcacaatctttctctaaaatcttacttttcacgtctcacacaaaacatttctcattacatttgattcaaaatttttatttattattaccgtagttgatgattcatagggtttaaacgcaacgagttcaattgtgagaatatggagaagtggacggttgcgaacttgccgtagactatcaagtgttttgaatgattagtaaaacataaataattattaaaattgagagattaaagtgtttgacaattaacatgaatatatatatatatatatatatgaattttattttgctcacgtgatttttttttactcggggaataaaccttaacaatctcaaagtaatttgaaacaatataaaacgttttttaaatgattgattttaaaccaaaatctgcaggagaaccaataagttgtatagttattgataaacgaattgggtggatacaataaatacctggagattctttttcattaattaaaaatatatatacaaaaaattgactaaaaatattttattttaaaaaaataaaaattgagggccctataaataagagatatccactcccactgaaacctcaaatcaatcagagagagagcttctgagacataaacatcaattcaaatcgacgcaagcaaagaaagcaaaatgtaagtcactgaagagtttggaattcccatttctgttcaattttcaattgagtttttgtgtttttctcttcagggaaaatggaagcgggaaggtgttgaagccg

SEQ ID NO: 13411 - DNA, 3000 bp, Unknown
  misc_feature (1)..( 3000): cDNA_ID_2702931_gDNA_ID_2214625_Annot_ID_187781 3000 nt of promoter + ATG
ggaagtcgaagagagaggggtccaaaatcaatttctgaagataattaagaaaagagaaatgtcatttcacgtggtccaaatgattatataatgtcatatggtatatggtcattctctacttctcttagtttacatttgttattttctcctagtttctcttctgttttccttttataaagataaaattttattttagaaatatgaactaaactcaacggaaattaaatgatcagtcttttgttaaaagagaactagcaaaattaaactcagtagtggcatatcacatatatgtaattttgttatttcttattccctcattccgcaatctctaattgcaatttgcatggaacaaaaatacgttggttcggtaacatcaaacgataaaaggagacgaaaatgagatatgcatgcatgtgggattgtgtgtctatgtttttctttctttttaagtcaattatgcaccaaaattcatttccttttcaaaaatgcatccatttactattgtacatctagataatatgaattaaatcgagaaacatttcatatctgcatgtaaatgcatcatacaaatatacaaataaataacacttaatccattttaagcgaaaatcaaactaaaaattatatgaagcgtaattttttaaaaagtcttaagaaacgccatactggctcaaaaatcattaggtaatattgacacagttaagttggaagacgtgagaatgtgatgatggttcttaaaatttttgaacgcacgttaaaagacagcaattcaattattttcctttgtctacaaacgtctaaaatatataggaccccataattcacgtgacaaattggtcgtaaacaaatcaaaatatgtattatatgttactgatggaacaaatcatattggagtatcgaatatcgtaggtttaagaagtctgatgattttgtggatccggtagcacttgttgattcacactcaacacacctaataccttgtatctcttgacttttacctttatttttggcaagattacaaacgtttggttaagctattttgtaaaccctcaactttctttaatatgtatatcaaaaaactttcattaatatgatatatattcacatttctattaaagaaaaagagagaagtcaatccaattataaatacatccttaataagaggtacatcccggtacatatatatactttaaacaatcaaaatccaaaaaataaatatcaaatatttaaactaaaattctaaaaaataaagattaaaagacttaatatcaaatatttagaccatcatttacattagttccatcaaaaatcatagaaagcacttgaaaactagtttgtcgagagaaagatgttaaaactcgagtcatacaagtagttaaatcttaatatttccaaacttttaaattattaagttcccaaaataaaataaaaaagatttttcgcatttccaaaacagaaacgtgagtttccatcatatttccaaacatagaattttagaaaacgcgttttcgtaagttttcatctaatttgcgagagttttcgttttcgaaacgtttcagaaatgggaaacgcactgcggaaagagttttcatgcaacatagacttaaacgcaaaatatgacagtttgttttagtttgttaatgataaacataaaagcaaaaaagaaaaaaaaatacaactttaccaatatcttctatttagttgaaatttaaggatctttgtactttttgtctacgtgcataacaatctgttttaaaaattgatgttatgtaaggaacctagctacttagctgttttcaccggatatttgagctaagattctacttagctgatatctcacttgacgcacaatatgattgtttgttttagtttgttaataatgataaacctaaaagcaaaaataaaataagaaaaaacataaataataatatcaactttaccaatatcttctaatattatttgaaatttaaggatctttgtacttgttgtttacgtgcctaaaaatctgttttgaaaattgatgttatgtaaggaaatcgccacaaactccacatagtacaaaccaaaataaccagaatacacttgtaacagcaaaactaaaacataagtaagaggaacatgtgacaccaccagctccaatattggttagattggcagacaaatgatattttaaaatgtataaaatcatattgaatatttctaaacaatatattttttttcgttaagcacttaaacctagctagttagctgttttcaccaaatatttgagctagattctacaaatatgcaaaaccaatgccatgtattatggccttatggttaaagtcatctcaagcatgtatcgattggttagagcatatgacctaagagagaagcctcaactttgatacatttatcgaccagctatttgttatatttattgttttatgtgcgagggacaaaattagatcggtccaaacacataccactcacactaactctgcaaatatctgtctttataaacctatgacccttaagatttgcatttcgacatctcgcggcgacgacaaagtgtatcgctataaatataacacagcattccccttagttgaaagtcgaactgtataaaatgttagcattccctttagttgacagttgaacagtatattctcaaaatcatgacactttgtctcttatttcacccgagagaaatcacaatttgcaccgaaataaatactctcgtaggtgaaaaaaatgaaaaataactcaagcaaagggacataaatgggcctttatgttgaagcccaatttaaaatttaggttttagaagaagaaaactttatttactaaggcagttagggcttatatgtttaggcccaatattgttgtgtcttatggacttaaccgccacaatcttttgtcgccggtaacagcaacgggaattttcatggcggcgaggtcaccggacgttatataatttgtatcccaaatcaaaattctgagaaggaagagaaagcaatg

SEQ ID NO: 13412 - DNA, 3000 bp, Unknown
  misc_feature (1)..( 3000): cDNA_ID_3029991_gDNA_ID_2214625_Annot_ID_187780 3000 nt of promoter + ATG
aatattcaaccgttgggtttggtaaagccacattcaaagtcaattccaaattttcaacgcttacaagtttaggacctgaacttttagtttttcatatattggttaaagacttttaatttcttttaattttatccataacttctacaaagtcaaatctcgtaatcaacattaacgttcgttaatactatgaggtaatcaagtataagattcatttaaattattccggaatccgagtcatccgatattatgctagacctgttcttttcgtaaattaaatatctttgacttatagatcttgtaagtacttgatcctaaacaaattattgattgctaaaagtgtatattgtgcaatcaaaatatttttaaggtacatcgtgatataattgctataattctcttaccactatatttgtttcctggatggtttttccttaagtagtagcatttacaaaactgaataaaagtagctagttaactttaagcaaaatataaatataatgattcgaacaaaatataatttatttgatattttgtagcttggcttaacattttaaaacttgaattggaaagtaatggaaacaagctaaaaagacatttcatggatgattttgtaatatttttttgattaaatgttagtagattcatacctaataaagtattttctttatattgtcattttttaatctaatgttcttcaaagataatgattatagatttagataatagataattgcccgtatatatgtagattttatatatatatatatatgataaaaaaaattgaattgacattaataacagtgaactaaaaaccataattttgaccaagatttatagcttaataaattgtcttactattatcgttgatgtatcacaatccttggtttaaaatccagatatgattgaatgttgtcaataataaaataaaaaaaggtcttagggggtgttattggtttatgattttaaaagagttttagtgacttaaaatgtcatgtacaatcagttgttattcaatcaagattctttatttagatattacgttgtgaaatccacatataacaatgttgtcaaagttttagagtttcttctttaaaatttgattaggtgaataacattacatataagtaatgaaggaaatgtttgttttgtttcaggaccttaagatgtgagcaccgctggtaacgaactagcggatattacaatttgttttcatatagaaaaatggctagaaaagaagaaccacacaccttaaaatgcaatgatgaaaattgtggcagcatggtcatatgtgttaaaatgcaatgatcataatgggacataacactatgttgttgtatcatgaatcaaggagaacaaagtttttagctaaactcagcaaaattgctacttttaaacttgactagagcgaagttgagaattactactaaaaagtttctgaagattaaataggcaaagaaattacagagacaaataaataaagagagtaatagcttggaagtgaaatttataattcttttgagttataagtcaaacgaatatatatgtttatgagttcaaagctactaaaaaagacaatatatatttttaattctttttttgctaattacactatagcgatgaaatctttggtaagggccttagaagttcacgatttaagaattacatcgattaaagtcaaatttcttgcatccctactcaattttgataacatttgtggtaagattttggaaaggattatttgaaagataaaactgaaacttcatttagttaaacttagcgatgaagtcaacgattaagggtttgtaagaacagatagtgcaccaaactcataattatgcatagagctagaacttggaaacaaatctgatgatcgaaaatcagataaatgaagtttctgctccctcttcataattaaagttgctatttaggtattatagtttcaaatatttttgcatatataaaatacgtccattcaaagacatgcaccataacatgcaaaagtaacataatggagaaaatagtaacatatgttgttattataccatttttgaaattgttaataagcttttcatattttctactattttttaaataacgaatcttggcaaaataaatgagagattattttaaatgactacataagaataccagatttgctattcctttttggtaattgtgtgggaatgaaagtaatgaagtttaaattagacaaaacaagtcaaattaatcaacaattttggttgtatttgctcataacatgaagaccacgtttagtagagttaaaggaaaaaaaacgtgagaggttaaaaagacaaataaaaaaagataaaaagctgttcttctcctggtctcaagtataacctcccctttttcgtataattctatttttagtacaaactttatttatctgtctttttcacccctcccagagaagaagattcaattccacttttgttgttgtttgttccaatttgtgttttgtaatcttcttctctccctaatcttcttcaccgcgcattcatttccttccctccataatccaagcttccgttacaagctctctctctcttcttcctctttttcgtgtttgaattttcctgaaattaaaaaacaaaatctctcaggagcattattgattttgctggaggatttgaaaggtatctaattcttaaattctgtgatcatcttcttttgattcgcataggctggtgtttagctggaaccttgaattcgttcttaccaaaaaaaaattgaattttcttatgatttcaaactcttctaaaaaaattagggtttcgttataaataaaggattggtgattcgatgatcgtaggattgtgttgataatattgctttgtttttgattagattgttgatgtgtttttttttgtgtgtgtgttttaggagagattttgttggtgtgttagttgtttgattttggctgatgttgtgtgagggaggaggaggaagtggtgtatgaagccgagctttaatacggat

SEQ ID NO: 13413 - DNA, 3000 bp, Unknown
  misc_feature (1)..( 3000): cDNA_ID_3029995_gDNA_ID_2214625_Annot_ID_187779 3000 nt of promoter + ATG
tgaatggacgtattttatatatgcaaaaatatttgaaactataatacctaaatagcaactttaattatgaagagggagcagaaacttcatttatctgattttcgatcatcagatttgtttccaagttctagctctatgcataattatgagtttggtgcactatctgttcttacaaacccttaatcgttgacttcatcgctaagtttaactaaatgaagtttcagttttatctttcaaataatcctttccaaaatcttaccacaaatgttatcaaaattgagtagggatgcaagaaatttgactttaatcgatgtaattcttaaatcgtgaacttctaaggcccttaccaaagatttcatcgctatagtgtaattagcaaaaaaagaattaaaaatatatattgtcttttttagtagctttgaactcataaacatatatattcgtttgacttataactcaaaagaattataaatttcacttccaagctattactctctttatttatttgtctctgtaatttctttgcctatttaatcttcagaaactttttagtagtaattctcaacttcgctctagtcaagtttaaaagtagcaattttgctgagtttagctaaaaactttgttctccttgattcatgatacaacaacatagtgttatgtcccattatgatcattgcattttaacacatatgaccatgctgccacaattttcatcattgcattttaaggtgtgtggttcttcttttctagccatttttctatatgaaaacaaattgtaatatccgctagttcgttaccagcggtgctcacatcttaaggtcctgaaacaaaacaaacatttccttcattacttatatgtaatgttattcacctaatcaaattttaaagaagaaactctaaaactttgacaacattgttatatgtggatttcacaacgtaatatctaaataaagaatcttgattgaataacaactgattgtacatgacattttaagtcactaaaactcttttaaaatcataaaccaataacaccccctaagacctttttttattttattattgacaacattcaatcatatctggattttaaaccaaggattgtgatacatcaacgataatagtaagacaatttattaagctataaatcttggtcaaaattatggtttttagttcactgttattaatgtcaattcaattttttttatcatatatatatatatataaaatctacatatatacgggcaattatctattatctaaatctataatcattatctttgaagaacattagattaaaaaatgacaatataaagaaaatactttattaggtatgaatctactaacatttaatcaaaaaaatattacaaaatcatccatgaaatgtctttttagcttgtttccattactttccaattcaagttttaaaatgttaagccaagctacaaaatatcaaataaattatattttgttcgaatcattatatttatattttgcttaaagttaactagctacttttattcagttttgtaaatgctactacttaaggaaaaaccatccaggaaacaaatatagtggtaagagaattatagcaattatatcacgatgtaccttaaaaatattttgattgcacaatatacacttttagcaatcaataatttgtttaggatcaagtacttacaagatctataagtcaaagatatttaatttacgaaaagaacaggtctagcataatatcggatgactcggattccggaataatttaaatgaatcttatacttgattacctcatagtattaacgaacgttaatgttgattacgagatttgactttgtagaagttatggataaaattaaaagaaattaaaagtctttaaccaatatatgaaaaactaaaagttcaggtcctaaacttgtaagcgttgaaaatttggaattgactttgaatgtggctttaccaaacccaacggttgaatattgttttaaatgtctctctcacgcgctacattcttccttctatctcagccgttcgatttgactcttacgagatctctttgacttgaataaaaaataatcattaatgttaattttgttcttaaatgcaatacattatgtattattcgtccgattgttaacaataatgaaaaagtttagtaaaaaaaatcgttaacaatactaatatagctatacgaaataaaaaatattaatacagaaagttgaaaatatatatcgccagtttttaccaattttggtactggttttatgattgaaataataacacttataccaccactatggtacgaattactaatcaagttgaaacaaatatcaacaaatttatataataataaaaaaaacttatcaacaaattctagggtttgattttcatgaaaatattgttagaacgtgcacataacacgctaaacgttggatattaataaggagatgcggaagctgaggcattgataccgtgaagtgaaggaccccctaggccgcacatgcactttgtgtcttgggaattgtattgcttacataaatatttcatccgtttccttacaacaaattacgagttttcctaaaagttgttttctgaagcaaagaaaatgatttgttttaatattgtttttacataaaaggttgggaagaatttgatcatcaaaccaaacaaatgaacaatcaatgaaaaacatataaatccatcaatttctataatcagcccagattcttttgagttgaggcccattaggcccatattcatcatatacccgttcaaaactcgtcatttcatcgtcaccaccaccagtacaacatccgctttttgattccaaaccaaaccctaatttctcagctcgaagtttccatttcattgcttcttcttacctcgatttttcccgggtattagaattcggtcaatttactgaattatagtgttctcacatgccaactgattctacttcaaaatcgctgcgaatttctgcgatcagttacgaaaattttgtcaatg

SEQ ID NO: 13414 - DNA, 3000 bp, Unknown
  misc_feature (1)..( 3000): cDNA_ID_3029999_gDNA_ID_2214625_Annot_ID_187778 3000 nt of promoter + ATG
gttacaaaaaatggattgtaccgaagacaaaacctcatgagtcacttaagtagagagagaaaccaactgagccaacatatcattccgagttttgttttttgtgtctaaaccataatttcatgtttgtgttgtgtgaaagccatggaagccggcgggagcaaaaccaagaaatgagttgcttgctacaagaggtacaattcttatagagaatatgtttttcacatcaagattgcgttccattcgattcatcagccttagtgtggggtttgcttcaaacattgtaaatcattcgaatctgttcgagaacaccttcacggtatggcttgagcttatatgatcttcttgttctctgtttttttgttgggttggtgtttgattgatgattattttgaacaatgtcagttccgaaccatccctctcgaccattcaaagaaaaatgcaaaaccattttcgctgaaaaagggtgtgaactttgtcttcaagtctttgtggaagccactgctagggatgagcatatgaaagagtgtctcatgtcttcaccacctcctatccaaaatgcttctagtgcaagtggcacacgcgtgatgagtctgtgcatatctaattttagaaaaaactattttgactctagtggatacaaagatgtttttaacattatacactgttaaaattgagtttttttcaatgactttatcgaaaacatattgcgttctataatattaatcaaagataaaatcctaataaaacgtaaatatataacaatttctttttttaatgaatagtctataacttttcttaaaatataagactagtatgtatcatgctcataagatggaaataaaaacatgttaaaatattaaagaaattataaactgaattggctttagtggttatttaaatttcaattaaatttatttgatttaaaaaaaaagaaaatcttctaaattaaattggctttaacggttatttaaattttgattgactcaattcatctacaattattttttaagaaattttataatttacaattttttttttttgcctagccgtatcggttagggtcatgttgatctttaaaatataaatttttatttgtacggaccgagatcaaatatatgcgggttttgcagactaacccaattgacatgcatatttgttccaataattatgtttgttctttggatcttctaaacttaatcacttagtataataataaagaccaagcagaaacaaaatttatagcaaaaataaaacaagaatgattgaaaaaaacaatagcaatttaaacaaaccacaaaagttttgttctttcatcccaatacataaaaatctatcaaaaagtgaaactaacaccggctttttcagtttcactattgttttctaatcatatagcagcaaaagatataaatataaaccatgttcaccggcaagtaacatcgacacatggaagtgacaaaaaaaattgtaataattattgcttaagtctcaagtatgtggtgaaggtgtcgcttaatcacttaatttttttgttgtatttgatttatcttcgtattgtttacggaaaaaaaaaagaagcctttgttcaaaaaaaaaaaaaaaaaaatgccaaaaaaatctcacatgtaatttcgattaaataaacaaatgaacacaaagtttacaattcaaaaggacctcaccacagttgttgacttgttgtaatatgtttttctaatttcgtgtacatattattagtataaaacgtggaaggtttatgtaggcaagtggtttaagttaaaccaccaattaaccagacactttggcacctgatgttcaatctctttcaataatcgaatccaaatgtatggcttactaactttctgagtaggtgtagagaaaccatatttataaataaaactattatataagacactatttatgaattttcattttcgaaatcaaaagacaaactttctaaaaagttaaataaatttaaggcacatagtatttttttttttaattagtaaagaaaaatctaactcaatttaatgctaataaagtagaaaattaacaaagcaccttaatactattaatcttaaaattaactattttcactattattaacatatatttttaaataacttgagtgttttagctatcatatactataaatcatgaatagattataatatattcttataaaataaatgatctaatattaactcaatttctttctaacatatattttctaatatttaacatttccattaaatcaagtcacattttatcatttcataggttcactgagattttttactaaaaaattaatgacataaagaaaatttcacttctgaataagcatttagaaatgtctaattagtttaattaaaatgatgtgaatatgacgtttcacataagagtttagagacaataacttgataagttagagtgtataagggaaaagttatcaactttaagtaaaagaagcaaaagatggaaaaaacaaaagaatttgataatttcgtctttgttaaatttggattttcccattttatctctagaaaataacaaaagtgattagaatcagaataggtatttttggaatttactgttaattaatactaaattacccttttaatatttttttggtagtaaattaccctttaattactttactctagaaagactaatttattcacagaagtagaaaaagagaagaaattaaaagaaaacagcaaaaaataggtgaaaactatataagaggaagagaagatttatgatttcttcattagcaatttgttttgttgtcaaagggttttaatttaaaagcttttcacacatacatatatctctcaactctctctataagatacaaatctctttctctgagaatcctattatttgcattcacactctgagtcacattgaacttcgtctctagctcaagcaagtgaatgattctttgttgctacaggaatctatctcttgggtttctgatttgattcatctccggtgaaaatg

SEQ ID NO: 13415 - DNA, 3000 bp, Unknown
  misc_feature (1)..( 3000): cDNA_ID_1022296_gDNA_ID_2214625_Annot_ID_187775 3000 nt of promoter + ATG
atctcaaccatataatcagtctatgtcggtttgaatcatatcattcatctatcttcttcaatcaattcatcagtaatgtagttcggacaagatctaaaatcatcgatacctatgtcttctaacataaatgtgttacttaaaggaatgcagaacaacgacatgccacacaatcttcaaaaatcagtgtgagtaagtaagagtgatgctgacctgtggcaaccaatcggttcgagtagttcttcttttgctgccttaagctcatagccattctatgaatcaatccaaacttgaggtgactgaaactgaaaggggatccaatcatgagacttaaaacgattactcgttgtaggacttgacgcttccaacaaatttgaattgctgatgctggaaaatggaaaggatactatgtcacatccagggactttaaaaggacaatgatccactagagagtttgaaagattacgataatatgtgtaatctctggttaaacaatctgagctgtttgtgtgatgaaatgtctggagctcttggtttgcagcaaccacgtcttcgtcatcaataatatacctctcgagttcatcatgctcaaaatggctggcttggttcgttgttggtaagaggaaactgcctgaaatggaatgagagagcagaggtaaagggtacagctcccttgtaaccaaatcatgggatgaagaatagtcagagcaccatggattgtctgtcaaagatgaggatgatgcatttggatacgtgatgagtcttgtgtgataactaagtggaaaatcatctgtctttctggtgcttgcggtttcagtattccactcgagaagtaatgcagatgaaggctctctatgttcgtgtgataagtcctctgtgctgtatccaatttctcctctgtgataatccattgaaaaaggcttgtagtttctgaaatggaggctagatatgggagaacactccaaattttcttcaacaggaaacgacaggaactccttctgtttcaacagtggaggtcgataaactgattccttaggatataagatgggaaagctaatctcttcggaatctcttgggatgaaactgctctgaacgtgaggatactgcagcctcggggtaatgttattttccagccatccctgccaagatatcaatctctccctttccatatgcagactgtggtcaacttctgcatagctttcatgggacctcttaagaaactttgagccaggagattcaacaaacgttcttcttttgactctggccgtcgtctccttggaaaacctagaaggctgagaaggaaaaaaaagtgctgaggattgatcaagataagcaattgacaaatactcagggattctatcaagcttacctgtgtctcctccgtaccaggggacagccgagttaggagaacagaaactaaatcatgcctgaaaaatgattattttctgagtgcattatagaaacaagtattaagattaggataaattaacaactattgtgtacccgtttgaggtaagctcagggatttcagtaagccatgtatctttgacccactgatgcagtttctttctcttcacagagaatatatctcctttctcttcactgattcctgataattcaaactacaaaatcatatctcttaattgttaactagtatcttttgcttctttgatatgtaagaagtagaatatccaacatctacctccactttcagatctcagattgtcaccacttggaactgtgtacctatctctactgaatgatgaagaagatctcccattacattttcctataaacaacagaaatcagaagaatgtttatggatcactacttccaaaataccagtaagagattctacagaagtatccggataagagacacgagatcttatcatgtggcacaaacatgcaccaagaaatcgaagtagcaacctctatccctttgagtcaagttggcatgtaacatagacgacccacgtctggcactatgaatgggtgtggagaagctatagctcttggatctaccattatcgtcgcagtccgttcctgcacatcctggtttatgaaacagtatagatgaaaatccaggggaaagccaagcaaacactatcatcatcatcatcacaaagaaaagctcaaaaacctttgtctggtttggctctggattcgaaggttttaggaatttgttgaactttatttgatggtttagaatcagaagattcagagcagtgaccaaaattagactttaacttcttaaagaatgcaaactcagaggtcttggcatcaatcgctgcaaataaccaataccaggcgattttcaatcaaattcaacattctaagaaactctacgcttattcacgtgaagtagacgcgaacacttacatcctccggcctgagattcgttcaagggactccgatgatcagcatcgtcgaaactcacccttctcctgcgtttcaaatctaaaccaccagaaggaaacaaaattaaaacacacacacaaactcacggaaatcgaaatatatgttgtaagatacctgaatttgctcgagcgctcgaaggatcagtaaacttgaatccgatttgtggatcggtcttatttagggtttcgccagctttcgttcgctgattccttcttctcatcaccgagtatctgaattcgttctacagaatcgtggatcaaacgctgttataatcacgaaggcgatgaagaatgagagatttcacatcacgcgtccatggcgattcataagaatttgaaatcggagaagatgagaaatgaattttggcggcaaaatcaatcaacccttattacagattctttgctctaattatatatttcattttctaaggttgccacgtcatcacattatccagacgatactgatatgtgatcacacgtgtcatatcacaagtggtttaaaacgattccttttaaccccaaacaatctaaagctttgtccaccttttcggatcactcacacaacttccaacgatcacacacaa

SEQ ID NO: 13416 - DNA, 3000 bp, Unknown
  misc_feature (1)..( 3000): cDNA_ID_2702916_gDNA_ID_2214625_Annot_ID_187773 3000 nt of promoter + ATG
gtacagcaagaacagctagtctcccttaacccaacttcgtgtgaatgtaccacactattaccatcttctcttttgctgacatcttcctggcccaaattagttagttagtatttatttcttatagttatatactcttaattttcataaatacaaacatctataaccaaaaactaacatttagtttttcactagagggacacaaaattgggtcaaaaaagttagcttgtacttaatgcaacggaaccgaaattctaagaactggttgaatagttgaaagtttgatggccgtttgggttataaaagccggttcatgatgtgaaagtctaaccagagaaacgagaattgaagcgtggagatgtatccacgttgtctacattgatacaaactaacaattggaaaaagttttcttttcggaatgttttcaccctttaaagtgtttgtagatactagataggatattcattaaaaaaaattgtagatatgacatgacatcgtattttatggcatgcataagcaatattggtatgttaacatgtttaaactactactattattgtgaacctatttgtctgtaagactgtaactagtacactaacccaattactagataagtactaattaaagtacaatagtagaaccacaatgtaattttcttataaaaaaacaaatcaaccatacattctttcttttctaagaaaatcatctttatgaacggaattataattaaatggaatttggacatccaaccaaacatattaaaaacggagtctagcatatcaattatagacaactgagatgtgtttacaaacatattagttataattatatataggtgagacaatttaatgaaaaggataaaattatccaaaatgctcaaaactcactcttgtccttttggaccaaaaaaacttattctttacttaattggttttcctaaattttgatcattgggtgcaaattatcgcatcaacatattatatttattattatttagtttaatttaattatgaatttaaatcatgcattaattactgcttatataataatttgatatgttttaacttattaattaaatagtttcaatgtaattagttacaaagtatatcaaactcatatataaattaacttgtttaaatttggtttaataagttgtataaacataaaatcaatggaatatttattaaatttttgattttttaaagtataaaaaaattaaataatatgatattagaatttatttcatgttttcatatactataatatatataggattagtgacaataaatattagttgaatataagatctattttaagcaaaatataagatattaaatcaacactacttttcgtttacttaaaaatactttaaagttaaaaacatatatttttacgataagtatttgtaaataagtgttaaataatataattaaaacttacaaaaaaaacaaaaatagagtgaatcatttactcgagaattagagaaatacatcaaaataataattagaaaaaaaatcaaaaattgtttatcagttcaatcgatataaattattataactcacaaattatggacgaataaatctgtaggttgtgttggcctagttactctaaaacttgtagaaatgctcggttactaaatgtcaaaacaaacaatttaaaatattgcatctcattatctcaatgtggttagttttttggaaggtttcatttggacaagaaaaaaagacactaagagaataagttagttggtccatttaagatattcctggtcccaattctattgggtatatgaaattacatattagagtagatgatcattattcttttatacttgcttgcatatatatgataaaacatataacatgctattgtattatcgattcttggatcatttattagcaactgtgatatttcatataatgccatataaatctatttttagcttgtaagttgtaacagaaaatcaaatatttgaaactttttccttattttcattgttaatacagtttcaaccaactacacagttttatttatttcccgcaacttaacaataaatattaatggttgatatgttaatcgttaacataatacagtttatctcgtggatttttttttaattattttttttttggtgcagaaaatacagtttattatagacataatttaatcgatttagttaaaaaaaagtggttaaatctattgatagaatggttgagaaaaagagagtaaagaagaattataaatttataattgcagtaatgaaagtggaatacgtaaaaaaaataaggttatgtgatcatatcaaattttggtgaaatgcattcacttcctaaatcctaattccatcttcaagttgagacaaaccatgaaatatggcaacaggaaaagtaatgtacttcaaccatatatgattatatatgatataattttgtccatcattagctcatttacaaactttaatgaaaagaaagattttactaaacattttttttgtgtgatatatataaaaatattagtcatttgcagttttttccctctattaataaaaaagcccttttggtatcagaagacgacgtcatccccttaaaaagctcttcctgttagattcacataaatcttctccggccaaagctatttctccgacgacgtcagagcttgacaatgtttctaaatctagctacctactaacagagtaagttgtctctctctatctcttgctctttctcactgagtaaagtagaaaatgtctgacttatagctccgatctcattttccgatactttttccgttttcctcgttgccggaatctgatctctgttctatttatctccaaataagcttattttttttgtcaatttgcttcgttacatatatttagcaagattcgttacccattcacgagctcattgttcaatttcatggttttcgaaaatgcagaatcagtgagagtggatctgatgctgtagctgaattgagaagaagcttttcattgaggttgttatg

SEQ ID NO: 13417 - DNA, 3000 bp, Unknown
  misc_feature (1)..( 3000): cDNA_ID_1397500_gDNA_ID_2214625_Annot_ID_187772 3000 nt of promoter + ATG
cttaagttgagcttgcacagggactgtaaagactttccagatgacagagaaccaacaacagatttgcagctaaaagtagaaagccatcctgaaatctatatagcatgtgtaggtcagccatgaaatgcaagccatacatcaatttgaacaggaagaaccacggtggtacccacattgttttcagagaggtcaagggatgaaaggttggaagaagaatcaagaagtgtagagaaaaccatcctcgcaaaatatctatcgaggttgctatcgccaaaatgtaaggaatgtaaggtcctgaaagaaaaaagatgctcactaaaagtaaaatgaagaaagaagtacataataataatattacaacatttatgaagagactttgatagccaaatgagcaaacatttaacaagacacgttttggcatcagtccatatatatacctcaccgacatcaggaatgaaacgaaagcggaaggcgcagcaagtggatctatctcaatgctagatgtctttatacagaaacgttgcatcccagttgtgtggatacccttttcatgaagagaagtgcatattgcactgatggaactcaaagaaagcttgcagtgaataagttcaagcgaagttaatgtttctcggctctgaatcaagagcttgcacaagggctcaacctggagttcatggaacatcagcaataaaattccagctaactaaatctaggagactaaatagagaaagcgtcttacatgcttctcggatctgatccaacgtagaaccaaacttcgcaatttacttgtcctcaataactcctacagtaacaaagcctaaagattatttctgtcctccctctagaggttgaatgattgattcatcaacaaagatacaaatttgaagttctaagagagagataaacatcgaaagcaatacaacatatcacggcgatcagtggatactgaaacaaaaataaaacaaagatgactctatttacaaacacagaaacacatcaaaacgtcagagcatagtttaattacttacagaagtttctgtaacgcatagcacattcagaagcctcagacacctgcaacaggtaagaatgaacgcaaagaagcataagtatgttagagcattaaatcagtccaaaccagatatctcacgcacaaccagttatgagcgatataaaagtaaggcaagctgaaagtagtacagtgtatccgtatatacaaggaaaacgtgaggctatgaaacgattaataatcagacacacatgaaatgttactcaacctaagatatggtccaaaagtttggaaatgaaaagatagttccttgcagacacaattttgacaagtcatgatgtgctcttcatggcaaatgtatctcaatatgttatctgcaatagaaaaatacaacaaaaaaactgaataatgattattacacaactgaaaaaatcaaacccaagaatttcattggaacacataccagatacattaatggaacaaatccgaccactaaatgtcggacgcagagctacctcagctgcttcatcaacacaactgttactcggataaagatacaactcaaaaggaagttacataagcaataaaaaacaaatcatcgatcatttcaatagaattggcatacttttggagatgcttttcccagtaaagctgttgccaatcagctggtgattccacacggtcaacaaaatcaggccaccgcagcttaaacaacaacttccaagagctaccaagtacatcatttctgcagatgaatttaagttaaatctttctcagtctgtcttctcaattcgaataacaaaacagaaatcaaaagaagaattcatcaaaccttgcacgttttctcccagtaatcaagcagcaatcatctccagattcataactatccaagcaatgaaacggcctataccaatagaaaaatgtaaatgaaataagagttgtatcatcttcatccatataattcgtaaccctaactaaacctttcaatttgtattcaaaacttaaatgaaaccaaagagtgtactgacatgttggtctgaaacttctgcaaagcaagagcaggcaagtgagcgacaatgccatcaagtaactccgatggaagctcgtataaatctggaattggattatcgcctggaattacacaaaacccaaactcaaattcagcatattttggaatcaaattggcgcaacaaaagctttgttagaattactttctagaagctgaattttgagggattggatgcagagaaacgcaagagaaggagctttcgtcatccaaacaaagagaagagagtgccaatcgcaacgcaaccaaaacttcccgctgcagctgctctcggctcgctgtttctttcttccaaagagggaagagcaaataattcgttatgaggtctctttcataatgggccgcttagtatggcccaattcataattattcatagataattaaatctttttgtgaccagtaaaaaaacaattaaagttttaaaaactttgtttaaaaaaacatattttcatgagtagtgtaaattattttaaaaagaaatggaattataaggaaattttaatcaacaataattttataatggaatttaaatgttttttttatataaaaaaaaactaattgtgagcattgccatccaaaaataaatggtaaatttatttgtaattaaaaatagaagaaatatcaggatcatataaatcattaaacacatgcagccaaaaacataataagtgtacaaataaaattttaaaacagttccaaaaagcatcagataagagcgaaacaaattacaaaattgaattacacaataatgtcctctaagcgacgactaccggtgaaatattttataagaaaacaaaaacaataattaacaaacaaaggcgacacctttagattcgacaagacgaccattttagaaaaagcttctcaaattctctccttatccccaaaaattcaaacttttttctctttggaaaattctgaggcaaaa

SEQ ID NO: 13418 - DNA, 3000 bp, Unknown
  misc_feature (1)..( 3000): cDNA_ID_3030010_gDNA_ID_2214625_Annot_ID_187769 3000 nt of promoter + ATG
ccatttgctgtttttttgtgtgtaactaaacgcataatgattgtgttcaggtgatctcaaacgtcttgacatgactgggaatagttgcatcagccacgaagctgaccattcttctctactccatgaatttcaacacaacggagaacccatcttcgttttaccttcatcctcggtttcacatgttccttacgatgatgacccgtagatagttcctatataccggtttatccttcagtctggaactgtttactggtgaattcattggttgtgtatgtgcattaggttggttcaacgttcacatgaaatagcatcccaaaacatcttaaaccgtcgcctaaaaaaatagtcagagagcagtggtttaaatcttaaaatagagaatgaggagatgtggtcttatttcatttcttattaaaactcgatgagtagaaattgctaatacataatttggatatttcaacttttaatttcaacatatattgaagaaatgaaaatatttcaaagtagaaatcacaaatgggattcatgaggcaccacaggcggacaatggtagacgcaagtacattctccaccaggactagtactagtactgtagtcgcagaagccattagccctatctccaaacgtagctctgcatgtggcactacagcttttatccttttcgcatggtcccatagtcgctgtgcatcccatattttgctcaactacatccaacaaaaccatttaaactacaacatttgagatgttatacctagacactatatatgtgaaagcttttgaaaattcctaagtgtagaccttaagatgtaaatgtatacgtgagacaaatgttatcgaggaactacggtaagcggggaatatgacaagaatagagagaaatgtatacctaaggcaaacataacaaggaagatgattgagagaacaagtgtagaagatgcctttgccatatttctttgcttccttctcttaatattttactaacagtaaaccttttaacacataaacaaaaatcactaatagtgcttttatttgttagacctataacaatatttataaagaattgtgaggtgaccaatttcagaaagaaatataattatttaccatttgaccacaaatattgtttgactttaatttatcaatataggaagttcactcatatcatgttgaatatgctagtttggtatgttattagagtctaggataaacataaactttaccctctgtcacctatcgattcaaatctaatctgttagtagagtcttaattcttttattttcataaatttgtctttttattgcctaatccaattgtaagtgactttgtaatcagcatcaaagtaaatgattgtattttgggaagtgataagcacatagaagtaaaagaagaaaaaaaggtgggaaagtttttaagcatgattacttgtcaattacgctccgactctttggcccgcaccagctgtttaagatcgccggcgtgacaagtgacaacaattggccacgtgtgtgtgatttattatcttaagtttttgttatttctctgcgaattttaaagaaaattttgaactttgatcaaacttgtatgaattagaggggatgcaaaaataaatacacattatacaaacgagatggtatgaaggataacaaaaaaaaaaaagatggtatgaagaccaaaatatattaagcatttgattaaactccgatcagctgacatattaacatgatcaaaggttaatgtttagacaaaaggcttttattagttgagaatggtcttatctaattaaacaccacattcgtgtttataaataatcaaatctaatgaaccgacgtcgggtattatatcttatcagtggagtgatctaattaaactaatttcacaataactgattgattcgaatttagagttattttataacatatcttatttaagatagtcttttaaaattccaatgactagaaattaaatattcgtaatttggatttattccagctttgttaggttggtgatagacatagttaagattttcttttctttttaatttaatgttatttaatgaaataaacattctcttgattttaatttaaagaaatttatttgtattgtttctctaaagaatttaccaaccagagtggaggcattttttatcctatgttttgtccagatttggtgagatatttactttttctttcggtttgatccaatttctaatcaaaatacgtatgagtagagcaacttttagtttattttagtaaaattcactacatttttgttactatatgatgtggttcgactgcaccaatccgagttatccaaattagacactgatttttttttctcaaacatatgtaggtcgataaaatcaaaaaatttatttgttttactccaaattaataccacattctttaacaaaaaaaaaagaaattttaaatttcaaattaatagctcctcaataaattaataattaagaattttatcttcatatatttcaaaagaacaattgctaaaactcctgtaattcactttattattttgttaataacccaaccggattaaaccaacccctccgaatcggaaccggcggttaagttcagagaccataacataatagtggtatgaaacagtaaatattaagaaaaacaagggcaagtaccaaagacgccagccaaccacatgctctcgtttatcttcttcaaaatgagtttagtctctctactagtctctcgcctttactcttttctttcttagtactaaaaattaaacgacacttctcccctcaaatccctttttctctctctaaacacatttacacacagaacacaacacactctctctctctctctctctctacgattctcgctcactgttcatcgaatccgtcattggatcgattcgaatttggtgtgtgttttctttccaatacctctgattagagatttcagcagatctgaacggaggagcgtcagatcggaatcgtccgtcggtggtttggtaaaaaaaaaaatg

SEQ ID NO: 13419 - DNA, 3000 bp, Unknown; identical to SEQ ID NO: 13416
  misc_feature (1)..( 3000): cDNA_ID_2702916_gDNA_ID_2214625_Annot_ID_135946 3000 nt of promoter + ATG

SEQ ID NO: 13420 - DNA, 3000 bp, Unknown
  misc_feature (1)..( 3000): cDNA_ID_2713666_gDNA_ID_2214625_Annot_ID_135947 3000 nt of promoter + ATG
tcgtctggatcgacattggaggagactgttaaaacgactgtggcagagaaccctgtcgttgtttactccaaaacctggtgctcgtaggttcactatactttttggttcaattagaggaatgggttttgttaatttatgatctagtttgtcaatattgatacttttactgggtttgttctttttggtggtgaagatactcgtctcaagtgaagtccttgttcaagagtcttcaagttgagccactggttgttgaattggatcaacttggtatgctcaattctttactttggtttgctatatgggtctgagtagtttgctatattggttttgataatgtgtgtgatattgtttatatcgatcaaggaagagctggttacaagtgccctaatgtttcagcattttgactggatgaaattaatacttgtttccaacttcttcttgtttatcttctggttcatttggctgcttgcttgaattggtttgtatgttttttgattagattttgatggaggattgatgatggttaggggggtttctaatggcctaagatagctttacatttcagagattctgtgtcttgtttatgtgaaaaatttacttccactgtagttttccttggaccaatgacttgttgatgaagaatcaacgggtaggctagtacttctaatggcttaaatttttcaaattgaagattctttcctgcctttgaatcttagacagtatgcttctatttgttagaaactattatgttgctatcttcttagttatcttttctcgtgtcaagatttggtgactttccaaaaccatttgttctttcttgtcttgtttagtttctttgggtaaaacatctctgcctcatgatattggtctgaaacatttacaaaagttttggtggtttttggcgtttccaggttcagaagggtcgcagctgcagaatgtgttggagaaaattactggacaatacactgttcccaatgttttcatcggttagttgtttcatcatttaagccagttactaactatactctgatcatttttcttgattattttgcctgaaaacaaaactatcgataaaatcttagccactacatttgctatgaccatcacttatctaattttgatatcatgtttttgttcatgaccaggaggcaagcacattggtggctgctcaggtacaatctctcttcctttcttacctcaacaccgagatttttctaatatgtaattgagatcgtctttgtgtattttggcaccaagatagatagtactcaagatcttgctcaatgtcttgtgatttttctggtaacttgacctgcatatcattattgttgaacagatacattgcagctgcacaataaaggagagctggaagcaattttagctgaagccaatggaaaaaacggtcagacctagagatttctagagatgaaactggttggtgattcttcatgtttccttattgaagtcgagatgatttgctgtttgaatttactgtctatatagagattttcaataagaatcttgtgtttctttctacgtacaaaaaacagtcaatgagtcatgctgggttctgttactaaaccggagttgctgagtttgatccacactacttggaatttgcaatcatttttgggtggctaaatgcatatttggaaatcgatcttgagattgtaaaagataaaagatgaattgttggttaactttttggtacatacggttttgtttaagattacaaacagacgaaccggtttagagataaaccatgtctctcattttacttcttccacctcgtccaatgcgtagttgttggtcgatatattcgcgtaattcaccttggcgaaccggaccacaaccggatatcgggtcttcgggtcctgacaatttagaccggaatataagatgaaacgatatctaaccgttagatcgttaacttcaaaagtaaatgcattacctgatcaacggccacaactgatccaacgttcttgtaccagtatgattctttccttagaatcttgacctgtaagtcctcaaaattgtttataaatttcacagtagccctataactcttaatatgtatactaaatagacccagaacttattgatgatacccagtttagctcaaatattagtccaatcttctctactagcatctaattaagcttgaattttcttctaccacaagggttagttccttttaatcctgatctagaggtccaaaaacttcatataagtttcacattgaccccatacttacaaaattattctaaatagtccagaaactttattgtaatccaaacttggctatcatcaataaactcaaaattttgaagtataaacatgcatcaaagattatgtatgaataagtaccttggatcctctctttgggccaattggaggaggtttagccttagcggccggaactttcgccggagcagcagcagcggtggtggaagaactatccgacgaggcggttgccggaggtgtatcttccgccgctctgactactagccttgaaccgaagcttctcatcggcaagaaagacacaatggtggtgctctttgaagaaccaccgcctattgccgccgggacgttggccgtgagaataaatccggtagctgctgacgtcatcgccatttgtgtgtgatcgttggaagttgtgtgagtgatccgaaaaggtggacaaagctttagattgtttggggttaaaaggaatcgttttaaaccacttgtgatatgacacgtgtgatcacatatcagtatcgtctggataatgtgatgacgtggcaaccttagaaaatgaaatatataattagagcaaagaatctgtaataagggttgattgattttgccgccaaaattcatttctcatcttctccgatttcaaattcttatgaatcgccatggacgcgtgatgtgaaatctctcattcttcatcgccttcgtgattataacagcgtttgatccacgattctgtagaacgaattcagatactcggtgatg

SEQ ID NO: 13421 - DNA, 3000 bp, Unknown; identical to SEQ ID NO: 13415
  misc_feature (1)..( 3000): cDNA_ID_1022296_gDNA_ID_2214625_Annot_ID_135948 3000 nt of promoter + ATG

SEQ ID NO: 13422 - DNA, 3000 bp, Unknown
  misc_feature (1)..( 3000): cDNA_ID_3029999_gDNA_ID_2214625_Annot_ID_135951 3000 nt of promoter + ATG
agaatatgtttttcacatcaagattgcgttccattcgattcatcagccttagtgtggggtttgcttcaaacattgtaaatcattcgaatctgttcgagaacaccttcacggtatggcttgagcttatatgatcttcttgttctctgtttttttgttgggttggtgtttgattgatgattattttgaacaatgtcagttccgaaccatccctctcgaccattcaaagaaaaatgcaaaaccattttcgctgaaaaagggtgtgaactttgtcttcaagtctttgtggaagccactgctagggatgagcatatgaaagagtgtctcatgtcttcaccacctcctatccaaaatgcttctagtgcaagtggcacacgcgtgatgagtctgtgcatatctaattttagaaaaaactattttgactctagtggatacaaagatgtttttaacattatacactgttaaaattgagtttttttcaatgactttatcgaaaacatattgcgttctataatattaatcaaagataaaatcctaataaaacgtaaatatataacaatttctttttttaatgaatagtctataacttttcttaaaatataagactagtatgtatcatgctcataagatggaaataaaaacatgttaaaatattaaagaaattataaactgaattggctttagtggttatttaaatttcaattaaatttatttgatttaaaaaaaaagaaaatcttctaaattaaattggctttaacggttatttaaattttgattgactcaattcatctacaattattttttaagaaattttataatttacaattttttttttttgcctagccgtatcggttagggtcatgttgatctttaaaatataaatttttatttgtacggaccgagatcaaatatatgcgggttttgcagactaacccaattgacatgcatatttgttccaataattatgtttgttctttggatcttctaaacttaatcacttagtataataataaagaccaagcagaaacaaaatttatagcaaaaataaaacaagaatgattgaaaaaaacaatagcaatttaaacaaaccacaaaagttttgttctttcatcccaatacataaaaatctatcaaaaagtgaaactaacaccggctttttcagtttcactattgttttctaatcatatagcagcaaaagatataaatataaaccatgttcaccggcaagtaacatcgacacatggaagtgacaaaaaaaattgtaataattattgcttaagtctcaagtatgtggtgaaggtgtcgcttaatcacttaatttttttgttgtatttgatttatcttcgtattgtttacggaaaaaaaaaagaagcctttgttcaaaaaaaaaaaaaaaaaaatgccaaaaaaatctcacatgtaatttcgattaaataaacaaatgaacacaaagtttacaattcaaaaggacctcaccacagttgttgacttgttgtaatatgtttttctaatttcgtgtacatattattagtataaaacgtggaaggtttatgtaggcaagtggtttaagttaaaccaccaattaaccagacactttggcacctgatgttcaatctctttcaataatcgaatccaaatgtatggcttactaactttctgagtaggtgtagagaaaccatatttataaataaaactattatataagacactatttatgaattttcattttcgaaatcaaaagacaaactttctaaaaagttaaataaatttaaggcacatagtatttttttttttaattagtaaagaaaaatctaactcaatttaatgctaataaagtagaaaattaacaaagcaccttaatactattaatcttaaaattaactattttcactattattaacatatatttttaaataacttgagtgttttagctatcatatactataaatcatgaatagattataatatattcttataaaataaatgatctaatattaactcaatttctttctaacatatattttctaatatttaacatttccattaaatcaagtcacattttatcatttcataggttcactgagattttttactaaaaaattaatgacataaagaaaatttcacttctgaataagcatttagaaatgtctaattagtttaattaaaatgatgtgaatatgacgtttcacataagagtttagagacaataacttgataagttagagtgtataagggaaaagttatcaactttaagtaaaagaagcaaaagatggaaaaaacaaaagaatttgataatttcgtctttgttaaatttggattttcccattttatctctagaaaataacaaaagtgattagaatcagaataggtatttttggaatttactgttaattaatactaaattacccttttaatatttttttggtagtaaattaccctttaattactttactctagaaagactaatttattcacagaagtagaaaaagagaagaaattaaaagaaaacagcaaaaaataggtgaaaactatataagaggaagagaagatttatgatttcttcattagcaatttgttttgttgtcaaagggttttaatttaaaagcttttcacacatacatatatctctcaactctctctataagatacaaatctctttctctgagaatcctattatttgcattcacactctgagtcacattgaacttcgtctctagctcaagcaagtgaatgattctttgttgctacaggaatctatctcttgggtttctgatttgattcatctccggtgaaaatggtacttttaaatttctgggtttatcaaccgttttaattccattgtagcgtttctttcgttttgttttacttaaagttttgatttttgttgttgttgcaaacggcaaatgtgttaacttttgatactttcttccaaattttgtgtgtgtttgcttcttctgggtttcatttaattatgctctgtcgttgatacagagattgaacatg

SEQ ID NO: 13423 - DNA, 3000 bp, Unknown
  misc_feature (1)..( 3000): cDNA_ID_3029995_gDNA_ID_2214625_Annot_ID_135952 3000 nt of promoter + ATG
acttctattttgcctaatagacaaatagtccaaatttatcaaaaccggaaaaacattgttatattttggatcaaaattacttctaccatcatttagttagcttttaatattttagaaacaattgaatttttgacccaaaaaaagaaacaatggaaataactgataaagtcttcttaaaagtataggaaattttgccaagtatatagtattaattttggaaacaaacacgaaaatggaatagttttgagagttgatacttgtcatttgtggaattattactattactttttaatgtaaaatatttcgaaaataaacttttaacaaaagtaaaatccgaaaatacttagtttccaagtttatagaaatcaagcccagcccatttggggtttttaatttttttttttttttttttttaaaaaaaaaaaaaaaaaaaaaatcaaacccaaaacgattccgtttagtaggctaaaattcaagtaagtcccggcccaataaggcaactaacgcccaaaaaagaaacggttttgtcgatgtgacggtagcaaacggccaccagttttgtcgtttcgatgtgcgtggccaccacgcgcatacgaaaccgcgtcggtgttcgctaacgccatcatcatcgccttttttttttttttttttttgcctttctccgaaagcagtctcactacggcaacacactaccctacgcccccttcccaccatcagcattaaattctctctctctcttcgcttcttctggtttcgaattcactttactctcttcgcttccaatctctctctaccactctgataccttcgccggagaagaagctctcgttctctctatcgtcggagaagctctcgttctctgcttccctgctctgtacagatctcgagccgcatttcgtggatctgtcaaaatcgcgttaaaacctactcgcttctctctaaccctagggtttttgaatttttttcgggacgagggagaaatcaatgtctgtgaagctttgaggaagctatatggttacacctttggttctggttagtcttcgttttgatcggcggagagtgttcgccgaggcttggtgtctccgttattgactaatggtggtttttgatttgagataagagatgcggaactttgcgatgcttctgctgttaattcttcttcttcactctctcgcctcgtttcctatatgctttggtatgaactagttaacaaatttcttttccccttttcaaatttaggaaacgattttgataggagaaattaacctttagttaagttgctcttactttgacagctcaagattagttggtggtctatctatatttagaattgtttattggatttagatatatttagaagctaattttggttatgtacaaagtaagcaaaagagtttagattatttaagtttggaatctgtgattgtgaagcgtgagagtgaagatcaagtcctcacgttttgtgccttaattggcacacaaccttttaatagctagaatgcacatagatcttactctttcttttctgagtatcttgaggaaatatcgattttgtgtgacattctcttggccaaattttatcctctacagttggcattatacttttaaacccaagagaggaggatggagtatgcatactattagaaacattctattttttcgaaacttttcactgctatgaatattcgacatgtgtagaaagaatctatagatgacttatcagcttgctttatcatttgcagctcggttatttccgatgagtttgccatttacccgatcaaaggcgcatcaaatgcatttctttcatccttatcttaatccatcagttgctcctacaccttcaccaggtcagtaagggaatcctatttgtcacctaaacatagtgtcattatgtttctgtctaggagtattcattgttcattgtctttccctttttagctttttcccccaacccaagtcgcattccaccactaaggcacaagggtcatcaccgtcatcgtcgctggcatttaagacgcaatgccactgcagtgtcaccttcgtcacatggtagttcttttgcttcttgttggttatcctgcgtcctattatagtggcaacgataatgttttatatgaatactttttcttcagacttcagttgataaatcaagcgtagtaactactttttcctgtgtatttccggctttccttttgatagactgtcagcagacatgtgtggagcctctcacttcaactccctttggttcaccttgtggttgtgtcttccccatgaaagttcagcttctactaagtgtcgcacctttttctattttccccgtgaccaacgagttagaaattgaggttgctgctggaacatacttggaacaaagccaagtgaaaataatgggtgccagtgccgacagtgaaaatcaagggaaaacagtggtggatattaaccttgttccacttggggaaaagttcgacaacactacagcaacacttatttatcagagattccggcacaagaaagtacctctaaatgagactgtttttggtgattatgaggttacgcacataagttatccaggtaaactgatttcattcagatgcaagtttctactttttttttgttttatttcaaagtttgaacttcttaaccttgcttcaggaattccttcttcttcgccaaatggagatgttactggagatgctccaggaggccttccaattccgatcaatgcaacaacttttgccaacaaaagccagggaataggttttagaacgattgcaattattgcgttgtcaggttttgtcctcattctggttttggttggagctatttctataatcgtgaaatggaagaaaattgggaagtcatctaatgctgttggtccggctttggctccatcgattaacaaaaggcctggtaattttcaccctctgacttcttaacgcttctatagctttaaaagaacctgtttctgaaaaatttattcgccttgcaggtgctggatctatg

SEQ ID NO: 13424 - DNA, 3000 bp, Unknown; identical to SEQ ID NO: 13413
  misc_feature (1)..( 3000): cDNA_ID_2713662_gDNA_ID_2214625_Annot_ID_135953 3000 nt of promoter + ATG

SEQ ID NO: 13425 - DNA, 3000 bp, Unknown; identical to SEQ ID NO: 13412
  misc_feature (1)..( 3000): cDNA_ID_2713658_gDNA_ID_2214625_Annot_ID_135954 3000 nt of promoter + ATG

SEQ ID NO: 13426 - DNA, 3000 bp, Unknown; identical to SEQ ID NO: 13411
  misc_feature (1)..( 3000): cDNA_ID_2702931_gDNA_ID_2214625_Annot_ID_135955 3000 nt of promoter + ATG

SEQ ID NO: 13427 - DNA, 3000 bp, Unknown; identical to SEQ ID NO: 13410
  misc_feature (1)..( 3000): cDNA_ID_2702935_gDNA_ID_2214625_Annot_ID_135956 3000 nt of promoter + ATG

SEQ ID NO: 13428 - DNA, 3000 bp, Unknown
  misc_feature (1)..( 3000): cDNA_ID_2713654_gDNA_ID_2214625_Annot_ID_135960 3000 nt of promoter + ATG
taacaatgatcaaagatttgaatttatccggaagataacaaatctcatgggaataaaaatatttagtaacaactcgtatttaaaatcatttatacctggaaaaaaaacctgtattgtttttttcgtggaaatgtgatatttttaattttcaaagtgttaacactttaaacgtagatattactgtattttactaaaacactataaaccatcaaaataattttattatcattctaaactttaaaactagttttcatgtttgtgacactataaaaaatgacagatttccgtaaagaaaaacatcagaaaagatgaattaaagaggtcataatcacatataaaaatggcaatttaatattcatcacctaagattagcccgaaaataaatggtgctctgtatcatagtattaattaggagagatggcattcctaatctcttaaatagataaattgaaattaaattaattaaaattaaaattaaacaaatataatttaactatttcatgttagtagatgttattttccgtcatttttttatggcggtacaaacaagaaaactagttttaaggtacaaaatgttttataatgtttagtaaaattatattgaagattaaaatgctgttaaatgacacgttaaacattaaaggttaaaaatgttatttttcgggttttttaaacatactattgtttttcttttaatctatatttatttcaacgaaaaaagtaaaaataataaaatctaaataagaagttgcaaaacccagaaccctacagatcatcccctacctcgctgcttcgggtcgaatcagcgagtcgggtcaaaattcacctgagaaaaatgttcgcgaggcggttcacttcgttcttcaaaggatcttcaacctcaaggtacccaaaaatgatgcaacttctctgatttttctgcttgaatttgcaattcttgaccgtgaaaaatccaatttcggattttgatttgcgatcttacaaattggaatccgatcgatttctcttcttcgcgcatctgaattcattccatctctatcgcgatttcaaaatcgacctagtttttctagttggtgaaatgatctatatacccatttacacctattgacttgagcttatatggattagattcaaaatttggatgatttatgttatatatggtcgtttaggagtgaaaatgagctgaagaatgtttttgaaacagcccggacaaaacagctgggacattgggctcttttggtcgcaaggcagtgtctttcgtcttgattacagtcactggtggtgttgctttgagtgctctcgatgatctttctatctatcgtggatgtagcaggtaatctcccatcacatattcgtttcatcaaaaatgcatttatctttccattgaagtttagctattgcaatagacatactatgtgtgtaaccttcactgatagttgaattgtgaatcgattcggagtcttgacaaggctttattagcaagagactcgtttggacaacaggtttagataatgtttaaaccattttgttgaagtggtggctgagaccatcaattctttgaccatattttgttatcaatgggttggggtttaaaggatcaacttcgaaagacaacaaacgaaactcaaattctcctgctagtgatacatgtacgtgaattgatgctgtctccatatttcgattttggcttcaagctttagtgaaactggttaagcaaacgaagagaaagatgtgtagtctggtagtctatcttgtgcttgtgccgccactttacaaagtaatgatacttcttctacctgtcctcgttaggaatcgagtgaaaagtcagccgtaatatccagaacaaacatattttttttggatttctatacgcaccattttgttatttgttgtccattctgtcatgaatttctctatgatcttctccttgtatcatcaaatcaataacatggacatgattttcaagaatgtagtatctgcattggcgattactcaaaaagtctttgtatgcttaattttcagcaaggcgatggagaaggtgatgaatagtaaggtgatgattgaagccatcggagagccaattgagaaagggccatggtacaatgcttcactagctgtttctcaccaaaggcactcagtgtcttgttcattccctgtgattggaccacaaggcacaggaatcttgcatctcaaagctgttcgcaatggaggtaaacattctcaaacccgaacagtcactcaaagacaaaacatatgtgttaggtatctgcatttgccatttttcttactcattggatccccttttctgcttgggatagaagatagcatgttcgggtttctccagcaaagggactgggacattctgataatggacgcacttgtccatgtcccgtcaaacgagggaccccaacaaaccttgagaatcaacgttactgacatcgttgatccttcgcctggtacccacgataaacctttggaaccattagagccagagaagagctaaaaagagaaagagagagagagagagaacgcttggtggagctcctggctagggttttattccattccattatatcttgtggaacaagagagagaattgggtcttttatttactaataatgaacaattttttaggagtatacaaaagttgaatacatgattgagagtctagtgaataacagcattgctatatccgttttgatttggcctcctttatgttttcatatatatgttttacgtgtttgtttaagcattcaagtcctaattgcatcaatcaaaatgtaaattagaatcctaacactgcttcaatcatattaattgcatgagaattaaaatgttacatgaccatcaaggcctagttagctaaatatcccaacatcatacaaaagaagaagccaatttgaaaaaagcaagcccacccatgggatcattagaatcagagaagtcttgcctgccaagcgatttccggagaggtttccgatttgtctgatctcgccaatg

SEQ ID NO: 13429 - DNA, 3000 bp, Unknown
  misc_feature (1)..( 3000): cDNA_ID_2710620_gDNA_ID_2214626_Annot_ID_135964 3000 nt of promoter + ATG
agctttacatttgctcattgtatcatgacattttgcaccattttagcttaatttgcatacttaggcatctaggatcatcttgcattcgcattgcatgttttggtatgttttcaggtgcagaaagagctaaaaaggactctactcgatccattcactcgatccaggcagctacagaagaggcatcattctactcgacctctttactctatcgaggatgctacaaaggaggttgtagtttactcgaccctcctactcgatcaaggcaacctcagatgaagcagcagattgatctactcgcccctcctactcgatccactactcgatccatttactcgaccaagggtgaccaactctacaagacttgttgagctatcaaagcgtcttcggatcctcctcattccccactcaaccagacatctgagcatacaaataggagaggatgaagcatctactcgaccaattgatcactcggagtatagacacaaaggcgcagactttgcaacaccctctttactcgatccccaagatcgagtattcgcccaaaccgcctcaagtctcttgtcttctagtgaatctagggtttccaacattttagtataaatagatcactttgggatttttccaaaggatctatgctttatctttcagtttttctttgtgtttatgaatcttgaaaccttaattactcttaatctatttcgtttttgcaattgattgtttaagtaaagttgtttagcttgtttagatctacattttggtatgattttagtaatttctgggtttatgttcttaagaatgttgcttgagtagtgattagggttcttaaggatggattagattagggtaatctctaggttcgttaggtggttagtgtttaggtttatgtccttctggattcgcttggcccctatgcggttttcgctggctaatgtgaagattcgatgacgtccagcgtccaaaagacgttcaaatggatgtcggacctacgaattccagagatttgtagactcgacaaggagagaggcttttctgcctattggctttggtagattgtttcttaaaccgtctctgctatgtttcatcaacgagagttgagattaggaagtggtagagttatgggggtctctgtcacgagagtggattgaccctgtttttgaatctatcgtcatgggtatctacctttcgcctattagccatttgatgaatcctagagttgcccttatcaatgaatccatccttagaacttctattacatttatttgtattccctgttgattgcacttttatttacctgttatttgtatcccctatttgtatcccctgttgattgcattttagttcttaattttgtcacatgttggttctactcgacccaatgatcgagtagggctcttaagttctcatttttacttgttcgaatcctgacctaggattgttactagaaaccaaccatcattataatctgacttgacttagtcgtctctatacacatcttgattgctaacaatacagtggactggattgacaccccctataactgcatcgacatgtttgtgttttaggggaattgaactgaatcacacacatctagtataagtaggcataaaaacatgtatatcaatttggcgccgttgccaattcattgttgcattgttacattcaagatatcagaaacttttaagatcaagttcttttacatttatcaagttactaactcatattttcgtctgcttgtttttgtggtataggtactaatctttgtgcatgcaaactcgatccaaaggttctgcacacctactatcattcagagacagaattgacagaattgacagaatagctcgtgagttacaagaaaccaaagcaaaggcagtctgtgatcagcaaagaccagctgctatggatcaacagaacagaccagttgatgttcaagacccacctaatgttgatcaaccaagaaacattggtgctggtgatgccccaaggaatcatcaccaaagacaagggatagtgcctccaccagttcagaacaacaattttgagatcaagagtggtctcatctcaatgatccaaggaaacaagtttcatggtctacctatgaaagaccccctggaccatcttgacagctttgataggctctgtggccttaccaacatcaatggtgttactgaagatatgtttaagcaaagactatttcccttctctgtgggagacaaggcacaccactgggagaagactctaccctcagactccatcacctcatgggacgattgtaagaaagcttttcttgccaagttcttctctaacgcttgcaccactagattgaggaacgagatctcaggtttcaaccaaaaaaacaatgaaactttctgtgaagcttgggagagatttaaaagctacacaactcagtgcccccatcacggtttcaagaaggcttcattattgagcacactctacagaggagctttaccaaagatcagaatgctacttgacactgcctccaatggaaacttcctaaacaaggatgtagtaaaaggctgggagttggtcgaaaatctagcacaatctgatgggtgctacaatgaagactatgatcgctgaatgagtggaactgaaggaagtgaggacaaacaaagcaaggatatcaaggctctaaatgaaaagttagacaagttattgctggctcagcagaagccttgcggtatccaattgatattagctgaaagatcagtcagaatacctcatggaattctcacagacctgcctgttaaagtcggatcaataaacatccctactgatttcgaaatactggagatggatgaggagccaaaagacccattaatcctaggaagaccattcctagctactgtaggagccattatcgacgtcaagaagggaaaaatcgacctaaacctggggaaggagatgaaaatgaccttcgacattaacaaagctatgaaaaaaccaacaatcaatggacaagtcttttggatcgaagaaatg

SEQ ID NO: 13430 - DNA, 3000 bp, Unknown
  misc_feature (1)..( 3000): cDNA_ID_3030048_gDNA_ID_2214626_Annot_ID_187803 3000 nt of promoter + ATG
ttcataagacggtagaagcctcaggcaatatccgatctgactaaaattcagacaaaatcttcggtgggactatcagctaaagattcaacggtgggatcaatagtttaacggttcaaacggaagttatcagttcttctataaatcagcaaaaggaagtacattacaccaacaagtgacaatggatcatcactagcaatcgctcaaggtttccactcattcatcaatgatgcgatctccaattctgtctcgacgacctccctcataaaagataagttcaattactttcttacatattaattaagcttgattgacattctcacttatatcacaagcattcatccttctctctttctacgcaaagatgagatctcctctaacgaacaacatcttaaatgtagattttcatacaacgacgtttacaatctcaaagattcagatcgtccatgccgtagatttcatcatctctatgtccaaaccaataagataagtgttatctattataatctaacaagtacagcttaatcatatatatgcattctctgctatattttttgcgtaaacttgcaaaaacactcgtctaccgagcaaaaaggggggggagtggggtccgtatatccatactcccacttcaatttttctacttcgaattttcttggaatttgatttctaaatctttttactttgaaatattttaacgggcgacggcctattattttcaaagtttcatttacaccgcttcggttacagcgcgctatataaatattcaagataagaatctgctcgaatgtttttccgagcaggctatgaattctatcttctgaaatccggttatacttaacaccggtgccccagctcgtttctaaacgctggtaaaagattgaatcaaatcgggtcgcaaccgtgggtattcaagtctactgaaatccagttactctaaacactggtaccgagtcaaccgcttcggaaactaaaacccagttatcataaacactggtgccgagcttttgcttcggctaaatacagtttcttatctgctttggtctgcttagaaatccagttatcccgaataacctggtaccgagacgatcagctcggaacgaagtatactgaacccagctttgactcacgcaatttgtacccgagccaaccacatcagttcgtctgtagctttcctagctcgaagttcgtctagctagcagctcgtcggcacttcgcctagctgacagctcgtctgcagcctttctagctcccagttcgtctgtagctttcctagctagcagctcgtgtgcacttcgcctagctaacagctcgtctgcagctttcttagctccttgttcgtctgtagctttcctagctcgcagttcgtctagctagcacctagtctgcacttttcctagctcacagtccgtctgcagtttctctgactcgtagttcgcccagctaacagctcgtcggcagccttcctagcttgctattgcccgcctaacagctcgtcaacagcttggagttcttcaacaagtctcctagcagctttcctagctcacaacttgtcaacagctaacattttgagttcgagatagcaacacccgtcaagaacagaatctcgtagcaccaagaaaaaacaagccttactttcaaaagatacggattagtcagtttagatgcgaaagcagctggctcggtcacaccattcatgaagctcgtggcattaactcttaaccaacgagctggggggctaactgttggggtcggattcccccacaagcaagaccgagccaaacagtctaagaataacaatcacctcatggttaaacatatgattggcccctagcctagaacaaagcacctcgggaccttattcgatcgaccgtcccgaagagagtttgtaaaatggctcgggtgttaatcatatgaacacagcccgagccaatcgcgagaacgctgcgggaaacatctatatcggctcgggagacagccaactgagcttaatggacagtcatcaagcgcgccccgagccggtacataccgtttgccccgaagccacctctcaaacgaccaccgagccgtgaagaacacgcgaggcaaagacttaaggagaatctttgaagataatgttgaaatcaggaaatctccccaaaacctccgaagaataaggagaatatccttaggacgattatcctctagaaccgacctaaggataaataagaatcttccgaagaatatcgctaagggggcggtttaaggatcctatataaagtgcctcagggacttcacaagagggggatctttggatactcacaagaacacataactttatacctattgagaactacgaatggcttgatcccttcacagggtacgtaagcaatccatcatggatgcagctatacctttttaaaaccctaactctttttctgttcttgagcaaaaccctaatgtatttcataagagattagaacatcttttgtaatcgagtcttggatagaatacctaatgaagagaaattactagatttgttttccctctctaaacaaatctattgtgtgaatccttggttcaacacaactcaagttttttctcatctaatttgaaaatgtttctgagacatcaacaaatgtatgaggagaggtttctcagacacatggaggtgctgcaacaaacacgatcgacgaaatatgagccaacaaagatgggaaatcagaatctcacgggtcaggattttgatcatgtgcaacaaatgatcgatatatggaggaggtcgaagatcaatcccaaggaagctatttagaagcttccagttatccagagctcaagatctgaacacaacaccttaaaaaacaccaaaaactctcacgggaattttgtcgaacaggtggtgtgcatctcaacccataacgtttcttatgattctgggatttctaaaggctcgactgcaactcaaaacctgaggaaacgacaaactcatgttaagcgaagttaccacaaggttcgaaaagaaaa

SEQ ID NO: 13431 - DNA, 3000 bp, Unknown
  misc_feature (1)..( 3000): cDNA_ID_3030019_gDNA_ID_2214626_Annot_ID_187811 3000 nt of promoter + ATG
tttttaaatatgcaatatttaataaaataaataattgtcatattttttaaatatatatttcttacctttttcttatctcggataagttttgtaatttatttttaatatacgtatcattatatttactttttgggattcaatagataattatataaaaatcgttatactgtttactttatttaagatttgaggttaaattatttttcaacttaaaaagaattctgttaaaaaaatttggtcctataagatttgttttttgtcaaacggtccttaagattaaaaaaacgaaatcatatggttcaagaaaattaaatttaggtaaaatagaaaattaaatttaggtaaaatagaaaattagaataaaatcgttagaatgaaacctaacactcatacttaaatagagtgacatatagaagaaaataactctgattaaaacaaaactcattttattaattcctacaaagataaaaccattagtataaaatatagtacaggaatttaaattgatgagtgaaaaaaaaaaaatagaagttatccttggatctttgatgattttaattagattgaagttcatatgatttttgtaagaaaaatatatttagttatatcaacaaacaaacaaattatctgtgggtttatataagcaatttattttgtaaaagtaatagataatatatgtttattgttgtttgcttaatccgatttgcgaagatcaatctctacaacggtaattatattgttatgtgttactacatatctatactatttttaaaaacatgtccttttacttataaaacagatagctggagtgtttccaattcttttgatgttttacaagtcttcgtggatcccacgttggctgagttgggtttttttaagcaaaggtaattgtatttatttgccactaaatatatttgcttctacataatattaaacaaagtatatttttttaatatatagcataccaaccgatgggttaactttgggaagttcggaatcttttcacaagaggctctatgcaccaagaactggggatgacgatggtgattatccaaggcaaacaatcaaggaagtcctcacatcttctgatatactattcattaatttattttacctactaacctttttattacatttttcatatgtttaacttagtttgtgaattcctctttatattcatttgaaggtgggtaactgcaaaacagtttgcactgtttcggcaattgatacagattagccgtggtactatttttgttgtcgtgctcacaacaagaaagttgtcaaagaaaaagttatcaaacttgaagatatcaagctacctcaaaagccaagattttggtgtgaaatatgcattggttttgcaaaatttgttgttgccaagttagtctttatgaaatctttatattgaatgtattttgaattataatttggtgtttggaagctaataatcctatttaaattttaggttttggttacatctccatattatggaccaaaccggtgaagctagatacatgttattcgatagtcatgcaaaagaacttcttgacactactgcccctgaattgcttgatgggtcatttgatgaggtataatgcctttttaaaaataaactctttcattaaaatgacaacgttcatgttataataatctatatttttctatagatcgaagacccaactattttgcatgatgtgatcaatggtttgaaagggaagacttttcagtttctattgtgcatccaaaaggaaaacatattaggtggatatgattcatttactgttgcccgagtctacaccggtaacattgctgatgaaatcgttcaagaagactgatgcatacgttgatccatcatccttaatttcgatcgaacaggtttgtcaaataacattaaacaattccaattatttatatttatattttagggttgtctttttaaaaatgtttatgtattttcatatagggttcccttatgcttactaatggtgttgacctttctcatgtggatttgtcgtcaacctctactccatcatcaaaacgaaaagattcagatgatgttgatggaaatgatcaggcttccacaagtaggaagaagtgttctaagattaccatgtcttaggaaggctccggcgaatgatgctcattgactaatccagcttggatcgttttcttctttcttatttatttgcttaaagttatcgaagttgttttatttttttaagttctaaactatctttattttatttggttttttgggaattaataaaattatttcaattatatgtcgtttcgttttgttaaatctcagtttttgggaatacacagaactgagatttgattactccttctgttccaccaaattttatgttgtagaattttgacacaaattaagaaaaataacttttcatgaattattattattttgttagtttaactatagtattagttatatttctctcttcttttattggttaacaataaaaatattaatgatgttgatttagaacatcaatcttgatgaaagaagaaaaaaaacaaaaacatcaaattttcagaaaacaaaattgtttattattaagaaacacattattttatattataatgttaatcatactaagaactataaacaattttgctaattttgtgttaaatattctacaaaatcagaattagcaaagattttgtacactaaataatcagtcttattaaatatgattaatcatgataactcaaacaaaacaaacctattcctattttttcataaactctcattttaataattacaatttttagtaacacgttaagaaataaatgtcatcattattgttctaacctataagaaatcctactagttcttgacgattcgtttcctttttacactttaactttccatcattgtatcttttcccaattatataaaatcaaaaatttcaagcctaacacaattaggtttaactctttatctgtcgaaaaaaaaaaaaacttccttggatacacatg

SEQ ID NO: 13432 - DNA, 3000 bp, Unknown
  misc_feature (1)..( 3000): cDNA_ID_3030052_gDNA_ID_2214626_Annot_ID_187802 3000 nt of promoter + ATG
ctctaatcggtatgtttcttctcacaattcgagttttaagggtctaagatcattaaattgaaataattggaattcataaactgttgttagtagtgtttatgctctaataagtgatggatttgtataaggtcagaatcacttatcaagtaagtaaccagaaggagatgagaaaatagaagaattaggttgagaagcagaagaattcagaattagaaagaagaagaacaagagagaagagagatgatgaagaggataaacatattgttatgatctatttcgatagtgttcccgtaagggagaaagagttgttaaatacaaaggttaagggcttaagatgccaacaaattggcagcccaataacatactaaaagaggcccaataaaccacaattggatacttatcaatactccccttttgaagtatcaccttgtcctcaaggtggaaggaaatgaaactctgccagtacattgccttgtttgcccgtgcatcagcctttgttgtagcttcgagaatgtctgcaccttcagtctttaacttgatggagaagatctcattaaagtccttatgagtaatctcaaactgcttccgttcgttctcttcaacttgtatctctcacgcagttgtgttctcaattattgagaccaactttgaaaagaacagctccaaaagcttgccatcactggaaactctgtttcggaatcttgatactttccccaagaatgcaaactgtaagagagggtccttagacagtgacttccaaacatgagtgctacacgttttcttcttcatgtcaaacggtctattctccactgtcatatctatattttgggcttcacgggttgctctaaggttctcctgttcctgccattctccaaacaacagttcaggtggccgtgacgattgagacacttcacagttggtatcaatcttaaccaagtttccaagatgaaactgaaagagctgggtcgacatggtctctatcaaagtagattgatctctcacaagacaaatgaacttatttgatatcatagctacaacgtccttattgatcttgatcaacctacttgtaatcttttgttctatctctaacaagtatcccaagaccataacgacaacttccgtactttttcttaaatcgttgtgcttctgatatttctcaacaacatctctctcaaccaatatttttgaaacttcttgagttgttaatattgttgtctcatagataacctatagcaattgacgtcttggtagtggctcagtagctttaatagaacacacaaactcctctctgcccaaagagtagacacaacccaaatcaacgtcacaaacaactcttgagacactgttcttacccttgttaacatcatctttgacatttcttagtttcttctttactgtgtcgctaacccatcttctgtcattacctttactcgcccctgaaaaatccaccttgtcctcaaggtggatgaacaagaaaagagtttctttgctaaggttctcacttaagtgaacatctaacgacttgagcagcttttccaaatcaaaacctgtgagtaaaagtagcttccgcctcaaaattccttttttatacccaacacgcaactttttcaagtcccttctcatgaccttttgtaaattagtcttatcaagcttctgtattaatcttaacactccaaaatttctgtaaccttccaaacccatagaacttggctaacctctaaaccaccacgctcgcatacgcgattagctctcccagggtcagttggttgtttgttaccggtacaaactctacaggctagacgcttaacaacatcaacatcctcaaactcctagaaagccactaacccgtccaaatgaattttgtcagtcatcctctctccatgatcccaaacttggctaacgaaagtacatccaaaaaacttgttttcattcatgaacactatgtcagttattgaagaactagtaatttgtttctcatcggtaccatgaatcttccttgcataaaaatcccatcacttctttccttcactgtagtacaaagcgttcctgcaccttctagtaaactcacttcactagccttttgtagattcatcaccaagatatctcccctgtaacactcatcatcactcacagtcaattgtctaagaggaggaaacgagaatgtatgagagctgactttctcctttttctttgcaacgacccattttttattctttgatctgaatgaggcaatcacaactcgatatctatccctctctcttcgtttctgaaattggtgaaaacgttgcttgaaactagctcttggagtacctatgtggcgactttcctttaccagattcactgccatcgaattgagtctatcttctccgagatacaacacgtttcttggcgaacgagtacaaaaacttagttgtagagattgagaaagattgtcacgtttcatttttcttttcgaaccttgtggtaacttcgcttaacatgagtttgtcgtttcctcaggttttgagttgcagtcgagcctttagaaatcccagaatcataagaaacgttatgggttgagatgcacaccacctgttcgacaaaattcccgtgagagtttttggtgttttttaaggtgttgtgttcagatcttgagctctggataactggaagcttctaaatagcttccttgggattgatcttcgacctcctccatatatcgatcatttgttgcacatgatcaaaatcctgacccgtgagattctgatttcccatctttgttggctcatatttcgtcgatcgtgtttgttgcagcacctccatgtgtctgagaaacctctcctcatacatttgttgatgtctcagaaacattttcaaattagatgagaaaaaacttgagttgtgttgaaccaaggattcacacaatagatttgtttagagagggaaaacaaatctagtaatttctcttcattaggtattctatccaagactcgattacaaaagatgttctaatctcttatg

SEQ ID NO: 13433 - DNA, 3000 bp, Unknown
  misc_feature (1)..( 3000): cDNA_ID_2713737_gDNA_ID_2214627_Annot_ID_135971 3000 nt of promoter + ATG
ccaatctcccatcaatcaattgtccttcagacaacttagccaacctttataaaaaaaaagacaaaactcaatttcagattcctaaacaaaagtacaaaactagtggttgtggttttgctagatgatttatcttaccgatgaggacaccgatcttcgtaacaacgaagtgttccttcaccgtctttatacaaaacaatttgacgatcgtagacggtgaggccaagaggcgcatcttcagggacgtttttagttaagtacaatggataccattcctctgtccaatcataatccgccacctcaacacgtttctcttcttcagggtttaaaagaacatctccacctccttctgtttgatcagatacggcggttccagcgacggcggagcggcggaggagacgtagacgaggctttgtgggtatagtgcatgttgatctgtggttgtggattattggtgttggtgttactttagtgaagagaatcggagaagtgggtgtgagttgtagagaagagcttagaaatggaacagccatggcggattcttcactagagagctcgaatccaatgttaggtgttgtttgcctcttctcataaaatatatcataaggttgcttgttcaaccattggacctcgttccaccacatacatagatagtagaaactttggctaaacgacgtcgtttatttttacgttatttaaatgtcattttaacttctttttattttatttttaatcttttaagttttaacattagtcttttttgctttaatacatttcatagtgatgaaaaaaaaacataaaactatgttaatagtgattaattatttattcattgttgataataataacaataaaaaaggctatactatgcctaagaacagaaactgataacataattagcactagtacatgtaaatctactcgaagcataatcgtacacatagctatacgcagtgggacaagctcctttaaatatcttcgagtatttcgtcggcgggcaagtctccggtttactgaaagcgccggtgcaacaatactccggtttgttaaaagcctcacaagcactcttacacgccacaacacccgatgagccgttaacgcgtagctcttttggacaaatggcattcacgtccgaaacacatcccgcggttttacaattgcctgagccaccttgtggtgtgattttcacctgaacgttgtaaccgtcgacgagactcacgtcgtaagaatcttgtacggtgtatttctttccagaggagccgattctgaattctgctagtgtggctggtggtgctcctcttgcaccggtgcatttttacattttctggaaccagaggcgttgaagttgcagcccgttcgaccccagattcgaccagaccaacctggagaaacggttaagtttacagaagaacctgaagctaaggcaaatccgccgccgcggagtagtgtgcggtttgcggttaggattccgggccacacagtaaagttgcagcggtttgataaagtgaagacggtgccggagacaatagaaattgtaccttgaagaatatacaattaaaaaaaaattactaggacggacaacaaaaaaaaattatcagataaattattaaatcaaagtagtcatcttaaaatgttggaaatgttttatgtatacatgtggctatgatgaaggagaagaagagaagatgtaatttggagaaaatagccattgttaatctgagtattgaaaagttgaagttgtgatgattagtgaaagttgatggtgaggatcctctgtttatagtgtttttcttttctttagaaacaaatccattaacttattgttttggatactactaccataagtgacacttcatatttttattttttttacttttaaagtttaatgagattttgtttcttattacataaaaatcaactttattaatcttaaggaaatctccgtaagcattgatgttttggattttacacacattaaaaattaaacattattttatgactgtttattttttatattaaatatttttaataactataaactaatactcattgattgtaatctaataaatttaatcattgcatcctgaactttgtgatttataatatcagtcaataaagaagaaaagaaaaaaaaaactacaaaattaaagtggaataaacttaaaatgattagaaaaagatggagtacattttttctattattttttcacaaagctttaaacctaacattaaaaaatttgcttgttttgtttccttcgaaattataagattattgcttaattaggttattgaattcgagtccaaagccacgacccccaggttttaaaatccaaatatctccgttgcttgtttatttttgttctatatcgagtttattatctaaaaacgacaaaccttttactgatttccaccatttcttgtacttttcaggttttctgagacatgaaagacaaagaattggcttatcaacagaaactatcaacaaataaagagtttctgaagcacattattagatccttttgtacatttttctatttatagattctctcttctttttttgtatgcaaaagtgacatatactataacaagtcaaagaaagatgaattcaataagcatgagtgatttttttaaatcttcaaaaagaaatatctgaaaggtacaaaaaaaagttttctgatttttgtcacaataatggagaaattcatactattttagggtttcttacccataaaattcactgcatgcagtgattggattcaccactttcaaattcttgttttgtttgtaaaattgatgactcgatctcatggatgcatgcataagagagtaaagagattgtcattaagttctcctgactcaaccatcactatctctctctctctctgacacgaacgcacatgcatttacagttttcatttatcacaacaactacaacttctcttctctctctcggctgattaagcaacttcactttccatcttctgacagacacattaaaaaatg

SEQ ID NO: 13434 - DNA, 3000 bp, Unknown
  misc_feature (1)..( 3000): cDNA_ID_2702975_gDNA_ID_2214627_Annot_ID_135973 3000 nt of promoter + ATG
ttcttatgtatgtgtgttttgatgaagttcttacagcttctactgcatctcttgcggcaagaacaagtatatcagcacaagagactgtgccgggacaaaagatttcgaggatatttttgacgctttctatcacagcgaatcctcctagagacgcattcccagggtcgcttcgctctgtaccgtttcctcgaatcaacactgagccatcacaaccctaagacagcaatgacaagaacaaaaatctcattaaattggaaatgccttgttatgcaaggaagaggcagtcctgtgagaatgtaatgtacctggacgaagcagtcatggaagatgagacgtaggagcttcccaaggactgatggatcagaggaagaagcagatctaacggtgtttctgacgattaactcagctccaggacaagaaccggcgtagaagttgaaagagagctcagctactgaagaagaaagaagcaaaagtagaagaagagaggagaggaatgtatattttggtttgcatgaaaaaaactgcaacgccattttttaatgtgtctgtcagaagatggaaagtgaagttgcttaatcagccgagagagagaagagaagttgtagttgttgtgataaatgaaaactgtaaatgcatgtgcgttcgtgtcagagagagagagagatagtgatggttgagtcaggagaacttaatgacaatctctttactctcttatgcatgcatccatgagatcgagtcatcaattttacaaacaaaacaagaatttgaaagtggtgaatccaatcactgcatgcagtgaattttatgggtaagaaaccctaaaatagtatgaatttctccattattgtgacaaaaatcagaaaacttttttttgtacctttcagatatttctttttgaagatttaaaaaaatcactcatgcttattgaattcatctttctttgacttgttatagtatatgtcacttttgcatacaaaaaaagaagagagaatctataaatagaaaaatgtacaaaaggatctaataatgtgcttcagaaactctttatttgttgatagtttctgttgataagccaattctttgtctttcatgtctcagaaaacctgaaaagtacaagaaatggtggaaatcagtaaaaggtttgtcgtttttagataataaactcgatatagaacaaaaataaacaagcaacggagatatttggattttaaaacctgggggtcgtggctttggactcgaattcaataacctaattaagcaataatcttataatttcgaaggaaacaaaacaagcaaattttttaatgttaggtttaaagctttgtgaaaaaataatagaaaaaatgtactccatctttttctaatcattttaagtttattccactttaattttgtagttttttttttcttttcttctttattgactgatattataaatcacaaagttcaggatgcaatgattaaatttattagattacaatcaatgagtattagtttatagttattaaaaatatttaatataaaaaataaacagtcataaaataatgtttaatttttaatgtgtgtaaaatccaaaacatcaatgcttacggagatttccttaagattaataaagttgatttttatgtaataagaaacaaaatctcattaaactttaaaagtaaaaaaaataaaaatatgaagtgtcacttatggtagtagtatccaaaacaataagttaatggatttgtttctaaagaaaagaaaaacactataaacagaggatcctcaccatcaactttcactaatcatcacaacttcaacttttcaatactcagattaacaatggctattttctccaaattacatcttctcttcttctccttcatcatagccacatgtatacataaaacatttccaacattttaagatgactactttgatttaataatttatctgataatttttttttgttgtccgtcctagtaatttttttttaattgtatattcttcaaggtacaatttctattgtctccggcaccgtcttcactttatcaaaccgctgcaactttactgtgtggcccggaatcctaaccgcaaaccgcacactactccgcggcggcggatttgccttagcttcaggttcttctgtaaacttaaccgtttctccaggttggtctggtcgaatctggggtcgaacgggctgcaacttcaacgcctctggttccagaaaatgtaaaaatgcaccggtgcaagaggagcaccaccagccacactagcagaattcagaatcggctcctctggaaagaaatacaccgtacaagattcttacgacgtgagtctcgtcgacggttacaacgttcaggtgaaaatcacaccacaaggtggctcaggcaattgtaaaaccgcgggatgtgtttcggacgtgaatgccatttgtccaaaagagctacgcgttaacggctcatcgggtgttgtggcgtgtaagagtgcttgtgaggcttttaacaaaccggagtattgttgcaccggcgctttcagtaaaccggagacttgcccgccgacgaaatactcgaagatatttaaaggagcttgtcccactgcgtatagctatgtgtacgattatgcttcgagtagatttacatgtactagtgctaattatgttatcagtttctgttcttaggcatagtatagccttttttattgttattattatcaacaatgaataaataattaatcactattaacatagttttatgtttttttttcatcactatgaaatgtattaaagcaaaaaagactaatgttaaaacttaaaagattaaaaataaaataaaaagaagttaaaatgacatttaaataacgtaaaaataaacgacgtcgtttagccaaagtttctactatctatgtatgtggtggaacgaggtccaatggttgaacaagcaaccttatgatatattttatgagaagaggcaaacaacacctaacattggattcgagctctctagtgaagaatccgcc

SEQ ID NO: 13435 - DNA, 3000 bp, Unknown
  misc_feature (1)..( 3000): cDNA_ID_2713730_gDNA_ID_2214627_Annot_ID_135974 3000 nt of promoter + ATG
gatttttcggccgttaaaaaaaaacctctaacatgcgagtcttgtaagtaaatcttaactttaagctatatatgcatttaccattcaagtagttcaacctgataacattaataaagatttgatcccttgacaagttggcatgaatccatttatcttttctcaatggtgctatagaaacaaaaaataatttgaagaaagaaaatacagctagtaagatactagcctacaagttatttgctaccaaaaaacacaaaaaccaaaagcattattatgaatcagaaacaaccatttccattggcaaaattataaatatttgagggaccagaaggcatgttcacgtaaggagggactgtcactttgttgtccaagaaaccaaacacatcgtctttggcctcattaaacgacgccatgtttgtcacaaccgtcttcctcaactcctccaatgcatacttcatttcctgtaactgaaccatattcatctcctctactggcttttcccaccaattaatcatcgaccgcctcacactctcttttctcatctcttccatcgcttgacccttcttcttctcttcttctacctcgctcaaaatatgcgttaactgcatattcagttcgcagctcgctgcagggcttccttgcagttgctgcgactgagctaaggacatattgtttcgagacacgtagcgatccaatacagattcaacacttggatgtccgaatgagaaaggctttttcgcgggagaaaacacgatgatcccaatctctgcaccacacaaagtgcaaagctcactagctttcttgaagagaccggctctgcgtttggagaatgtgacttgccggtggctctctttctttatttttaccattggaattttttgtcgtccgatgctttctttcttcttcgacatcatagttttttttgtatggagggttttagttgcttttctttgttggaatatttggtggagagaaagtgtttgtttatatatacatgcttgagtctggtgtggcattattatgagatcaacttgcaaagttggtaatttatttttatattttgtaacatacatttgtaattactcggcttgcctttaattttatggatagataataaaatacaaagatatgtgtaagttataaaaatcttaatttggtaatgcaatgatttatctttctttactttttataattgtcttgtgtataaatggatgattttcctaatgagtaatttctttatgttacaaaaaggttgttttaatgagtgagtctgtgtggcattattatgagatcaaatggcaaagttagtaatttatttttacatttgtaacatccacttgtaattactggttttgtctttaattttgtggatagataataaaatacaaagatttgtgttagttataaatattttaatttggtaatgcaatgaatttttttcctttcttttataattgtctttgtgtataaatggatgattgtcctgataagtgattgtgtatgttacaaaagaggttgcaaatcaaaacgtttacacatgttaaagtattatccaaatcaaaatattgttttaagttgttaatatcttttcttgtttttctatttgataaacatgcattattatacacaaattaatatttaaatcttgaaaatttgaagtctaatttatagtgtctgacttggtaaatggtttccgaatcagcgagctcaatcgtttggctgaaactggaccttacaagcctaggcttttcaattctaccaaacaaaagcctcaatatcaagcttacctaacaaaaccttgcactcaaaaaggatttacgttacaatcacgagggcaataactttaactaagaaagtgagaactaaggttttcaaccaagggctcaagagaaatgcagttctcaaccccaaccaactttatcgtctttgccacacgatcaagagaacaaactccacgaaataggccaaatgatccaaaaaataccagtctgacattcaaaagccacattggagacgacattgagatttgaaagtttggatacaaattatcaaagtcttagtgagagggtaaatcaatgcattgtttgtcacgtaagggactctagacagacaatgtggtcaaacaacattggtatgtttaaatctttgggaattaaccccacaagccttggcattcggatacccaaacccgataagttcctttttgggttttgggtctgcgtgggtaagagagtcgagattcattcgatatttcaaaaattcggtgcggattggggttcatgtattttaatcgagaattaaaaatacccaaaataactatattttagtttcgggtcaaatttggatgttttatctatatatatacttaaatctacccaaaacacatgatagtcaaaaatacattaattacgttttacctatatataaccaagtgtatccaaaaatattcaaattacctttaaaaactataacattggttacattttatccaaatatatccgaattactcaaaactatctaatatattcaatttataattgtaattttggatatttggagtattataagtataaatataactaatattttaaagtgtatatttatattcgaatatttacaggtattagatttggttctgtttttttttgggtaattaggtttagaactcgacgtatttttaaaaatcggatctgaatcgattcaggtattttttgggttttcggtatcgggcattcgggtattttttttgggttttcggtttcgggcatttgtcaaatcggttatataactacaaagttaagagtttaacaaaaaattatacaaaaccaaatcaaattaaattgaaccgaaccgtatgcgaattgcaaccaaacgcatataaaatgaaaaattataaactgcaaacccggttaattttccgggtcggcccggaacccaagaagttttcttcttcctctctcgtcttctctcctccgcgggagactctaaaatcatcttcccatg

SEQ ID NO: 13436 - DNA, 3000 bp, Unknown
  misc_feature (1)..( 3000): cDNA_ID_2702979_gDNA_ID_2214627_Annot_ID_135976 3000 nt of promoter + ATG
taccagtcgttcgccgttttccagctactactaccgtcaaggcttcggcggtggattcacctgagagttcttcaaatttcgccaagcgtatggatcaagcttggattatctcacaggttcgtatctccagagagttgttgatgtgtataattttgttgaatctgagtaatcacaagaactgatccttgatgtagtcatgtacgagtgaagagctatatgcaattttgtatgagattaagaacttggatctgtgatgaaatgttgtaaatttcagattatgaggtgaatagtatcagcaagtttcaaaaggatttgtatcgaaaatctgtaattgcaaagtaccttttagttggtttctagcaaaaaatgtttgttcacaattcatttgatttgtgcatatgatgagaacatgttagctacttaatcaggttgtagctgttctctatgatccctgagtgatgaggcttaagcaggcttatctcgcaacgcaatgtagttttgtagctttgcatgtacaattgttggattctctgctttttctctaatattgctcttagagaatctatcaaaagttcagactttgaagcctttcttctagcacttgcaatttgatattgagctcgtgtgaattttctagatgttacttgttgacctgtgtttcgattcaatgattttctttgtctgtttttttcttcactgcagcaaccaagtcctgttggatgttcatcgtgcaattcaaagggtcatgtggaatgcaaatggtgtgcgggtacaggattcttcatccttggtgataacatgctttgccaggttccctcaaggaatacttcatgtgtaatctgctctggacaggtttgttatctaataaaaacgaaagtgcagacacattattgtgtcttcttgtttatatatcttcccaagtatgaacaaattcgattctttcaatggttttagggttctgctagctgtagcgattgcaaaggaacggggtttcgtgccaagtggttggaaaaacctccagtgccaacataactgatgaacaaaagcaagttaagctttttggtctttgatgatttcttatggaggaaaaatgtttatatattgattcaagtggaacatgaatcagatatgcatatatctttatacatgtgttaagtatatatatgtaagttcatttattcatttccccttgttctgtctgtacaaccaaaggcctacacaagagttcttgtaatcgacacgtgagttttacgatttcgatcattggagtagctcaacggaagaacattagtagcacagggtcaccttcgtatttcttttgatattttctcgttgtagggttaaatcatgtgcatcttccttacccttgatgaatctggatatggcgtttctctaatagaattgcgattatcatcatcttagatacagtttgtgcctaacaaatccaacctaagctagttacttaatcattttcttttggggaagtgaaaatggcatttgatttcaggataattcttaaccaaagctgctaagtgaagaacttgtgtcagtgtgcattccatttcccaagtgatgaggaaatcttcaaaagtgttcatgtctagagtgtaagagggcactcgaacacagtggttcgccgtttcctccattatatatacctctactttgccccttttagttttacttgtcacaaaactttccagatacatatttactgcacaaaaactaaattattttgagtaaaaattaccaacgcaccagcaggttatttttttttattttttttacggtgtattgaagaaaatttcaaaactacataatcgtaaataagagttttattaaattttacacaattagatgcattttttcatctgatccaactttctatatctcttcttttttgtgaaactgtatttttagaaaaataatgtgtttttgacggaaaatttggtggattgatttgggttaaccccttttgacaccccttagttccactaatagtttttttatcctacacataaatttctataaacttttgtaatcagatatagtcacatacatatggtagtaagaattaactaataggctatatctgaaaatggaaaatggaaaccgtctttttaataatgagctcaacaagaggattttctagatgcttgatataatcgaaatattgaatacacctaatggcttcagaaaatataatattgtttctagttctcataatgtatgttcttggaagcccaaaaagaaaattaaaaaagatcttctccatgatctcctctttaattattgtaaatgaggtattatacgcgcaatgtcattcacgacgcacgcataaccatttgactctttgattgcgttatacttaacattaagctatagttaaatgtttagtttcgagtgttttgattggataattttaatttgcttggttcctgttcggattagtttgtgtgtttttaacctttatagattgtgttatataccttttaatctcttaaataaagcaaacaaaaaacagtaataatacataatggttagttattcgggtaataaacaaaaatatgtgacatttgagtcaataagaaccagccactgcccgcagaccacagcaagtcttttgtttttgtttttttttgggtcaaaaatattagttaagtctattcacgttttatttaagttataaagaacaaataattggaaaaaggtagtgtttcacgagatcgaatattttcttgttttttgtgcaagtctgtaatcagactaaaatatcattaatttcatcgtatgttcttaaagtattaaaatattgatcgtagcatgtggaaaatgttgattattattcttattttaaggtcttcattttttgtagtcttgcgacgacccttgactttaaatcctttataaaggcctcgactaaaatgagatgtaccaacaacacaaaacttgtactcacaactaaaagaagaactcaaacgcaagacagaaagatcaatg

SEQ ID NO: 13437 - DNA, 1872 bp, Unknown
  misc_feature (1)..( 1872): cDNA_ID_3070726_gDNA_ID_2214627_Annot_ID_187852 3000 nt of promoter + ATG
cttattagtactttagtagtatactcattagaagctacctctctccattattacaatatcaatctcaaatgttgttctatataacatgtgtttactatagaatatctttattttgttcaatcagtatataacaattcccttttcgaaattgaagctaaggaggttttatgcgatgagggtgatacttacatgctcaccgaattcactcccactcgttattccgattcggtttttcttcgtgaagcgaggctcttaaagtatctgcaccggtgatcaaagtgaagtgtcttaagttagattaaaattttaatcaataaattgtaaaaatattaaacccaatcaaaaagtgacatgtaagtaaaaagtgtctttaacatatgtttcttctcttttctcctttcacaaatatttcaaatttatattaaaaaaaaatagtataaacactcgttaatataatcgatggaggtgcttttagaagacgtcgaagctatcttcaccaacatgggtctaggaagacctctctcgagagttccttgcctcattgaaagtcaaaaatattatatttttagctatttaagatatttaaatgttaataatgttgtaatacaatatttaagtcgtaaatatttgatagaccacataattatttttgtgcttcaagcctctcaaaactaaggaccggctttcacttggagacaaaaaatcttctgaagttcctttttcttgtatttttttcttccatttctattacttcacatacctaagtgcaaaaattgattgtatcatgaaactatgtatgttcgatataaaaacagaaatcataaattttgttaaatgccaggtaaaaactagcatatgttaatttgtttttgcaatttatcctaccataatactctttttctgtttaaaatttttaatatacttttagccaacgacaaaaccagtttatatgaaagttaagatgacaaaatactaatggtctacatatagcaaatacacaactagttaaattcttctgtaattttgctgtttacaatgacgattacacacattcttaaagctgtgatgacgaatcagagaaagctttaaacagctgtaaagattacacatctcaagttttagttaagtaagttattaacaagaaaaagttttgaaaaaagtaaagacctttaatagttttcttttctcggacaaaacaataaataaaaagaacacactttttttatcttttgtccttaggatttgattgtacatacatctgatctcaagtgatttcaagtggttggttctgttccttttctcgtccccgatcaagtttcttctcctaaactccagaatttggtcttgaagatctctaaaggctcttcctttttgttcatttctctacccagatatgtaagttgctagcttcttctgtcataactttaatatctgaatctttttccgatccaaatagtcaaatattcgcatctaggtcaaatcgattcaaaaccctttttgttgattgatgtgctaagtagttctgagttgattaagtctatcagtttaagagaaaaggattgtgtaagattatgattcgtacaagttagcttctttcttgattaggtccactgtgaatcatgcacacgtttatgaggaagatattagattgtgtaagattctgattggtttgatggtttcaagttagtttctttgttgattattgattgctgagtagttctaagttgattatgtcaactctgaatcatgtacaagtctatgagctagaaaatgaattgtgaattgtggagctaagaatgatgttgttgttttggctgaaagcgatgggtacatacctaagttctccgaaaactgaaaagttatcagaagatg

SEQ ID NO: 13438 - DNA, 3000 bp, Unknown
  misc_feature (1)..( 3000): cDNA_ID_2993328_gDNA_ID_2214627_Annot_ID_187851 3000 nt of promoter + ATG
atgcaccgggaaactgttcccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatgagaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatact

SEQ ID NO: 13439 - DNA, 3000 bp, Unknown
  misc_feature (1)..( 3000): cDNA_ID_3030103_gDNA_ID_2214627_Annot_ID_187850 3000 nt of promoter + ATG
ctaaccttggcttaatattttattggatctttcatatttcttgtgttactggcaaaatttgtagtatttcataatcttttctaatttatagatttttgtagatttttattttttagtcaatttgtggcagttctgagaaataataataaattgaatttataacaaaatagtagcaaggagccaaaggacaaagatctcttagctaacaacaacacaacatgtaatcataagaaagaaagctttttgaaacaaaaagctcattctaaaaagcaaactcatcacatggttccaaatcagaaccaagcacatagaccaagaacaagacctaacacaacataacaaccaccaagcctaactgagccgctaatgggagctggagccaaagctggaccatcttcgaattcaaccggagaaggagctggagagatgacactgtgacgaggactgatcacaacaaggctcagcttctgacctttctcacagtgaccattagctccactaatgaagtagaaaggaccagacctgtccaatttcaccttggtttctccatcagtgtagttagccaaagggttcgtggtgttgcagctgttgtaagcttcttttgttacttccaaaacagagtctttaccagattcataccggaaaactgaaaaagacagattgtgtcagaacagaaacaaagtctatgtcagaaacagagtattttttaatggtgggtaccaataaagtcgccgactttgaagcgagctttttgagcccactcagtgaatgagtaagaagaggaaggagggatcttccagtcgccggattttccaccgacggtgacttcatttgcagcggcgagtgagaataagaagattaaagagaagatagcaacgtgaagtgaagaagaagccatagatgccgatagaaacatagtattgagtagtagagaagctagttgcttggagtgtagtgttaggaatgttgttttggaaattgctgagttatgaggaggttcttgtgaggttttatagtggtgaaaattcgaaaactagccgttagattatttactttttgttttgttgtgaaaaaagaagaattttgaaaaggtaaagaaacgttaaatgtttgttactgtagccgttgcgagtgatgtaaccgttagagaaaatttgaaacaatgtaattatggatactgacatttgttgtgtgtgtcaggcaaaactatgagtgtttctcgttgtctcgcttttaattttgacaaaataattgttcgtgaataaacgtagtaaacaaagtaaaatctagtcattctatttggtgatggtgacgtttgggtattgccgtattgggcctattagctattggggtgatacgtatacacacctttacattttcggatatatttgttgagatcactcctggcccaaagaaaatagaaattttcaaaaattttaacaaggaatttacgttgttcttcttttttcaataaggatttcgaatcaacagagcaaggaccaagtgctaaaaccaattatcaattgagttatcttctttataacatttactagaacaagacataagctcatctatgactatgagaggcgtgtttatacaagggatttggtttaactaatagcaagaatggctcatgagtttaccaactaacgaggcatcaactcatttactcagctacatgatccgtttgtgcaacgtttcccactgattgagactattgtactgacatgtctagcatcaccccgtaaactatagtattgtttaggtgaatttggtctccctaaccatatatagggacatgaagaaaatgtcttgtgcagtttgtcagtcatattagtgtattatatcttgttacctccaataatgtcatatattggaaaacttgagaagtgatcagggccgatgaatgaaacattttttttatgtaatttggttaaaaagtgtaacgaaaaaataattaaagtgaaatctacttttcaaaatcgttaaaatgttttttgtgaacttcaaaaaatataaaaaatagcttacttttcatttaaaatgtctaaatttaatgtaaatattaaattagaaaaatgaatttatacatataccaaaaatcccagttttattttgtatgtgaccccaatattcttaaaaccaattaactttttcgacggaccaagtattccgtcgatttggttcaatatatatgtaacgaaccataatctacctttcgcggttgaatcggtagctaaaaaattatttctaacaaatataaaattacaaaaattgtatttttctcattaatgacttaaaaacaaactatgatatctaagtgtgtactcattcaaagattatttaatttttttaaatgaagtcatggcaaaaggaaataaattgcaaattccgagtttaggaaagaaaagaaagcaaatcttaaataactcaaaaaagaatattggaagacatgtatcatagtcctaaacaaagtaacagatctttgggtcctcctttcttttttttcccttctatctgaaatccgacatcatcctcaatctctgtctgaatttctcaatagctatatcatcttcttcttggtcttagaatcaaagaaaaaccctagttcctcttttcccaagataaccaaactctctctcttctctctctgcatcattccctttcttctttctcgcatgtgcagagctatcaaacatctgttttgattgaaagctaagtttccaattccaaaacggaagaaattgaaagtgtgtatgtcaagacaaaccaccaaactacaaaagaaacaaaacccacatcgcattgttccttaaagacccagcaataagattatctcacgcttccttctttcttcctgacatttttctcgtttttgttttctccttatttggggtttttcctgcaatgtgggtcgcatttggtcataagtgattatttctagggattgtgtgacctctctgcttttttgagttaagcatttaaagaaacctctcaatg

SEQ ID NO: 13440 - DNA, 3000 bp, Unknown
  misc_feature (1)..( 3000): cDNA_ID_2702969_gDNA_ID_2214627_Annot_ID_187844 3000 nt of promoter + ATG
ttcttaagcctctgtttccatagtttatatcttaatacgtgttttctctttcttttggagctttgattatctcttttaaactatgttttcgaagatatctttgttttctgccggttttgtaagatcggaaaatatatttttattttataatattaataaaaaagatgacaaaacaaaaaataatgattttctttcaaacttaatgaacataaaaaaaagggaaacgaaatcttattttgcctagctgacataattaactaatgcaactaaatgtaggtaggattaagtaaacaaaaatatgagacaaaattaaacatgccaacctccagggcatagtcaatgggtcaagtcaagcgaaagttggtctggatcttacaatgcaacttaatgtaaagtactcatttttcttcgacatgggacatccgccgaaattgttgatttttgatccatctttacacttgttttctccgattacaacaaaacataacaattcgactacgatttaacacctaacctttttaattttttaggacacgcatttagtatttacgatgcaagccaacaaatttaatccaacgtattaaacacaacttgctttttgtcaatacgtattaaattaaatagttttcttgcaatttttgtttacacatttcattagtattgtttttttccaatatttttgtttctatgttcaatcactatcatatgcataatacacattataattttggcacaattagaattacacacaaggattttataaatgtttttaaaatgatttacaaaagattttataaaaattttacaaaagtttttaaaagatttaataaaagttttaaaacgattttacaaagagttttaaaaacttttaaaggttttaaagaaagtttatgagaatttacaagaattgtaaaagatttataataatttttttagaattagaaaggagaccctcattttccacccaaatcgtcaaccttctcataattgacaagttattacactctctccacttactagttactataaaaccaaaggagaccaaatctcttagcaattatgaatttggtcttcgctataatctcacgttacattaaattggctcctgtgaacctaaatttatggactatgatcccaacaccaatccgttcgaccttcatttctccggtaaacttccggtgagtttttcaatttcttcgaaaatttcacttcaattttcgaggttgtggtgattattcgtggtgttcatatatattttattgcctgatttagaaaagagaagtctcggcttcagcttctaaagttgtagagaagaaatggttagtgaaagatgaggttagttctttcatcgaacactttggtgtgcaatactttgacctcaaaatttttgactatgagtgaatggattaggttgatcaagttctcatatctgatttagacattgaatagtttgtttagatcggtgatgctcaaaagttgaacaaatcaaagctttgtcttacagcttagtttggtaatggtgattttcattttacacagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttggtaaggagatttctactacaagtatcgttctttgagtgtattgatttgttaacgaatgttttgtggatatacgttacttgtagactgtgaaagatggatatcaatggaggaaatacgggcaaaagattacgagagataatccatctcctagagcttacttcagatgctcgttttcaccgtcttgtctagtcaagaagaaggtactttggtttaaactttgttaaagagttcttcgatatcatcttgctgtctgattaaattccctagttgtgtgtgcgcttgtttaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatgttgaaagagttttgttatagctcggtgtaagtatggtagattgacgctgcttcgacagtttatgtatcttccaatgttatcttgttcagttgtttgtattaacttccattagagaagaatgtgatgccattacagacataaaagaaacagagaaacccggaaacagagtaaaaccacgaaaaacagagtcggtttaagagaaccaaaccaaaataaccggtacagctataaaaagccaagaagaaaaattatgaaccgagtccaaattaggttacggttagcttccaatcccaacttcttcttcttcttcatctgtgtttagtcccaaattgaagaatcaaaagtttcgtgttttgagaatttgacaaaaatttgtttatgtaatcttagttttcgctgattttgagtaagttatcgac

SEQ ID NO: 13441 - DNA, 3000 bp, Unknown
  misc_feature (1)..( 3000): cDNA_ID_4281780_gDNA_ID_2214627_Annot_ID_187840 3000 nt of promoter + ATG
gttaaaaaaagcataacaagatagttaaacaaagaacaaaatcagaagaatcaacaaaaccaatcataaataaaattatagcactcatgcttcttgttaaggaaacaattcaaaatcaatagtaaggcgtcttgtagacatatggtggtggtggagacttgtaagtgactttaggagaaggagagtagtatggaggaggtggggagctgtagacgtatggtggaggtggggacttgtagtaaaccttaggagaaggagagtagtatggtggtggtggagagctgtagacgtatgatggtggtggagacttgtagtaaacctttggagaaggcgagtagtacggtggtggtggggagctgtagacgtatgatggtggtggagacttgtagtaaacctttggagaaggcgagtagtacggtggtggtggggagctgtagacgtatggtggaggtggagacttgtagtaaaccttaggagaaggagagtagtatggtggaggtggggagctgtagacgtatggtggaggtggggacttgtagtaaaccttaggagaaggagagtagtatggtggtggtggagagttgtagacgtatggtggtggtggagacttgtagtaaacctttggagaaggagagtagtatggtggaggtggggagctgtagacgtatggtggaggtggggacttgtagtaaaccttaggagaaggagagtagtatggtggaggtggggagctgtagacgtatggtggaggtggggacttgtagtaaaccttaggagaaggagagtagtatggtggaggtggggagctgtagacgtatggtggaggtggggacttgtagtaaaccttaggagaaggagagtagtatggtggaggtggagagctgtagacgtatggtggaggtggggacttgtagtaaaccttaggagaaggagaatagtatggtggtggtggggagctgtagacgtacggtggaggtggggacttgtagtaaaccttaggagaaggagagtagtatggtggtggtggggagctgtagacgtatggtggtggtggagacttgtagtatacctttggagaaggagaatagtacggtggtggtggggagctgtagacgtatggtggtggtggagacttgtagtatacctttggagaaggagaatagtacggtggtggtggggagctgtagacgtatggtggtggtggagacttgtagtatacctttggagaaggagaatagtacggtgggggtggggaactgtagacgtacggtggtggtggagacttgtagtctacctttggagatggagaatagtacggtgggggcggggagttgtagacgtacggtggtggtggggacttgtagtctacctttggagatggagagtagtacggtggaggtggggagctgtatacatatggtggtggtggagacttgtagtcaacctttggagatggagagtaatacggtggtggtggggagctgtagacgtatggtggtggtggggacttgtagtctacctttggagatggagagtagtacggtggaggtggggagctgtatacatatggtggtggtggagatttgtagtttacctttggcgatggagtgtagtattgtggtggtggggaacttttaacatatggttttggatgtggcgcgtacttagggcctttgtgttcatagctgggagaattgtaacttggggtttgaggagatgagtaagggtatgatgtcaccgtagccgcaatagcacttagaaccacaacataaactatgcagttctctattcccatggttcttgaggatctcattacacctattatgctattttatttctttgttttggttatgttagacttgaacatgaacaccctttatatagtcttgctttgtgttctcaacttgcgttcgtgtgtggcacttctaagtacattagagaacgtgctaagttgtatgtttggaaaagtagtgattcgtgaagaaaattaatttatactagattcttttgcaaccctcaatttttaaggattataagttgaagaattgtatggtacattaatcttaagctggttcttcttttgttaaggcaactggatgtgaatcggtcgtgtgagcaacatttgattcacgaccatgttttttcctcatgggcaaccacgttcatcccaaataaaaaaaaaaaaagaaaaaaaaagcgaagcaactatttacattagagttgcttatgctgtttcttctttacttttgtttttttttattattattggcaataaacattattcatctagtggcctttattaacatcattagacggaacaaaataaatggaaaaatatcaaaaaaatcgttaacttttaaatttgagacggaaaaacatagactttcgaagtatcattaaatttctaaagtttggtttgattttatgaaaaaaatagttaagttttgtttactgtgtcattttaggcatatcgataaatttatgctaacaaaaatatgacggagttaacttttcgtaacgtttgaaaaataaataaaccgttaaagagagaaacaagcacaacatagagttacagaaagtttataaggtatttttctaaatacatataagggattgttctaaaccaaacgttacggaaaattaactcccttatttttttagtcaacaaaaatttaacagtatgcctaaaatgacttagtcaacaaaacttaaccattttattataaaattaaactaaactttgagatttaaatgacatttcgaaagttcatgtattttcgtcataagtttgaaagttacctattttttcgacatcccccctccccatccaaaataacattaacacacatcatgttgttatttaagttaaggcaagaactccctgccgtttaggcccctcgcttctttgggtagaaaagaggcgggaaaaatagataaaccctaaaagagtgagagcaagaagtaaaattgagagagcgagagcgagctagaaacaagatg

SEQ ID NO: 13442 - DNA, 3000 bp, Unknown
  misc_feature (1)..( 3000): cDNA_ID_2685770_gDNA_ID_2214627_Annot_ID_187826 3000 nt of promoter + ATG
cttgtgtattacttttaaagtaagatttttaaaacaaatactttattacttaataggttacattgatagtatgatatgatttataaattaatagggtaattattgaagatttgcttatgcacaattggttactttagttatcatttgatcttccacataagttttagtattatctgcaactcgttacttgaccttaccattttcttaataattaaatgttaataaattcatgtatatctaatatgattattataagatattatgtgccattttagatactatgccaacaatagtaatacaaatgtgtgcatatataaaatctgaaacacaaaagccaataacaaagaaaaacatctaaatatctatccaaaataaatgaaaaacttttcaatctttctattcgtgtttagtctttgcatgtttgaccatgtatccagctctggattcaagatcacgaacgaactcaaatccaataaacttcttcggattggatgttattccaaagatgacatattcggtccaaaaacaataccaataggacaacatgttgaaatcaattttactattaatttttggcatacaacacgttttatgtgtaatttggaacaaggacctaactataaacattatcagaaatttacagcatacaaggtttccggttttatggttgaggaaggcatataggactagagagcaagagaagatggaatctatttagacaaagaaagcggcaaacatattggaaaatcgattaatttgcataaaatgtatgattggttaaattatgtttaacaatctacctaagaacaaaaaatattttatcttatcatcttgaaacaagaaaatttaccattcttcttttccttcttccccttttcttctagtttttatcattcaaaagcaatctcataatatttggttttaatacatttcacaaaccatctctaataacaaaattcaaatttcttgaaatcccaattgtaatcataaaaactagtcacaatggctattacgagaggctatttaaaggacaatttcgattataaatccaaaatgtaattcaaatccgaattgtaatcataagaaatcctaattgtaatcaaaattttatccaaaatctatccgtttcacccaaaatcaaagaaaaaaggatcaaaccatcaaatctaatatgaaataaaatcctaattaaatacaacacaatcaatagaatgaaaccttaaataaaatcctaattaaacacaacacaatcaatagagtgaattaaaatcttaattaaacacaacacaacataatggttggatcgtaaataagtgaaaaccccttgttttatttgtcttttactattttttggagaaaaaaaactagataaacatatttttttttttataatgggagctaaatagagaatgttttaacccgagaggcccgagtagattaaaatccgaattcaaccttttcggccaagaagaagaagaaggaaatggcgatttgcatgtgttgcgattcacatcttgtaaaaaaatcgattatgaatccatggaatttgcggagtagaacgaaactagggtttgtactggtcgtttgccgttttccgactactactactttcaaggcttcggcggtggattcacctgagagttctttaaatttcaccaagcatatggatcaagcttggataatctcacaggttcgtatctttcgagagttgttgagtttgttgaatttgagtaatcacaagaacgttattacaagaacaaaatgtataaacctaatttagtttgtctttctctacttagttgtttattgtactttacaaattgtctattacttttaaaaacaaatactttatttactaataggttacatagatagtatgatatgatttatagaataaccagtttattattgaggatttttttatgcacaattgaatttcttagttatcatttgatctttcacataaggtttaatattatctacaactggttacttgattttatcatttttttcataattcaatattaatagatttatgtatatctaatatgattattataagatattatgccattttacatactatgccaacaatagtaatacaaatgtgtgcatatataaaatctgaaacacaaaagccaataacaaagcaaaaatctaaatatctacccaaaaaaaatgaaaaactgtttagtcttttttattcgtttttagtttttgcatgcttgaccatgtattcggctctggaatcaggatcaccaacgaactcaaattcaataaacttctcaggattggatgttattccaaagatgacaaatttggtccaaaaacaataccaatcggcaaacatgttgaaatcaattttatgattaatttttggcgtacgacgcgttttatgtgtcatttggaacaaggacctaactataaacattatcagaaatttacagcattcaagctttctggttttatggatgaaggaggtatatgggactggagagcaagagaagatggaatctatttagacaaagaaggcggcaaacatattggaaaatcgattaatatgcataaaagtgtatgattggttaaattaaaaatatttaacaatctatgtaagaacaaaaaaaaatgttatattatcatcttaaaactagtaaatttatacatagaaaaaaattattttctcaatcatataagcaaaccaaaaacaaacaagcaatctggattttgttttgactgtaggaagaatccaaggaattgtagaggagataatgagttggtttaaatcattgaatcaatcattttagcaaacaaaaagatccaactttaatgggcccagggtccaataacccaattgggttattcctagacttttctcctcctcctgttgtcttccaatttggtatgcgagaaaaataaaataaaataaaaataagccaaagacaaatttaaacctccgatttcaaccttctcggcgaagaagaagaagaagaagagaaaatg

SEQ ID NO: 13443 - DNA, 3000 bp, Unknown; identical to SEQ ID NO: 13436
  misc_feature (1)..( 3000): cDNA_ID_2702979_gDNA_ID_2214627_Annot_ID_187825 3000 nt of promoter + ATG

SEQ ID NO: 13444 - DNA, 3000 bp, Unknown; identical to SEQ ID NO: 13434
  misc_feature (1)..( 3000): cDNA_ID_2702975_gDNA_ID_2214627_Annot_ID_187822 3000 nt of promoter + ATG

SEQ ID NO: 13445 - DNA, 3000 bp, Unknown
  misc_feature (1)..( 3000): cDNA_ID_3030159_gDNA_ID_2214627_Annot_ID_187821 3000 nt of promoter + ATG
gtggagatgatattactatttgcttcgttaggagagggatacattaacgtttgacgggagtttatttttgaaattcgttattacttattacaactcaaaatgcatactttgtggagatgatattgctatctgtttgtttttaaaaaaatacttttcattaaggttcgaatccatcttaaaacacgcataaaagatcgatccatgtggcaatatcctaaatggttcaaaaaaaacgcatgaagttccttaacagtaaaatttacattttgcaactccttctgtataaaattactaatatttaatcttttttaaatattcgtattgtctacattggagttgaaaataaataaatcaagaaattgttgattaggagaaacttggtctaatcttcgtttaattaacagcagaacaagaacgtctaatctcaccttcttcaccaactctcactcccatcaaactcatcttcaaaaaagactcagtccatctatcgaaaaaactctcctgatcattcgcaagaatctcaacaatcttcctcgtccgatcatcttccatgagagctgaatccgtttgaaacaaacccttgtgagccaacagattcttgtagtactgattatcgaacgtcgacgatgtctctggatcgttatcaaccaccgtggtcgttggatctagtgacgatgaacacttgtttacaagtgtttgcgcataggagttatcgagagacgcgtctattagttctaagttgccttttggatcaagcttaaacctgctgttgaacgtgttacaatgcgcagctccaatagtgtgcgctcctgagacccgtaatagatcgaaaattgaaggtttgttttaaagaaagatctctctttcttgaatatcaagaaagataacgtacctgagaggacaactagatcatgaacagataagcctttagaggaaaagatattgatcatcttatcaactgtgaaatcggtatctatgatgtttggtctgacatttgctgccattgagactctcccgtctctcctccctgtcggtatcggaactaccggtcctccgagctgtcccaaaaatagtattcacaacaacaagaaacagagttttaaaaaccaaaaataaagatacaaacagagcattttatgcaaaagtctggtttaagttattcagatatataaacatttcttatgtatgtgtgttttgatgaagttcttacagcttctactgcatctcttgcggcaagaacaagtatatcagcacaagagactgtgccgggacaaaagatttcgaggatatttttgacgctttctatcacagcgaatcctcctagagacgcattcccagggtcgcttcgctctgtaccgtttcctcgaatcaacactgagccatcacaaccctaagacagcaatgacaagaacaaaaatctcattaaattggaaatgccttgttatgcaaggaagaggcagtcctgtgagaatgtaatgtacctggacgaagcagtcatggaagatgagacgtaggagcttcccaaggactgatggatcagaggaagaagcagatctaacggtgtttctgacgattaactcagctccaggacaagaaccggcgtagaagttgaaagagagctcagctactgaagaagaaagaagcaaaagtagaagaagagaggagaggaatgtatattttggtttgcatgaaaaaaactgcaacgccattttttaatgtgtctgtcagaagatggaaagtgaagttgcttaatcagccgagagagagaagagaagttgtagttgttgtgataaatgaaaactgtaaatgcatgtgcgttcgtgtcagagagagagagagatagtgatggttgagtcaggagaacttaatgacaatctctttactctcttatgcatgcatccatgagatcgagtcatcaattttacaaacaaaacaagaatttgaaagtggtgaatccaatcactgcatgcagtgaattttatgggtaagaaaccctaaaatagtatgaatttctccattattgtgacaaaaatcagaaaacttttttttgtacctttcagatatttctttttgaagatttaaaaaaatcactcatgcttattgaattcatctttctttgacttgttatagtatatgtcacttttgcatacaaaaaaagaagagagaatctataaatagaaaaatgtacaaaaggatctaataatgtgcttcagaaactctttatttgttgatagtttctgttgataagccaattctttgtctttcatgtctcagaaaacctgaaaagtacaagaaatggtggaaatcagtaaaaggtttgtcgtttttagataataaactcgatatagaacaaaaataaacaagcaacggagatatttggattttaaaacctgggggtcgtggctttggactcgaattcaataacctaattaagcaataatcttataatttcgaaggaaacaaaacaagcaaattttttaatgttaggtttaaagctttgtgaaaaaataatagaaaaaatgtactccatctttttctaatcattttaagtttattccactttaattttgtagttttttttttcttttcttctttattgactgatattataaatcacaaagttcaggatgcaatgattaaatttattagattacaatcaatgagtattagtttatagttattaaaaatatttaatataaaaaataaacagtcataaaataatgtttaatttttaatgtgtgtaaaatccaaaacatcaatgcttacggagatttccttaagattaataaagttgatttttatgtaataagaaacaaaatctcattaaactttaaaagtaaaaaaaataaaaatatgaagtgtcacttatggtagtagtatccaaaacaataagttaatggatttgtttctaaagaaaagaaaaacactataaacagaggatcctcaccatcaactttcactaatcatcacaacttcaacttttcaatactcagattaaca

SEQ ID NO: 13446 - DNA, 3000 bp, Unknown; identical to SEQ ID NO: 13433
  misc_feature (1)..( 3000): cDNA_ID_2713737_gDNA_ID_2214627_Annot_ID_187820 3000 nt of promoter + ATG

SEQ ID NO: 13447 - DNA, 3000 bp, Unknown
  misc_feature (1)..( 3000): cDNA_ID_3030165_gDNA_ID_2214627_Annot_ID_187816 3000 nt of promoter + ATG
cgaacaaatgcatgtgcggtcacgagggtagaatggtaattttcaaggaggatggtattggtgctggagaggagaaaatgggagacagagagaaagccaaagaaaatgaagaaacaacgagtcagtgagcttttttgttttcttttcttctctcagtcttgtctttttttttttgttggggaattttccttcgtgttttcacgggaaatgtaaaatttactgagagaaaattttgggttatgattaatgaatgtttgcttgtaatttcctatccccaatggtggaaaactcgtttttagtttttgtaattctcaaaagtgtgataggtaacctttctcatacagctttaataccaatcagtaatagagtaaactaaaacggaataacataatagtacttaaaattcttacaattttatgtcatcactaagatctacaaaaaaatgaatcatagtatcataacactatgtttgcccaaaaaaaaaaaaaaaagtatcataacactattgatcataaattcaaagcttgcaatgtttcgatggaaacgtgattcatcccgtacacaaactgtaattttatatacattttcagaaactaatgtaatgcattaacccttttgtattacgtatatattctcacattttatattttgtaaggagattcgtttagttactttaattatgaattgttataattgtgtctcctccatgtatttgtgttactttcatattttccttgcatttatatattttatttaccataggatagttctgaatttgctatcaacttggatattttaaattaattgagactccatctagttcaccgtcaaattttaactatacttgtttaactatacttgttatataacgagtgaataaactggaaatagtattactattaactatgaacttacattcgtaatattcgaaaatatgtgcgtgagttagtcttgtcacaagaaaaggaatcatattctttttttcattaaacaaaaattggaaacacatattatggtataaatcaaaagataattcgattacttgccccatttgcctgctttactttcaatttgataatatcccatcaacaagagtcttgttacatgaccaaattttcttctgttctcacgttattaagtattttgaagtgaagtgcactccaaacaaacgtctaaaacttaaggtttgtataatcctcaatcaaaaacattttacaacttatttctatttttttatattggggtctttttcccagctactaatatacgatcacttaagtaattttttgtaaaaatcattaaaaatcctaataaactcatttgcgtagttcaattacacacatacatatgtagtaatataaatattattttccgttttaaattatcgtaaatggaatgtcatttagaattttaattttattcaccacaaatgtttttttctgttttaatatatttgtttgttaaaatttatattttcgtcgctaattagtccactgaaattataatccacaggctagataatccactgatttcaacaaaggtgaaaaaattatataactaatatttgtccattagtagtagctaattaattgaaaacgtttgttctctgaatcgaaagagctgcataagagaaaggggacacgtgtcaaaaacagagtttaatatgaaagcgaagacaatgattctgttttgacttatttgtcatttgctgagctgtctttagaggcgccgagtagccgcgtctcccgcaagaaagttccaaagcaatacttcttctttcattgcattcatttccccaactgtctcaaactttgtgccgcataagcaaaaggtacaaataaaataataataaaaataaaggatggcgaaaacaaaattacttgtatcaaacaagaacattttgttaatttttccgagtgaaaacatcacttgatatggatatgcgattttagttgttgtaagtttctctagcataattgataattcctattaacatcaattttgatatagcattaggacttcaatgtttttatttttagggtttgttctttttgacttcattagtctagtggtactttaagaccactttttcacctcacacatggatgatccagacctagtcaagctaggagtgacttttatgtttatataatttatacatgttaaattattttagttttcttttttaaaggagatgaatttaattcggtgtggatcccgtctctagaaaatatagggtctttgggcttgaacttccaaatattcgaataacaaaaaaaattattttagtttttaacccaaaaagaaaacatttgcgatcaaatgttattgtaaacaacgcacactaaaaagacatttacccttttcggtgaagagacacagggacagctacatgcgacccaaaaaatgagcttaccctctatttcacatatgtaagaatatactctaattagactcagcatgtagtataaagaaggtgttgacaaaaaagctcaaataattcgataaactaacaatgcacgggtactaattaacaaggaattctcataaaattgaaggtaaatttaaacaacaataagagcatcccaattaggtaagagatttagttaagtaattgcgatcaaggaaacaagtacaacagaagtggaagtctgtctctatatcactttcttccctgatgcataaacttacctcttgttcacaaactttgttaacattttgataatgcaatgaaatgaaattagaaattcaaaacaaaaatagagaaaagtacaaccagtggactatagtccaattagtcaaccaaagtaacaatgggccgagctgataatatttaggcccaaaaaaagcctctggacgaatcagagacactggaaatgaacgttcttcttcgcactaactctcaaagaagaagaaaagatctgagaggtggtcgaatgatccaagagaagaagaacaatctctcttagatcgtttgatctgatccaatcgaagaagaag

SEQ ID NO: 13448 - DNA, 3000 bp, Unknown
  misc_feature (1)..( 3000): cDNA_ID_2685770_gDNA_ID_2214627_Annot_ID_135977 3000 nt of promoter + ATG
atcattcaaaagcaatctcataatatttggttttaatacatttcacaaaccatctctaataacaaaattcaaatttcttgaaatcccaattgtaatcataaaaactagtcacaatggctattacgagaggctatttaaaggacaatttcgattataaatccaaaatgtaattcaaatccgaattgtaatcataagaaatcctaattgtaatcaaaattttatccaaaatctatccgtttcacccaaaatcaaagaaaaaaggatcaaaccatcaaatctaatatgaaataaaatcctaattaaatacaacacaatcaatagaatgaaaccttaaataaaatcctaattaaacacaacacaatcaatagagtgaattaaaatcttaattaaacacaacacaacataatggttggatcgtaaataagtgaaaaccccttgttttatttgtcttttactattttttggagaaaaaaaactagataaacatatttttttttttataatgggagctaaatagagaatgttttaacccgagaggcccgagtagattaaaatccgaattcaaccttttcggccaagaagaagaagaaggaaatggcgatttgcatgtgttgcgattcacatcttgtaaaaaaatcgattatgaatccatggaatttgcggagtagaacgaaactagggtttgtactggtcgtttgccgttttccgactactactactttcaaggcttcggcggtggattcacctgagagttctttaaatttcaccaagcatatggatcaagcttggataatctcacaggttcgtatctttcgagagttgttgagtttgttgaatttgagtaatcacaagaacgttattacaagaacaaaatgtataaacctaatttagtttgtctttctctacttagttgtttattgtactttacaaattgtctattacttttaaaaacaaatactttatttactaataggttacatagatagtatgatatgatttatagaataaccagtttattattgaggatttttttatgcacaattgaatttcttagttatcatttgatctttcacataaggtttaatattatctacaactggttacttgattttatcatttttttcataattcaatattaatagatttatgtatatctaatatgattattataagatattatgccattttacatactatgccaacaatagtaatacaaatgtgtgcatatataaaatctgaaacacaaaagccaataacaaagcaaaaatctaaatatctacccaaaaaaaatgaaaaactgtttagtcttttttattcgtttttagtttttgcatgcttgaccatgtattcggctctggaatcaggatcaccaacgaactcaaattcaataaacttctcaggattggatgttattccaaagatgacaaatttggtccaaaaacaataccaatcggcaaacatgttgaaatcaattttatgattaatttttggcgtacgacgcgttttatgtgtcatttggaacaaggacctaactataaacattatcagaaatttacagcattcaagctttctggttttatggatgaaggaggtatatgggactggagagcaagagaagatggaatctatttagacaaagaaggcggcaaacatattggaaaatcgattaatatgcataaaagtgtatgattggttaaattaaaaatatttaacaatctatgtaagaacaaaaaaaaatgttatattatcatcttaaaactagtaaatttatacatagaaaaaaattattttctcaatcatataagcaaaccaaaaacaaacaagcaatctggattttgttttgactgtaggaagaatccaaggaattgtagaggagataatgagttggtttaaatcattgaatcaatcattttagcaaacaaaaagatccaactttaatgggcccagggtccaataacccaattgggttattcctagacttttctcctcctcctgttgtcttccaatttggtatgcgagaaaaataaaataaaataaaaataagccaaagacaaatttaaacctccgatttcaaccttctcggcgaagaagaagaagaagaagagaaaatgacgatttgcatgtgttgcgattcacatctcgtagcgaaatcgattctaaatccatggaattctcctaggataacgaagctaggtttcgtaccagtcgttcgccgttttccagctactactaccgtcaaggcttcggcggtggattcacctgagagttcttcaaatttcgccaagcgtatggatcaagcttggattatctcacaggttcgtatctccagagagttgttgatgtgtataattttgttgaatctgagtaatcacaagaactgatccttgatgtagtcatgtacgagtgaagagctatatgcaattttgtatgagattaagaacttggatctgtgatgaaatgttgtaaatttcagattatgaggtgaatagtatcagcaagtttcaaaaggatttgtatcgaaaatctgtaattgcaaagtaccttttagttggtttctagcaaaaaatgtttgttcacaattcatttgatttgtgcatatgatgagaacatgttagctacttaatcaggttgtagctgttctctatgatccctgagtgatgaggcttaagcaggcttatctcgcaacgcaatgtagttttgtagctttgcatgtacaattgttggattctctgctttttctctaatattgctcttagagaatctatcaaaagttcagactttgaagcctttcttctagcacttgcaatttgatattgagctcgtgtgaattttctagatgttacttgttgacctgtgtttcgattcaatgattttctttgtctgtttttttcttcactgcagcaaccaagtcctgttggatgttcatcgtgcaattcaaagggtcatgtggaatgcaaatggtgtgcgggtacaggattcttcatccttggtgataacatg

SEQ ID NO: 13449 - DNA, 3000 bp, Unknown
  misc_feature (1)..( 3000): cDNA_ID_2713706_gDNA_ID_2214627_Annot_ID_135986 3000 nt of promoter + ATG
aaaattatttctatttcaggtgaatcaaaagttatattctgacaacaagactcgaagttatgtgtatacgaaagtaagtatattatcattatatgtatgtctaatatataattacttatccagttatcctatcatattttctaaaagatttttgatgtacaaaatatttctatgcataacaatatatttaatcatacagattggtgaaaaccaatgttataacagcatgtgtccagctgggattataatggtcagttcagatattgctcttggtttggatttaggtcctccttgtgttcgtggttcaagaacaatggtctcttctgaatttggtttactcaaggtttgttggttatcagtttcttcctttctattttatgatattattatcaagaaatagttcattttattgtatttatcatctatagttataattaaacaagtttatgattcaattttattgattttttctgcaaaaaaaaaaaaaaaaaactcaagtccactttttaaaaaaagtttttagcctttcctaggtctgaacaaaatatttgattcaaaaacaaaacagaatagatttcgaatcctaaaaaataccctgttaaatataaatcttaattactcttggtatcgactaagattgtgcatgtatcacccgattatcggatggatacccaaatttatctaaaaaaagaggttcacaccgatttgattcctatcctatcagatattttggatcatttcacataatttcggtagaagaacaggttacaaaatagccaacctgaatcatacccaatgatttttctccctatctacattttctttcttccaaatttatacagcgtatataacactttgttttaattaaatcatcatacaaaatatgttctgtctatcattatattattatgatctgtctttgttttttttgtgacaattgattaaagaataaggaaaatggtgattggtggctcaagttaggaggacaagaaattgggtattggccagcaaaaaaatttaaagagacttcggccaacaatatcgaatggggaggagaagtatatagtgcatttttaccgagtccacagatgaggaatgatcattttccagaaacgcatatagagtatgatgccatcatttttaatataactatagtcgacgaaaatttcaagagtgttgagcggataaagcatagagaggcattttcggataacactcgtggttataaagtatatgatgatatctatgtagaattaccgataagaaatgccatatattatggaggtccagggaatatctaaaaagcgagaaaataaatctgtaaaagttataaacaaattctataaaagcagcttgtaaccaagcatctaaaattcattattcatctttcttctttttcattgtagattatatatatgaacaaaaacaatttactagagaaatgtccgtaagtttgatgagggcatatagctgtagtcttttttactactaataacattttaacttttacaaataaacttgtaaagaaaaatgtcacccaaagaattatgggagaaaaacaaaactatatttgtcacgctcacttagtcactatgtttgttaacattcttctttgaaagtaacgtaatcatgaactcatcttcgataaattatctagaagttctcctaatgatgatagcaaaagacatatttatgaatggataaatggacaagaaaaggaggaccaatgcattccaaaccatggacataatgcacaaggaagctagctatccaacatcatgatgggttaagccgttgcaaggaatgattgtatgcaactttaatgcaatataatcatggaatgatatgacctgatcacatgagctagctggatcttgcgaaatgaacgtgagtgctacattctctcgttgtcaacaagactgccacaaacaaattcggcactggaagcgaaggaaatcttttccatgcaattcaaccgatttggtgtcaaggacactgattggttgtcatggatgaagactacaactcttactaggttctttaaataaatccgatatggttcgaccggaatacaccagttcaaaaacagatatttgactctggaaagtatttcacttgccccttctcgccaagtaaaaaggactagtggatcaggcctagtcaactttcctaacatattatttatactatttgaacatttttgatcctttttctctaaaatttctctatttctgttgtagcacctgaaatgtcacaaaaccaactcgacggatacttgaaacattttgtagacgctaaactcgacgaaaaactcaaaatacaatgaaaacacaaagactttaaaaagtagtaaaacgcaagagtatataaaatttggttattacattaaagaaacataaaagaaattgtgacttcatttgtatttaattataatcatttttaataaaattatagctgtcaaaatatagttatctattttatgtttacggtaatgtattgtaacattcagtatttaaataataaattagaaatttaaaatatatcatatctaaaataattcaactaaattaaaataacaaaatcgttatattcaattataacaggattatagataaataattatatacaaaaacaatgatattatttattcgtaaatatttaatttcatttataagtttcattttattttttaattaaaaaatatatgtttataatggatccgataaggccctaataagttaaaaggctcacccaataatacaaaaggcccataatataaaaaaaaaaaaacagagagagagagagacaaaacactgaaacagtgcagccaaacagaagatgtcgtgaatcgtaattcaggattaggtttactctctcttccaaactccgcccaatctctctccctctctccgccgcgtgcaactgtaacagctaactaacggtactctgtttcttccttactctcatcgtcttcttcgttgtgtgtttctcacttagaag

SEQ ID NO: 13450 - DNA, 3000 bp, Unknown; identical to SEQ ID NO: 13441
  misc_feature (1)..( 3000): cDNA_ID_4281780_gDNA_ID_2214627_Annot_ID_135987 3000 nt of promoter + ATG

SEQ ID NO: 13451 - DNA, 3000 bp, Unknown; identical to SEQ ID NO: 13440
  misc_feature (1)..( 3000): cDNA_ID_2702969_gDNA_ID_2214627_Annot_ID_135991 3000 nt of promoter + ATG

SEQ ID NO: 13452 - DNA, 3000 bp, Unknown
  misc_feature (1)..( 3000): cDNA_ID_2713696_gDNA_ID_2214627_Annot_ID_135992 3000 nt of promoter + ATG
tgcacttcatggtggtctacaatactcaatgagtgcaaacaaagttatttacaatattttaaaccagaggtcaacatgtgagattgaaataatctcaagaggaaagagtttcataaacatagtctaatttgagacacaatctaattttgagcaaaataacgcatcacgacttacgagccactatgtatttttttagctttggtaaaacctagtctaatttgagcataatcaagcttcaatcaaatatattttatgaaatattataactatcatggaaaaagtttgcgtttttctatatattttaaataaatatatatatatatatatatatatatatgtggatcaaaaatctaaacaaatatccgaattttagcagatatgcggacatcaaatatccagtaaatggcatagtggatacagatctgaaaaagtcaatatttgtatggaattgatcaccaataccatataaatcgtagatatccacttcaagtgcaatcttaaaatatttttaaagcttatatacactaattgaaaagtattggctattggaagaaaataagaataacactttcttttgatatgtaaaatttaagactccacctttctgattgaaggaaaaaaaaaactattttgtcaaacctacaatacactattataaaaggacaagaaatagaataaaattttaaattgattgataagttgcatcaatttcctggcgactattttggcgcaattgttttccaaagtattaaatatgaaatatttaaaaaattaaattaattgaaaatttcttagcttgatcgatttatctaattaaaaagcttacaattgttcacacaccgatttaaaataacccagataacgataaaaaaatcaacaatttaaactacgtacctttagagtatgacatcgatgttaccctgggtttcatctgatgacatgggctgtgtttcctttcaaacaaaatatcggaaactacctccttagcgacggtaatgcaatattctttttcaagaggcgtcacaaacttatagagtatttttttgctctagactaatacgtcatctcaattttttttccgagcactgcgactgccctttatgaaacgatgagaactcttcaatatatcctttgacagagaaaaagaagatttgttttagttgttatctatatcgtatagaatgtatttatatgaagaacgataaacaaaaaaaaatacaaaaaggtataaattgtagaaaaggccaattcttctgaaattgaggaaataaatcattttgttatatcgggtataaattttatgctttaaattaaattcttattttttcttggtatttgtttaagatttgaggtgagagttaaatacttacggtttggagttttgggtttcatatttgactatttaaatttaatttttgaatatataaagtattttgttaacatagtataaaacatgacatcttttcttaagagtctctttatataattaagttgtacatctaatatcataaacctacaaattcaaatttagctatttattttcttaaccaataaagaaactttattgccagtctctatatttaaattgattacacatccattgcagtcaacaaattataataggaattagtaatttttgttctttatttgttgaccaacaaaaatgaactattttttagagtgaaatttttaaaaaaatatatattatcaaaatttaaattttgttttcacttctaactaataaaacctcactaggaagaaaactttaatatgatgtttttgttattagtattttagttattcatatgtgtcatataagaatccataatcagtttaaagttttaatttgtatagaaaaagttctggacaatagcacatacattgtttatgccagttaatgactaatgcattagccgttttatagaaattataattaaatttacagttttataagcatccaattttgtcttcatactctatttatgccagcaaattacaacatgcattgggttgtctaaaaaagagataaaacagtattaaatgttagataagcgttaaatttttcttcttaaaaaagacaaaattgtaattaatgttccaactttgtcaagctttaaattttggtttcacttcgtttcttctaactgccaagccaagtagtcaacatagacacctttttttccttgtcaaataataattgtttttaaacagtttatgtatataaatcttaaattctttaacaacaaggaaacaaatcgtaaatgtacttatctcttaaaatttaatttttactttttaattatgtttgtgtccaaaatgaattgtgagtagacccaaatttaaatttgatttacattaaaaagcatctcaaaattcttcattcaactagacattcaaaaataagtatttattaacggaaattcaaatattctcgctttaaaaagtacctataacaaacaaagatagctttgtaaaaaacaaatttagtcataatataaatatatgaattgttagggggactaatacaatactaactacatttctaatgttcgcgccactttttcagatttacacattattatatatatatatatatatatatatatatatattgataaaaattgtcttttacttttttgtatatattatatattgattgtaacaagaaacaaaaagtggcttaaacataatatctaggttaaaatatacccttagttacatttttcatgatacgttttacttactcatcatcaacaacaaagtattgttataaaaaccaaaggaacaactttacattttatattttatttgtcacttttggttttaaaaaactattttttcatatccttattttatatttatatatatatatatatgtaagtgaatttggaggatgaaattcagtttacatgcatatcagaaatttttgttttctttaaatcttcttcataagaaaactgaggaactgtagtttgggctctaattttccataacttttca

SEQ ID NO: 13453 - DNA, 3000 bp, Unknown
  misc_feature (1)..( 3000): cDNA_ID_2713692_gDNA_ID_2214627_Annot_ID_135993 3000 nt of promoter + ATG
tattttatgaaatattgtaataatattgtgaaaattttaatttttctatctagtctaaatattttattttgagtagatcatatatcttaatgaatatccaaattttaacggatatgcagacatcaaatattcagtaatggcataatggatacatataaaaaaagtcaatatccgtatggaacggatcagaaataacatataaattttgaatatccaatccgtgtccacccttacgcttctatacaataatgaaaatattggcaattagaagaaaagaagactaacaatttcttttgatatgtaaaatttaagactccacctacatgatagaaggaaaaaaaccattgtgccaaaaagagaagaagatataaataaattaagttgattgagaagttgtatcaattttctggttattattttggagcaattgttttccaaagtagtgaatatgaaatatctaaaaaatttaaattaatttacaatttgctaccttaatcgatttatctaagtaaaaagcctaaagtaaaaagcctataattgtgaatacaccgattgaaaacaacccagttaaaaataaaataagaaatcagcaattaggactaacctttgattatgacatcgttgttaccccgcatatacgaagatataagatagtaatcatcgcaccatttatgttaacctcggctatgtctcccgtcaaaccagatatcggaaactatctccttaccgatgatagtgtgatattccttttcaagggtagtcatctcaaatcaaatttttagaatagtttttgctctcgactaatacgccatctcaactttctttttgagcattgcaacccttaatgcaccgatgagagaactctttaatagaagatttgacggagaaaaataagacttgcttttagttgttatctatcttatcatataaaatatggttttctgagttactaactcataggattgtgccatgtgtcaattttatccatcttagattttgacacgtgttaaataaaactttatttttattaattttaagactaaaaacgaaatttaagataaaaaaaaaaagaagaaagaaagataagttttagaaattataaatttaaaattaagtgtaaggaaactaaacaatttttaaaatgtaaatatgataattataataaaactaaaaatgtataaataatagaaaatcctaattcttttgatattgaagaaataacccattttggtatatcgggtttaaataaattatgattttttcttgggatttgtttaagattttagattagagttaagtaattatggattaagttttcaggttagagttaagtacttacggtctatagttttgggttccatttagaatattttaattttgtttgttgaaaatataaacttttttgtcaactttagtatgaaatattacatattttcttaagagtctctttatataattgagttgtagttctaaaatcataaactcaaaaaatccaaattaagctatttattttcttaaccaataaagaaatctttattaccagtttttgtatatttaaattgattacacatccattacaatcaacaaattataataggagttagttagaagtgaccagcaaaatgaactattgtttagagtgagaatgaaatatatttttatcaaaatgtaaagtttgttttcacttctaacttataaaagctactaggaaaaaaacatcaataaagaaacttttaatatgacgtttttgtatgtttgttttagtaattcacatgtgtcatgtgaactcataatcagtttcaaagttttaacttgtattatagaaaagtgttggagctggacaaataaatgcattagctgtttttatagaaaatttgtcttcagactgttttttttattcgacagcacttctgactttgtttatgtcagctaatataacatgcactggtcgtttgaaagaaaaaaaacgttacatttcgtcttctttaaaaagataaaattcaattaaatgttcgtattctgagaagcgttaaattttgtcttcacttcttttcttctaactgccaaaagtcacaacatacacgctttatttccttttaaaataataattggtttttcttttcagcaaaaataataaatgttttgtaaagaattttacatatataaatcctaatttctttaacaaaaaggagaaaattataaatatactttttaatctatagaaataatttcctaaaatttaatatttacttgtattatgtttgtgtccaaaataaaatatgagtagacccaaatttgaatttgatttacattgaaagtcttcatttaactagacattaaaataagtatattaacagtatatcaaatatttgcgcttaagaagtatttataacaaacaaatttaggcttgtagaaaacaaatttagtcataaaacaaatatatgatttttttaagaattaatacaatattaactatatttcaaatatttgcgtcactttttcagatttacacattgaatatattttgataataattgttattttattaatgtttacttttttgtataaattatctattagttgtaacaaaataaaaagaaaaggggttttgttattgtttatcatctaaattaggtagattcctttagttagtgtttgtttttatgtcttgttgagcgagtcatcaaggcttcgaacttgtattgtatcagagtcttatcattactctgtggtgcacctcacctcgtaatcatttcccctcatttgattccacacgaaagaagcgaccgccatcgtgttcgatttccaacttaagtatggaacccttgtatccctccaaggccagttagaagaagctagaaagaacctcacaaattctagaaagcatgaatattcactagtccgagaataagtaaccaagcttaacatagcggatatagtaagcaagtgacctatattccactgtccaatcttcagcaatcagagagagaaaagctagtc

SEQ ID NO: 13454 - DNA, 3000 bp, Unknown
  misc_feature (1)..( 3000): cDNA_ID_2993328_gDNA_ID_2214627_Annot_ID_135996 3000 nt of promoter + ATG
cccttaactgactcattatgcggctcacataaactctgtaatcttcatcttccaacatatccgtggttaagcagcaatcaaagactgtaatacaaaaacatcaaagttcagcaaccttatagagcaatcttatatttcgtaagcagcttatagagcaatcttttgtatctttctcactaaaatagtctatttctcagagctaagcatggataagacaaggacgaatttgagaagtcatgcaacacagtgaacatacaaaacctgaaaaatctatccatgagctaaatctcaccgatcaagaatcttaagctatcaaatgttagattcagttcaattaacaagcctaacaagaagtacactataaacttaggctaaaattatgatttttaagacctaaaaattcaaactttctaaaatttaatactctaagagcaagggataagacaagcaaaaggatttgagaaatcatgcaacccagtgaccatacaaaagaaactgtttcctgacaattctttgagaatgagacatcttaagctataatagatagactttccaccaatgagcctgagcctgtgctcatggatagttaacagaatccatgaactaaatctcacccatcaagaatcttagtctatcaaatgttagattcagttcaatcaacaagcctaaaaagaactagaaactaaaacaggacactacacttatcaaaatctgatcttaagacctaaaaactcaaactttctaaaaatcaatactccaaagcccaaagaagagcaaggataagaaagcaaaccctaaacccatcacttaaaagaagaaagagcataccgtaaactctctctgagatctcaagcaacccttcaggaggttttctgtgaaagaactttctaaacaacgccattgagaggtttctttaaatgcttaactcaaaaaagcagagaggtcacacaatccctagaaataatcacttatgaccaaatgcgacccacattgcaggaaaaaccccaaataaggagaaaacaaaaacgagaaaaatgtcaggaagaaagaaggaagcgtgagataatcttattgctgggtctttaaggaacaatgcgatgtgggttttgtttcttttgtagtttggtggtttgtcttgacatacacactttcaatttcttccgttttggaattggaaacttagctttcaatcaaaacagatgtttgatagctctgcacatgcgagaaagaagaaagggaatgatgcagagagagaagagagagagtttggttatcttgggaaaagaggaactagggtttttctttgattctaagaccaagaagaagatgatatagctattgagaaattcagacagagattgaggatgatgtcggatttcagatagaagggaaaaaaaagaaaggaggacccaaagatctgttactttgtttaggactatgatacatgtcttccaatattcttttttgagttatttaagatttgctttcttttctttcctaaactcggaatttgcaatttatttccttttgccatgacttcatttaaaaaaattaaataatctttgaatgagtacacacttagatatcatagtttgtttttaagtcattaatgagaaaaatacaatttttgtaattttatatttgttagaaataattttttagctaccgattcaaccgcgaaaggtagattatggttcgttacatatatattgaaccaaatcgacggaatacttggtccgtcgaaaaagttaattggttttaagaatattggggtcacatacaaaataaaactgggatttttggtatatgtataaattcatttttctaatttaatatttacattaaatttagacattttaaatgaaaagtaagctattttttatattttttgaagttcacaaaaaacattttaacgattttgaaaagtagatttcactttaattattttttcgttacactttttaaccaaattacataaaaaaaatgtttcattcatcggccctgatcacttctcaagttttccaatatatgacattattggaggtaacaagatataatacactaatatgactgacaaactgcacaagacattttcttcatgtccctatatatggttagggagaccaaattcacctaaacaatactatagtttacggggtgatgctagacatgtcagtacaatagtctcaatcagtgggaaacgttgcacaaacggatcatgtagctgagtaaatgagttgatgcctcgttagttggtaaactcatgagccattcttgctattagttaaaccaaatcccttgtataaacacgcctctcatagtcatagatgagcttatgtcttgttctagtaaatgttataaagaagataactcaattgataattggttttagcacttggtccttgctctgttgattcgaaatccttattgaaaaaagaagaacaacgtaaattccttgttaaaatttttgaaaatttctattttctttgggccaggagtgatctcaacaaatatatccgaaaatgtaaaggtgtgtatacgtatcaccccaatagctaataggcccaatacggcaatacccaaacgtcaccatcaccaaatagaatgactagattttactttgtttactacgtttattcacgaacaattattttgtcaaaattaaaagcgagacaacgagaaacactcatagttttgcctgacacacacaacaaatgtcagtatccataattacattgtttcaaattttctctaacggttacatcactcgcaacggctacagtaacaaacatttaacgtttctttaccttttcaaaattcttcttttttcacaacaaaacaaaaagtaaataatctaacggctagttttcgaattttcaccactataaaacctcacaagaacctcctcataactcagcaatttccaaaacaacattcctaacactacactccaagcaactagcttctctactactcaatactatgtttctatcggcatct

SEQ ID NO: 13455 - DNA, 1826 bp, Unknown
  misc_feature (1)..( 1826): cDNA_ID_2993331_gDNA_ID_2214627_Annot_ID_135997 3000 nt of promoter + ATG
cttattagtactttagtagtatactcattagaagctacctctctccattattacaatatcaatctcaaatgttgttctatataacatgtgtttactatagaatatctttattttgttcaatcagtatataacaattcccttttcgaaattgaagctaaggaggttttatgcgatgagggtgatacttacatgctcaccgaattcactcccactcgttattccgattcggtttttcttcgtgaagcgaggctcttaaagtatctgcaccggtgatcaaagtgaagtgtcttaagttagattaaaattttaatcaataaattgtaaaaatattaaacccaatcaaaaagtgacatgtaagtaaaaagtgtctttaacatatgtttcttctcttttctcctttcacaaatatttcaaatttatattaaaaaaaaatagtataaacactcgttaatataatcgatggaggtgcttttagaagacgtcgaagctatcttcaccaacatgggtctaggaagacctctctcgagagttccttgcctcattgaaagtcaaaaatattatatttttagctatttaagatatttaaatgttaataatgttgtaatacaatatttaagtcgtaaatatttgatagaccacataattatttttgtgcttcaagcctctcaaaactaaggaccggctttcacttggagacaaaaaatcttctgaagttcctttttcttgtatttttttcttccatttctattacttcacatacctaagtgcaaaaattgattgtatcatgaaactatgtatgttcgatataaaaacagaaatcataaattttgttaaatgccaggtaaaaactagcatatgttaatttgtttttgcaatttatcctaccataatactctttttctgtttaaaatttttaatatacttttagccaacgacaaaaccagtttatatgaaagttaagatgacaaaatactaatggtctacatatagcaaatacacaactagttaaattcttctgtaattttgctgtttacaatgacgattacacacattcttaaagctgtgatgacgaatcagagaaagctttaaacagctgtaaagattacacatctcaagttttagttaagtaagttattaacaagaaaaagttttgaaaaaagtaaagacctttaatagttttcttttctcggacaaaacaataaataaaaagaacacactttttttatcttttgtccttaggatttgattgtacatacatctgatctcaagtgatttcaagtggttggttctgttccttttctcgtccccgatcaagtttcttctcctaaactccagaatttggtcttgaagatctctaaaggctcttcctttttgttcatttctctacccagatatgtaagttgctagcttcttctgtcataactttaatatctgaatctttttccgatccaaatagtcaaatattcgcatctaggtcaaatcgattcaaaaccctttttgttgattgatgtgctaagtagttctgagttgattaagtctatcagtttaagagaaaaggattgtgtaagattatgattcgtacaagttagcttctttcttgattaggtccactgtgaatcatgcacacgtttatgaggaagatattagattgtgtaagattctgattggtttgatggtttcaagttagtttctttgttgattattgattgctgagtagttctaagttgattatgtcaactctgaatcatgtacaagtctatgagctagaaaatgaattgtgaattgtggagctaagaatgatgttgttgttttggctgaaagcgatg

SEQ ID NO: 13456 - DNA, 3000 bp, Unknown
  misc_feature (1)..( 3000): cDNA_ID_2703017_gDNA_ID_2214628_Annot_ID_135999 3000 nt of promoter + ATG
aacagaaacagtaaaacactcgaccaacacagctctttgcagagcattgggtgaggtcgagtgacaggtcgagtaacagacaaaaaataaaacagggatactcgactgcacagtctgttgccagacaactgggtggtcgagtatcaggtcgtgtaacagtaaagaaatgtagaaattaaacaacagatgacaagatgcagtaaacaacagtagagtaaacaaagaattcaatcagataaagaattcccgaggatggggtaatcgagtagcttcgttttctaagtttacaggtgattgacatgctcaataaattaaccctagacaacaagttcattaaccaaatctaagtgccaccgcaacagagaccctcaagttaacctagtcccagactcaatcaccattgacgagagctacctaacaggcatgacgaatcaacaagttaaagccaaaacgctccctgcaaccaataccttggtacagggtcacgaatctctggaattagtggttcagacatttcatcgaataccttttgggagcataaaatgtctgggctcaaattccagttgatcagaaagcaataggcattaagaacaactaatccagaagggatctatcaatcaatactcaatcacctagcatactcagaattctacactactctaacccatcctcagaaatctattcactactcaaacatcataacagaaagcataaacgttgaacaagttgaaaacatgataacaacagtgtaacaacaggatgataacagaatgaacaacagtaaacgaaatcaagacaaaagctgaatactgaatactgaatagataaagagaaatccggattacaaaaagactagaacacaaggtctgcggaataaaactaggtaaaaacttctttttgcgaaaatgtgaagtacatgctacttatagccaaatatcccgaaaccctaatactcaaaacgacgaagtattgggacggataaagaactgtactcgacccatgtggtcgagtgggaggtcgagtgagtagctggagtcttctttcctttcctgtgctcgagtgtctggttgagtgcggaatgaagaaggctctgaagcttgtcatctagtatgcagtcgagtggtgtgatggtgatactcgacttccaagtagagcaatgaggtcgagtagtggtctggcaatgaaggtgaagacactcgacctcgtggtcgagtgaagtgatcaagtgtttgtcaggagatactcgacttccaggttgattgacgaggtcgagtggttgtctgatgatggaggtgaagacactcgacctcatggtcgagtgatgtgatcgagtgatggagatgagggcactcgacctcgtggtcgagtggtgaagtgaagtggtgatgtcctctactcgacctgggggtcgagtggtctcttgagatcttgaagctcctactcgacctctgggtcgagtggtttatcatgatcagatccgcttcttccagatagctcgtcaacagctccaaatcacctgaaatcaacgcaaatatgcaacatgcatgcaaaactatcctaaacatgcaaagttatgacaaatgatgtgaaatggtataatcagtgatgatatgatgctaaagtgatgacaaatggatgctcaaaacatgcaaaatacacatttatcaactcccccaaacttagtctttgcttgccctcaagcaaacaatcaagaacaagctggaagtaaggtttgaaagcggggattcagagccaaagaaccagatagaccagatgaaatcaatgtccaagttgaaagttctaagctgcaagatcaaattctacttaaagacgttagccatgcctcattatcaatcaatccgactcatatgctcgacccacacatgttttcaaatctaccaatccctttaacattcattagttctggaacgtgaatcaaacaatgcatcatcaatgaactcatttggctaaggtaaaaggtcaagagacaaagatggtcccttacagaataggcttcagtaacaggggatctctcaaaaaatgattaagctttaatagaatgctaaaggtaagtcccaagctatgcatactgagataagatcccatctacacagagtatatcaaatgaagctctaatggtaattgttgattctgtaatcaaacaatgaatttgtactaagggatttagacaaattcactcctctcttagctcacaaataatcaaaggaaaagaactaagttgcttgaacaaaaagctagggtttgctctgtaatagtagtctcttgtattaggttaaaaatggtctcaatggggggtttgacccctctatttatacaatgggtcgaatataccaaaatatgataaacttctaattatcctaggtctaaatcttcattacttctattcttcataagatcctcttctcttaaatggaagttttccctttacacgacctaagaagttggttatggcgatcttgattgtcgacttaagtcttcgggcgagctcatgacttaggcccattaacaggctaaccgggataccccggttcaatcgacttctcgattttattcacattattcctcggtttaaattggtattgtcggaggtgctaattcctgcaccaacaattagtccccccccagtccggagaatccgagttgcctaattcgaaatttccgaacttagaaattgaatatttgatttaaatcttggaagacgtgaattaatcattagatctccgaatcgattcgtatttcgaacgtatttgacacgtgtcaaatcgtcgcatctgtacgcgcgcgtgaagctcaagaaccgaagcgtcccgtaggtttaatgatgacctcgtaggcttgccgcccattcgtctctatttatattcgaccaaaccctcgggaaatcattttctgccgcttgcaagaagaatcaaaggtagctttcgctctctcctctacgaattattttgtattctcgattctttatcgatttttccggca

SEQ ID NO: 13457 - DNA, 3000 bp, Unknown
  misc_feature (1)..( 3000): cDNA_ID_2702994_gDNA_ID_2214628_Annot_ID_136003 3000 nt of promoter + ATG
acattattgattcctggtccacaacaaccaggtaataatatcgatgtctacttagaacctcttattgaggatttgaataatttgtggaagaatggagagttaacatatgatgcttttagtaaaagtacttttactctaaaggcaatgcttctatggactattagtgattttcctgcgtatggaaaccttgctggatgtaaagttaaggggaaaatgggctgtcctttgtgtgggaaaaatacagatagtatgtggttgaagtttagcaggaagcatgtctatatgtgtcatagaaaaggtttggctccaacacacatatatagggaaaagaagacttggtttgatggaaaagttgaacatgggagaaagacaagaattttaactggtcatgaagtttatcaaaatctgaaaaacttcaagaatgattttggaaatgtgaaaaaatctgggatgaagagaaagagaactgtctataaagaaccagtctatgatagtgatgatgtatccagtgaatccgaggaagatgaggaagtagaagtagatgaggatgagttatatagatggaagaaaagatcaatcttctttactttgccttattgggaggtatgattacttgttttcagatttaaatagcttttatatgtttaagtatgatacatcgattacttctaaaatatatgtatgtctatattgtaggatctaccagtaaggcataatttggatgtaatgcatacagaaaagaacgtggctcacagtattgtatccacattgttgcattgtggaaaatctaaggatggtcttaatgcacgtaaggatctgcaacatcttggtctacgacacgctttgcatcctaccacacaaggaaagagaacataccttccagcagcaccttggtccttgtcgaagaatgagaagaagattttctggaagcgactatttgattttaaaggtccagacggatactgctctaacatttctagaggcgtgtcagtaggagagtgtaagatatcaggtctgaaatcacatgattatcatgtcatgatgcagcagcttcttccggttgcacttagaggactgttaccaaaaggtcctagaacagctatactacggctatgcgcattcttcaattatttgtgtcagagagttattgacattgaggttatttcagtattggaaactgaaattgttgaaactctttgtatgtttaagaggtttttccctccaaccttctttgatattatggtacacttgacaattcatctaggaagagaagctagattaggaggaccagttcattttaggtggatgtacccatttgagaggtaaatcttatctctattagtaatttaaacacttatattatctagttattgttttattattgctaatccttacattttcattttacagatacatgaaagttttaaaagattttgtgcgaaacccagcaagactagagggttgtatagctgagtcctatcttgcagaagaatgaatgcagttttgtaatgagtttctgaaaaagacaaccaatgtagaagaaaagctagacaggaatgtagagtatgtgaacagctctatattagaaggccgtccaatatcagcaggaacatcattcacgcttactgaaatggacaaaaatatagcccatctagctgtcattcaaaatacagctgcctttgatcattatgtggagtaagttccttgtgtaattttccatatcaaattacatttatctagctgattctaactcaaggtgtttatgatttggtagtatgcatttacaatatttacaagactcaaatacaagatgcagacgtgatgcttcagttttatggtctatgcatgctaagaattttgctgcttggttaaaaggagaggcaagtaaattatatttgtaatgatgagtctgtttataaatctatacttgactgaatcataattttttattttgcagatatctaattcttctgatgaacatgaagacatagttaaatggctagcatatggtccacgatgtactgctaggtcctatactggttatatagttaatggacaacgttttcacacacgctcacttgaaaggcagagtcaaaatagtggtgtttattatgaggcaacggctatgtgtagatctagtgctaaggatacttcacaagtagttgatttggtatcatattatgggagaatcattgacatcatattgctagactacaatgtgttctatgtgcctatatttagatgtgaatgggcagtaagaggtaatggagttaaagtggaagatgggttcactcttgttaacttgaatcagagccaagtaagctttctaaaggatccatatatcctagcatcacaagcaaagcaagtattttattcaagtgaagaaggatcaaattggtctgttgttatgagaggtgcttcaagaagatatagtaacgatgagtctgaggatggaaatgcagatataattggtccattaccagtagacgttgacatggatactgaaatggatgaagctgaatatgctagatctgattgtgaaggcatatatgtgccaaatgtaacttcttgattcatttatatacggtcttctatatgcttttgtttatggttgatgtgtgatttttatagatcttctatatgcttttgtataattgtcaagttataactaattaattattccttttttgcaggtgaattaaaatggctaaaggaaagaagaagagtggacaaaagagaaagaagaagtctatagatgatgaacctgagtatcttggtattgtggaacctgtagctacagaacagcgtgtagaggatcatcattcagaataaccaccaactgaaaagcaaccagctatagatgaagaacctccaactgaacaccaaccatctatagatactgagagagatgttcccaattcagaagagccagaaggagaggttgaattttctggaggacatgagcagccgcgtaaaagacaaagaggaccaacaaagatg

SEQ ID NO: 13458 - DNA, 3000 bp, Unknown
  misc_feature (1)..( 3000): cDNA_ID_2703011_gDNA_ID_2214628_Annot_ID_136004 3000 nt of promoter + ATG
aagataaaataaatagtgttacttgtaagtgttgaggttaagcattagcttctaatgataccatagctttgagatatttcatggagtgttgcaggatgtttatataaataaagctaatggataatcacctagtgagtgtgaaatggggccgtttctaggagaataaaagagaggctatattctccaaattcactcatgaataacgaggcatgttcaaggccaaaatgaacacaatagagaactaaagttctatgagaaaatgtcgatgtgcgatatatgttgtctcggtttacatcaaaatttgggtggttcaagacatcatgttcacctcctggccgagtaaacccgacatatattaaaaatgattggttcaaagctgaaaaatgttacctttcagatatagttatattttcgcatactctcgaaagtctgtctagtctagtcaaattgtgtctggtctagtcaagtctagtttagtttgttaaagtttgtcgagtctttcatatgtttagtttgtcatttctattcatgtgggggattgttgagctgatttttacaaaagcccaattgggtttagtataatcaaagaatgtgaatatcaaatgggccataatggatttgtttgctcaagatggagctccggtagatgacgggtcgaatttgaaaggagaaaacaagtcactgaaggaattggtctcttctgtttcacgatcccttgagaataggattcatggagagagtggttactccttcacgtcgtccactcctagatttgtggttgactaaatttgatttgttgaaaaacaaatttaaaccttgtaatctaatctctatataaacctacgcttcaagtctttgatagacacagtgaagtatttgatcgttacacacaaatagcaatagcaaaagctccaacaatctctctatgttaaaagtaagtctcgagagtatcgtagtaactatgttcgttagagctgagtttcgaatgatgcgaaatcagtaaatagaggttgtatcctgggatctttgaatcacacagaaatcatcacactacgagtgattcaaagggttaaggaaagagttcattaactcgactcctcccatgttttttccttaatgtttgtagtttcaatttcaattacctttatgtagtgtttacgaattttagctcctacaagaatcaatgtctaagagtgacactaaagtcaatgtagtgtttcttctcgtcacaactgaccaccccttcatagacattccaagcgcagggagcacaagagggttttcaacaagtagtgttttattcttctcaaaagtcgagaatatgcgcaatgctatgacgatgttctctagaaactcgagattcaagtctcctgaaatagagagcggaaacagagagcgaagtgagcaacttggcaatggaatcagggattttggcgacaaagtaaacacaaacagtggaaaatctcttggccttgagggtaagctcttttgcagtttctgtctgatcttcaatctaggaaggagaggaaatacgctgaagcaatgattcaatgtcaccactgaacaggtcaatgacttcatcagatggttttggccaatcaaaaatgcgaattcgacaacattccataataacctcgttgatcaaatggtttggtatcataaaacggtggtaaaggacttgtttggttctagggcatgtacgtcactacaacaaatatggacattgatagcagacgaggatagctcatttaccgtacctgctataaaagatgtgatttttttcggttactttataatagcacctaagaaacgctatgatagaaaaattatggagcggaaaaaaaaagtgacttagtccgccaatacttagtgaattattatttcttctaaaaaaaaaaaaactctcgatacttctctctcgtgaaaacctaagctcaatattctctctctcgtgaaaacctaatttcttcttccaaattctctgtgtgtacaagtgaaatctctatcaaatctccagcattatcgccgttcgtgaaaagccccaatttcgctgttcgtgagaagccctaaatctccatctcagctcaattgaactctcatcgaaggcatgtattctatcctctgtgatttcattctctgtttcatatctctgtgatttcgacctgtttgattgagatttcgacctgtttgattgtgatttcgacctctatgtgtgataatagtttcgactcaaatttagattatgatttcgactgatttgtttcataaacgatttgtttcctaaacgattgtgaaacttatacaaattagggtactgatttggttacagatttgttgcataaacgattcatgtttcaatctgtaacgattcatgtgtaaacttatattgaatgagttttttttttccaagtgctggtgattgcaatgttggggaactgaagcttctcatttctctgtactcacacaacaggttagtatcattcaacaaaattagttgattgcaatgttctgtcctttgagtctgattcgtatatagcttgttaatgttgttgtttatgtgatgagattagtatacttgcttaattatcttaagttatcgtgagattagtttatgtacatggaattgcttatgtgcctgatttggtgtactattgactgatttctaatatgaaaaactcttttaaagttgcttatggtttgaatatttacatggaattgtctgaattgttgcttattgtggattataattggaaaattgtataatctgtatctctattttatctataaagggttaaatttatattataacatataatgttggacaaggcatgggttcatctaaacaggtaaggaattataattatagttaggtttcatatggggtttggatacttagagtttctatttttttctttacttatccattgaagagctgatcctggctatgaaagaggtgcttggaaatttgtacgggatgttgctgcggtgttaggagacatg

SEQ ID NO: 13459 - DNA, 3000 bp, Unknown
  misc_feature (1)..( 3000): cDNA_ID_3030232_gDNA_ID_2214628_Annot_ID_187877 3000 nt of promoter + ATG
tgttgccaatcagactttaacagctaaagttttgaaagccaaagtgtctacaactaaattctctacagctcaaatttttacagttaaagtctttacaaccaaaattaagagtcgttaccaatcggcccctaaattgcttcatgtttggaggtaatattctgttaaggccggtgaatctatcgaaaagattttggttgatgaagctgtacgtattatagttttaacattatattttgtccagccttatagtgtggtcaagcatcattttcacttattaatgattatttttgtcttatagggtaataagatgtatgctgctttgagaagagagcagatcaagaagtttgaaaggtgcttaaccgagggtgtttggaagatcattacgaccatcactttaaatcctacaagtggtcagtatcgtatttctgacttaaaatacaagattggttttgttttcaaaaccattgtctctccatgtgatagcgtctctaatgctttgtttctctcccttgctaagtttgacgtgatcctctctgggtccgctaacgctaatatcttgtacggttatattaaaatttatatattaattttgaccatacatgcattatctcttctatagtctatatattcatagatttattctctttgtctatatagatgtaatggtataggttgttgatcggtctgaaatccaagatcttaacgctaacaacaagtccaccaagaaaatcgatttccatttgagagatcagcagtactaacaatctatattcatattccttcttatttagatgtttattatttatttactatttactaataaatttattcttttcatttaagtgacactcgcttggcatgtacactttgggggaagtatgctgagatcggtgaccaagcttgccagcagttaaccgatggtattgttgtttgcttaatccgatttgcgaagatcaatctctacaacggtaattatattgatatgtactactacatatatgtattgttttttaaaacatgtccttttttatacacagataataggagtgtttccaattcatttgatgtttcacaagtcttcgttgattctacattggacgagttgggtctttttaagcaaaggtaattgtatttctatttcactaaatatattttcttctttataatattaagcacggtatattacctttatatatagcataccaatcgatgggttgactttagaaagttctggatctttccacaagaggctctatgcaccaagaactggggatgacgatggtgattatccaaggcaaataatcaaggaagtccttacagctacttatgtactattcatgaatttattttatctactaaccttttattcttctttttttttttctttttttaacttagtttgtgaaatcctctttatattcatttgaaggtgggtaaatgcaaaacaatttgtactgtttcggccattgatacagattggccgtggtactatttttgttgtcgtgctcacaacaagaaggttgtcaaagaggaagttatcaaactttaagatgtcaagatacctcaaaagccaagattttggtgtgacatatgcaatggttttgcaaaatctgttgttgccaagtgagtcttttgtgaaacctttatattgaatgtattatgaattataattcggtgtttaagagataataatcctatttaactcttaggttttggttacatctccatattatggaacaaactagggaagttagatgcatgttattcgatagtcatgcaatggatattcttggcactactgcccctaaattgcttgatggttcatttgatgaggtatatcgcttttttaaaaataaactctttcattaaaatgactacgttcatgttataatagagtagattttttctgtagatcgaagacccaactgttttgcctgatgtgatcaatggtttgaaagggatgacttttcagtttctattgtgtattcaaaggcaaaacatatttggtggatatgattcattcattgttgccagagtctacaccggtaacattgctgatgaaatcatacaggaagactctgatgcatacgttgatccatcatccatagtttctatcgatcaggtttgtctaataacattaaacaattccaatcatttatatttatattttatggttgtcttattaaaatattttttgtattttcatataaggttcccttatgctcactaatggtgttgatctttctgatgtggatttgtcatcaacctctattccatcatcaaaacgaaaagatttagatgatgttgatggaaatgatcaggcttccacaagtaggaagaagtgttctaagataaccatgcctgaggaaggcttcggtgaatgatgcttaatgactacttcatcttggatcgttttcttcattattatttctttgcttaaagttatcgatgttgttttcattttttaggttttaaactatctttattttatttgttgttttggaattaataaaaaaaatttcatttatatgtcgttttgttaaacaattttattattttagttatatttatgattaagaaacatattcttttatattacaatgttaatcagacggagaactataaacacttttggtcattttaaacaaaaaaaaccaacaaaatcagaattaggaaagattttgtacactaaataatcaatcctattaaatatgattaatcatgagaatcttgaaaaacaaacctattcctattttttcatacattctcctttaaataattacaattttttagtaacaggctaagaaataaatatcaacattattgttctaacctataagaaatcctattggttgtggacaattcgtttcctttttacacatcaactgtccatcattgtatcttttcgtaattatataaaatcaaaaacctcaagcctaaaacaattaggtttaactcttatctttcaaacaaaaaaaaaaacttccttggataaacatg

SEQ ID NO: 13460 - DNA, 3000 bp, Unknown
  misc_feature (1)..( 3000): cDNA_ID_3030224_gDNA_ID_2214628_Annot_ID_187880 3000 nt of promoter + ATG
atctttacatatgtatgtatgtatgtaaccattgattcatgctatgtttattatttatgtatatgaattctgaagaatactatttagaccaacaaggatgataaaaataaaatgattatttgttaaatggatctttcatttttaaaagaaagagaaaaaaaaaaaattatccaaaaaattgtgaaacaaaatatatataaatttgtagagattttttaattattatggaagaagaaaaaaacaagttttctacgcatttgttttaacaaccgtgtatttgagggttttaaaaaaaaggagaaataaagaagaaaaattaaaaatggctttaaaaactttaaaaaaaataaagcataaaaagtttgattggtagaaaaaaaaactgtgaggactttagaatactcttaaagtcctggaagtcatgtgccaatcaccccctttaacctgaatacgccaagcgtttttgtaaggcttaagcgatttcaaaggagtaaatggaagaggattagcgagcatcatttaaaaaaaacaaaattagaaatgaatgtatgagtctaagatgagtgagtagattgaaatgaggggtccgatatttataagaataagtggttaagtaaaaaacaaatacgcaaaagatattattcctgaaaatcaagtttattccatatcacaaaatctcataattataggaaaatgtttagcatttaccgtaaaagtgggtatgtatatatggaatacgtgtggaaaatgtaagataattccaaatgaagatccaaatggaatattagatgtgctataattatggagaagtgatatattcgaatgctggaaacgaagatacgcaataaattaaatgaaattaatacgattcgttgcctgatatatagtcagataatttttttgcatgaaactacaaaatcgtacggctagtaattaatctattcaatggctaggattaaacggagaatccgacttttttaaaaaagaataaaaagaaccgcgttttttttttgggaaatacgaaatcgaaaggctaaaaacaactcaattcaatggccaggattaaaggcgagtacccaaatttttaataccaggtaaaatgatccgcgtgttttctaagtgaaactgcgaaagcgaacgactaaaaacaattcaattgaatggccaagattagaagttatgacccattattttaaaatctgggtcaaaaggatccgcgtgttttgtaagtgaaaccccgaaatcgaacagctaaaaacaattcaattaaatgaccaagattagaagttatgacccattattttaaaatttgggtcaaaaggatccgcgcgtttctaaaaaggtttttttcatgacataaaatttttaaccttatggcaaatttattattttagcgaaattcatgcatactttattaaacgtaattatcaaataatagagtagattataattgaatagtataaacatattttcattttatttttgtttttgtttaactaagctcacagcgacacaattccgaatattagcaattggagaaagaataaaagacacagagcaccatattattcttttagcccaaaaatttccacaagtacaaatccggcaaaaacacatacatagaccaatttttggtttactgacgaaattttcagatcagaaaaccggatttgattcaagtgggtccctaaaccgtcggttttaaacaatattttcaacgatgagctttttcaagtcaaactagcgaaacagctatcagacctagacaaaacattagaaacacaatcatgatgattatcttgatcgtctttagatggactattaggcatagatctaagcattcttggtgaatctaagctttttctcaagatctgtctcatcgcagagatcaaatgtcttgtcagattcgatggtgggcttgaggatttgaacttattacacttgttcatgtgtctcgccatagcttcttcttctgttgttaaaaatctttttgttctcatgactttgtacttcacagcttcagaacaaaatccagagatccatttccctatgtaacgctctcttatcatctctgtgtacgattctgtacactcgtcggttaatccgcaacagtcacacgtcaccgaatctagctcatcgctggatatttgtgtcaccggaaccgttgagataattattacatccggtgttgaaattaacattgttggatcactaagtacactatcagacatggtttcttgatttaaaaccctgttgagaaaatttcgatcaacaatctgattcttacttcaacataagaaactataaagaaaccaagaggagaagttttatcagtagcagaagatgagaagataacgcaataagcttgtgatatatcttctttgttttgtctctgtttctgaaacagagaaatggtttttaaaaagggattcttaaaagaaattggaatacatttttttttttttaacgttcgttttgccactctctgtcttctaaattactttcatctccgagaaaaatttcacaaaacaaaaccattgcaaaaacagagtattaaaaatgctttttatctttggcttttcttgaaaacaaatagaaaaagttaccgtttctatttacttcacggaaaaaacattagaagttcataaaaattcactcgaatctctcgttacttcagaagagagaaaaaaaaaagtattgttttggaaatatatgaggaagagaaaatgagagaagaagtagtgcaggcgaaggagaagcaatgtttggtgttttataagagagacgatagtagtaactagtgacgtggaatattgattttaattttttagttttattttatttattgaacattttatcaaaacgccgcgtattagagaggatgccctagtttaatgtcttggtataaaagcctatattttgcatttttcatccgactctctgcgttaggtttcattttagcggcagacgagagagcaaaagcaaggagaaaccctaacc

SEQ ID NO: 13461 - DNA, 3000 bp, Unknown
  misc_feature (1)..( 3000): cDNA_ID_3030240_gDNA_ID_2214628_Annot_ID_187875 3000 nt of promoter + ATG
gaagagttgaaagaattgtggatcaccattggcagctttgtaccgttgaatacttccaggtcaaagagcaatcagatacgcaaccctgtcatcaggtacttccagcgttctatagccaatgtactctactcccgagagattacagggactgtcactaactctgatatggaaatgatcgcaatggccctcaagggaactctccgccaaactaagaatggcatgtccctccagggtgaaatcaatgactcacctctctctatacttcttctgatccatctgtgtggatacaagagctgggctatcagcaataatcgcaagagagcacgaggcgctctgtgcataggtggcgttgtgacaccgattttgatagcttgtggagtcccaatcctttctgctggactcgagccacgagcaatggatatcgagcacctacgtcactgcgaattcctggagtttgcaatggttgacgatttccacaggttcaggtttgagcactctacagacaggagagctaacatccttctccctagccctgaggttacaaggataatagagggagataacattgattttaggcctgaggttggacgcctctactatgagaacgctccgccattggatgaggacgatcttcttgaagaagccgcttcggatgggatggatgaagatagggcagtggcgttcgacactagcatgtatcactttggtgaacatgtacctccagcgaggcagagcaagagcttgactgaagctcataaaaataacagtaaactgtagaagtggtgcaagaagcaggacaagctgctcgccaagtgtttcaagactatcaagcttctgacagataagctgagttgttcctcctccaccactgctattccacagggacagcctcctctggagatgccatcaaggagatttgatgagcctgagcacaggcctgagcttagcgagcagagagtatcacatgtcctggctaggcattcgtcgttcgaatcccgggagcacaagagaagaaggaaggctacactcactcgatctagcagcagatcacgcctcattcacttgagaaggtcactcgaccgcggtgctggccgcagcagaaggagagaggtcgagtttcctcagagcggtgctggccgccagagagctgatgaggtcgagtacccacttcctggagctgatacagaacaaggtggttcgtctatggcctgggagcaatcacaggcagccattgacgagcaactacgttcattcttcaactgaggtaagcgcctcacttcaccattgtattatatcatctgttgtgatttgtttcttcattttttgtttctatgattggatttgtcctgagtactctcttccaagtttattcgcacagtggactgtgtgatttaagtttgggggagggctcagaaagtgtgtgttgcattgtatatatttttgagtctgcattcatctaaggcatagaaaaaccaaaaaattttgaaaattttcagaaaatgatttcacaaaaaaagagtgttcatgtagttgcattacatttaggatcgagtctagagtgtttcatttaggattgttgcatatgcataggggatgatgatgagatagccttgtaagcattttgatttacctgataaactcagtgccctcgttgctagttgtctgttgcgtagtcaatgaatttgaaataacactgaaccatgcctagattgctctactcgaccacactgtcatgatctgataccattccctatcaatttgaacctgaatctgatctttaattatcatgtctgcatcagatttgaactcatggttaccctaaaatacttggattttcttatttattttgatcactcttgttaatccaagtagctgactctccttattagagcagttaacccaaacccaaacctagactttctttcaagccctatatcacttgtgagtgtttgtgaggtcttattccgattaagcttggtaaaaagtgttaggttcgtaatgacagagatagtgtttcatgtagttctagttcgcattttcggactagataggactaggtggacgcttatactttgggttgggatgtgtttaaaagaaaaaaaaaagagggggttgattcattgataagaaaagaaaaaagactctaggtgaagtaagctaaagaagcagaaaaagtctagtaaaggttttgggatttgtaaagaaaagaaagagttcttgttagctattggagatgggcaaaagcccttggttttgaaatgttaaaaacaggaaccttagttgttaaagaaatccaaatccgctagatgtaacaaagtgttgagaaagcttctcctagagttaagagaaaaggaaagaatgattagaacaagggtttaaaagattcatgaatgcaaagggtagagttaagttcttatattgagatgggagatgggattactgttggtgcaggaattaacacctccgacaataccaatttaaaccaaggaataatgtgaataaaatcgagaagtcgattgaaccggggtatcccggttagcctgttaatgggcctaagtcatgagctcgcccgaagacttaagtcgacaatcaagatcgccataaccaacttcttaggtcgtgtaaagagaaaacttccatttaagagaagaggatcttatgaagaatagaagtaatgaagatttagacctaggataattagaagtttatcatattttggtatattcgacccattgtataaatagaggggtcaaccccccccccccccattgagaccatctttaacctaatacaagagactactattacagagcaaaccctagctttttgttcaagcaacatagttattttcctttgattatttgtgagctaagagaggagtgaatttgtttaaatctcttagtacaaattcattgtttgattacagaatcaacaattggcgcgccaggtaggggaatataaacaaattttctctacgctcctttaatcaaagcaagcatg

SEQ ID NO: 13462 - DNA, 3000 bp, Unknown
  misc_feature (1)..( 3000): cDNA_ID_2713744_gDNA_ID_2214628_Annot_ID_136011 3000 nt of promoter + ATG
tgtgtgtagctttgtttggggattctgagcagtctaaggagatgtgtcatggctggaggcaatgctactgatagccctagtgatctctgaaccatccataccaaattccatctccaaatcacaaatgttaagagagatctttcctctcttcacatcaatcctagcaccagctgtagttaggaaagctcgcccaaggataagaggatctttaggttcctttccataatccaagaccacaaaatcagcagggattaaggaattaccaaccttaacaggaacatcctcaaggattccttcagggatttgtttggaacaatccgcgaagacgagagtgattctagtcggcgtgtagttagtcatgcctaatctttcagcagtggtctgatcaggagtgatagtgcaacgtccactctctgtgccttctctttcttggcctttggtagcatctttttttattttttcttatttatttttttttaattttaaatttccattaaaaagttacatggcaacagcccaacaaggcacacatgcacaaaagaaaaagaaaaataaaaaaggaaagaaaacttacaagcccaaaggccaacaaagcacacaggcccaaaaacaaagaaaggaggaagcctagaacagaaagcagcggatggcttgagaccgaagaaaaagcacctgaaacagagaacgaagaagaagaaccaaaacagagaagcggtgactaatcaactttggaacacagcaaaccaagtcatcagaagcgagtcacccacaagaccctgacccatcctcctagaaagtggatcaagacgggcccttacaatgagctggatttccttaatgagctgagtatgattcaaaaatgaggatgtgtgaatccgagagttgcgctccctcaacaacagataaatggaagcctaaaagaggagcttgattataagtgataggttctttgacgtcgaagccgtcttcaaccagaggagagaagccatgaaggacgttggaggagatagtccaacacacctagtgaaataagtccagacagcgctgctatacgggtagttgaagaagaggtgttctctagactcatcccctgagttacagagcacacacactgcaggaatagagaaaccccaacttttcagcctatcccttgtatgcaaacggttccaagccacaacccaagagatgaaagcatgcttggggacccgatccttgaaccaaattgatctatgccaattaacctggacacccggagggtgaagagccatccaagtctttgaagcagagaacgagtttgaaggagcatgagcatcgacttttcacagataaacatcatctttagtacactcagccatactccccacaaccggtaagcagggctttaaaagaagaatggaggggttacgactcctactagcagacagccatcaaacaccacctcttaagccatcttttacctccgtattcagaggcaaaccaactaagataggtccagtaggccccgtcagattaatgagaagaccaagactcgttcaattgtcttgccagaaacttgcagtttcacctgaaccaacatcacacatcaagaagggtctcgctaaaggtggtatcttacaaagcttcctccaaatctaactaccagaggaagacggattcaaatcccaaaagcatttgtgtctaatgagattaattctgacccacgaaacccacaaggaccctgcagctgtaaacaataaccaaatgagtttgagagccataaccttgttccaatctatcaaacgtcgaagacccaacccgccacactccttaggggaacaaactgtttcccaagcaatttttgctcctcaaacggagtttggagctgctttccataaaaaagcattacacatctcctctagctttgtgagacattgggtaggcagcaggaagatcgaaacccaaaagttaattgttgaataaattacagacttgagtaactgtaatctgcccgtaaaggaaagatgcctagtagttcaagtagagaacttaaatttgatcctatccaaaagaggctgataatcatgttttttttcatcttttgggccattaggggcactcctaaatatctgactgggagggctccttgtttcatccgaaaggtagccgctaaagaagaagacctggcatagtctcctccatctagcataagagcggttttggacttgttaatgcctagtccagacccaagcttaaacgcctccagaatgttgagaatccctgcaactgggctcatggacccatcaaagaaaaccaaaacgtcgtctacaaaactgagatgagtaataaagggagccacacacctggggtgaagattgaataggccattgatagcacccctatccagtaatttagcaagaatatccattacaagcacgaacaggtgagatgacattgtgatctccctgtctaataacctttttactacaagaaaacagacaaataacgactacaaaaagcgacaacagatgtcgtcgtcatttttggcgactacttgacgacagtgttacgacaactatacgacaacctgaacattagtagtcaaatagtcgttattttacgactaacttcgttagtcggcaactactcgtctattaacgactatttaactattatattattgaagggagacgtttgtcgttacatagtcgccaatgcacgactacaatttccgactacgatagttagtcgcctgattggcgactaaaataatacacatttctgcaatcgtaaaatagtcgcaacttagtcgcagagtagtcgacttaagcagttggaaaacgttttcgcattgccaagtaggtacacctaatttgtttgttgtagtcgtaaattagtcataaaaattcgtatatataatcaaaattcaggacactcttctttcaccaagaaatcaaaacaacaatcaaaaggaaaaaaaaaacgattgaaacgaaaaaaaatagaaatttagtttattctata

SEQ ID NO: 13463 - DNA, 3000 bp, Unknown
  misc_feature (1)..( 3000): cDNA_ID_2703045_gDNA_ID_2214629_Annot_ID_136013 3000 nt of promoter + ATG
tttgcaatttaagaaataatgtggagaaaaatcaggctttcaagtagaaaattaaactataacgactttgtgaacatgacatgtgatgtggtacccctcaaatataaatgtgtataagcccaaaactacatatgttgggtaaattgatccaaagagactaacaaatacatgcaaaaggtatacaatttctcagtattaattccttataggcttatactaataaagacatgaatcgaattttttttttagtaaaaaatctgaaatgtaaaagaatagaaagaaactaatccttttaaaattaactttttgctatatggattaaaaatccacagaacttatgtgatcctggattaggtaaataatttgcatacgattgacatggtggtatagaaaataataaataaaaacataagaaaatgaaagagtaagataatgaaaaataggtgagcgacttgaaaaaatgatgagagaaaagaggtcgctaagcataatagtaccaaacacggacgattcatggaaactcgcgtcacatgttgttggcttattagttgggacaacgacaccaatccccaacactctccatttatgccttcttttatattattctctttcaataacaattatattttgttaatcctagttattatgtttgataaataacacttctactttgtttaataaaggattcaccaaatatcaattgagtttccgacttaggtttttgaaatttcatacgctgatcaggatctcaaacttctgtttgttgtgtagatcttttctagtaagcgttttgagacctaaattgtctcaaattgtgactatcaacattgatatttttctaagtgattattacgatttgtctataaaattttgattttgttgattggacacaattcttattgtgttttaatgcatataaatatggctactttggttgagaggcaacttatatgatcatgccgtaaacctatttatacaccaaattattttgatgaagataattttgttctagaacatgatcaatccattgaacagattaaacgtatagttgaaattgaaagacaaaccaattcactttcgattaaccatttttaacatattccgtggtctgatcttgttctcgaacaaagtcatcttctttggacttatttgaggttttgggtctgatcgttcacgtagcctttgcaccaaagtagtcatatttatctgtagtagaacaccaagatctgtttgtttttggcttgtgtttaaaaatcagctttcgattaaataaattacttttttaagagaaagcaggttacagtgggtgatgtcgtgcgtataagctatgacgaagtgtaccaaattctatttaaagtcgttggaacaaacaattatgtgatggtaagtaaggtgacatcgtcacccgtaacgcccacacacacgtacgcattatccactaatgctagtgttttttttgtacatgatctaattgtaaaccaacattgaatgatagacaaatataaatgagggcaggtgtttatccattcacatagatatgcgttacaatatcatccagtctacgtgtagaaaaactagaaattttatcacttctatcaaatttaataatgtttttgaaaataatttgtttacaaataatggatcggtgatcaataattgtggttgttgaaatataaggatggtcgaagttaccttcattcattgtcctgtacagttttcatccttaaacataatcattccccatgatccaaatgttatacttgtatgggacacaaaacctgaatttgtacgaacatgataagaatatatctacataccaaaggttgattaagtatctcatataatcttttttttcatatatatatatatcttatcatgattggattcatatagtttaccatcacataagcaaattttaattattatagagattttgaatgtatgttgtgacttgtgagcgaagcgaactaaaccgtaaccagattaaaccactatatttttagaaaatagtactaatcgccacggaccaaatttatatttatgtagaaacggttgtaattagtccgcgccatttttttttccgatctgcagtactattagaatgctactatatactatgcaagccgcaaacggatttattcgctataacgaccacgaccatatgagatgtgataaaatcatgaagtactgtagaaaaatcatgtagagatttttcttttaaaattacaacgtagttgagtggttctgtggtcgatatagtcaagtactcaagtcacattagcctattttgagttcgaaattagaatgtggctaaaccacaagaccgataactccaaaattacaatcaaaatcaaagctcgtaagtcgtagttaccaccaccaatccattgtcaccgtctcatcaatatacgtagctttctctaccattaaaaccaccacgtgtctcattctgtcctaccaaagtaccaataaaatcattaggtccaccgtaacaaataactctgagaaacacttgataactccacccaccttcttctcctctcctttattaacttgcttcttctctcggctactactatacccgcgtcttcatcactctacaaaaacttaatcaaactgattaacactaatcctttctcttaatcttcttctcccccgccattcttcttaaatccgagaccaagaagacgacgacgatgatgcaattgcaatgcgtatacgcctgaccaaaataaaaagcggtaatcaaatccaaatccaaccactaaagcaatacatttctcaacaaaatcatagcaaaagcgaaagagaaagcgaaagcaatccatttgcaaaatctgtgtaggtgtgataaaatgcagtaacacaaaacggtgaagcaacaggtgaatcagaaactgaagcaaaaggatgctttactgtttctacaagcctattcttaataaatagatcatatcgatctctcaatcagattagattatggaaattgcagcgaaaatg

SEQ ID NO: 13464 - DNA, 3000 bp, Unknown
  misc_feature (1)..( 3000): cDNA_ID_2703042_gDNA_ID_2214629_Annot_ID_136014 3000 nt of promoter + ATG
agaaaagtagcaaaacattgtgaatcatcggagagagtgggaaacatggagaaaaacaagagagctatcggatttttacttctggtcgtacttatcaatggagttatgatgacgagatcaaatgggtatgaaggagaagaagagtggggaggagcaggaggaggagagtggggaggagcagaaggaggaggagcatggggaggaggaggtggaggaggaggagcatggggaggagaaggagaaggaggaggagagtggggaggaggaggagaaggaggtggtggaggaagaagaggatggttcatgatgagagagtcgaggcaagtgatcaaatcagaaggtggagagatgagagttgtgttatcaccaagaggaaggatcattgagaagccaatgcacattgggtttctaacaatggaacctaagaccctctttgtccctcagtatcttgactcaagccttctcatctttattcgtcaaggtatctctcgctctctctcaacatgtgtgtatctctttctttcaacatgtgtcactctcactctctatacatgtgtttacttgcaggtgaagcaacccttggagtgatatgcaaagacgaattcggagagaggaaactgaaagcaggagacatctactggattccggctggttctgtcttttatttacataacacaggcctaggtcaacgccttcatgtcatttgcagcattgatccaacgcagagtctcggcttcgaaaccttccaagtacttagcactaatcacagttgcattgattaataaaattttgcatttggctaacttgttacttctgtgtagcctttctatataggtggagggccttcgtctgttctagctggatttgatcctcacactttaacttcagcattcaacgtgggtacatttgagcctaaatgattatttcattcatttcaatcacacacaaaaagggtggtttgacactttgacataatttataaatatattaaattttcttatcccaagctagtcttttttctatgaagcacaaaaatcaattctatatcttaaaacggagaaagtattaattaggactttgcaactgtcgatatattctcatatcgcttctatgcttatattataggtttccctacctgagctgcaacaaatgatgatgagtcaattccgtggcccgattgtatacgtcaccgaagggccacaaccacaaccacaatcgacggtatggacccaatttttggggttgagaggggaagagaaacataagcaactcaagaaactcttggagactaaacaaggatcccctcaagatcaacaatacagttcagggtggtcttggaggaatattgtaagatcgattttggatctaacagaagaaaagaataaagggtcaggatcttctgaatgtgaggactcgtacaacatttatgataagaaagataaaccaagttttgataacaaatatggatggagtatagctcttgattatgacgattacaagcctcttaaacactcggggatcggagtatacctcgtaaatctcaccgcggtatgattactactctaaaattagatcaatattcaatagtcaagtatattagcaacttctagcaaattttctatctatgggagtagaatttgttagttacatagttctgtacgtaattcttggataaactagacctactaaaaattattgttttggtatagggtaaaccaatttaagtctagattggattggtttaggaaaaaaacaattcttaaaccgtatttaatttgaaatttcaacaattgtcagggagcaatgatggctccacacatgaacccaacagcaacagaatatggtatagttttagctggctctggagagatccaagttgtatttcctaatggaacttctgctatgaacacaagagtctccgtaggagatgtcttctggatccctagatacttcgcgttttgccagatcgcatctcggaccggaccattcgagtttgtaggattcaccacatcagctcacaagaatagacctcagttcctagttggatcaaactcactactcaggactttgaatctgacgtcattgtccatagcgtttggagtcgatgaagagacaatgaggcggttcattgaggcgcagagagaggctgttattctccctacgccagcggcagctcccccgcatgttggtgaaatggttagcgaccgctttgtttgaggaatgtgtgaaagggtttctttttgtatgttatgtatgtagttaaacatgagtatgtatggatgtatgtttttgtttctttgaaataacattaataaaggtgatcactaaagcatgttatgtatgtagttataactatgagtatgtatggatgtatgcttttgtttctttgaaataagattaataaaggtgaccactaaagcatgttatgtgagaaagtttgattacaaataatgggcctgttaccaacactgctactttttctataaagcccatagtttatgttagtaataaagaatctgatccacataatgggcttgttagttgccgaggcccaattagaaaaaaactcatctctctctattttggttctctctgtcgccgagcttctcctagccgtcaccacctccggcgaagccggctgctgattctctaaaccacatcgctgagaatttaatccatctcactccactcttctatcactctgatttgaggaagccaacttcgaatccttcaaagcaaaaactttctcaaaccagcaccatagaggtttctcaggtaaaggtttgatattcaattattcatcctttatctccgatatggattacgattgtatgtaaatgtctacgagtattcaattctcaaagtattttgttatttcgtagttttgctcaccacttgttcgacgaaatgctccttagtgaattcttttggctaaatgttcgattttgtagcagattatataaaaaagctcgagtcttgagatgatttagccaaactatg

SEQ ID NO: 13465 - DNA, 3000 bp, Unknown
  misc_feature (1)..( 3000): cDNA_ID_2703035_gDNA_ID_2214629_Annot_ID_136016 3000 nt of promoter + ATG
tgtgaatgaataaaagaaaccaaaagacctttcctgacaaagaaaaagaaaagaaaagagggagagctttcgttagtacctcaaaaatcaaagaagcccttttttccttacttaatgtgtccaaagagctgaccaatttccaccaaacttatcctaaatatgtcccccaattgagtaatttagtttctactataatatgatcgagctaattaactcatataactcttagaaagttgaataaattgatatggttgagagaaagttgaaagatagcgttgtcttgattgtggcaggagagacagaaatatgacatagcacacccaataactcttttagaaacaaactggcttgctcgaccactgactacgtgtcgttcttttgcttctcggacgacaagtagttgtaacgtgcatttttcttctgtagttgacgtctaagttttattcatttttctataaatgaagaattttgagtttaaattcagattgtttttcaaatcttgtgaaaatatcatacatttttttttgataacgatttttaaccactatttaccactataagttagtatttttattccatagttgacatgttaatttttaatttatttcagtgaagtattttattttatattaattttcaatttatttcagtgaagtattttcttttatattaatgacagtccatacgttataattcgtaccgctgggaagtagcagcctatatgtgaaaattaaactattttgcctgtcaaaaacgatatatatggctgtattttcatagaagtatcgaaactatattatatattaagaaaaaaaaaggagaagaaagagcttagaagaataattagtacaactaactaaattattgtcatagatattaagggacgagtcatctataatcatgtatttctaaacaaggctttaaagagaatgtagccacgctttacaaagtcagataattagttataaattgtattctaaagctaagactaaactgaatatatatttcgtatttgtcctaaatgcatcaattaatatgtcatgtcgtaaagaaaaacgttgaaacaagtggggatacgtccataattctcatactaaacaaagacaataagactttataattatgccaaaattctttctttcattttcttttgtcaggttcggccaaaattcgttaatgttcggtcttcttttctcttaattataaagaagaaaaaaggtttataaagactccattgttttggatatatcctagtaccatttcatagaaatcgttatttcaaaagagaaaagtcttacacagttatactcaagaatttaagaataaaaaaaacaaaaaacaaataagaagacatttatattaccaaaattaggcaaccatttggattccactaatttccttaacattatattactgcatgattattttttttaccttttattgatatatgtggtttttaaggaattctacagattgtatttcggtttgtttctatcagtttttgagtattttagtatatatctatgaatattttgtaaattttaggtatttttgacaaaagagtcgaaattagaggtaaaacaaaacaaaacaaatggaaaacataatttacaatcaagatgatttaacgggaaaagttcaaaacttcaagcaaacgtcatttcgagcagaagtctttctcatatcggaaaacacgacggcaaaatgaagatctaggtaaaaagaaactaaagaaatctgagtgaagactaatgtaaataccactgaaagatcactatcagaacactaaaaccaaaatgtacataagttatccttcggttaagcgaccagttggaggagaaaccagaggagtgacggtgttggcaacgaatagtgcgacactcaaagatgttccaagttttttgtggttgtagtgcagttgaatggttcgtttccatcaatttttagccgattaagtcctcttatatctattaacgggagtccaatctcgatcatcatctacaaaaacatgcgaatatgtcaatcttgatcatgattaatcgattttgttatattcttcatattaaatgtcatcaatgatatatcaaacataaccaacttgatctctagatgctgaaaatttctattaaagaggtttgatgaaattacataattaaccaatatttattagcatttcttctttagccgttgagagttttcgtaaacatgattatgacgaacattttgttgttacaatcttgaagccattctgaccgtgccgacattttgacaaagaacctaactcgattcgctttcatagttgaactatccatcttacacttaacgggagtctagtagcataaccaacatttctccacgatgaaataaattcaattcccaacacttgtcatcacaataaggattctattctcttagagatcatttaatagtgccgaaattagcttggcattcacatcaaaatcaatttaactcgttaataccttcgagcaatttagtttctttttaaatatcaaagatagtaacgcgtttgtacttcttcacacatattttctataaaattaatatttgcatataagggagatgtgtgagaacggggaacggattactcctttttaagactactttaaggataaattggaaatcaaatataaaaaaagtttagcttaagtgcgaatgtggaaataattaattgagccgccaaagtcaatcaaccgttgaaacaaaaaagctcaagaggaatttagtagtagtcaccgtaaagatataaaattattccgaataaaaacaatgacatcataactcaatatttatatcgtcacgtaatcattctctttagtatgtctctctctatatatacactcacaatcctccttaccataaatcacttcactctacaaaacacactttggttcatcaattgtttcaaaagaaactcaactaactgactcaaaagaaaatcaaataagcccccaaaatattttgagaatcatgctaaagatg

SEQ ID NO: 13466 - DNA, 3000 bp, Unknown
  misc_feature (1)..( 3000): cDNA_ID_2703032_gDNA_ID_2214629_Annot_ID_187912 3000 nt of promoter + ATG
caaggtgtctacattgctttcttttaagatctccagatattttaatgatacaaacaagtagctttgtttataactattccttgcatgattggtaattttagctaggaatcaaatcactaacgatacaattatcataatttataaattatatgttttgataaatgattaagctagtctgttactatttgattaatccttttatactatctctatttagtgatttttctctcttttatcaacacataaataaaaatgtgacatatgaacgaatagagacacaagtctcccacattaaacttctatgcattgatgatcctcatacggttggctatgtcgtggtactataataagtatcgagccactaaagatcaattgattgcacatcatatttcatagatgaattaagcaaaactatcaaaatagtcgattatggtttctcaatcattaatcaatataaagaaaactaagtgaacaaacgaccatgcaagaaaaacaaataagcaataggcaaacaactatatgacatcaactattgattaagctcgggttaaagtgtttctcgttgtagcatttttagtattcaatttatcctaggttctagagctagaaaatcatccaaatgaaataatatattttttatgcatctttgtacattgttgttcaagtttgagatccatatattattttcaagaataaaaaacttggagtttaaagtgtacatgtaatttttactctacataatgtaaagtaacgttgtccacataaaataaaaatccatacatacgagaaagagaaaacagaagaaaacaaaactatatacaatacacaagttgttaaataatgagagaatcacgtgttcttcatgcacatgtaagagactatgaaataaggataacaccgtagataatatcttattgatcaaatgaagcctaatcttttttttaagattagcgttaagacagatattctctatatttgagtaaatcccagccgttggatcactgacctataccttattgaccaatcccaatcgttagtacaatgccgtccaagaaagagagcttgcaatcgcatgttttagatgtatgctattaaccctaaatcctcaatttctcgatctcaatcttgctatgtggtgggtgatacatcaatggtaattgatatattattcttttatatatttgtggttttgttaaagaaggtatcaaatctgatgctctgaaaaagtgtgatttttttactggattttagtctatgtaagtatgtattatggacagagtttaaacttgaatccgaaccatttaagaccggaaaaatttcatgctattctcaaactaaaagaaacgattaaccataattagatctattaaaagtggatacatcaatcaaataataatatgggctgtgataatatagttgtatcaatactcgggacaaaaatgcaacacgctacaatggtagattcaattataccgtatgaatgaaaacattgcatgtgggctacttcttacgaagagacatgttcacttccaaaactagtactagtcaaatgattcgacataacctgaataccaaatgctatatcaaaaatggcaaatattcaactaataactaaaaagaacaatacttttaattttcttattaaaaaagttctagataataaccttttgagatttgattttcgaagatattaataacggcagattactaaatgcaaaattacaagaaaaaaatttatattatgtgattttctagtaaatgtcgattctaccgtagttgactacgtgttggcgatgaatcttctgagcgaattttcgggaaagtttgacaacatcatctatgtcatcaatcaccatcccccgcttcactgaggcatgatcaatgctctcatggtagcatacaaagtcaaacataagtcatactcatcacccacaattctacaacaatatgcttatcataggacattaaaatcaaggacgaggaaactacaagagctaaagacatcgcggacaaaaccatataagtagtggttaatacaacaaccgttcactcatacgattagcactataataacacctcggtcatatacactaatcaaaaataccaatccactaatcctagacctatgactcaaataccatctgcccatgtccaagtccaacatcccatcctctaatggcatacttggaccaatatccatcaagccaaattggtgcacacactcaatctcaaaacacaccaacgtacattcctaattaactcatgcaatcaacactatgtcaccccaaaacccaaaccaaacgacgtgaaaaaacatgtaacacacgaaccaaatcacattttactcttgttaacattaacgaatcaactacacctacaaaaatctaatgtaacaagcatgggttaaaaaaaacaatactgcagcgatcattactcttgttttggtcggaactaaaagttgatgtttcatttcatgtattgtattgtctcctttgaaaaccaaagcattgaccaaaagcagtacgtaccggcaaaaaaaaaaaaaaaaaaaaccggaaacttacttagccggtataccactgccaaaaaaggaccaacaacaatatgttaaaattttattataaagttattatacacatttatagttacagagagagaaaaacaactttattataaataatgatcatcctctaaaattgggtctgaaatgttccctcacacgtctccttctatcttcttctccactttaaaaaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatg

SEQ ID NO: 13467 - DNA, 3000 bp, Unknown
  misc_feature (1)..( 3000): cDNA_ID_3030267_gDNA_ID_2214629_Annot_ID_187911 3000 nt of promoter + ATG
aactcctctgctttgtctttttttttttgaatctttataaccgaatctttcaaattgatatttgttatgccgtagtagtaaatgtcagaagtggacaatttagatctctttttggagggtttcagttttttttttttatataaaaatatacatccttgtcatggatttttggaggtttgagatataaatggaaccttatgttggctatacccattttataaacaatacataatcttttaacattagagttgtaatggtggtgatgaaatgtatttgtctcggattccagatcgtaagattttgatggtgaggttgtgttatgtatcagacacttcgtcctaaaaattgaacaagttcttggctggtcgagcagacattttattgttcaatcaatcctgcatctaaccgaaccatatgaacttttgtttgagttcaacaaaaccgaatcaaatccaaattgaaatcagagattaaccaaatgtcagatggtaattctgatctttatttattagtagtaaaaaaaacaaagaggctcgttaattgtggttctttaaatagagcggcgactttgactcgttcatatatttgaccaattgttatcttcaaaatatcttagctagcatcttatatccaagtagagcaaatttcatgcattgacttcaaaaagaaaaggagggagagtgacctttcttgggtgtatatttgtatgcatagaggaatatattactctaaacgtaacaatctcatcaagtttgggtttgaagaatctgttttcggctcacaagttggtgaaatgcattcaaagaccaaattggagacaaagatcattcaagagattatcttttccagacagtcatgggtattctgaatagcctcgctatatggaagtgtagcatgttggagataaagatagagaagacaccatcatgcacaagtccaacaagttcatgcttctctaacctctcatatgtgttaatgtgagattgctcgggtctaatggatttgacgtggttgttgtttactccaaaccttattgatcttaaggttggttcgataaatgaacaagtatttgatgatataataagaacaagcatagtgtcgaaaacttagaaagcttccattcgactctaaaagtggtgttgttggtaaagaacttgtcataaatcacgtagacgaggaattgatagaaagagttaaatgggaagacgaggccacaagacttcgtttctcatcttcttcctacaaattccaaaaagaaatgtccaaaactatctagctccgcgggaacgtgtgtaactacaaaaatgcataagttaattaaaaagtcagctccttactaagtccgtcttgtccaagtacttcgctccgatatgtttctaagtcattattctttgtagattcataataaacccatctctttcttggtattccaaacattccttgactcatattttgatattattgtattcatccaaactttttgtgtaaaccaaatcactataaacaaaagtcataagaaagttaagaatttcatttctttgaataaccgctcaaatatcaattatcttatcattcaaaattgacattaaattcatcattaagcagaataaagctataataatccaccactagctagaacttattggttcaaccgtaaagaagtgataataacctaaataccattaaataactcatcaatgcttgaatgatttgagaccgaacccaccttcccagtactggagcgttactttccactttctagactaaagaaatctgagtagacactcaaatcattcagatatttccgcaggtaaaccaattttagaaatcccaagttgataactaaaccttaagtagctcaagtcgaattaaaccccaaatcctaaatctgagtgatattttttcccgaaaataattggtttttacgatatgaatttatcaccgtaacaactaccttactaacaccatgtcacaacaggtccgagacatcgagacacaactctccacataaaaactggactaaactaaagtgttcgacttcaaactcaaaataaaccggactaagtgtttgaaattaaattaataaaccaaaaaccgttaataaaccggactaaagtgttttaactttttaaccatcactaattaccaattatccaaaataaataaaccagaataatccgaaataataagaaaaataggttttagaatacctagaaagtaactggtcgcatgagataaatgtacttttaacatgaaaaaataacttgccgtcaaaacaaaaaaaaagaacatgaaaatgaaaaataaattaggtataataattattatttaactatattaattgacaaaaaaaattgaatttgacatctttgaaaaaacaccagccattggcagaacaaaaggtttagccacagtttttttttttctcctcgtctcttcgcaaatcctcttcttccttcgattctctctgaaaatctcttctccttcctcaaaaaccgatactctcttcttcaatctccctctcttatctctccaagctaattctccaaaccgtcttttctcaaaccctaacgtacggattagggtttttgttcgttgattccaaaggttacgactttcaatttctccaccaaattctctgtaaaggttaaagatttctactttcttttgagttcttagcctgattctttaaccttttcgttgtcattcgtcggaattttggagtggtcaaagtaataatctttatcacaattcaagctttttgagagttgattggttaaaattgtttctttttgtttttgcgagtttaatttagtttgagatttgtcttcactggtttctggttttgattagaagttgtttctccattgtttaaaaagtaaggagtaatgtgtagttgcagtagttttttttttttttataattgagaattgtggattatgttctgattctaatgattgtttaataatttgtttaattaaaatatatgattaggtgacg

SEQ ID NO: 13468 - DNA, 3000 bp, Unknown
  misc_feature (1)..( 3000): cDNA_ID_3030271_gDNA_ID_2214629_Annot_ID_187910 3000 nt of promoter + ATG
ttcatacagttgattcctcttgtgttatgttgcctctattttgatttctagatggatttcaaaactctcatgcaatttatcgaatccctggtgtgcgtagaaagtatgagaatgaaaaatgtacaaatctgaaaacaaataacatatcaaacattcggaacattagcatgaagagatgaaataactgcgcacaaaaagaagggggaaaaaagaacaatattttttgggttaatagtgagattgcaaaatttataatccatagtcgataaaacaaaatgttttttatagtcaaatattcaataatcagatttataagatataacatctcaatcattactaccaaaatgtatagaacatctgaacatataacatctcaattattactaccaaactgagttttcttttttaatgtaattcgaaggccagccggtcaataatcctagagttggtcttgtaatgtgaattgataggtgaatttactgtttttatcgaaaaaatcacatttttaatcctgaaagtgtcagtggatactatgttaaacctcgacattatttcacaaacattataaaccaccaaagtaattttattaataatataaaccttaaaactgaataaaaacatacatagtaatggccatttcttcttcataattatgtagtattatatatgtaaaaacttctgaggccagaaatagttactatgtaatttatgtatagttaacacacataaaaaaaatgctatgtaatctttgtctctctgaggctattactctcattttaacaaacaactgcacacaaaatgaaaaagagaccgtacctatcactacacacaatgacgatagaagatattaatcgagttgacgattctgctgccttcgtatctctccctcacgcacgttctatagagcgcataattttcatcaacaaaactgatttttttcatatttctctttctctctcttttttttttcttttgtgaaaccatgtttctctcttaaccaattagaccaattcatagttttcttcttatacttaatcgtctcgcttttcttttaatatatgttttctggactaaagtttcttacaaattttgtctttggtatctaataatcgtctctctattctgcttcccaaaaatacacttcctttcacgtactaataaaacgtgacatttagttttcttaatagatgtcacatactatataatatataccgaaagtcaaactagcgaaagagtttcttcatactttacattgatgaaaattataaatactctaaatggattttgtattaatgttgatatttcgtgatatttaaattttatatgaatgttgatccaaaaacccattttaccaaaccaccataaaactcattctgccatataacatgttaagtcatgtaacttatcttgccatataatccgtcatgcaatatagtctgtcttatgctttttttttatatatttttaaattttccataatattataaatttttgttaattttaatccaccctatattgaaacagcgagttgataattttttaatttattaatgttgatccaaaataagtctcgctaggccatcataaaatctcgtcccatgttactttttattttaaaatgtttaattgttcataatattataaactttctatgctctcaaatatatcgattataataattcgtgtaaaattaaagaatttaactaaaaaccgaattaatatgtatacaaactttttaatttggatgtttgttaagtgaaggtttccagctcgtttagatttatattcattttgatcttatttataatataactctgaatcattatctaaacattttaaccgatgtgggacattaaacacatattttttcattaattgggtaatatatgtctgttttaaaatttttaaattacaatatatgtagaaaaaaattgagatttttttaactctatgtattataaattattcaaaggagttaaaaaataatcaaacaaagatggaaaaggaatcttaaatctaaatcattaatttgaaatatcgaagcataattagtggacacagtccaattttggtaatattggtattcgacttttaggaaaaaaaactggtgggagatccatgttaaatataacctgacccaaataaatttttatgaataatttttcttaaagaatcagataccatttgtatctaaaattattttaacccttcagccaaaaaatgacttcaaaaatactatagagataataaatgaataattattgggttcatccataagattaacctttttattcacctcattttattccatctaattattaaacttatttaattataaaatccaaacttttactacttttttataaactcaaaccgatatataatctcgttgtaattacataatctaaattttaattctcttttgtaaactcaaacagatattcaacctcgtttattgtaaaatataaactctaaccattcattctaaatccgaaccgatatataatctcggttaattataaaatttaacccttttataaacctaaaccgatatttaatcacgtttaattgtaaaatctaaatccttttataaattaaatctaaactttttaatgtcggtttgaatttataaacgggattataactaaaaaaaattctgttatgtttttagtcataaaatgttaatttgtttatgattatttttgcaaccatttgttttgtgtttataattgttttcaaccgaatgaaaatgaatttccaccagacttataccggacgaaaagagtcttttaatttcaattttttaattggagatgcaaaatcctcgttttctcatgtcagttgtcgacgggaacaaaaactgaactccgcttctaagatccttcgacggagagaaagatatttcagatctgatcggagagaatcattctcaaaatttctccattctaatttctctttctcgagagagtgaagagagacaacaaggaaggaagaggaaaa

SEQ ID NO: 13469 - DNA, 3000 bp, Unknown; identical to SEQ ID NO: 13465
  misc_feature (1)..( 3000): cDNA_ID_2703035_gDNA_ID_2214629_Annot_ID_187907 3000 nt of promoter + ATG

SEQ ID NO: 13470 - DNA, 3000 bp, Unknown; identical to SEQ ID NO: 13464
  misc_feature (1)..( 3000): cDNA_ID_2703042_gDNA_ID_2214629_Annot_ID_187904 3000 nt of promoter + ATG

SEQ ID NO: 13471 - DNA, 3000 bp, Unknown; identical to SEQ ID NO: 13463
  misc_feature (1)..( 3000): cDNA_ID_3030283_gDNA_ID_2214629_Annot_ID_187901 3000 nt of promoter + ATG

SEQ ID NO: 13472 - DNA, 3000 bp, Unknown; identical to SEQ ID NO: 13468
  misc_feature (1)..( 3000): cDNA_ID_2713761_gDNA_ID_2214629_Annot_ID_136018 3000 nt of promoter + ATG

SEQ ID NO: 13473 - DNA, 3000 bp, Unknown
  misc_feature (1)..( 3000): cDNA_ID_3030267_gDNA_ID_2214629_Annot_ID_136020 3000 nt of promoter + ATG
tcaaaaaccgatactctcttcttcaatctccctctcttatctctccaagctaattctccaaaccgtcttttctcaaaccctaacgtacggattagggtttttgttcgttgattccaaaggttacgactttcaatttctccaccaaattctctgtaaaggttaaagatttctactttcttttgagttcttagcctgattctttaaccttttcgttgtcattcgtcggaattttggagtggtcaaagtaataatctttatcacaattcaagctttttgagagttgattggttaaaattgtttctttttgtttttgcgagtttaatttagtttgagatttgtcttcactggtttctggttttgattagaagttgtttctccattgtttaaaaagtaaggagtaatgtgtagttgcagtagttttttttttttttataattgagaattgtggattatgttctgattctaatgattgtttaataatttgtttaattaaaatatatgattaggtgacgatgaatgagaaaggagaaaagacttgtcctctatgtactgaggagatggacttgactgatcaacatcttaaaccttgcaaatgtggttatcaggtttgatacattacaaccacttttcctcacaatgtggctctcttgtttgtttattgtcactgtttgagtagaatgtgtgttttggggtcttgtttatagtctgaaaccgttgggtgttgatacgtttcattaagggtattgcaatttgctatgggcagagttttttctcaccctattcttttgagtttaagcaccaaagaatctaagcttctgttaattctgtatgctgtatatattaacacatgcctctgtggagagttgtcttctgcttgaaaaggaccacgatgtgtagtctcagatttcgaattgttttataggttgtcccacattgtctataagcatcttgtgaatggaccttttcttataatcgatgtttaaagctgacattacccagccttatattgttgcctgttcatttatgtttgaattattcagtgtgccactgtggtgatctataagaaaccctttttatgtaaatacatgtactttgtgcagatatgtgtttggtgttggcatcatattatagagatggctgagaaagataagacagagggtcgttgtcctgcatgtcgtacccgttatgataaggaaaagattgtagggatgacagtcagctgtgaaaggtagatctgaagctgaaaacaaacccttttttgtttctgtgaaacgtgtaaaaacttatctttttcttgttctgataattcactaggttggttgctgaattttacattgaccggaaaaagtcacagaaggcgaagcctaaacctgcggagggaaggaaagatctaactggtgtgagagttattcagagaaacttggtttacgttatgagcttgccttttgacctggcagatgaagatgtaacttaaacagccttaacttatctccttggcactcacatttgctttgaaaagagataacctttttcatatcattaatctgggttgttatgtatgcagatgtttcagcgaagagaatactttggtcaatatgggaaagtcgtcaaagtagcaatgtctcggactgcagctggggctgtccaacaatttccaaacaatacttgcagtgtgtatgtatccgtatttctttacacattcgaatgattgtatctagttcttgatgaactaatatttgtgagtccatatagctaagcacaaccccatttctttctgcggtctatttgacatgtttgcttttaacaaacttcattgagctaacattttcgtttttgtctaaaattgaatttcccagatatattacttactccaaagaggaggaagcgattcgatgtatccgatcagtacatggatttatattggatggtagaaatttgaagtatgttatgttttctttttttttcaaaaatagttatggtagcctgtggttcaatttctaatatatttttggatgtcgttagggcatgttttggaaccatgaaatattgtcatgcgtggttgagaaacatggtaagcagatattgacttgcttttgctcactaggtccctctatatacttaaatacaaatccaattgtgtttcgtggatgcctttttgtttcagccttgctccaatgctgaatgcctttatttgcatgagattggtgcccaagaggatagtttctcaaaagatgagaccatatcagcgcacatgaggtaaattaatttcaataatctctgccttttagttaaatgaaatagattgtggttgattcttgtttttcgttgatgttgatgttgggctccgttagtgaagtatactttaattgacattaatattgcatttagctcatgttttgtggatgcagatgtgaacttgttcactagctggttttctttgaaagttttaacacccatcctttcttgaagctaggagagatttgattttatatcagtaatttcttctgctctatatgttgtgctcgttaggtggttatctgattcccgttctgtttgaataggaaaatggttcaagatattactggttggagggatcattatgtgcggcgttcagggagcatgttacctccaccagttgatgattatgttgataatgagtctagcacaagaattattccaaaagttgttttgaatgtaagttgccaactcttcttggagcttcctgaattttttctgctctcagcatattcacatgccgttatactttatgagaaggactagatgcgtttatgtgtgataaattctgcttttgacttctttcttattcgcccttttttttcctttgcagaatgtacatagtgccgcgaaaaattctcctccaaatgacagcaacagtcactctgttactcttcctgctggagccatgtggtacactgaattcttatgataatgttttttttaattgctttgtctgagaaacttaacttgtttttcagggga

SEQ ID NO: 13474 - DNA, 3000 bp, Unknown; identical to SEQ ID NO: 13466
  misc_feature (1)..( 3000): cDNA_ID_2703032_gDNA_ID_2214629_Annot_ID_136021 3000 nt of promoter + ATG

SEQ ID NO: 13475 - DNA, 3000 bp, Unknown
  misc_feature (1)..( 3000): cDNA_ID_2703028_gDNA_ID_2214629_Annot_ID_136022 3000 nt of promoter + ATG
ttggtcttcacagactccataaatgtcaagtttctctgcaaagataaaacattagtgtgtgtaagaagcaaatctacaaagaagttgaaaacatataaaacaattattgtaaaacataaatatagtgtttaagaaacaaatctacatatataaaaaagaattaagaaaatcatatgaatcttaaagggttctttaattcagaaagaaaggtacagataaggctagtcttgcttcttgttaaagcaagagacaaatttcttattagaacaaatgttactaaaaatgtttttttgctgagaagaggaaagaaaagtagaaggataagaagagagatggagtttaatttataggcaaagaaagagtaaagatagctccaaaatccaaattaattaattattaaacatgattaggaattggtcttctgtggaaaaattgctcagaaatgtggtaaggttcggtgtttattcagaatgcatggtgggtcaatggtttctaggggcacatattatattttattaatattttataataccttgtacttttgtcatgaatattcaagaatgctttaagaaacaccactggaggtgttctaagaagcttatgaatacgtgtgtgtgtgtgtgaatacttggggtcatgcacctaaaagtcacgaaacaagttgaagtagatcaaggtaagtgataaatgaaataaaacaaaaaggaatcatcttatttaaaatccattgccaaactctaatggaaacaaaagagagtcttcatattaaaacaaaatataatgttcattatattttcattaataaactatagagttggtgcatatatagactagtccaattagaaactcatgaaccttagtctaagggatgataacgtttcatatatttaagatttaagatgatccaaacttcaatgttatgaaaattgcatcactaaagatgtgtagtaagatttagtgacaatatgaagtgtttttagttttttacagataatgtgaatttattttagtttagctttttgggttgtttcacaatttagtttagttagtttctagatgaagaaaggaaagtctcgagcaagttcggtcgttgactttggtgaaagaaaacatttcttttgttttctcttaccatagagaaaaatgtatttcgtaaagtgatttaaacacgtttaaatatgtaattgcttttaatctggtagtttaaaagtatagtatatggttttaccatttggaccgcaagtttgtgtagtattagacaatatgttttctacattgagattgcatttagatttatcattttaacagcatccaatttttgtagattttttagaaaaacaaaaataagcatttgaagtttattaaccaaacaagcgacatattcaatttttactacaaagattttgaatttcagatcaagagccacattttcgtcatgtccacaaccattaacattttcttagtatttttaacctctcaaatttgttttttggcctatatattcgaatttttaataactttaccgaatgaatattctaggaaattcattgtagttgtaaagtatcactctcatataacgaattcatcaatataatataattaagtggaccaacaaaaatgtcaaaaagacttcatccaccgtccttattgaattggtatgaccccattctaaagctttttatgagctttcatgacttcaaatcatccaaacatgaatcacattaattagaccgtccttccatttatcactagctcagacttttggattgtatagcttaatgagtttccctagttgtatacacttttatgtacctagaagtacgattagtgaaatacaattttaaaacgttcacaatggccaaaaagaaaccatgtgacgaatcgtagctcttacaaagctcatcaatcactatagcttctcccaatccaatggtcaggctcccattagattgattgtgttaactctttcattgtcatattctgagttggtttttaaagttcacgcgtttttattttgatggttggactaaaacctctacaaagagtatcttatttatttatatactcaacaactataattaaaatgttaaattttattgtagttgtttgtctattcaactttctgtggattaatcctgatattaatatgtcattggtttatcaaatactaatcatgcacgttatttgtgacgttccttcactttttccactttccttcttttatacttgaccaaataagaaaatcttaaaagttcaaagcacatcaaacaaatataaactactcaaaatcaaatttaaaccagagttaacaaagatacactgcttagctggatccaatgttttgaaaaagacttgctagttcctcggaatattattataagttcaataaaaattacaatataaacagaatccgcaacttaattatttatatcttttggcttgtatcgttttatttttggtcaacaatgatatcaacgtttattgtttatacattattaagatttatatttttctattcgatcaaatttttttataatgcattcatagattcaaacaaaaattgagtttatgtcgttaccattcactcaaattttatttactatttcaaattttcacataaaggatagtcaggaaacaaaagctataatatattataatttttagtaaacattatttggcataaaattgtaaaaaaaaaaaatcgattttacaaacaaaaaaatatactttatgaatgtggtattcattttaaatttttcgccaaaatattatttattttgatagccaaaacggcaaaacccaaaaggcccaaaacgaatcttaaatatggtccgggtcatggataatacaaaacgggtcaggcctaatcatctctttaaggcccaatatggtttagtaaggaaaggactctcaatttggcgggagagagaaagagaagcttctctaatctcttcaccgtctaaagaatatttccgacgccggagacgaaaacaaaaaatg

SEQ ID NO: 13476 - DNA, 3000 bp, Unknown
  misc_feature (1)..( 3000): cDNA_ID_2994527_gDNA_ID_2214630_Annot_ID_136027 3000 nt of promoter + ATG
gcaatgataatcagtaaaagggagtttttcctaattgatccatgttttctaaagctacaatatatatatatatatatatatatatatatataaaattggttgtatatatgccatgtaatacagaaaccgatagaagcgttgctaagtgtaggatttttcatttttgactcaaaagttaactatattatttgcaggaaacaatggatttagatatgattattgcattgcagaatgttcagaacattttttagatgatgtatgcaagccagtgtgtatagacaaggggtactcggatggaggatgtattggtttagcaccaaattttaaatgttgttgtaagaaatgatagaaaccaataatctttatagtaaaacggtgatggtgatttgatatcttgtatgttcttcgatgaaataaagctaatcttatctttgataagcttcagaagtcttaataatttcacaaaagcttagcattatcgatatcctagagataagaaggtataaaaaagagtaaaatttatattgaaccaaacaattcatgggactgttttatcagaggatttggcgagtaatggcaccggaacgagtccgtgtttttctctggttagtggtgcagcaagtgatcataactaatgtggaaagatatcgaagacacttgagtgatacgagggtgtgtcagatttgtcaaggcggggaggagacgattctacatgttctccgcgactgtcccgcaatggcagggatatggagccggttagtccctcgtgatcaaatacgacaattcttcactgcttctttgctggagtggatctacaagaacttacgggaacgtggatcatggccgacggtgtttgtaatggcagtatggtggggatggaaatggaggtgtggcaacatctttggcgggaatggtaagtgtagggaccgtgttaagtttattaaggatttggcggaggaagtggcgatagcgaatgcttttgtgaaggggaatgaggtgcgggtgagtagagttgagcggttggtgtcttgggtatcgccggaagatggttgggtaaagttgaacacggatggggcttcgcggggtaatccggggtttgcaacggcgggtggggttttacgggatcataatggagcgtggattggaggttttgcggttaatataggtgtttgttccgcacccttggctgagttgtggggtgtctactatgggttattcatcgcttgggggaggggagctcggcgggttgaattagaagtagactcgaagatggtggttgggtttctcacgacagggattgcggattctcatcccttgtcattcctattacgcttgtgctatgactttttatcgaagggctggatagtccgaatctctcatgtgtatagggaagctaatcgtcttgctgatggattagcgaactatgctttctcgttatccctaggtttgcatttgttggagtctagacccgatgttgttagttctattttgttagatgatgtagcgggggtttcgtacccgagacatgtccaagtgtaatttttttattttcttttaataaaacgggagacgcagtctccctcattctaccaaaaaaaaaacaatgcagatatttgcaaatttttcttctttttagatacagagtatatgtaggcatgtagctaaagatacttgatttggtgtgattttgatcatctggatgtaaaaggtatggtgatgcgtctagtgttggagcacttgaggctttggttattggtgttgtggtcattgttaattagtaccaatgtgaagcacctttatcgatttcacagggactggaccatagtgatgcttgagtgacgactcttattcgtcgtggtctaagccgcctctttatcatttttagggctctttggtcgactaattttattttatttttccctttcactagggtttcctgacttgttaaacaagctttagctctccgattaacagctaacagctcttttaccactcagaccctttatttttttatcccggccacctattatttattttgcttgattttatttcattaataaaatttataggaaaaaagaaaaaatttaaaaataagaaacaagaggtaggctcttctagcgaactcctttcatacgttttctctctactctcatcgcttttcttatctctctcggagctcttccgtcgtccaccattgattacggtaagattcaccttctcctactcaatttcataactatagataaataaatctctgtcttctctgcctctgttagtttttttctacgattgaaaccatcaaatcaattcaaggttttacacagtttcttatgcttgtcctgattgtttcgttcccggagagggagaaattacggcttttggaatccgcccagaaaatttcccgcccagctcggattttgatagaaatgttttgcctttttggtttctgtaaaattgatattcttattgtactttgattgaagtatgtgtgttcaattgaaattgatgttgtgtatttcttaagtttgaatctttgtgtaaggattgggggtttagggttttgactcatgattgctttctgcatttttaaagttaaaaagccagactttgaggcttagagctacttatattgtgttgcagggagtgtattgagctaaatatggctataatacaacttggaagtacatgtgttgctcaatggagtattcgtcctcaatttgcagtcagagcttattatcccagcagaatcgaatcaactcgccatcaaaagtatgatttttaagtctctggattgcattcagttctgtggctttaagcctttcaagtattttgatttgttcacattgcacatcttaagattagtcttcgtagaatgaagtttgtattatgtgatttctacactgagagttttatatatgaaatagcattaaaggttttccttttcacaacttttacagttccagtagccaagtaaattgtttgggagcttcaaagtcgagt

SEQ ID NO: 13477 - DNA, 3000 bp, Unknown
  misc_feature (1)..( 3000): cDNA_ID_2703053_gDNA_ID_2214630_Annot_ID_136028 3000 nt of promoter + ATG
atttgaatttgatcatgcaggatgtgatttatatggttttactggtgcttcaggtgaagtaccggtgaaagcggatgcatcaacaattgccatcagttgctggagagggaaggctagtttggctgttatggccactgtcgcagattgccaggagctgctagagagatttgccgagaaaacaccaaaaacagaaggtggttcggtaaatggaagcaacggcgattcggacggtccactagctatggagacttaagccctcccttcttcataacttcaaattgtactcctttgttgtggtttgactattcccttactacctccaaattatttttcatataagcataatcatgatgacttttgttggaacgacataaaaaaaatgaaagattttgttctaaaaatcaacgtacactacacaaaactcactatctaaaaaccaaatcaaaacaatatttttgaagtatatgaaatggtttattttattctaaactgtaatggaccaaatcgagaagactgacttattgagctgcaacacacggtggtcttagaagactgacttgtgagctgcaagacacggtggtcttagcgagattcttcttgttcaccttgttgaagatctcagtcaagagagtgttgaaagagttctcgacatttgtggagtttagtgctgaagtctcaaggaaaaaaagcccttccttctctgcaaattccttggcatcttccacaggaaccgatctctggttctctaaatccgtcttgttaccaatcaagatgatgacaatgttcttatccgcgtgcactcgtagttcttccaaccactgaggaatgtgctcaaagctttcacgtattgtcatatcgtaaactaacattgcaccaacagcacctttgtagtaggcttatgtaatagctctgtgtctactcacagcaaaagaacaagaatgtcactaatcaaaccaaccacattgctatgtacaatggagaaaacatgccatgcacaatgattagccacttggatgtgaatgtgatcatcactacataatttgattcttcaggagaatgctataacaacacattacaatgttgccgaagaacaaaatcgaacaattccaacactaatggtccaacttctaaaagagtcgattactctctagtcaaaatgaggtcactctcaggtacacacgaagatcaaaatcgaaattgaacagcaacactgtaacatcatcgagttcgaagcaatattttatccattgttaaatcagagaagatagaactaagatcggagaaggatatagtaccgtttctggcctgcgatgtcccagatctgagctttgatgttcttatcgtcaataacgagcgttcgagtattgaaatcgacaccgaattgtggctttggaatccatactgaattcgtctcttgtgaaccgagctcgtagctgtgacttcccaaccgctgaatctccgttcaaaacaaccttgaatacgtagtcaacctcttcttcagccatcttcttcttcgctcgcagtcggcgatcgaacgacgtcgattttctcgctgtttttacactctccggtggactgagagattaaactaatcgtagggttaaaatgtaatcctctacggtagagagtactagagtgtatggtagtcaaagtcgtcatacgtggatttgattaatgattgctacacgtgtatcgcattgataggttctcttgctcggatcactaatacataaacttggatacaacccaaagcttgacctatttttgttgaacacctttttgtttttatatttttcatcctctgaaacaagtccatagactcttgtattaatatatcctgatgatatttggttttacatttgcatcttgtatcattgtaaacaattcataagccttcccacaaaagcatgcttggcatttgacaattggcaattcataaatgatgcattataagcataaatatcaacttggatattcaacttggcccgtgtattatgctacctctacaaatttggtgaggtaggttaaaatgaggccggtttgagttaccggtatattagacgagcattaacatgattacacacttgaggatattattgacgaatgaagaaactaaaatggtttagttaatgcaaaattgaggattcattcgtctattgaaatagagaagaattgtttgaggctaaaataaatatatttacatttttcctattctcctccaaacttttcgtaaacatggttatttgacttatttttgaactttttatctaataatttaaaggattgtggtgatgtagtggccacttaatctacacaacatcgcaataattttgacaaaattttctacatatttcttgtcaacaattataaggaattaacacattctacttagtagacatttacagtaatcacaaccaagatgaaataaccatatataaatatcatttgctatgttcataaactttatcgaaactagttgacttcttaaaatgccaactaattaggttagggttcatgaactttttagcaaagatagcacaaactaaattctatcttcaacctaactaatgacggtttactccggttaaccggtggttatgttctcatcatgcggccaactaagctaatgggctatttggtgatcactaatcaatgaccgagatgcactagagtttttattatgatcgagttcccaaaaaaggggcaacaagaaaaaacgaaatggcctatacagggatcgaacctgtgaccttcgcgttattagcacgacgctctaaccaactgagctaataggccatcttgctttatctacagctaactactatataacaactacacaagtgattctagtaactagctaaaattctccggtgttaaaaaatctcagattcgctcccgaggacgatttaggaagctttcgttagtttttccaatttcggatttggtcttgttgagaatatatttacgattttaattgagagattttgtgatagctcaatg

SEQ ID NO: 13478 - DNA, 3000 bp, Unknown
  misc_feature (1)..( 3000): cDNA_ID_2703094_gDNA_ID_2214630_Annot_ID_136030 3000 nt of promoter + ATG
gaaactcgaaaagtgactgacactacggaagtcgtcatcatcatgaccttgcgttctgaaactctaaaaggtactgatacgttgccgtttttaagagattatgttgtccccatctttagttgtcaatttttggttgaaccaaaaaaagaggttgtcaattttcgtatgcaaatttattacacttcggagaaacggtcacaattaattaatacataggactcggaaggtatctagtttcctaagaaatttatagaattcgaaatcaggaaatgggacgcacatggaggtcattgtatttgaggttcaccaaaccaatccttaccaaaagaagagaggatatcaataaatattgacccacattttaattcattaaatatgggttttttaatattccttccgtttaataaagagtatcattttgacatattcacacaattttttttaattatgtatatatttgtttctgtttaacaaataataaataatttattagttttaggttaatgttaaatcaaaaaaactcagtgtataaatcatgttgaaaaatgtaaaatgacactcttaatgttactatgtttttattaaactggccaattaatacacaggagatgtcatttgagtttttttttgccctcaaacccatttctatactagtttagaccaaagatgccttaatacaaaactcagcagtttcattcagtcccattagttattagtaatctcatattccgaaaatagtacactcaacgagctcctcatatgccttccaagacaatgtaagcgatcataaattttctcagattccggtctcgatttatccctaacgatgaactcacagacaattccattaacctcaatggaactacaaccaggaatcttctctacacctctctcgttcatcatcctcctcgctctctttgcatcttcccacatattagcctctccatacatgccatccaacaacacatagatcccgctatcactgggatcaagttcgagaagtttcttagccgctttctctcccagctcaacattaccgtgcatcctgcaaccgaataataatgctccccaaaccgcagcatctgcctccattggcatactttccatgagcctgtctgcttcttctaatagcccggctctccctagcagatctaccattatagagtaatgtttcaattgagggtttaggttgaatctagacttcatctgagagaaataatcacggcctgtttggatcattccaccatggcaacatgctgataatagtcctatgaaagtgatctcgtctggggcaatccctgcatcaatcatttcgttgaagtatgatatagcagtggatgcatctccatgaagggctaaacctccgattatcgctgtgtatgtaagcgagtttcttgtttgaattccgtgaaaaacactgagagcttctgagatgttaccacatttggcgtacatgtcaaccaatgaagttcctagcgcaacattgagactaagactgtatttctcgatgtaacgatgaatccaaatgccaacatcaagagcaccaagctgagaacaagcagataggcaatgtatcatggtgatttcgtcaggcttagtgttacttgtttgcatctcctggaacaatgccaaagcgtcttgaccacgcttggcttggactgatccaccgatcattgcattccacagtacaacatctttttcttccatatcatcaaaaagcttccttgaaacatcaagcaaaccacatctagcatatcctgaaatcattgtagtccacgacacaattgttctcttttccaagttatcaaatatccttcgtgcctcgtgaatatctccgcatttcgagaacatatccatcaaagcatttacaagaggaatcgtcattctcagtccattttcttttacgtattcataaaactctttcccacgattcaaatctcccaacattgaacacgaagaaaccaacccaatcatcgtcacatcatccggcttaactccttcagattccattagcttatatacatatatcgccttctccgcctcaccaatcttcttatacccattaatcaaacaattccaagaaaccaaatccctcacaggactttcatcgaacaccttcctcgcattttccatatcaccacaagaagcaaacatatgaatcgacgcattatgcacatgactaaccaattccaatcttagcttaagaacatgcccaagaatcatatgacctaaactactcaacctaagatcagcacaaaccttaaacaaaacagggtaagtgaaatgatccggtctggactcacaacaaccatgtctaagcatctgcttatagagcaaaaacgattctttaggattctcactctcagagaatcctctaatcgttacattccaagagaatatgttagggttctcaatacctttaagaatcttcacagagtaatcgagatatcgagattccgataatgcacagaaagcaattaaccggcttgaagcaaatgggtccagaatcaaaccatttattatcatctgagcttgaatttgcttcaaatgtaacaaaagtttgcatttttcgagcaatgaaagtagaggattgtgtagaacgaaactgtgagtagagttccagtttatgggtttgtctctgtgatgaggaagtgatcgagtacgacgctgagaatgagaatacagagaacgattcagttttggtgtaagaggaggaggaagaagaagaagcttggccttcgatatgttcatcggccgttgcgcgtcatcggcgaatttgccgggagaagaaccttaattatcagtctaatgggctttatacggcccaaaaaccaaaaccctaaagcccaattaaaaagccatgaacaaatttgagaagtaaaacggagaagaaacagctctcacttcttcagttcttgtagattttttcccagagattttttcgaatccggcggcggatattgaactttttggtttcttcgacggaagctacgaaaaatg

SEQ ID NO: 13479 - DNA, 3000 bp, Unknown
  misc_feature (1)..( 3000): cDNA_ID_3030312_gDNA_ID_2214630_Annot_ID_187945 3000 nt of promoter + ATG
tctgaatcttttctctcgccatcacaacgaacaaaaaaaccctagaagcaagagagagagcttaggttttgattttaatggatctttcgagaacgggattgattttgatggatcaagattcaagaatgagagatgattaaagagagagtaaagagaagagatggaggaggaggaagaagaagccagaggaaataaattttgtgagagagagaatttttgctaaaaagggagactttaaagaagagagagagagtgacaagacgactgaaatggaaagtaaatcgtgttctttttgctaaatttagaagaataaatatgatttcaagacagtaaaaaccctagtttttgaaagatttgaaagaaagaacacactcagtcttttgtgagaagaattagatctagtcgatgaatcaacaaggaaattagagaggatcaaaagaaaaaaaactcaagaagaagaagaaaactaaaggagaaaaaaagctaagggaatatatttaattttccacctcaaaggtcgaggagagaagaagacatgagaaggttttgattggtgaaggatgagatattttcagggagaggtttattaattttataatactatcaagatgatggggtttcttaaatgattatttttggaaagaaaacgatatatattatatttttagttttagttttttttttggatattggtctgtgtgtggtggttattggatatggtgaggtaataggatttataagtctccaatgagatgagagagagaagagaagtgtgtgtttgggtcagtggggaatttctttttatagggaagcataaaatgagttgtctcactttgttcacttatactccttgtaactaattggttggtatttactgcaaaaactaactagaagacctgaagaacatcaagggctacaacgtattttcatttttgtaaatctacgtactatatggtaatggtacctcataacaaaattcagaaagaacaaaataatatcaactgtatattatttttatttatgtaaaaacatttgggaagatgacatttcagaatttttctgaggacaatgttttgtttttactgaaagaaataagtttgtgagttcggccttggtttgtaagaatccaactcggaaatgacaaaataatttgttaatttcaaagacattagtgcaataatttttgaaaatttagtagtcaatcatgtggcatataacttgtcgaaaaattgtgtccttaaaaaaagaggtttgtaacctaatgaaccatatctactcagatacatgtagtccattatacaattacaatctatgcactaatttggaaagtttgtcatgcacaaataaattttgttcaatcccagtaacaattacacacacaatgggggtatcaatcatcactgaagtatttttttataaaaccaattgaatatgtaactcaaaataaaatttaaatgaaatcactttcttacgaggttatttatcatttaacattttaatacataagctcaacattacaaatcacatatacttcaccaacgtcaacaacagaaccaaacatatgatttcaatcgccacaatcatcattccatagactaaaaagcaatttacaaaaccgtgattaaaggtaagaaaataaaattaaagggtttttaaaaataaaataatgtttaagcataccttcatacgaagaaacagtgaatagagggaccctcgaggcacgagccagagtaaaataaaaagtgtcgaccactaaaatttttcaaagggacccaaaaccagacccgaagcagccacaagaaatctgattgggacacgatccattgtccgtacagaattttatttctaaattaaagttttacccaaataaagatactccacgcaactactacaaacccattcttcttctctttattactccaagtttgcaataatctacccttcaagaatacatgtggctcgtatcactcaccccctatttgagtattatttactcttccgacgaaactcttgtgttgtattattgcgaatttattatgatactatatgaattatgaagttgcaaacggtaaaaaagtcatatggttgatgtgattaatacggtgttaaatataattatggtttgcgttaatttactgtaaactcttttcttttcttctttaactcttttctatctaattgggtaatcaagcaaatatagttgaattataatttgaaatttttgttgacaacaaaatattaatatggtttgcgtttgtgttctacgagtaatggaattatggaagtttttaaaacaaaaatgtagtattttttgaaaattttgatgacgtatattagaaaacactagaaaacaaaaccttctagtggttaaagttgctaggagaataactataagagaggtggcctgatcgatattacttatttcggcataatacatattcctttctaacgtattttaaacaaagaaaatcgttgagtttttttcagcttggtttggtttcgaaaaaaaaaaagtttgttcactcacaaaattattatcaagtaatgtttattcatatttgtcatggtttggtaaaagtagattaaatttggtagaacatccatcaattggcgtttggaaccgcatgaatcatttatatttgaaattgaatagtgtttagaggcgcacgtgacacaactggtgaggtctttgagttttgattggtcaaagtgtcagagtttttatgagtagacgactcgtgacctttcccttaacagttccaagcctctctaatgaaacattgcacctaaccttttagccattttaggcttctttctttctacacagtccctacactacacactctctctgacacatcaaggaaactacagtcaccgttatcataaagcggagtccctaatgggctttttattattattgggcttttattaggcccaaattttccttacgagtaaaataagtattattttggttcagtttctcgccggatcctgaaaatg

SEQ ID NO: 13480 - DNA, 3000 bp, Unknown
  misc_feature (1)..( 3000): cDNA_ID_3030325_gDNA_ID_2214630_Annot_ID_187937 3000 nt of promoter + ATG
tggagttaatccagcggaaggaccgggagcaggagcatcggtctgaggaggagaagcaaccggggatgttgttggagaagtggtaggagctggagttggctcgttaactggaacaggcggtgaagcaattggtgaaggtgtttctgctgtcactggaggaagcgccgttggtggaggagtaacggtggttggtgctggtgcaggagcttgagcgagacatgaagtggccaagaaaccaagaaagatcaaagcttgcattgccttagaattcatttttagattatctcttctttgtctgaatcttgaaactctctctgtttaatgttataaactcttctttatttttgttgatggtgtagaacaatgagagaagagagctctatatatacgcgatggttgggaaatagttaataattaattattggtgtgacactaatcatgcgaaccacatacaaaaatacaacatggcttagcttttcaatggcggtttaaaataattgttgtcttttttctttcttaaacttgacgtgtttgagtttttgaagttttcttgaagaatcatctacatgaaggagcaccaaacggatacacagatctctgccacgtgttttctcttaacgatgttaattctgagatcagttaagtattgacacgtgttatgtttatattggtttttagatatgatttgactctgcgtaatttgctttttggttaaccgcgttacaatgccaggcgtaaattaacttgagttttgcctaatgtttcgtggaaataacgcgtttacgagtaaataattaacattatacgaaaaatgggtcattatttaagttcatattcatatatagtatgtctatcaaaattttcaactgttaattattttagatgtatattataatcgtttctgttgaaaaaagttattttatatgtttcgttgtaatgtgttatctggactgattatacgagcaagggctggcaaaagctgtcatattttcatgttaattaaattaataaattagtagatcattatagttatatttatggtttttattttgttgcaatattctagtgacagattacttggtggccattattgttacaaacttacaacgaaacagtcaagcaaacgcgcattgttcatattctacagctatatcattattacggtgtgaaatgcttcatttcaataagaacctacctaacaattatttatattccttgaataataaattgttagactcttgctttgaccttaatatgcattgtatcagtatcttcttcataagaaaattataagttgaaaacttttttcctgccagctttgaccaaatgaatatattaaaaagttaccaataaagaaattttaattaatttgattagtagtacaagtttggacgaggccttggcaggcctctctttctagcttttcgtggatgtggcctaacctcgtaacttttcgtattttatcaagcccaaagtagctttccgttatcacttatatgaaaaaatctaagatctaaggggagttattgattagtattttaatttataatctatatacattaaagaaaatagaacatcttgaaacctctaaataaatacaccgtgcttaaaaaacttcacgagatattcaattgatttttttttgtttagaatattaaataatcaatactccattagatgtcatttacccaaaaaaaaaaaaaaaaaactccattagatgttattattgtagattgtaccaataaactctgatatataagtccaacaaaactccattagcagtagtgttggtaagctccccatattcttgggctttagtttcagaagatttcatgttatccgtcggcttagtttatggaattatcttgttaatcgccacttttatataatttcatatataatctatcttttagtgcaaaaaaagtaaaaaaaataatttcaacgaaactcaagtttggaaccgcaatccaattattttaatcaaatcattgactaccgaaatatttttccaccttcaaacaatctaaaaagaaaaataatttttttgatcaattcaccaacgttatttagtttataaaacatgataaaagatcctccaaaaatataaaacctagactttccttaaattttaagaagtgtacttttgttcactcaatttattatttctctgccaaattctctatattcttcacacgtaattactatctagttctcgtccatttcctttatcattttctcattgtcttgtaaattgaccactctaatgatctctattatttcctctagaatagagtatgatttatctccaatctatcactctatatatagagtaatcctacaattttctctattttaaagtaacatatagaatgaggatggagagaatgtactatatcatagagttttagaggacaaaattaaagtgggattggagatgctaagtatgtaaatttggttcggttagctatcataagggaccgagtgctatatgacaatgtattataggtaaaagaagtgatattgtctcctgtagatttagtgtccttaaccgttcatcaaatctatgtgaatctcagtagtaggtagttgggtgaagaacgtgtgaagtctatacaactcatattactcctcaaacattttctgataatatattgcatacattgaacctctttttaaattcaaaacatcaaaggtattgatcttacatagaaaaaaacatagactcttatgttcatgtccctattgatcttagtcatacctcataattgtctaacaaagaaaatcaaaggtatcataattatcatcatatgtaatgtagggaacaaatctgtatttactggtatatatatataacacaaaaaaaattaccaaagaaaaaaaaagagcaaagggaacgataccattagtcccaataccaatccttgcaaaattcaaactcaaacaaaccgtttatctcacgcgccgccgtactcgccacgatccgtctttggagaccaattt

SEQ ID NO: 13481 - DNA, 3000 bp, Unknown
  misc_feature (1)..( 3000): cDNA_ID_2703102_gDNA_ID_2214630_Annot_ID_187932 3000 nt of promoter + ATG
aaccaccgccgtagaatatcactgtgtgtgtttttcgccggtgatattttttggtgtgctgacgtggcagttgtatagatatttttccatttatgggtaagcacgagcggaacggcgtcgtttaggaattgaatacgatgtcgtattaggtggaaacacaaatccccattgagatcatcttgtgtcggtgccttgactcgttttatttacgtttctattacacaaaacgtttttgattggataatgattttcttcaccaaatttacaccttactttacagttttcctcttttatttttttttataagaatggagcattgtatcaaaatagaaaatcgagtagattttgttgcatttttttttttttttcttcaaacaccatttatattaagttatcgggaagagactctccgctagagagagccatttaggaaccaatgtgcttacatgggaaaaaaggctattgcgagcccgagctttcttagctaaacaatctgctcgagtattagaactacgagaaagaaatctaatacgaaaagaagggaaaaaacaaactaaagaacgatatgaagccaattccgctgcaaaagtcagccaatcgtcttggttatcaaggatagcaatcaagtctgagcaatccgaagcaaaagtaccagaagtatcaccaatagagatcatgcactccattgcctataacaaagagttaaattccgcatgaagcggtgataaatttcgacgagtgctcttaaggccaaggtggatgaccaagtcttgtcgaacaagtacccaaccatgcccgctcaatgtgtcatctacatgccatgatgcatcgagttgacattcagggagcaaggtggacggggtctgagaagaacctacgaacacgattggacgagtggaatcatcctcttttagagttgcttgtttccaaacagctgtctcttgaagtgccaaaaccaaagtttcagggggaggttccctgaagttctcaaaaacaaaacgatttttacttttccagatataccaaattatccatggaaagagttccaacaccttttctccaattccaaattctcggtcacgccaaaaaaggaagtcgaaattatagaagagagagtttctagggaaaatattccctgaggtaggaataggcgataaagcccaaatctgtctcgaaggtggacaatgaaacaatagatggttgattgtctcttctacttcttcgcaacggggacaacctttatctgtacccatatggcgatatgtcaatctttgacaagtggctaaacaacccgagatacattgccacacgaaatgcataagcttccgcgtagttttaagctttcatacttgtgcctgaagtgccgaaacacctggtccctgaaaaggggggtcacaagtaggacgagaaagatctctcgcgacccaatatcctgacttaacagtataattaccggatttagtgtgagaccagctaaagccatcactcaagtaggtacgacttgggcgaatccctaaaatgagtggaatatcaacgggatcgatcagtgcttggagacggtccaatttccacaaatttgtgttttggtcaattaaatcattgacatagagtagagaatctcttatgttaagaatgctctttgcaggccgcgctaggatagtgggaatccatggatctttccatacgcgagtcagcattccagaacctatggtcctccgaaatccaaagacaagaagaggtttggcgcattttcacctctaaaataaacacaatttcatgttgatattaaggttgttagtttcgatccaaaagaattattttgactatagttaagatgatgttatacctaaaaaatataatttacattttataaagaaaacaaactaattatattatcaatggatgataccggatataggaacttataaggtgaaaaaaatcaaagaaccaaaaacccaaaaactttccaaatatataagagaatataaatatgttttggagaatcaaaagaacctaacccaaataaaaagaaagcaaaaaactcactcttgttgctgtcatcgaggcccaacagctcttgtctcatttttgcattgccacgaaagtcatcaccctataactttaatttataaattttttaatgggttagagaaaataaaaaacgcatataatccaattattacaactttaacaaattaaagaagacatgatgattagattaccatgcgaataagacaaacatattttgtaaaatgttgtcaaaaaaatatctctaaagcattcatgattttagcatttaacaaaataattctgataaccaattttgttacacactactataaaacttctaaacacaatattgtgatgttataataacttttacatggtgaatagacaatttcaaaagattaataaaaagaaaactcgattattcaatttttaaaaatagattattaatttaacacagagattcctttccacgtatagcttgagtggagctgagccgattagtataagccgagccatattatatccgtttgagattaattttattttaattgattttttaatcttctcttacacgagttccagtgataccggaagaaacctggaggtaactgggtatagccggtggaccccctcaaatttattttaacaaaaaaaaaaaaatcatttacaaaagaaaacacccaagacaatatctacttaaccatggttactttctaacccaacctttgagtttatttaaactgagagaaagtgtgaaaccaagcttgttcatatggaaaacgctcatcaacctcaacaatctctctcctctctctctctgtatatagaagaatctccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatg

SEQ ID NO: 13482 - DNA, 3000 bp, Unknown
  misc_feature (1)..( 3000): cDNA_ID_3030296_gDNA_ID_2214630_Annot_ID_187929 3000 nt of promoter + ATG
ttgatgcagggattgccccagacgagatcactttcataggactattatcagcatgttgccatggtggaatgatccaaacaggccgtgattatttctctcagatgaagtctagattcaacctaaaccctcaattgaaacattactctataatggtagatctgctagggagagccgggctattagaagaagcagacaggctcatggaaagtatgccaatggaggcagatgctgcggtttggggagcattattattcggttgcaggatgcacggtaatgttgagctgggagagaaagcggctaagaaacttctcgaacttgatcccagtgatagcgggatctatgtgttgttggatggcatgtatggagaggctaatatgtgggaagatgcaaagagagcgaggaggatgatgaacgagagaggtgtagagaagattcctggttgtagttccattgaggttaatggaattgtctgtgagttcatcgttagggataaatcgagaccggaatctgagaaaatttatgatcgcttacattgtcttggaaggcatatgaggagctcgttgagtgtactattttcggaatatgagattactaataactaatgggactgaatgaaactgctgagttttgtattaaggcatctttggtctaaactagtatagaaatgggtttgagggcaaaaaaaaactcaaatgacatctcctgtgtattaattggccagtttaataaaaacatagtaacattaagagtgtcattttacatttttcaacatgatttatacactgagtttttttgatttaacattaacctaaaactaataaattatttattatttgttaaacagaaacaaatatatacataattaaaaaaaattgtgtgaatatgtcaaaatgatactctttattaaacggaaggaatattaaaaaacccatatttaatgaattaaaatgtgggtcaatatttattgatatcctctcttcttttggtaaggattggtttggtgaacctcaaatacaatgacctccatgtgcgtcccatttcctgatttcgaattctataaatttcttaggaaactagataccttccgagtcctatgtattaattaattgtgaccgtttctccgaagtgtaataaatttgcatacgaaaattgacaacctctttttttggttcaaccaaaaattgacaactaaagatggggacaacataatctcttaaaaacggcaacgtatcagtaccttttagagtttcagaacgcaaggtcatgatgatgacgacttccgtagtgtcagtcacttttcgagtttcagataatttcttgtttgattgctaaaaaatatgaaccaatggcctgaaattgttgcctccctttctcacaacaattctcttatctcaagacaccaactcactataatattttatccactaaagtgttgttatataacaaaatacaaaaaatcaaaacaaaaattgacatctaaattttaagtaaattatgcataatttagaattatattgctaatctttttatcttaatttattaattttatccttaaattattagccgtagagtaactatagcattgagcactacgacgacactgatcacattaaagtattaaacaataaatgaataaaagatgcatgcttttttgtaaaaaaaaatatagtatgaattatttggccaaccaacgtgaatgtgaagataaggttttgtatgctttttacaaagtcaaaaagtgccttgaccatacgttaggtttaaaatcaagagttgaataattcactcacaaattcatcgtgacctttaaaagcctatcaataaatgtgtgttagttacactatttgattatgaacattgaccaggattaatgtttggttctagctagatcattcgcatttcataaatagtacaattttttcattattgttatcaatagtattaattatagcattatttcttgtatacgttacataaacaaaattcttgtataaatatttaactagttgttgaatacaataacaaaaatctaactattcatattatacaaaaataatcactattagtattaatgtatcttattaatatggagtagtaattatttttgtatgttatgaatatatatttagatttttcttaagatgtttttaatagtaattatttttcataagatgtttcttattaatgtatttttaggattttcacacatcttaaaaaacatattaaaagttgattagaaatatattattcttcttgaagtttacacatcaataataactagtaataaatattgcatagaaattttaaaaatgactatcttttcgaatcaaaaaaatttcctacaaaatacaataataaacaaagagagtagtactgttcatctaaatactgtataatggatgttttaccaattttaacaattacgtacaaaagtttcacacctttataaaaaaaatttgatcaattatccttttatcttctttatttttgccagctaatatacactgcaataatccaaacttaacaaacatttaacattacttcagattcatcattcaataatttcacaaacccataattttaccaaattactacactaatcccccattggcaccaattctataattagaaaatttatttctttatttatttatttatttatttctatttattaaagaaataaattatagaaattggaatgcccaccaccaccagagaccacacttgcacaaattccatctataaacacaaaagcctttagtatcattctcgaaaaccaccaaaaacctctttataacccaacaaacaaagtctctacttcttcttcaatcactgaaacacaacaccaaaaaagaaaaaagtatgtctcttcttccccatctcatcctctacctaacacttttgacggtggttgttactggagaaactctccgaccaagattctacagcgagacatgccctgaagctgaatccatagtaagaagagaaatgaagaaagca

SEQ ID NO: 13483 - DNA, 3000 bp, Unknown; identical to SEQ ID NO: 13478
  misc_feature (1)..( 3000): cDNA_ID_3030346_gDNA_ID_2214630_Annot_ID_187926 3000 nt of promoter + ATG

SEQ ID NO: 13484 - DNA, 3000 bp, Unknown
  misc_feature (1)..( 3000): cDNA_ID_2703053_gDNA_ID_2214630_Annot_ID_187923 3000 nt of promoter + ATG
atttgatcatgcaggatgtgatttatatggttttactggtgcttcaggtgaagtaccggtgaaagcggatgcatcaacaattgccatcagttgctggagagggaaggctagtttggctgttatggccactgtcgcagattgccaggagctgctagagagatttgccgagaaaacaccaaaaacagaaggtggttcggtaaatggaagcaacggcgattcggacggtccactagctatggagacttaagccctcccttcttcataacttcaaattgtactcctttgttgtggtttgactattcccttactacctccaaattatttttcatataagcataatcatgatgacttttgttggaacgacataaaaaaaatgaaagattttgttctaaaaatcaacgtacactacacaaaactcactatctaaaaaccaaatcaaaacaatatttttgaagtatatgaaatggtttattttattctaaactgtaatggaccaaatcgagaagactgacttattgagctgcaacacacggtggtcttagaagactgacttgtgagctgcaagacacggtggtcttagcgagattcttcttgttcaccttgttgaagatctcagtcaagagagtgttgaaagagttctcgacatttgtggagtttagtgctgaagtctcaaggaaaaaaagcccttccttctctgcaaattccttggcatcttccacaggaaccgatctctggttctctaaatccgtcttgttaccaatcaagatgatgacaatgttcttatccgcgtgcactcgtagttcttccaaccactgaggaatgtgctcaaagctttcacgtattgtcatatcgtaaactaacattgcaccaacagcacctttgtagtaggcttatgtaatagctctgtgtctactcacagcaaaagaacaagaatgtcactaatcaaaccaaccacattgctatgtacaatggagaaaacatgccatgcacaatgattagccacttggatgtgaatgtgatcatcactacataatttgattcttcaggagaatgctataacaacacattacaatgttgccgaagaacaaaatcgaacaattccaacactaatggtccaacttctaaaagagtcgattactctctagtcaaaatgaggtcactctcaggtacacacgaagatcaaaatcgaaattgaacagcaacactgtaacatcatcgagttcgaagcaatattttatccattgttaaatcagagaagatagaactaagatcggagaaggatatagtaccgtttctggcctgcgatgtcccagatctgagctttgatgttcttatcgtcaataacgagcgttcgagtattgaaatcgacaccgaattgtggctttggaatccatactgaattcgtctcttgtgaaccgagctcgtagctgtgacttcccaaccgctgaatctccgttcaaaacaaccttgaatacgtagtcaacctcttcttcagccatcttcttcttcgctcgcagtcggcgatcgaacgacgtcgattttctcgctgtttttacactctccggtggactgagagattaaactaatcgtagggttaaaatgtaatcctctacggtagagagtactagagtgtatggtagtcaaagtcgtcatacgtggatttgattaatgattgctacacgtgtatcgcattgataggttctcttgctcggatcactaatacataaacttggatacaacccaaagcttgacctatttttgttgaacacctttttgtttttatatttttcatcctctgaaacaagtccatagactcttgtattaatatatcctgatgatatttggttttacatttgcatcttgtatcattgtaaacaattcataagccttcccacaaaagcatgcttggcatttgacaattggcaattcataaatgatgcattataagcataaatatcaacttggatattcaacttggcccgtgtattatgctacctctacaaatttggtgaggtaggttaaaatgaggccggtttgagttaccggtatattagacgagcattaacatgattacacacttgaggatattattgacgaatgaagaaactaaaatggtttagttaatgcaaaattgaggattcattcgtctattgaaatagagaagaattgtttgaggctaaaataaatatatttacatttttcctattctcctccaaacttttcgtaaacatggttatttgacttatttttgaactttttatctaataatttaaaggattgtggtgatgtagtggccacttaatctacacaacatcgcaataattttgacaaaattttctacatatttcttgtcaacaattataaggaattaacacattctacttagtagacatttacagtaatcacaaccaagatgaaataaccatatataaatatcatttgctatgttcataaactttatcgaaactagttgacttcttaaaatgccaactaattaggttagggttcatgaactttttagcaaagatagcacaaactaaattctatcttcaacctaactaatgacggtttactccggttaaccggtggttatgttctcatcatgcggccaactaagctaatgggctatttggtgatcactaatcaatgaccgagatgcactagagtttttattatgatcgagttcccaaaaaaggggcaacaagaaaaaacgaaatggcctatacagggatcgaacctgtgaccttcgcgttattagcacgacgctctaaccaactgagctaataggccatcttgctttatctacagctaactactatataacaactacacaagtgattctagtaactagctaaaattctccggtgttaaaaaatctcagattcgctcccgaggacgatttaggaagctttcgttagtttttccaatttcggatttggtcttgttgagaatatatttacgattttaattgagagattttgtgatagctcaatgtcaatg

SEQ ID NO: 13485 - DNA, 3000 bp, Unknown
  misc_feature (1)..( 3000): cDNA_ID_2994527_gDNA_ID_2214630_Annot_ID_187922 3000 nt of promoter + ATG
taccaccggagattaaaaggggaaatcactttcataggatggccagtttgggcttcacactgcaattttcatttaagcttcgaaatcggagattcatgaaacgtttggccggagtttcgagcaaaataaaataaaattataggatcgattaattgacagagatggtgttgttcagctaagaaaatcacaattctagagctgtgtaaaagttctcgagaaaaaatgtacggtcaatgcttttaattggattgaaacttgtttatgtgattaaggaaaataatgtattttcaataaaatgaaattgtctattcttgttaaggcaatgaaaagttctacttttagcaatgataatcagtaaaagggagtttttcctaattgatccatgttttctaaagctacaatatatatatatatatatatatatatatatataaaattggttgtatatatgccatgtaatacagaaaccgatagaagcgttgctaagtgtaggatttttcatttttgactcaaaagttaactatattatttgcaggaaacaatggatttagatatgattattgcattgcagaatgttcagaacattttttagatgatgtatgcaagccagtgtgtatagacaaggggtactcggatggaggatgtattggtttagcaccaaattttaaatgttgttgtaagaaatgatagaaaccaataatctttatagtaaaacggtgatggtgatttgatatcttgtatgttcttcgatgaaataaagctaatcttatctttgataagcttcagaagtcttaataatttcacaaaagcttagcattatcgatatcctagagataagaaggtataaaaaagagtaaaatttatattgaaccaaacaattcatgggactgttttatcagaggatttggcgagtaatggcaccggaacgagtccgtgtttttctctggttagtggtgcagcaagtgatcataactaatgtggaaagatatcgaagacacttgagtgatacgagggtgtgtcagatttgtcaaggcggggaggagacgattctacatgttctccgcgactgtcccgcaatggcagggatatggagccggttagtccctcgtgatcaaatacgacaattcttcactgcttctttgctggagtggatctacaagaacttacgggaacgtggatcatggccgacggtgtttgtaatggcagtatggtggggatggaaatggaggtgtggcaacatctttggcgggaatggtaagtgtagggaccgtgttaagtttattaaggatttggcggaggaagtggcgatagcgaatgcttttgtgaaggggaatgaggtgcgggtgagtagagttgagcggttggtgtcttgggtatcgccggaagatggttgggtaaagttgaacacggatggggcttcgcggggtaatccggggtttgcaacggcgggtggggttttacgggatcataatggagcgtggattggaggttttgcggttaatataggtgtttgttccgcacccttggctgagttgtggggtgtctactatgggttattcatcgcttgggggaggggagctcggcgggttgaattagaagtagactcgaagatggtggttgggtttctcacgacagggattgcggattctcatcccttgtcattcctattacgcttgtgctatgactttttatcgaagggctggatagtccgaatctctcatgtgtatagggaagctaatcgtcttgctgatggattagcgaactatgctttctcgttatccctaggtttgcatttgttggagtctagacccgatgttgttagttctattttgttagatgatgtagcgggggtttcgtacccgagacatgtccaagtgtaatttttttattttcttttaataaaacgggagacgcagtctccctcattctaccaaaaaaaaaacaatgcagatatttgcaaatttttcttctttttagatacagagtatatgtaggcatgtagctaaagatacttgatttggtgtgattttgatcatctggatgtaaaaggtatggtgatgcgtctagtgttggagcacttgaggctttggttattggtgttgtggtcattgttaattagtaccaatgtgaagcacctttatcgatttcacagggactggaccatagtgatgcttgagtgacgactcttattcgtcgtggtctaagccgcctctttatcatttttagggctctttggtcgactaattttattttatttttccctttcactagggtttcctgacttgttaaacaagctttagctctccgattaacagctaacagctcttttaccactcagaccctttatttttttatcccggccacctattatttattttgcttgattttatttcattaataaaatttataggaaaaaagaaaaaatttaaaaataagaaacaagaggtaggctcttctagcgaactcctttcatacgttttctctctactctcatcgcttttcttatctctctcggagctcttccgtcgtccaccattgattacggtaagattcaccttctcctactcaatttcataactatagataaataaatctctgtcttctctgcctctgttagtttttttctacgattgaaaccatcaaatcaattcaaggttttacacagtttcttatgcttgtcctgattgtttcgttcccggagagggagaaattacggcttttggaatccgcccagaaaatttcccgcccagctcggattttgatagaaatgttttgcctttttggtttctgtaaaattgatattcttattgtactttgattgaagtatgtgtgttcaattgaaattgatgttgtgtatttcttaagtttgaatctttgtgtaaggattgggggtttagggttttgactcatgattgctttctgcatttttaaagttaaaaagccagactttgaggcttagagctacttatattgtgttgcagggagtgtattgagctaaat

SEQ ID NO: 13486 - DNA, 3000 bp, Unknown
  misc_feature (1)..( 3000): cDNA_ID_3030296_gDNA_ID_2214630_Annot_ID_136032 3000 nt of promoter + ATG
aatgtggtaacatctcagaagctctcagtgtttttcacggaattcaaacaagaaactcgcttacatacacagcgataatcggaggtttagcccttcatggagatgcatccactgctatatcatacttcaacgaaatgattgatgcagggattgccccagacgagatcactttcataggactattatcagcatgttgccatggtggaatgatccaaacaggccgtgattatttctctcagatgaagtctagattcaacctaaaccctcaattgaaacattactctataatggtagatctgctagggagagccgggctattagaagaagcagacaggctcatggaaagtatgccaatggaggcagatgctgcggtttggggagcattattattcggttgcaggatgcacggtaatgttgagctgggagagaaagcggctaagaaacttctcgaacttgatcccagtgatagcgggatctatgtgttgttggatggcatgtatggagaggctaatatgtgggaagatgcaaagagagcgaggaggatgatgaacgagagaggtgtagagaagattcctggttgtagttccattgaggttaatggaattgtctgtgagttcatcgttagggataaatcgagaccggaatctgagaaaatttatgatcgcttacattgtcttggaaggcatatgaggagctcgttgagtgtactattttcggaatatgagattactaataactaatgggactgaatgaaactgctgagttttgtattaaggcatctttggtctaaactagtatagaaatgggtttgagggcaaaaaaaaactcaaatgacatctcctgtgtattaattggccagtttaataaaaacatagtaacattaagagtgtcattttacatttttcaacatgatttatacactgagtttttttgatttaacattaacctaaaactaataaattatttattatttgttaaacagaaacaaatatatacataattaaaaaaaattgtgtgaatatgtcaaaatgatactctttattaaacggaaggaatattaaaaaacccatatttaatgaattaaaatgtgggtcaatatttattgatatcctctcttcttttggtaaggattggtttggtgaacctcaaatacaatgacctccatgtgcgtcccatttcctgatttcgaattctataaatttcttaggaaactagataccttccgagtcctatgtattaattaattgtgaccgtttctccgaagtgtaataaatttgcatacgaaaattgacaacctctttttttggttcaaccaaaaattgacaactaaagatggggacaacataatctcttaaaaacggcaacgtatcagtaccttttagagtttcagaacgcaaggtcatgatgatgacgacttccgtagtgtcagtcacttttcgagtttcagataatttcttgtttgattgctaaaaaatatgaaccaatggcctgaaattgttgcctccctttctcacaacaattctcttatctcaagacaccaactcactataatattttatccactaaagtgttgttatataacaaaatacaaaaaatcaaaacaaaaattgacatctaaattttaagtaaattatgcataatttagaattatattgctaatctttttatcttaatttattaattttatccttaaattattagccgtagagtaactatagcattgagcactacgacgacactgatcacattaaagtattaaacaataaatgaataaaagatgcatgcttttttgtaaaaaaaaatatagtatgaattatttggccaaccaacgtgaatgtgaagataaggttttgtatgctttttacaaagtcaaaaagtgccttgaccatacgttaggtttaaaatcaagagttgaataattcactcacaaattcatcgtgacctttaaaagcctatcaataaatgtgtgttagttacactatttgattatgaacattgaccaggattaatgtttggttctagctagatcattcgcatttcataaatagtacaattttttcattattgttatcaatagtattaattatagcattatttcttgtatacgttacataaacaaaattcttgtataaatatttaactagttgttgaatacaataacaaaaatctaactattcatattatacaaaaataatcactattagtattaatgtatcttattaatatggagtagtaattatttttgtatgttatgaatatatatttagatttttcttaagatgtttttaatagtaattatttttcataagatgtttcttattaatgtatttttaggattttcacacatcttaaaaaacatattaaaagttgattagaaatatattattcttcttgaagtttacacatcaataataactagtaataaatattgcatagaaattttaaaaatgactatcttttcgaatcaaaaaaatttcctacaaaatacaataataaacaaagagagtagtactgttcatctaaatactgtataatggatgttttaccaattttaacaattacgtacaaaagtttcacacctttataaaaaaaatttgatcaattatccttttatcttctttatttttgccagctaatatacactgcaataatccaaacttaacaaacatttaacattacttcagattcatcattcaataatttcacaaacccataattttaccaaattactacactaatcccccattggcaccaattctataattagaaaatttatttctttatttatttatttatttatttctatttattaaagaaataaattatagaaattggaatgcccaccaccaccagagaccacacttgcacaaattccatctataaacacaaaagcctttagtatcattctcgaaaaccaccaaaaacctctttataacccaacaaacaaagtctctacttcttcttcaatcactgaaacacaacaccaaaaaagaaaaaagt

SEQ ID NO: 13487 - DNA, 3000 bp, Unknown; identical to SEQ ID NO: 13481
  misc_feature (1)..( 3000): cDNA_ID_2703102_gDNA_ID_2214630_Annot_ID_136033 3000 nt of promoter + ATG

SEQ ID NO: 13488 - DNA, 3000 bp, Unknown; identical to SEQ ID NO: 13479
  misc_feature (1)..( 3000): cDNA_ID_2713769_gDNA_ID_2214630_Annot_ID_136043 3000 nt of promoter + ATG

SEQ ID NO: 13489 - DNA, 3000 bp, Unknown
  misc_feature (1)..( 3000): cDNA_ID_1450489_gDNA_ID_2214631_Annot_ID_136049 3000 nt of promoter + ATG
ttctttgtcgtctttgaaggttaccaccagctatatttcagcttcacaatgtcaaatcaaagatcatttcaacatttagagcttaaatcaaatgtaggaaaaaagagagaagcttttttggtttgctttatttctgtttgatggagtttgggtgtgtgtttgtgtcttttgggtctttcttgttcccataggagagggttttttggacgtgtttgtattgttttggacagctctctactaaatacttcaagacagaggaaacaatttttcttttcttttttttcttctcccttttatgaatgagaacaaaatggttccaacctttaatttctgacacaaacaaagctttaattctttactaagacatgttctaatatttggagaattattagaaagtttagttattttcttttaaacgtaattcaagccgtgtatttataaactactagagtttggagcaagaaaaattaaaactaatgaaatatgttggaactaatagatatattttactttccagttccacttcttattctaaaatgttccccaatgtcaaacaaatagtggatacatgatgataatagactgaaggaaatggaccttaatatgagatatgataaataaacatataaaaataatgcaatctccttcctaattgagatttcagttgggtcatgcaatctcgcttttggccacaacggcaatggaccccacttgcaacctcctaattccttacattttttctcaaatggtcaagggtatttatgtcattttgactccagtttggtaacatttttctttttgacatcacagtttggtaacagttaagcaattaggaattaggaatggtaggttaagtatacaacctcataaaatggttttgctctcaatggaatcggaaggggatatgcggaaacaagaaagaggttttttttgttttgttttagaaagcaggtatatgatagaactattatacatacaacttaaattttactacaccgaagaaagtgagaaaaagaaaccacaaatgatgagggaaactttacacactaccactttctatattgttcgcaaggattagactcgaattcaagatggctacaacaagagcttatacagaatttgctagactagtttaagaactctctcatcatgctcatcaacattctcgttatctactaaagagaagtttcttctccctcttaacattactaatatatcaaccttttacgatcttaaaccatattcagtttacctaagctttaggttgtgcaatctgaaacaccagaggttatacagtttgacatagaacatgaaactgtgtttacacaaatcaatccacagagaatacgaattattcattacattaccataagttttgaatagacatagcaatcttgcttgctctcagttcgctcgttcgcgtaacacttcaagatcaacctcagtaggatcagtagcttgaatctcatagtgaatcccttgaagctccctacttaactggtctttagaagtcgagtaaagcaccttggctcgaattccagaggtcgaaggagacctacaacatcagtagtcccaaatcaaaatgttttagtctcaacacatcaaaacccttatagacttactaatggtaaaaatcaaactaaccaagcaaagaagaagattttgctcttttgacaattctcagaagtaacgaaatcaaagtcataaacagcgtatctgcagtcattatcaggaagtgaagctaagaaatcatcgtagctctctgtaggatttccagttttctcaacaacaacttcttttttggattcatcaatcttgaagaccacatagcgatgagtttttttcctttgaagctctagaaatgtggttttgctctcatctgcaacacccattccagatattgcatttggctacagatataaaaccaaaacacatatcaaaaccataccaaaagattcgatttttaatccaaaattcatcgaattgacttcatctagtgatcttaaaccctcaataagagtaaaaatggagatgggtttagttttttttaacatcgacttcataaaaatcaaatttttaacattgaagatgcttgcgacatagacaagagtacatcgattttaagcaagaagagaaaagtttttttttgtaattttaccctgctaagtcctctgaaagacatggatttgattctgctttcttcagacaccacagaattgggttagagagacgaagacgacacgaacttatcaaacaaataaaatcggatgcgtcgctttgttcttcgtgcacacttttgcttagtaattaagtttttgaatttttaactttttttggtttattgcagaagaaaaagaagtgttcggtcggtggcgttagaacaacgcgataagaaaagtcgtgtttctttttaagtgggccatatttgttgccccttaactagtcgccgcgtatctatcaatattgggccttaattaagcccattagtgaatagtaacaaaaatcatttgggcctcagaagtagaaaaggaacgaagaaacgacgtcgttgttaagataatctctttgattttgtttttagacggctctaggcgattactgttgtggtggttcactccaactccggcgactcttaacgttcggaacctgactgtgccatcgtgtctcagagatgcagtttcttgtaggatttcacaatctttattctattgtatttttaatctcattttatgattctccaaactatagtgaatgactttgtaacttggggaacgaagcaggagaaggtgaagttgataaagaaggaagacccagtaatgttgaagagccctgaagactttccggtttactggttcgaaacctctgattctgtctctcaccgttatcagttccaatccgacggccacctctctgtaaatctccctctccctcgttcttgtctctcttatgccattgctctcaacttgtagaatcattatgtgaattatcacgttttagatg

SEQ ID NO: 13490 - DNA, 3000 bp, Unknown
  misc_feature (1)..( 3000): cDNA_ID_1807426_gDNA_ID_2214631_Annot_ID_136050 3000 nt of promoter + ATG
ccaagcaaatcttgtccccgtgccatcgagaaatctatcagtataccatcctttagcttgcacttgagataaaaatggattgaagacatcgttcattttgtcatacgcgtcttgcaatataatgtcatcagggtcattatatatctttgtcattgacttgacatatgctgcaactaaccaccctcgcaatgcatcttcaccggttgcatcgtgctctaagaccatatcggtccatgactttccatgactcaatagaaacttctcttctacaaacacttgttttagtctttgtacctcagaaggcttcacagctttatggagagcccttcccacttttacatttcctgcgtcttggattggtctctcggggaacattaggtcttcttggaatcttaaatcaggagggcttgggactttaccagtctgagaagatacaacaacacctcttatgtaattaaaagaaatcaacaagatggtttacagaaaaattgaacaaaagatgatgctaattaccttgagaaaattagccacaatcaaagcggttcgctgtggattcagtgtgttgattggtacccctcgcatttgttctacaacgctatacacatgtacaaccgaaagaattgacccaaccaccaactgcagatatcagccttttcataatagagttgcaatccaaacaaatagaaactgcattttgaaatagagagtaacgatgtagcagaatgacattacctttccctccattgatgaacatattgtggacgcaagttgaataccagcacctatcccggcaacattgaaaagagtagagatagcttctccttttgcaaaaatgtcactaagatttccttctttggcaaaagatgaatatattggtaatcttgttgcccttgctgcaactgtagccattccctatttaaaacaaacaatgccagaaaagtatgaaaaacaggaaaccagtgaagctgattgatgtataaaaggatggtctttagaaagctaatatatctcataggtctcctattgaagctgctgaggaaagcaggcacagatgttctaagaaagatatctataccttagcaaaattccccagaccagccatttcaagaaacagatgcgggcataatggagaaacgagttccagaccagtaccaagatcgtaaagcacgtcagctgaaaattatgaatcaatactttttatagttaacgctataaagacatcagcagaaacatgtagctacagaatggtgcatacccagaatcctccaccgtttaggctcagagtccattcttgcacccaaattgctacatattagctttccgacatgttgcatcccatccttcaatatctacagaaccaatagagtaaacaaaactttcacttacggacagggactgaacaagcaaacgaacaaacaaactgaagtggtttaacatacccagctaacaacagttgcttgtgccggtgtaggccgcaagcctgcagcaaacaacagtgactgcaaaggaatgatacaaaaaaaagttatgtgtccatgtgaaaacctccattacaacagctcaagtaaacaaatgcaattttcccaaaatcaataatcaaagctgaatcatgaagaagacctgagtcgataacactgataatgctgcactagagaaatgctgaagtgctcgaaactgtgtgtacctaagatatccttcgttgacactatagagaagaagtaaagaaagaaacttggttaaaacacatgctttaaggctaaagcctagagactctctaaaaacaaaagttccaaactttgagttcacctgtatggataaccagaaggaaagaacttgttaaggaaagattcaaccatcttctgaggaacaggtcttgcatcatcaacaactttcatctaaaacgtgataattcacataatgattctacaagttgagagcaatggcataagagagacaagaacgagggagagggagatttacagagaggtggccgtcggattggaactgataacggtgagagacagaatcagaggtttcgaaccagtaaaccggaaagtcttcagggctcttcaacattactgggtcttccttctttatcaacttcaccttctcctgcttcgttccccaagttacaaagtcattcactatagtttggagaatcataaaatgagattaaaaatacaatagaataaagattgtgaaatcctacaagaaactgcatctctgagacacgatggcacagtcaggttccgaacgttaagagtcgccggagttggagtgaaccaccacaacagtaatcgcctagagccgtctaaaaacaaaatcaaagagattatcttaacaacgacgtcgtttcttcgttccttttctacttctgaggcccaaatgatttttgttactattcactaatgggcttaattaaggcccaatattgatagatacgcggcgactagttaaggggcaacaaatatggcccacttaaaaagaaacacgacttttcttatcgcgttgttctaacgccaccgaccgaacacttctttttcttctgcaataaaccaaaaaaagttaaaaattcaaaaacttaattactaagcaaaagtgtgcacgaagaacaaagcgacgcatccgattttatttgtttgataagttcgtgtcgtcttcgtctctctaacccaattctgtggtgtctgaagaaagcagaatcaaatccatgtctttcagaggacttagcagggtaaaattacaaaaaaaaacttttctcttcttgcttaaaatcgatgtactcttgtctatgtcgcaagcatcttcaatgttaaaaatttgatttttatgaagtcgatgttaaaaaaaactaaacccatctccatttttactcttattgagggtttaagatcactagatgaagtcaattcgatgaattttggattaaaaatcgaatcttttggtatggttttgatatgtgttttggttttatatctgtagccaaatgcaatatctgga

SEQ ID NO: 13491 - DNA, 3000 bp, Unknown
  misc_feature (1)..( 3000): cDNA_ID_2703156_gDNA_ID_2214631_Annot_ID_136051 3000 nt of promoter + ATG
attgtgaaatcctacaagaaactgcatctctgagacacgatggcacagtcaggttccgaacgttaagagtcgccggagttggagtgaaccaccacaacagtaatcgcctagagccgtctaaaaacaaaatcaaagagattatcttaacaacgacgtcgtttcttcgttccttttctacttctgaggcccaaatgatttttgttactattcactaatgggcttaattaaggcccaatattgatagatacgcggcgactagttaaggggcaacaaatatggcccacttaaaaagaaacacgacttttcttatcgcgttgttctaacgccaccgaccgaacacttctttttcttctgcaataaaccaaaaaaagttaaaaattcaaaaacttaattactaagcaaaagtgtgcacgaagaacaaagcgacgcatccgattttatttgtttgataagttcgtgtcgtcttcgtctctctaacccaattctgtggtgtctgaagaaagcagaatcaaatccatgtctttcagaggacttagcagggtaaaattacaaaaaaaaacttttctcttcttgcttaaaatcgatgtactcttgtctatgtcgcaagcatcttcaatgttaaaaatttgatttttatgaagtcgatgttaaaaaaaactaaacccatctccatttttactcttattgagggtttaagatcactagatgaagtcaattcgatgaattttggattaaaaatcgaatcttttggtatggttttgatatgtgttttggttttatatctgtagccaaatgcaatatctggaatgggtgttgcagatgagagcaaaaccacatttctagagcttcaaaggaaaaaaactcatcgctatgtggtcttcaagattgatgaatccaaaaaagaagttgttgttgagaaaactggaaatcctacagagagctacgatgatttcttagcttcacttcctgataatgactgcagatacgctgtttatgactttgatttcgttacttctgagaattgtcaaaagagcaaaatcttcttctttgcttggttagtttgatttttaccattagtaagtctataagggttttgatgtgttgagactaaaacattttgatttgggactactgatgttgtaggtctccttcgacctctggaattcgagccaaggtgctttactcgacttctaaagaccagttaagtagggagcttcaagggattcactatgagattcaagctactgatcctactgaggttgatcttgaagtgttacgcgaacgagcgaactgagagcaagcaagattgctatgtctattcaaaacttatggtaatgtaatgaataattcgtattctctgtggattgatttgtgtaaacacagtttcatgttctatgtcaaactgtataacctctggtgtttcagattgcacaacctaaagcttaggtaaactgaatatggtttaagatcgtaaaaggttgatatattagtaatgttaagagggagaagaaacttctctttagtagataacgagaatgttgatgagcatgatgagagagttcttaaactagtctagcaaattctgtataagctcttgttgtagccatcttgaattcgagtctaatccttgcgaacaatatagaaagtggtagtgtgtaaagtttccctcatcatttgtggtttctttttctcactttcttcggtgtagtaaaatttaagttgtatgtataatagttctatcatatacctgctttctaaaacaaaacaaaaaaaacctctttcttgtttccgcatatccccttccgattccattgagagcaaaaccattttatgaggttgtatacttaacctaccattcctaattcctaattgcttaactgttaccaaactgtgatgtcaaaaagaaaaatgttaccaaactggagtcaaaatgacataaatacccttgaccatttgagaaaaaatgtaaggaattaggaggttgcaagtggggtccattgccgttgtggccaaaagcgagattgcatgacccaactgaaatctcaattaggaaggagattgcattatttttatatgtttatttatcatatctcatattaaggtccatttccttcagtctattatcatcatgtatccactatttgtttgacattggggaacattttagaataagaagtggaactggaaagtaaaatatatctattagttccaacatatttcattagttttaatttttcttgctccaaactctagtagtttataaatacacggcttgaattacgtttaaaagaaaataactaaactttctaataattctccaaatattagaacatgtcttagtaaagaattaaagctttgtttgtgtcagaaattaaaggttggaaccattttgttctcattcataaaagggagaagaaaaaaaagaaaagaaaaattgtttcctctgtcttgaagtatttagtagagagctgtccaaaacaatacaaacacgtccaaaaaaccctctcctatgggaacaagaaagacccaaaagacacaaacacacacccaaactccatcaaacagaaataaagcaaaccaaaaaagcttctctcttttttcctacatttgatttaagctctaaatgttgaaatgatctttgatttgacattgtgaagctgaaatatagctggtggtaaccttcaaagacgacaaagaaggaaaaagatcatcatcttctaacttttggtaattagataatttcattctctaaacaaagtctgatttttgaatcaatactaaaaaagtgatagaagagaagctatcaaaacacaaaaacagaggatttttcttttccaatctaaaagaaaggtgcttaagggaattagtttgagattaggttttaactgagtttatacaaactttctttatttaatgaaattaacttagattggcttttgtcttaaagattaattatggttgtgaaaattagttttggttgcagaaaaaaatcagttgaaa

SEQ ID NO: 13492 - DNA, 3000 bp, Unknown
  misc_feature (1)..( 3000): cDNA_ID_2703152_gDNA_ID_2214631_Annot_ID_136052 3000 nt of promoter + ATG
atttggttgagaagaaaaaatgcggtgcaaggcacaacaacattgaagtagacaataaaaacacgatttatgggactagcaagatagagcatccattctccaaaaacaaaaacacttttaactgtttgattcgtacacttagatttgtacaccacttttagtgtacatatatatataaaaatacacaacgtacactttacatttgtacactaaaagtgttgtacaatccaagtgtacgaatcaaatagtgaaaagtgactactttgcaaattatgaatagtaaagtgactacttttccaattaagtttgaaaaagtgactagtttgccaacacacccaactttctttagagctgaaaatgtcaagacaatgttatataagaaagatgaatgcactttgattacggagaaagaaaagaaggaatgattcaaagaaaagaagcagtgatgaatgatgaaattcatccccaaccccaagcatctacgatgaagcatcatgcataatatataagagtgatcaaattaatcatagaccactttgaatagacttgtctattgttagagatattgtgacgtgtgttttagaccggttaagtcgggtttgtagaccgataatttttagagaagtgcaggccctgttaaactaatatcaatttctatgaaatatctgtagtgcaaccgtcaaataaaataaaaatgatacgattcattacctaaatgaatccaacccaaccccttttctgaaactattggctatgtatggaccgaatcaagcggcactacatttttaatatatcaaaaaccaaatcgttggtttggtccggcaatacattttaacattttctgagtaatcagagtttgtactgtttagttaggatggggacagtcgcagtgtaccgtgtacgagagaggtaggtgaccagaattttttcagtttctgtcgaatttcaagaataaccctaattcttttttttactaaatcaaatataaagtatattattatcccattcttggatgtgggacctacttccactacttctcaaacaacccgctctctttgctataaacagaaatcgcatgacccaaccgctcaacaaggaaacttatacaattagtttgatccaaaattgttatttatttagaaaaatttaatagaaaagattgaaatataaacatatatgaatgaaatgaattatttatattcaatacagtccatgttatttttttaccagattctctattatacatctcttcaagtatctaaatatttttcttatggatgaatttttattttatcattttatgttatcgattatacacaaagaaaggaagtgttaaattagattaattaagtgagttgtcgatatacattacaggaagtgtttgagatagaaactattctatgatggtttagttgttgaacacagtttacttataaaattagaaaacccaggggtttaagtatttatacttctatttaactatgatatacatacataagttttatcaatgccatgtacaacgtatagatgaatcaaactagatgatgtgataaataattccatgattgttgatgataaggtagttaatcatccataaattaaaactgaacactttttatatacaaaacatatccatttaaaccgtgcattagtatttttggttcttgtattaagtcgaagagttttttcaattcgagtatataataaaatacgattgcataaacataacacatattaaacatgagattaattatagaagtaaaacatacatctaagacaagaaaatagtttcgcgttaaaatacttttatcaattacaattttgtatttgggatatttttatccaaattttactaaaatgaaaggaaaagggtagaaatgggaaagagcaaacggggctacttggtttgtcggtgtgagttagtggagcccatatcatattggtcagagagaagatcgtatttgctgataatgacggaaatacccctaaagtcgttgaaaagacctgagagattcggcaagggacccatctgttgattcttctaaccaacctttatgtttggccacaatgataaatcacatgctccaaccaaaacagcccccaaaaaaaacccaatttatattttcttaaaagtgagcttataacgtaaaagaaatatatacaatgctaattttcttacaactggttaagtgttaaaagatatgtttaggatcatattggtatttggtaatcaggtttcaacatttgaaatgattaatcaaaaaataagttgcatagaaaatgatttaaaaaatgactataaacaagaagtaatttcacaaaccatgtaacaaatcaaaaccttaataaatcatgcatcaaagttggattagaaacatagcttaatggattatatacaacattttcgtttaaattagacacctagaatatacatgttatccaataatttaactttgccatctttttacccttattgtattgtgtgtctccatctacaaatgtccgtatatttcaaacacagagagggagagagagactcttgtttaaaaaacttacttcttctcctgaaaattgagaagacagacgtagagaagaattaattgtaacaaaggttctaattttcccagctctgattactcattatcttacatctctttctatctattgtcaaattcaaacccttaacccaatgtttaatcttttggatcctaacaaacatttctatggtttcgtttccaaaattataaaagagctaactttttttgaaattagtttcaaatttttggtttttcttcttcttaaagattgttgaatgttacttttgatttgcaggtgttaaagaatcatctagagtactcgttgaaccatttccatggaaggtaacaaaatttcattatttggtctaatttctcatgaaagttgctacctttttcgttctggaagatctaaattagtgtttgagttacaaacgcagaagaaagagaaagcctttacgaggaa

SEQ ID NO: 13493 - DNA, 3000 bp, Unknown
  misc_feature (1)..( 3000): cDNA_ID_2703140_gDNA_ID_2214631_Annot_ID_136056 3000 nt of promoter + ATG
ttggcagatgaagcaaccggatcttcagatctgcgacgagatccagcggcttgacgaatttctttcactgataaagccacagatcggtttctcgatctactaagcatgttctcaagtggtttttccggcgtaggcaatgctacagaagacggatttggattcccggtttgagatttcgaagacggcgaatccatcaccaatcgtttcttcgatttgaatggaatggatctagaagagcctggtgtactcatttttatcaacaatgtctatagagtgtcagatgcagagaggagatagtggaggagatagatgaagacgatgaagacgacggaagaagaagaagggtttagatttatttaggtctttggcgcgcaatcctacgtgtaccaaagccacgtatacctcccgcgcctattaacccgttgcttcccgcgaaaacacttatctacgaagaagcccattaattaggcccattatgaattgctgtctctgaacgaatctaatagatgcaaaccaaagagaccagatttctttttttcaacttgtgattttttttatatgaacatgatttatataaggtcgtcgtgcaatgtttatgctgcttgttcagtatttatagtttttttgaaaaatcaaagataatctcatcataaggaatcttatcaacagtaaaatattaagataaaacagttagcccagcaaatcaaatataatcaatggtttagtttatgttttctatgtttctctttctaaactttgaatatatttaccacatccttattttaaatcatagaattaaacagtttttaaatgattatgatattttttctattgtcatttctaatattttactaacaaaactttaattttatttgtctattaaatgttatatttttccggtattgttatttctgtatatacttgaactttttcttattaaggttcgtcgtttccattttattttatattatatttgctaatgaggaaatctatataaaatcatgaaataaatattgattattaaaagaaaacacataaatattaaacattgaatattaccacatccctattctaaatcaaagaattcaataaattttcaatgattatgagattcttttcaattgtcattactactattttcttactaacaaaacttcaacttttctttttattaaatgttatactttccgatattattatttctctatatactcttatttaaatttgttgttttatgtcaatatatgaagttttgatgattataataataaataccaatttttatttcttttatcggtttatcgtctagttgacaaaaaaaaatataatgccgttataaaataattataactttcatgagtttttatttttgattaacatttaaaaaattaaaggagctagatgtatcaatttgtattatattatgctctgagactaaatattgatcttgataccaagaatctgatctagatccaaaatttatgtcaactgactcactatcatattttcaaaactcaattttaaagttagtaatataatgtacatcttaactattgtttttttgggtctgtttagaatctgggccggtgcccactcaaaacaatcggcccattatacaagttgttaaaataaaattcaatatatcacattaaagaaaaattacaattttttggcttcaagacttttttttttgtgtgtgcaaagacttttttggattcaagctaataaatgttagattacctttttaaccaaagatcaaagtaaaaccaaaatcatagaagaggaagagaactcgtgatcacgtttctttggttaagtaatgttgtatagaagagaagagaagagaagaggaagaagaaaagcccaaatcgaaaattgaaaactagtactccaaactccaaagcatcaatattttatcactcctcttttcttccacgcaaacccaattctcttcgtcttcttcttttgcttttctcccctaaattcgtcgatcaaattcttgtcttttcaacttcttcatcgaattttccattgcccatagcctctgtatttgattcctccttctctaaagcttcggatattaagacaattatatcttcctagctgcttatagaccttcgctttctaattgctgttcctttcgtgggtctctggtaagttttgattttctcatctgctgttatcgagaaaggttgattttttttgattaatcgcactgtgatttaaggttggaggagattatagtgttagcttaagggtttttgaggtttcaatttagaatcgtattgctcctgatcatttccctgttaaaagtagataaaccccttgttctattgggaaggaattcgccgtttttgcttcgtcttcttgtgaaaaatagagttggttttaggtaattgactttgatcaaggtctattggttgtgcaaaggttgcgtgaatcttgtgtcagcctcttgattgagtatagattacttcgtcttcgctttctctgcaccatcaattgtcatcagagtgctaggcatttagtgcattgtccaaagattctgcttgtgcatgaatgctattgttgaaaaagaaaggaagtgtttgaaatcgaatagtcttttgagtgtcaagcaaaggataggtgggtctggtttatatccatcatggtggaaaacagatatagaaacatttctttagcaggttatgccacgagttccgtatccttggtttgtctttctgcgtttaaggatttgatttgccttagtgtctcattggttagtatattcattgtatgtgcttctagcttgaacattttagtggcacttttttgtttgcatacataaattatctctgtcattaggtgatttgcattgtggatgctttatgttattcatgtttgatgcaggatttgtagttgcattctcattgcgcactacactttcttcaaatttccgcgtggtaagcagggaatggaccggctgttttggccaatcgtctgtgtttacaaatgatg

SEQ ID NO: 13494 - DNA, 3000 bp, Unknown
  misc_feature (1)..( 3000): cDNA_ID_3030375_gDNA_ID_2214631_Annot_ID_187970 3000 nt of promoter + ATG
gccaaaaagtcatttattttattaatattaattttattaatgatatgactctgaattataatctaaatattttagctaataacataggagtgcaccatatttatttaatagggaaatgtaccatatgacccgaatgcatttttatccaaatccaccaaaaaagtcttgcaaaaatactataaagataagaagcgatagtcggttttgatagatataagattagcaaatatattagttagcttaaattagttaaagaatacaaattaaaagggtatgcaccatatttatttaatagggaaatgtaccatatgacccgaatgcatttttatccaaatccaccaaaaaagtcttgcaaaaatactatagagataagaaacgatagtcggttttaatagatataagattagcaaatatattagttagcttaaattagttaaagaatacaaattaaaaaggtatattacactttattcaaatattgtatcaaaacttatataacacagagatttgataatttttaattgttgaatacttcttttttgtgctaattttatgtgattaagatttaattgatttcatatataaaatattaaattgacttatttgtttataatttggtaacagatagatatttgaatattcagtatattttgcttcagtttaggaaatctttgatgacccgtctttagatccaataagtcctataatctagagattaatttgcagtataccgcaggtaggcttatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacatgtagtataccatcttgtattaatatcgatctaaacccgtcaattctaggatttttcagcttatattaaaaattgaatcacatctaatatgttattaactattgtaatatataagattataaattttcaatataatatgtatgaaattgaatatgaatatttcaaatttatgtccccttactcagtagaaagttttcttaaatctatttttcacccgttataatattatttcatgtattgaacagtttatatttgtttttaaaaattcaaattatggcatatgcgaaaaaactctaattatttttttataatgatgatattatttttccgtataaatagaatcatataaagatgagaagtgaactataataattaataaaaaattaatatgataatttagataccaaatatagtttgttgattttaattggttacttttttagaaattaataatctatttcgtttttctaattaaattaaattaattaaatttagatatcaaatcttatatgttgattttgattggctattatttttggaaattaatattgtatttcgttttttaattaatttaattaattaaattagtatttgactttttaatccttaaagagataaattaatttactttttaaaattttatttctaatggcatacctatgtaattacttacaaaaattaaggttatatttaaaatgtacttcccaaataatatagtaggattgtcactacgactacgagggacacttgctaaattttcggaatattttatcttatgaattagaaggaaaattattatggaagttgtaataaaacatgtacaacattttaaatatcataggttttttattacaaaagtattatattttaatagtatatgggaaaaacaattgtctcttcaaaatttattcaaaataaaaaaaaaattaaactatagacgaatgagcctcgaaaacgcaattcctcaaacatttttttttacaatcttatccaccaacgtatgagtcaaatcaaacaaatagacaccttaaagtaaagtatatacatagttcactaatatttttgctagacggttaacctctttatacatatacgagattcgaattatctactctgtagataaaatatatgatacaaacttatcaagaaagacaattgggttcgactcacaaactcttgcctttaagaatcctaccactaattccgcagctctagcctcatcactctcttctcccatgggatatacaattcatagtagacttcctacaacttcggtaaacgagccgagtatacaatgtttagcgcacaatttccgcgggaaatacaaaaaagattgtgatgttaatgtgatgaatttgtaattaaacacacgataaattagtgcaatgtgtaaaatattttataaatttgtgagtaatgggtaaaaaaaaaagtaaagaaggaagcaaagttcagttggtgaatcattttgctggccattactctataagagagagagatcctatctccataaaatcccataccctcaaacacacacacactcaccatcccactaactcgaatagttaacatgcgcacaccgatccttggcctttcgttgctaaaatgagcatggtgcgtgattcacccgcttacttgctcgatttctccttcacccttttaaaaaggaacgtcttttagcttacctctgcctcctttaccctctctctctctctatctctatctctgttctttcctttttccggcgaatttctgggctgagattgttagtgtctctgagtgatgcagagatcaactgttgtagttaatcaatatcttctgacataagctaaactcgattctttcttacaatctctctgtctctctctgcttccttttctactgtcttctttcttcttctctagcttttgaattttcaatattgatttctcccatggcgagtagcagttgcagcagatctatctctgtttcaaattctgattctctcggtgttttttgtttgagctagggctaaattagtttccttcttgggtttttattcgtaatccgattcaaagtttgtatctttgggaggg

SEQ ID NO: 13495 - DNA, 3000 bp, Unknown
  misc_feature (1)..( 3000): cDNA_ID_2703136_gDNA_ID_2214631_Annot_ID_187969 3000 nt of promoter + ATG
cctttgtctctgtagtagctgtagagcctttcgacaaaaagatccaaatcagcaattggttgaacatttaaactctctccattaagaagtcccgatgggctctcactaccaggacttggtattcctccgtagttagatagctcaatctcgtgtgactcattatgaagcaatccagtagtcaaagacgatgatgattcaccacgttgccatttaaaaaagttacgtacatttggacccttatgcccactgctcatcatttgtaaacacagacgattggccaaaacagccggtccattccctgcttaccacgcggaaatttgaagaaagtgtagtgcgcaatgagaatgcaactacaaatcctgcatcaaacatgaataacataaagcatccacaatgcaaatcacctaatgacagagataatttatgtatgcaaacaaaaaagtgccactaaaatgttcaagctagaagcacatacaatgaatatactaaccaatgagacactaaggcaaatcaaatccttaaacgcagaaagacaaaccaaggatacggaactcgtggcataacctgctaaagaaatgtttctatatctgttttccaccatgatggatataaaccagacccacctatcctttgcttgacactcaaaagactattcgatttcaaacacttcctttctttttcaacaatagcattcatgcacaagcagaatctttggacaatgcactaaatgcctagcactctgatgacaattgatggtgcagagaaagcgaagacgaagtaatctatactcaatcaagaggctgacacaagattcacgcaacctttgcacaaccaatagaccttgatcaaagtcaattacctaaaaccaactctatttttcacaagaagacgaagcaaaaacggcgaattccttcccaatagaacaaggggtttatctacttttaacagggaaatgatcaggagcaatacgattctaaattgaaacctcaaaaacccttaagctaacactataatctcctccaaccttaaatcacagtgcgattaatcaaaaaaaatcaacctttctcgataacagcagatgagaaaatcaaaacttaccagagacccacgaaaggaacagcaattagaaagcgaaggtctataagcagctaggaagatataattgtcttaatatccgaagctttagagaaggaggaatcaaatacagaggctatgggcaatggaaaattcgatgaagaagttgaaaagacaagaatttgatcgacgaatttaggggagaaaagcaaaagaagaagacgaagagaattgggtttgcgtggaagaaaagaggagtgataaaatattgatgctttggagtttggagtactagttttcaattttcgatttgggcttttcttcttcctcttctcttctcttctcttctatacaacattacttaaccaaagaaacgtgatcacgagttctcttcctcttctatgattttggttttactttgatctttggttaaaaaggtaatctaacatttattagcttgaatccaaaaaagtctttgcacacacaaaaaaaaaagtcttgaagccaaaaaattgtaatttttctttaatgtgatatattgaattttattttaacaacttgtataatgggccgattgttttgagtgggcaccggcccagattctaaacagacccaaaaaaacaatagttaagatgtacattatattactaactttaaaattgagttttgaaaatatgatagtgagtcagttgacataaattttggatctagatcagattcttggtatcaagatcaatatttagtctcagagcataatataatacaaattgatacatctagctcctttaattttttaaatgttaatcaaaaataaaaactcatgaaagttataattattttataacggcattatatttttttttgtcaactagacgataaaccgataaaagaaataaaaattggtatttattattataatcatcaaaacttcatatattgacataaaacaacaaatttaaataagagtatatagagaaataataatatcggaaagtataacatttaataaaaagaaaagttgaagttttgttagtaagaaaatagtagtaatgacaattgaaaagaatctcataatcattgaaaatttattgaattctttgatttagaatagggatgtggtaatattcaatgtttaatatttatgtgttttcttttaataatcaatatttatttcatgattttatatagatttcctcattagcaaatataatataaaataaaatggaaacgacgaaccttaataagaaaaagttcaagtatatacagaaataacaataccggaaaaatataacatttaatagacaaataaaattaaagttttgttagtaaaatattagaaatgacaatagaaaaaatatcataatcatttaaaaactgtttaattctatgatttaaaataaggatgtggtaaatatattcaaagtttagaaagagaaacatagaaaacataaactaaaccattgattatatttgatttgctgggctaactgttttatcttaatattttactgttgataagattccttatgatgagattatctttgatttttcaaaaaaactataaatactgaacaagcagcataaacattgcacgacgaccttatataaatcatgttcatataaaaaaaatcacaagttgaaaaaaagaaatctggtctctttggtttgcatctattagattcgttcagagacagcaattcataatgggcctaattaatgggcttcttcgtagataagtgttttcgcgggaagcaacgggttaataggcgcgggaggtatacgtggctttggtacacgtaggattgcgcgccaaagacctaaataaatctaaacccttcttcttcttccgtcgtcttcatcgtcttcatctatctcctccactatctcctctctgcatctgacactctatagacattgttgataaaa

SEQ ID NO: 13496 - DNA, 3000 bp, Unknown
  misc_feature (1)..( 3000): cDNA_ID_3030387_gDNA_ID_2214631_Annot_ID_187965 3000 nt of promoter + ATG
aaatttgaaaagggatttcaagttcgaagaagggacgaaccaaggttagaacccaagttctgcacagccgtggataaaacacattacacttactagtagcatatgctttatatattatgtgcatgtcatattttctattgagcttcttgttatatgaacataacattgaatggtttttaagaggcatctcctctaatgcgtcaagcgattttgatcgttatctccagtttcacatgttcatctactttctaacagttaatctttatggacacaaacatcctctcatataaataagcttgaccaaatttctgaatgaacaataacttataataaaccactatacttattttttcacaaactatgtttcatatctccaccaaaaaacaaaacaaataaacataatccaaaaaaaaagcatagggctttttggccatcggttactccttcaaagattgctgatacacaatttagaaaggaaaaaaacaattttaaagccatattttatttagctatagtaaacacaggtttcaggctttgtgctagaatctggacaaagtttctaatcataaatgttggatcgaggaagtctcatccagtttcagttctcggtcttttaagaacaaagaaaaagaaagtcaatttagttaagctaaaactgtgacgcttcaatcgatctttattacagaaccctattctccaaccatatataaatggaccaacaattttgaccaatggttttcatttttctgtttaggttttggatctgagaaatatctattttgtctttgtgccaatattagtggctgtcggcacatcaagaaaagaccactctcttggggccacagttcgatctatctttttctcttaaaattctttatcaaacaaaactcaaaattaatgatttcaactttggagaaagaaaaaaaacaagaatgatttcaaccgtaaaaatagttattgcagttaagacgaaaaattaaaaaatgtggtattacgtgtacaaccgttggataattggcaataatgaatcatgtggttactgcgaactttacaatttttctatcttgctattctaaatttattttcaagctttccctatgaaaaaaaaaagatacgaattagtaattctaaaaacaaaacgaagtatatgtcaagggaagattttgtaaacctacaaatcagtaactagctttatagaacttataaattgctattgtataccctaattaattgttgtcaaatttgttgggcattaactaattgctgttgtataccctaatttgttgggcattatacttaactaattaataagttgctgaagccgatgtaaaattaacaatctggtgaaatagtgtgatagacatatcacatatacaccagtcttgtctgtttaaaacatcaattatttaaaacaatgttgcaaaacttttattattgttgttatgtgttactcatctatcattttgagaaagagtgtcattttgaccaatttcacacaaattaagaaaatattaaaactacaagtgtttgtctctatttaataagtgattaataacttaaattcaataaaaatagttgaggtaaaggtaaactagaaaattagttttaatttaaaaaatagcattgaaaatgtaaaacaacactatttgcgagaaaacaatttgtggaacgatactatttgtgaaaaaaagaagtactattaagtttaaacactattctttatttttagtttctgtgtttcgttattaatgtaagacaatcccaacatgaagacaatctcaacgcgatgaaaaaaaaaataaacaaaaaaatatttagccttaacatctaagtaccacatggattttttttcaggttttttggtatgcaagatcagttcaatacccgcctataagactccacactctaccctagttttgagaacacatgacatgcaagcgacctaatagttttgacttaaccttgtatcttctataatttgtaaaatggatcagtacataacatccttgcctacatacatctaaccaaaagtttatcctcttattccacaatttcttgctaaccttagatatgtgactgctactctttagtcatcggatttaatatatatggttaatgtacttatgaaaactgaatcctttggttgggcctttgtggtatgtcatccaagaaatctgacaagaccagacttaaacgaacaaattcaaaataacaacgattgtcatttttttattgtatcggaagacgtggaagatggtatttgatgcccggggaggatggtgtttcttaatatacacactctaaaaacatttgccacaaatgagatcgaaatatactcaatctatgcattattttattttatttttattattatgagtatctattgttaatagtatattcgttaattcacgtattgggaaatgtttctttttccagtcaactcttttaagactttcagtactatcgttactcaatattgcctcgaaggacaataagcgggtcctaaaatcgagtctgtcaaagcttacgtggcacttgtttgccacatcaccggtactaatgatctcatctattttgtcattttctcgccgcctaacgtcactccctctaaacagttttacgccacgtgtaaataaaaatcacccatttatttttctttgaattggaggataggtccgtataaaatcttgtttttttcccaaaatacattgaaaaagaaaataccagttttgtggttggtccccattcggttgtgttaaaattttattagttttttaaggcagccatatttgtctaataggacctatgataaacaatataacaataaaatacttcccactttcatatatcttataaattccgtgtctcttatatatataggattaggttttgaaataaacttattgccacaacaagaagagataacaaaaagaaaagaaaaagagaaatcgtaaaaaaaaaaaaaaaaaaaaacttatggaatattcccaatcttccatg

SEQ ID NO: 13497 - DNA, 3000 bp, Unknown; identical to SEQ ID NO: 13492
  misc_feature (1)..( 3000): cDNA_ID_2703152_gDNA_ID_2214631_Annot_ID_187964 3000 nt of promoter + ATG

SEQ ID NO: 13498 - DNA, 3000 bp, Unknown; identical to SEQ ID NO: 13490
  misc_feature (1)..( 3000): cDNA_ID_1807426_gDNA_ID_2214631_Annot_ID_187961 3000 nt of promoter + ATG

SEQ ID NO: 13499 - DNA, 3000 bp, Unknown; identical to SEQ ID NO: 13495
  misc_feature (1)..( 3000): cDNA_ID_2703136_gDNA_ID_2214631_Annot_ID_136057 3000 nt of promoter + ATG

SEQ ID NO: 13500 - DNA, 3000 bp, Unknown; identical to SEQ ID NO: 13494
  misc_feature (1)..( 3000): cDNA_ID_2703132_gDNA_ID_2214631_Annot_ID_136058 3000 nt of promoter + ATG

SEQ ID NO: 13501 - DNA, 1295 bp, Unknown
  misc_feature (1)..( 1295): cDNA_ID_2703122_gDNA_ID_2214631_Annot_ID_136062 3000 nt of promoter + ATG
gaatatgagttaaatatatagagagggagggtttactttttttttgtcgtcagggagggtttacttggattcttatggattgactttttagttggaaaaaattggttctcgacatttgaactagaaaataaagattgagactgattaaacaagttaacacgtaaaccggttttgtcttggaccgcaagatttcttgctcatacggaagggcgaagaagatcacgcgtctcacgaatttttaagcaaataggaggaaaatgcacccgggatgttattacggtccaacttgattagtgtattcccggtttgattttctgacaaattatggtgatcaatttcatatttttttgcttcttgtagtacatgttggattttttttgttagtacaatattctgaaaattttgatggaaaatgcaatcatataattatagcgaaaaaaggctgcaaagctaaaaaaaaaaaaaatcgaaacaaaaacacaacaaataaactaaatgagaaattcaactagcagtttttcaagaagaaacactgattctgaacgccgaattaaagatggacattcgcgtaattgtcacagttccaaaaatctcgagaccttatcgtcgttattacgaacaatctctaccctataccaagcttctaacctcaaagagacgctaactgctgtttcgaaaactaacacaaaacatgtcggatttaatttagcaatgtagctcttacgtggtcaaaattctcatttttgttccaatgtaaactagaaatgtacagatgttttccgaaatatacaaccaccatgattcaatcgttcgacggattctgcgaattcgtccatgatttgttgattttttttgttaatatatttttcaccaatgctattttcttttttcttttttcaattccctattgtcattttatagccataattttatgttcacataatcttttcttcctgtctcaaaaatataaaacaacaagtgatagtaatcatcgtctattgcataacggagggtgcaaattattgatttactaatctgatatcaaattaaatcattgaataaatctgattatcaaaataataattgaaagcaataatcttaaaacagactttttagggtaaaaaagggaaaaagggttaaacggtagaaacacaatctggaaaagcgtcgccgagaagctttactctcacctgaaacattcctcaatccgtcgtcatcataatcatcttcgatagagaagccatacgtataaatagtactctcgcattgtgtaattgtctcttaccggagaaatg

SEQ ID NO: 13502 - DNA, 788 bp, Unknown
  misc_feature (1)..( 788): cDNA_ID_2703209_gDNA_ID_2214632_Annot_ID_136063 3000 nt of promoter + ATG
gaattcccatgcttttttttatcattaatttctcgtaatgcaaatgtaaaagcggataacttagcgcgaaaagttcgcactgaaccgtttcatataacttatgtaaacaacattcctcagttttggctcgtttgagtcctaattataatcggatgacaaaaaaaaaaaaaacaagggatttttaagtagattttagaatcactagttcaataacattagattttatgaggcttttaaaaatctatgattgaatagcatatgatttgttattttaacacaaatcacttgaaatgtttgattgaatacaaccccttagagagttttctataatcttgttgattattttttcacaatcttttaaagttttcaaacaatctctatattttgatgatatttttcataactttattttgtaaagaaaaatgtagaaagtcataaactaataacacaataatttaactcattaaaaatcatagattattttgttttaattgaataacacaaaacttttaatgactttattaaagtataaattcaataactctagatttataaagattttaaattagtttttataaatcttaaactaataataccaaactttaacaaactttttaaaaatcttgattgaataacaacagattctccataacatattaactcattaatactctatttaaatcacaaatcaataacacctcctaaatcagtagcagattttctaagaaccttaataaaaaccaaaccctagatccatagagtgctcggcaattaaacgtatactcatg

SEQ ID NO: 13503 - DNA, 3000 bp, Unknown
  misc_feature (1)..( 3000): cDNA_ID_2703187_gDNA_ID_2214632_Annot_ID_136071 3000 nt of promoter + ATG
aagtatgtgaggtcatcgagtgaaagactcaaatctttaaatctagggttgaggcatgaaatgtaagtaaataaaacttatgtctagatgttgttactaggtggaattcgacttatcttatgctcacagttgcaatcacgtttagaggtgcatttgataagatgttggctgaagataagttatagaaaagaatgaagatgatgatgctgatgatgataatgatggcaaacatgttggtcctccatcttctgctagttagctgggatgaagtgcaaatgttagttaagtttctgaaaatcttttttaattgcattctttcctcttcaacatttaaataagtgacatcctctatttggtataatctaatgatgatggttatgagatgatggactctttgtacactaagatggtagcagagactacaaatatagaatctagtaaggaacttgacatttacctgcttgaaaaatatgtgctaagaattacaagtggtttgagattggattatgatgtcttaagatggtggaggaggaatagttctaaattgcaatctttgcagaattaacaagagatgtgcttgtcatacatgtctcctttctcaatttagagtctgcattcaacactagtggtcgtattttggatcctttctgaagttgcttgtcaccactcatggttgaatcattgatttgcattcagcaatggctcatgaatatcattagttgagaagttagcaaacctgattcagatgttcgaagaattaaagttttatgagtctttaagtactcattttctctctatctttcagtttttttttgttgttatttttatatctatagactcaactacattttatttgccttgtgtagcttctgagagtactcatacacaatcattagttgctcattgacgtggagttgaaaattgaggtatatttgatatatttttttgtcattcatttacctgtgagagccttttcttttaatcagtaatatatttttattttctttcacaacagacaaggtgacaaatgcattaagatttttaagcggcttaaaggcttgtcttttctctttatttattttgtataactaactctttctcttttggcatcgacaaaacaatgacaacataccaaatggacctgtaagaacttaggcagaatggatcattggtagtttgtcatttgtgtcaagttacatgttttttggaacaacttatgtatcttttgtatatatcacgatgattaaggttcgctactaagttgttgttgtattaataattgatgcgtctttttgtttggttgattttacattcgtttagtgatcagaccaaaaaaactgaataaaccatgtttgaactgaaccaaagcgaattattaatcggttcgttttagaaaaagttcattttccaaaaaaaacaaaaatcaagtaacggaaacagaattaactttttcggatcaaaattgcatgcctataaaattttatgttattaatccaaatccatccaatcattttttttcgtttttgaaaccgataaattatttgttattgtttgtgaacaatattcaaaagtcccaaatcaataaaaagaagaaaaaaactaattatgatttggaaataaaaaaagaattaatcaaatcaaattaaaatcctcactaaattgtaaacatggtgtacataatatgattacgtgacaaaatattattgaaaagatatccaaaaaattgcaaaaaaaaaagaataagaaaaaaggccaaaaccaaattctcaattctggtcggagtttgtctttataaaaaaatcttagaagccatatatattttctgtttatatattttgtacaacaaactctttctcttttagcgtctacaaaatagtgacaacataccaaatacacttataagaactgaggcaaaatggattattggtactttgtcatttgtcaagtgacatgttcttttagaacaacttatgtattttttgtatcatgaatcatgatgattaaggtttgctaccgagttgtttttgtattcataatttatgcgtcattgttgttaacttgttgtttggttgattagtgatcagaccaaaaaaattgaataaaccatgttcgaactgaacaaagcgaattattagtcaattcgttttaggaaatgctttattttccaaaaaccccgaaaaatcaagtaaccaaaaccaaattaaccgttcgaatcaaaatcaaagacctataaaattctatgatattagtccaaaactaaatccaaatccatccaatcatcttgttctttttccgaaaccaaaataatatttgttattatttatgaacaatattcaaaaatcccaaaccaataataataataataaaaaaaaactaattaggatttggaaattagaagaacaactaatcaaatcaaataaaaatcctcactaaattgtaaacaggatatgattacgtgacaaaatattattgaaaaaatatccaaaaagttgcaaaaaaaacaaaaaaaaagcataagcaaaaaaaaagagaggccaaaaccaaattcccaattctggtcggagtttgtctgtaaaaaaaaccctagaagccatatataaacaccacaagtaaactcgtttcttcaccttccttctctccttcactctaattgcgattgattctcctgtcttctccaatttatcaggtaattgcttctgcttcatacttcataccttattttccaatctctcaatccatctttgtattggagcaaagtttatacctttcaatttctcaaactcgactagttatagatctatggaagttcagttcaaaccttacatatataatatctggagaaaccaactatgtgtacttgcaattacaataagctaatagatttcgtactataaagttagatccacatagtacaattctaagttatgcagattggagctcttgtgaatttttgtttgattcgattttgcttgagactgtcttagagaaattgcagagatg

SEQ ID NO: 13504 - DNA, 3000 bp, Unknown
  misc_feature (1)..( 3000): cDNA_ID_1808076_gDNA_ID_2214632_Annot_ID_136072 3000 nt of promoter + ATG
aaaagactattcatcttcgaccaaattgtggtcaagaatctgctactctctctgttgttgagactagtgaaggaacttataagcttgaggagactacttctttgggtgaattgcattttattggttctacattacagcttagaggaactagtcctataaggcaaccattggtggattcttctgggaacattctagcttacaatggtgtggtgttattcttaaggttttttgattatcatatgttttctcttacactatacgatattgatttgtatattttccgtacaggcgaagtatttggtggaattgaactcaacagctatgataatgatactgaagtgcttttgaagtctttagagaaagcaaaatctttagttccagatgttctttcgatgattaaaggtccctgggccattatatattggcaggtaatttggtaacctgctgctatttgtttatgtagcatttttttttactttctctaagagcatttttctctatcaggaaagctcgagaacgttatggtttggtaaagatccgtttggtcggaggagccttcttgttcactcgccaactgtggaagaccctcgttttcttctatcgtctgtttcaccagcttcttcagtttctcaaggtgctggtttgtattacttagtagagcaattttgtctctttatgtacactccaagctcaagtaacatctgttcttttgcaggattggatactgaaaatggtaatagccttcatagatattgggaagagcttccatgtggcgtgtacagtatttcttttggggtttcagaattatgtattcatggtgaagttacaaaacacgaatggagaaataccatctggaaagaattgattgaatgggaaaggaaattagttgtacctagacctgaagatctatcaacgtcatcgcttagtggagttcaggaagacaaatctgtgtcaacttctctaggtactgcttaagaatcgtttgattcctccagtcctgtccaaatctcaacatgtctgacaaggtttagctttaggatttgcgcagacagttttggtcgtgttaaaggaatcagtgaggcggcgaacttcacttcatagcatttatcaggtatgagcttaaacttgttttttctctgaagctatgtgttttcttctgaacaccttcgtattggcataaacagggagataaagaagctgtcccagtagctgttcttttctctggtggattggattcgatgattcttgctgcgctgttgcatcagtgccttgatccaaaatgtaaccattcccccacactgtttctgtctcggccaacaattctgaaactaatcaaaagaagtaatatctatttcttcagatgaagttgatctccttaatgtcagttttgatggtcctaatgctcctgataggatctccgccaaggctggaataaaggaactcaaaaagattgcaccttttagaaggttgaacttcaaaagccttttatgaaaaatgcatatatctgttactatctatgttgatacaaatgtttttggaattttcaggtggaaacttgttgagattgatgctgatctgtcaaaactaggctttgagacaaaacgtgttatgtcactcataaatcctgcagacacttacatggtaaacctcaaagtcttgagcattgtgattacattcctccgaacttgatgtgaattattcaatctttttttgctatgttctaggaccttaacataggaacagcattatggttagctgctcgtggtgatggttggattcacgaagataatggaaatccaagtgtagaggaaaataaccagcgggtcaagtataagtccgatgctagaatcctgcttgttggcgctggtgctgatgagcaatgtgccggttacggtaggcacagaactaaatatcgaaatggaaggtatatgattcatttatgtatacatttcttatggatgtaaactaatgttaacctcatcgcacaagttttattcatttttccagttgggttgcgttggatcaagaaatgaaattagatatgcagagaatttggaaaagaaatttgggtcgagatgatcgatgcattgcagataacggtaaagaggtatatgtcatcacgccacaaccacaaactcaaaaaaaaagtttattctttgtgctttgttcttaaatcttaaacgttacttgttcaggggcgattcccgttcttagatgaagatgtgataaagactctccttgacattcccttgtgggaaatcgctgatcttgagcaaccaagtggaacgggagacaagaagattcttagacaggtgagtaattaaaaagataccatttttactgtaagaatgcctcaagaacattccagaaacttcataaacctgaattgttgcgtaaaatcttgaaggttgcaagcctgcttggtgtacatgaagttgcaaagatgcctaagagagcaattcaggtaagaagaagagaactttctgagagaactcagtttcaaacgagtaaagttgaaatctttttgttgtgagctctctctctctcactgttgctttggactttggttgtggttttagtttggatcaagaatcgctcgtgaatcaaaccggaagaattttggaagtaaccgtgccgcaaaccaggcttctgccgggagcgtgagattcctagcaccgtcacactaattccctctgattcatgttagatcaatcattgttatacattgtatcctatacaaagagacattctttcaatgatctcaaaactggtttgaacactgaacacaaatggactaataagaggacatgttaagacttaaaccacttggttcggtattttgctcaatttcaagggtaaaattggaaaaatcacaagaaaaacaaaagccctaacattattgtctaaaatcaattttctcctccggtggtgatctctgtgctccggcgcataaacccctgtaaagccaataacttgttgttccccaaagtttggttcttc

SEQ ID NO: 13505 - DNA, 3000 bp, Unknown
  misc_feature (1)..( 3000): cDNA_ID_3594203_gDNA_ID_2214632_Annot_ID_136073 3000 nt of promoter + ATG
ctgtttacacttatggactcaaacaagccttcatcatctgcaccaagagttgttgttgtagcatccacaaataggttcttgtctaccttaagcataatataagttgattatcaacattggttttgaatgcaatgatccaatggttttccccgatcttgtcaaaagggtggatgcgattgacccagcgctaagaagagcgggacgatttgatgctttagttgaagtgagcacaccaaatgaggaggatcgtttaaaaatcctgcaggtaattatcgagttcttaaatgggattttcgtatatagtaagtttgtttgtgatcttcatgttttctatttttttcagctgtacacaaagaaagtcaatttagatcctagtgtcgatcttcaagccattgcaatatcttgcaacggttatgttggagcagatttggaagctttatgtcgtgaagcgacaatatctgcaagtaaaagatcttcagattctcttattctaacatctcaagacttcaagattgcaaaatctgtggttggtccaagtataaacagaggcatcacagttgaaatccctaaagtgacatgggacgatgttggtggtcttaaagacttaaaggtcaatactttttaaaaatattcattttgcactttgttgtcctgttttctccattgcgattaatggtttttttttccttgtgacagaaaaagctccagcaagctgttgaatggccaatcaaacattcagctgcatttgtaaaaatgggcatatcgccaatgcgtgggatacttctacatggtcctccaggttgctcaaagacaactcttgctaaagccgctgcaaatgctgctcaagcctccttcttttccttaaggtatagattttgatagatcacatttaacaaaatccccctttggttgtgaaacttgtttaaagaaacttattttttcttgtgtctttgtgtgggtgtgcgatgcagctgtgcggagctattttctatgtatgttggagaaggtgaagcattattgcggaatacatttcaaagagctcgacttgcttctccaagtataatattctttgatgaagctgatgtcgttgcctgtaaaaggtttgtctctatctctcccaactcttgcttcgtgttatagactcttcttaacatgtttatttccttgggtcttcgtagaggtgatgagagctcaagcaatagttctacagttggagaaaggcttctatctacactgttaaccgaaatggacggtcttgaagaagcaaaggtaaacaaaagctcataggcttttaaagattttatctttgttattgggttgcaatgatattgatcgggttttggtttaagggaatcctcgtcttggctgccacaaaccgcccgtatgcaattgatgctgctctaatgcgacctggtcgatttgatctcgtaagtcctcatattggatcttttgatcacacgagttctgaaatagcaaacctcattgctaccctcttcttgatttaggtgctatacgtgccaccgcctgatctagaagcccggtttgaaatactgcaagtgcatacacgcaacatgacactaggagacgacgttgatctcagaaaaatcgctgaagaaaccgatctcttcacaggtgccgagctcgagggtctatgcagagaaagcggaactgtctcacttagagaaaacatcgcagcaaccgctgtcttcaatcgccatttccaaaccgcaaaaagctcgcttaaaccagcgttaacaatcgaagaagtcgaaacttattcatcattcaggaaggcggcgaaaagatctgattcgaaaccgattccgattaacaaaaagaaggcgacttccaccgtcttcggattctcatggcaattaggtgttttgagcttattgttgcttgctactggaaactattacttcaaccacactaaacatgaattactagtagcttctgctacatgagacttgaaacagctcaaagttaaaaaaagttgctaattttgttttattcataaataccaaaatatcttttgtttcaaagttcaaatttttaaataataaaacggctaatgattattagattcgaacaatgacaaagattggccattacacatgaatggcccacgaacctcaccaccgtcgtgaaatttctttaagcaccaataatttcactggttatctcttactaattaattactttttacgtgttctaatccaaatcaacaataattatctgatatttcttcataaaccggttttggaatttagctgaaagatgtgaattttattttgtcttattaatcaaaaaatttgaaatcgttttgatttcaattaaaccggaaccctgacactaacaaaaaccggtctgagcttataaatagagtggctcgctgatgactcagttagtcagctccgagtctgcgttttacttcttctccttgagtttcttcttctagatctgatcgcgaatcaccaaaaggtttgtttcttaacccctaaaattcctccagatcgctttgatttcgtttctctgatgtcttagacgaagttagatcgtagattcctatgttttgattcctcgatcatgcttcgaattatggtgtttttatcctcaatttttggagatttggtttctacggattttgtagattcaggaatttagaaatggtgattcgatttcaatggttttagatctgattcagtcttcactcttgttccactattttgaaaattggctaaaaactaggtttcgtcgtctaattctcccgacgttcttcgagaaatgtgaactttgaggtgaagattttgcgttagcatatgtggttttgtataattgacgttgctactattctgattgtgaattttaagcagcattcacaattgaattgagtcttcactttgttcagctctgaatctatcatctctgaatgttggcaagttatagtttcttattatatttcggtgttttggtttgttgtgctaggttttattttataca

SEQ ID NO: 13506 - DNA, 3000 bp, Unknown
  misc_feature (1)..( 3000): cDNA_ID_1014819_gDNA_ID_2214632_Annot_ID_187997 3000 nt of promoter + ATG
gttttattaaaaaaaaaaaaaaaaaaattggagaccggttctaagaagaattttttagtttagcaaatagcaacgacaatattatccggcgtggctattagaaaatattgtaagtaattacttaaagttaaagctaacgaaatgtttggtctattttattgaagattcgtggaaaacatgtttgtttggctgattttttggggccacgcctggagaagattcatggattatacatccatcatatcatcttactttataaacaagttaatgggaataatataaatggtccagctagatgtggtcaacaattattatagtggtttggatggatattgacgattcaactatatacactattaaacattataacaaaagttaaataattttcttaaaacattataaattttaattgtaggaaaggaatcacatttttaatacataactaatatttaagaactaagattatataattaattaaaatatgtatatggcatgccatctgattattttggcgacagagtttgctagccttaaaccctttacagtttattctgttttatttctatctttcagtcacacgattacattacgaggacacatgctcattgtttgtaagaaaattgaagttaaattttgaatacaaattcttttgttattattagtccaattcatagccaagtagaagcggccaatgatctgaactttatatattttatattttatttttatttaggttttctggacataaagctgatgtgaatcgatcaatcgaacagatgtgtatctttaatttaaagatctttttgtcactttcacgtaatcccttatagttggaccatcggaccacggttttcgttaaatgttttactaactaatggaattctgattttcctagatcattcttaaaacataatattcatgatatttacatcttaatcaacgcgtttggtcaaatttggtcgacaccaaaattctggagattattgaagtgtattgttactctttagtactcggtgggttccaaagttgttgagatttgatgcttatctgaaatataggtgggatatatatgaaaacaaaaactaagaaagaatagtgggccaataacgaaatttcttgagtatgttgcttcagtagttagttttgtccagaataatcctgatattaccatgcaatagatttataggattgaaaaagataaccaaaatatatatttttattaagctgaccacaagagatttgtctcaaaatcagcaaaaacaccaattggagacatgtgttaacaaatttagagatcccatactttcatcagagaaggggaaacgtaaaaccctagcgacgttgtttcaatgcagacaagaacttgtgtaaagtgagtattggggatcccattactttagagacacatgactgggtgatccaataaggtttcaaaaaataaaacccaaaaatcttatcaaatcaacatacattaaataccttgggtttatatctgatcaaacatttatagcctggtcataactgctctctcatggactcgaaatatgagtccacaagcacccacaacactcaagaaagttgttgtacaagcctatttttcacatatggcaacagaggaacaatgttctccacaacaaccaaaaggtcacttttaaaacaatcttcaagaatattatttgatcgagagatccgtaacaccatatccggtaaaaagtacaagaaaagatagagaaggcttatgcttctttggattcattaacattgtagtcttgttttagttatttttaccaagattactctaccattatattattcattttctaatgatatttacaagttagaaaaacaaaatacgttcatagccttagatttatccaatctcattttaaaaaatatatttgttttggttaaatatttgcattgatactcttttcttttgtatatctttttatttaatataaaaatgtaagtatcatttgattaggttttgcaagatattcaaactatataatcgggtctcatttaaaaaaaaaagaattaaaacatggaggcaaaatcactcataatttagtacatcgacataaacttaagcaatgaaggtcacggtgtcaagatcattaataacaatcttgagaatccgaaaacaaataaaaatcgtgaaaaagacaagaacgggaaaataacttgcttttgtacacctttattggaactacattggtttttaagaccccaaaaagatgataagccagcaacattagtaactacgttcagattttaaccatacagaaacatgcgaccggcatggccccttcttctacgcaattctctttcacctatatcccaaacatacgaacaccattctttgttatcttcttattttttttagttttgtttatttttaacttcttataatccatagaggaaggtattaggagtaacatgtgaccggcatgacccttttatcaaacttaatcacacaaagttgttttatagtcttagttgtttattcttgcaagcatgtcaaacctctgaattttaactaaacaaagtgatgtcattggttgtaattataaacaaattaatccacgtcagcctctgaggtactttcaaagattctcactttgtccttcttacaaattaaactcctccttttggttcaatttgctttaaacatgtcactttgtacttataaagattctcactttaggctacatgttgaaatcgcatactagttcttaaatgatcagtgttttcttccaagcatgacaacttaaataaatttctcttgcaagttgttagcggacgtgtttcttgtaaaagcgagtacacgtggcgagctacgaactaacaaaagattctcattggttagaaactaatttacgtcagcctctgaggttccttataaattaaagactcacttggttcctctaacaaactaaactctttccttttgattctgcttactcccaaaaacacacatttaaacatcttagagagatg

SEQ ID NO: 13507 - DNA, 3000 bp, Unknown
  misc_feature (1)..( 3000): cDNA_ID_2713781_gDNA_ID_2214632_Annot_ID_187992 3000 nt of promoter + ATG
agtgacaagttttcttcaaaatgttttctcacgattttaagttcctccatgggagctagtgtgatatatttagtatctttttttctcttgtctttatttctcgtttttttcaattctgaaacatagtgttttctgaaattattaaggatttttactattttttggagtgacatttatgaattttgccattttcttaaaattttacggatttactattttgatcatttaaaattattaaatttacgatttttaatactaaaatacatactttataagaacacataaaacctaataaattcaaacataacgaataaaacacatgttaatcgtatttttataattttatgaaaaatttacaaatgccacaaatggtaaactcataattaattcttgatttatccatacttttagacttaggaacgttgttgattcatttgtaaagtattgttctccagtttatataaccaattttttttttcttaaatttaatgtgagtggttgacataaaaaaaaggtaagttttgcaagaaccacatgaagctattttattagtacaattcgaaagaaaaaaaaacaatagtcattttcagaaactcaattattaattctgttcatttatgtatgtatatatttggggtaactagtagctagtagcaattctcttgttctgttggggagaggtcccttgtatgtacgattatcatttaatatgattttgcagaccaaaatattaaaattttgttaaatggctataggttacaaacatcattttgcagggtttcttccgtataattagactaacaaattgaaactacattaattagaccccatgatggtctaaaaccctagttactactcgatggaccataggcattttaaaatgttgagacatgattttgtaacaactttttctgcctttctgcgtctagtatttattggaatctctttcacaatttaacagctctttctggctttgcaaatatagtacatgttagatgtttcttgtttgaaaaagaacttttaaaccgtctgaaaaataaatctatatataatatagataatatatgcaacccatgcaattgctgctgttcgcctatataatatatgatcgtaagtagattatgattgttagattatcatatcagaaaacactaattcagtccgtatgtgtttcttaatccaaattaaaaaaacgctaacttagtatttacatcatcattttgtgttcaataatataaaatatatgttataataatctatcaaatctttttattaattaattatcaaatatcaagatccatttaaaacgaatcaaatatttctaagttatatgaatttgaagaatcgcttgattattttgattactctatagagtgagatagagaatagaaatcatatggagtataaaattctaaaagatatgtattagaaaaagtaactttaacctagttcataatacgaggtaacacgaatagaagttggccaaaaaagtcgtaaaacattcaattttattaattaacatttataattgtactttattgaagatactcttcaaatctttagttttgcttttaactaacaatcaagaacgtaagatgagggaagcttacgcaggttgatggtaaggggacagagtaggctacgtgtcgatctaacgttggttccaaaaactataattttagcatatgttgcgattgaacgaaacagtcatactcacatcacgtgcctgtactgacacgtgttgacatattactgctgccttttaagttttgatacacactattgagatacttgatagttgagacttgagacttcagagacgcagacaatttgttattttggaggatcattttcttattatctatcaagttgcgggattaaatcataattgacacataaccgtttggtaattatcatacatacactccttagtttgttttttcccttcttttcgtattagatttcttcctcataattctaatattcgaccagattatttagctaataaagctcgggctcgtaatagccttttctcccatataagcacatcggttccttaatggctctctctagcagaaaatctcttttcgataacttaatataaatagtgtttgataaaaaatttttttttatcatacatacacttaacacctggattgcatgaaattggaagcgaatacgcggaaacacaaacgtttgggaaacgtcaaagtgagttttttgaaaaattttagaaagcgggtacatgttgagaatttaaatttgagatgaaattctgtttttggtctctcttgtttttatttgaggtttccatttttatggtatttagcttacataggttagtcttgtggaattgaattcttgtgtagatagaattgaaatttgagaataaattgttgtttttgtgtactctagaattttgtttctttctctctatgggttactctagaaaagattttaaaataattacaatattcagttgttttttgtgtacatataaattaatttttataaaaatattacattatatacttattaagcatcaatgcctctgtagcatagtggtattgcgttcgcttcgtaagcgaaaggccgcgagttcgatcctcgccggaggcttttgccaattttattaactacatataactatatatcagttacaatatttatgggccaaaagctcttcttattggatttgactagggaatctctcagttttttttacccaatggcccaagttcttatatttcagtcatttattttcggtttttctttgaacattaaatgatgggccacaatggagttataaactaaaggccccaattgaaatctctctcaaaaactttcagtcaaatcttgagaacagaaagaaagtccacgcgaggacataagcgcgtgtgatttaaaatcgtcgtcgtcgtcttccacaccgactttaatctgattcttagaatcgccgtttggtttttaaccagagagattatctaccaaggaacgatg

SEQ ID NO: 13508 - DNA, 3000 bp, Unknown; identical to SEQ ID NO: 13505
  misc_feature (1)..( 3000): cDNA_ID_3594203_gDNA_ID_2214632_Annot_ID_187991 3000 nt of promoter + ATG

SEQ ID NO: 13509 - DNA, 3000 bp, Unknown
  misc_feature (1)..( 3000): cDNA_ID_3030441_gDNA_ID_2214632_Annot_ID_187990 3000 nt of promoter + ATG
ggcccacaacccaacaaagaaatcgaggcccaaaatggttgtagaaatttggtttagctatcaaaaggttcaagcggctgacaatagaatttgttgtctgtccaaaacaaactaccataagcttatattgccacgagtactcattcggtattttttttaatattcctattaagatttaagctgtaaataaaaataaattaatacaattcagatcaaatgaaatattaaacatgagcacaaaaaacaaagttatgacactacttactaggcttgtcaatttgaagcaaagcccgaacgtctcgccctaaatgaaatattttctctgttctatggactttgatgttttggttttattattgttccacaaaatttgatgttctaaattaatattattttatttttattaatccttaatagagaaaagagagaattagagctaatattattaaattaataataataaaataatatcaaaattagttttcttaatttgtgcgaaaaaatttcaaacatcgttcttttatgaatagaggaaatattaaacttgaccacaaaaaacaaagttatgacattacttactaggcctatcaaattaaagcaaagtctgatggccccgcttgatagctctactacttactacaaaaagataactatgtatgtgtagtaagcaaaccttttcttttttgtcggcttgtttaaattattttgagcttgaaaaagaaaattcatgtttttacttaatttaaataattttaacttttcatatttaaaaataggcaaaatattaataaataaaaactaaagaacaattttaattatcatgttagaaagttcacattttttatatttttgaatgttgtagaattttaacccttattctttttcctttattttttttgtaaataatattagtgtgataaatgatttgaaaaaattgtctgctttagagaaggagaaatggataaataagtttgttatttaaaattgtctagacaaaattttgttcagaacaagttattctctagaagaaagatttttgatataatgacaatatcatatcatcacaatcatctgttagctattcaagtaccttgtggacccaaggcgagataggctcccaatcaatcttgctcctttcttcaaacaaaagggtcaactgttatcgagataggcaagagaacggataaaccaagttcatataaatccaatatcaatcaaacaaatctcttattcacttttccatgaggatccagctcaaccaaattaatgcctcctttacgtagctcaaccaatctttgcgaattggttgtggtcctgccattgactgtgaatattttttccttcgtgtattcatcaatatatacaccaccaaatcaaaaaagatctggcaccatgtcataaatgtaactctttagaaaatgtattagctagaataacacaactaatcatagtaagcagcttatgatacttttaaaaaagatcggtagacaaatcattgaataatcggaggagtatgattatttgctacatggctaagtccaagtgttctctctcaacatcctctaaaataagatcaacaaaaaaatcaatcgctctgaaattgaaaatttgaaaatttcagttgagaaaaagtaaaacaaacacaaattcaactcaactggatcagatttaactatatatgaccatgtctagctcttgcagatttctgagccgttagaagtaagtctcgatgaaggagttctcgagacaataggctttgattgaatcgataaagaatttttgatgttttggattaccagttccatctatatctctttaggcatgtcaaaattctttttacaaataactcggcgaatgcgatgatatataaatattttagacataattttttttgtacaaggaatgtatcttaagttctagtttaacaccgtatttttcttattagattcaaaaaataaattttatatattgtaaatttgaatacaaatacacacaaaatatgtatatactaggatatgctccaaggtacataataggtctatatgttatttaaaaatgtaatgttaaaaatgtgatgatcatatagctataaaaaaaaatacaatttattttttaatgtatatttatatataatattgtttacgataagtagttttttatgttttgattatcgacgcatggatctttttaccctaaaataaataccgaaaaatagagtgggttaattatcaaattatataagttcgttctggttaaatagcaaatcttaaagtgttcttttctcacctcttcgtcaaccaagacgaatagcgaaagattcttatatactgttatcacagttaataattagaaatttagaaagaaaaatttgagtatattgttggcattcgtttaatacaattgagattatattaataattaatacaaaatacatatattttaaatagtaattagcaaatggacaaatgtaggtataaagagataaattagaataaaaatcgtttagttaatgtattttatttaattttaaaaattttaagaattaataaaaattacatttcgttgtaaatatatacaaaggccaggttttcaagttaatgtatatatatataaagaaatattttgttttctttgctaaaaatgtaaaattatgtgtgtctttattagtttctagcttttttttattttagtcgaatgtttaacatgtttttcgctgttatggtatagattgggccaacttgaaaaacataaagtccataaaatgccaatttgataagcccatataaaaaaattgaatttaaaaaaagcctacggtgaggatcgaactcacgacctttcgcttacgaagcgaacgcaataccactatgctacggaggcaatttgttcattttatagaatcattttagaagaatgtttattacttgttaaacaggctttaagtaactttcatgacaacaactttgacggaaacggagaccagaaacagacgccggcggagat

SEQ ID NO: 13510 - DNA, 3000 bp, Unknown; identical to SEQ ID NO: 13503
  misc_feature (1)..( 3000): cDNA_ID_2703187_gDNA_ID_2214632_Annot_ID_187989 3000 nt of promoter + ATG

SEQ ID NO: 13511 - DNA, 3000 bp, Unknown
  misc_feature (1)..( 3000): cDNA_ID_3030445_gDNA_ID_2214632_Annot_ID_187988 3000 nt of promoter + ATG
catctttaagatgaatcttgaaagtggcaaatgggagagagtgcattctattggagatgatgaatgagatgttgatctttggtcatggggttacaatgagagcacaagttcatgatgttggtgatggaatcaagagggattcaatctgtttcgttgaagatgatctttggccggattttgatcgtccttcaaattgcggtatcttcaatcttgccacaagtagaataacatggcctaagagatacggtgtttacatagatcaaaaacaatggtttcttccaggatttgcttagtctttgtttcactaatgcatgttcttccaaagtttaaggatgacggttcaattttcttctctgtcttattttttcactagtttgaatttgcttcgacatagaatgtgatggtgtcttctgtgttttgcttttctttctcttaaacttatttcttatcattaatcttaaacacatccagttgtttcactatagaggttaagcctaagctcagcaaaagacattagttgttcatctttacattagaagctactacatgcgtcttcttcttcttctctaacataagttttcagagagggaatactttcttgtgcttgaagtataacacaaaaccaaaatacaaaaaaccgcatccaatacctgttatcagtaaaacatactggaaagtcgtcggattctggaaaacagagtcttgcaaattcatcccgaagacagcggttacagcggcaaaaatagctgccacaaaggttgccgcggtgagaagcagttgaaactgaatcaactgattctgcacattcccctacaaaaacatggacaaagtcagagacccaaagagaaacaagaacatgattacgagacttgattttgtctgtccttaccagcttaatgttgatcagatcctctgtatcatctatatactctttcagctgcaaacacaagaacatgatcaaaatgatgaaacaacatgtagttgagtttaaaagaaagattaagaagaatctaaccgatgataatttgctcagagtgttatcaacaacgacaaagtaagcttctagtaacatctctagttgatcaatgttctctccgatgctagaggagcttaacaagcttttatgtgagccaacaatgctgctaaaggctctttgaagcttcccaaagtttccacttgttgagcccacaggtgaaaccggcgcagacttcgaaactattccagaagattcaaagtcctcaccaatgttatcttctagctcctctgacgcatgagcttcagctctttcttttttctcagtcaaatacatctcagccatgtcatcatcatcatccattaaatgctctatttcatcacaaacctgcaagttttgacctccaaaatcaaattatggtagtagggctttttcaaatttgaagagtcttttgtgttcaccttctgaactttctgtgttaaggtaagaagacgaccttttagcctgcgcacgtgttctagattaagggtgctgatgtttgtggctagttcatcaagaacgggatacacctccatctcaagctcattcacctaaaaatcacgttcaccaaaacttttgagcttaacaattagcttaaagtcatgcaataaatcatatagaagaatgatgaagagaatgtggcatacctgtgcatctaaagacaagcaagatagttccaaaaccagctccaacgctttaaattcaaatggcaaatcatctaaaaccaaacacatataacagtttcatcagcaatctaatctatatcataactccagaccaccaaagctataccaaaaccactgacctttaacatttaggttgtggtttgattgaaggcgtttacacagttccgactggtactgaacaacagatgcatctcgagcattcatgagaatgacctcttcagctgtgataatacacctgatcttctcaagactgacaactatcgctctctcacgccccaaaatactcgagggatagataaacaaagggtcaaggagtctcaaatccctggatggtaaggaacaacgcttcattatagtcgccttgtcgagctccaaaaccgcagagttcccatcttgatcaattttcacccaagaacgactagattgacctctcttcttaagaccagaaaaaggatgcccacggttagtttgtccttcgaaattaaccggtctaccaattttttgagaagatatgaaatccggaagattagaagcggaaaatggatctagttgttctcccatgtttgctcaatcctctcttccttacaatttactaatgcatcagaatcaaactctcaccattcaaatgaacagtttccagtgaaacagaaggagtccaagtaaacctttggccacagtttacaacctgaaaacaacaaaatttgacatgaaactcaaattcaatttcttcatatgatctctcttgaagaaccaacgaacctgagaaattcacagaacaaaagacaatacttttctaaatggtggaagctgcatcaaattatcaagaataacttcgtgtttaagttcttaagacactaaaacgaagaaaagtcacaaaatttgcagttaaagaagatccaattctcagattcagtatcttaattctaagaattcgatccgttaaaactatccaatacaaatcacaccgatcaattaggtctacagtatccatatccaattccaaatacatacccgaaaaaagcaaagaatcctaaaaaggaagaaactttcaaagaccatgttacagtaaagggaaatacaaaccctagattccataaaaacgttacctttcgtttacaagctttcactttccccaaacagtaaacagaagaggaagaagatgaacaatgatgcttttttttttgttctagtatctgaagccacgtgttaaaagtcaaggcgtttatctattggatagaacacggtttcttaaatagaccgtaacacagaggatcatttataaaacagaacagataagaagac

SEQ ID NO: 13512 - DNA, 3000 bp, Unknown; identical to SEQ ID NO: 13507
  misc_feature (1)..( 3000): cDNA_ID_2713781_gDNA_ID_2214632_Annot_ID_136074 3000 nt of promoter + ATG

SEQ ID NO: 13513 - DNA, 3000 bp, Unknown; identical to SEQ ID NO: 13506
  misc_feature (1)..( 3000): cDNA_ID_1014819_gDNA_ID_2214632_Annot_ID_136078 3000 nt of promoter + ATG

SEQ ID NO: 13514 - DNA, 3000 bp, Unknown
  misc_feature (1)..( 3000): cDNA_ID_2703183_gDNA_ID_2214632_Annot_ID_136082 3000 nt of promoter + ATG
agcactcctacacttatcaaccaaaacatccttcaggaaaacataaaacaaccaaaacccaaatacaaagtttgaatctttcagaaaatcgtaaaaagaacaaagccctaatcaaaagtttggattttgatgcactaccaatcggatgaacagttaaagcaggacgatttgagacggcggtgtgacggctgaggaagatgacttcatcaacaacttcaccggtagcttcttcccaacgtaaatcgagatcgtcttcttttactatagatctatcgtgttgaatcactctcgtttgcttgttactaaaactctttatgtcctgaaaatttcgacaagaacaaaatcagacgagagaaaggttgatactttaccggcggaggatgattgaaactttaccggcggtaagataggtccggcggtccaaccgggcatggcgagaagcgccgccgcagggttgatcgacgctggatcggcggtggtggccacgattagtgttaccatttttcgagttgttactgtaacgcgattattggcgtttaaaagcgattggatatgagttgcgtttgctttgagtctattgttgtgcgtgtggaggaagtgtataatgtttcggccgcttattttcaaaatcatgaattgaaacttttaggttttaactttcggaaaggtgtttaaaaggattttattttgtttgatcaacaagctaagcaattactgagttcaattggtaatcaagtttaaacgaggtaactaattttttttaagcggttaaaaaaaaaaaccagtattcggaaaaattgtaaaagatgataaaaaattgaatcgccggattatatatgatttttctatgttttggtaattataaaactaaaatttaactcagcaatttgctacagaaaaaaaaaaccgtaacaaacaaaattaaatcaaattgagtcttgaatcgagttgataagtacaaatcaattttgtcgatttttgagtcttgattctgtgataggggaatttaaatgttaaaaggactaatcaaaaacaaataacaaaaatatcatttcaaataattggttagagtaatttagcaatttaaaaacttttggagtttttttatctatattaagaaaaagaaaagtatatatcacatagaaagtatataatataatatcacatgcataactaatgtcaagttttttttttctgaaattatgagccgaatatgtcttcttatagttttttttttatgcatagtgatttagtttagaaatgaggtatagtagataaataactttttttttctgtgcgcgaaacttagtaattaaaataacatccgctaaaaactaggattgaaccagcagtaaattgcgagagagaaaaaaaattctattttaatttgttgatatttaatttttaagttttcttaatttattacgccaaagagtatatattttacagtaagtatatatagaataagattatgagttggtcatcacaaatattattgttttgttagttatatataaaaaaacatttgtaaaataaattaaagtataatatgtatgttttatggattacaagttttggggatcacctgttatttatttttttaacaataccattgtcatttatgaaaatcaaattaaaccaacccacctattgaatttgtctcgcatcatgctaagatattttgcatacttttgactgactaatcttcaaaaatccatctaatgacaatgaataatataatctgattaatccatatgataacactaagtattgtaaatttgtttaattttgtaacctagatacatataaacagtcatatatcatcaaagttatgatccataaattattgacaaaaaaagtcatgatccataaattgttgaaaaacaattcataatccaaatgattatactactttaaatggaagacataatataaagtgtttgttgattcatgcccgtttgagagttactacacttgaaactgaaacttagagaaaacaaaaaaaacaagaaaattatctgaatgacagtcgaggttacacaattcatcactaagaaagaaaacatatattttttctctagagagttacattttctaaatcattgtttcacggtggtttatgaaatatttggcagcaaagtcacactgatgagtaaattttggctcatgaaaatttaataaattttggctggtaaacaaatagataatatgttgtgtgaacaaaaacgtataagtttgaggaacaaccaaatatagttatatgtttgcttaatagacttagctttcattttttctaaaatgatatccataaaattattataagactcataatttattatgtgacattttataacataaattgtatgtaaacctaagatatataaaataattttaaaactaattttcgattattcttcgattaaccgagtaatcattaggacccatcggctgtctaattaacgactaacaatattttgaacatggaacaaaactaatcatctatataggaattaccatttaaacgtaaaaccaacaattactaaatgctcatttatcattatgaaatcaaattagtattaaactcaaatccaattagttcaaaatattctctaacatctaccatcatagtttacaagaatgttggtcatctcaaattgatttatgcactttattgaacactttttgtacataaaataagctaggttgtagaacacattcaaaattaggaaaagaaaaaaacaatatactgtaaattaaccttaattaaaaataccattcaaaaccgtggagaaaaaatgaatcaatcaatcctaattacaaaaaactggtgctgcccaggatcgaactggagaccttttgcgtgtaaggcaaacgtgataaccactacaccacagcacctgatgtctccttattctctcgtttaatatttaactttcaaactaaagcatcgcgaaataaacctttgggcttcgagtgagcatcggagaaatcagacagatg

SEQ ID NO: 13515 - DNA, 3000 bp, Unknown
  misc_feature (1)..( 3000): cDNA_ID_2994531_gDNA_ID_2214633_Annot_ID_136085 3000 nt of promoter + ATG
attttaaccaccaataaaaatatcaataatgtaatttacagcaattttaggcaaatctcacactcagacaagggttagagatgactcaaaaaatgttggatctgatattaaaaaaacaaacaaatacaaacacacagttactatcctttagttacatcatatatatgtattacgtcgttgctttgtgctatatagctgacctcttgctgatatttatattttcgtcaactcttgatcaaacacagatgccacgtcgtttctatactgactctcctcactctcttttatcttcttcaacatcttcttccctgtccgactccgcattcttctcttgcttaactaagctaatatcaccatcttgcttcccccctgtcagagattgagcttcctcgttttcttcatccacgtctcccgaatatgcatatctgtccatcattagtttcatattagcatccctatcacacccaggaacaccaaaattggaccactacataagaaccactagcatgtagccaagacttcccacaacatgctcagctgaaaccgtttccacaaaaccatgcttatttgttggtatgcccgagaggtatcaaaaccttttaagttgatgtaacatacctttgggagttctgcgagggggtccagagatagcaaataatacatagcaacaagaatgcgataacatcccagaaggcagttatagtccaagcagtctgccatcgttcattgaatggatctgttgctttgaaatacacctgcacggggacaaatcatcaggcaagcaagctgggtatattccaagaaagaaggagcttcttttttcctagcttgaaacaaagccagttttagttgagcagtttgtttcctagaggtaagatttgagtttactaaatcagcatcaaatcaggcttgacaggatggtacctcatacactatccacgcaacagaggcaacaaccatcacagcgagtgcatttgagaacttgcggtaaatttccagcttcaccgaggtccttttcatctgcagtaataaagaattttatagctggtctgatgaatcttgcctcaaaacccttacaacttacagagtctgatggctatatttagaaagaaagagatacctgtaactgttccagtgttttcgaaagagaggtaaatatccacaatatgagaaatgcatcgaggaaggcgtcaggaaggacaagaaaaagttttgatcttccggacatatcgtcaatgatgccaacgtgctcagcaatatcaaggatctcagaagctatgaagtaagtaactccaacaaggaggactttagaagtgagaccaccaagagtagatttgacaaccccaaatcccatggaaacacagagaatgagaatgcgggaaacagtctttctcaaggcaccaatggtaacaacccatgtagtaagggctaaaggcctcatccccgtgtgattaaaattagcataatccaagtaccaaaagagcatctcaagcaatcctagaagaatgacggcagtaatgcaatgttgaagtggcaatatatccatccggaacctcaaatactggaagaaccagacggcactgagcaacaaataagcgagagacatatagacatagaaattcacgagtggagccatcctaccaggaagatagccgtcgggatttttccaaacagtctttccggtcattttgaggcccttaagttgtggatcacaagatatgaataagagattatagattccagtcttggtgataagaatctcagtgtctgccatcttagcagacgagcgttttcctttaaagcggacaggtaagaggataggccattgagggtcatgtggagaaggaatcctaatgatctcaccctgcttacagccttgaagcttggccagatctggagtgcagcaaatagatctttggcctccgtaagctgaaccaccgatattgttacgatcggaggcttcaaagatcactgcttgaactaacccattgctgcggtggcccttaccggtaattgtcctccagagagtgatgttctcaaacctgcagtgaggagggaggatgagtagagtagagtagagagcatcaaaagagttgaaaatgtaatccatagaatatacctgattaaagatcgggaagaggcgaagatgccctcgctgccaccgtagaggaggagagaattaccgacatcgtggaagggctgggaagagtagatgtgggcggaggccccagcgattctaaagtgtaatgatagaagaaatgggcacagcagcgcagacagctggatcagttttcccaaatccattatcggggaacgaggatctctgaggctaactaacaggaaggaagcgggagaagagcagctgcagagtcgctcttgttctagctgctgctgactttggtggaccaaccaacttaatataatggtttgggccttagaatggtttgggcctataccgagaggcccggcttacccagaaagaaatgcagcaatagtcaatgccactgcctggaattcgtcgatcgagcgataagaagaagactggaatttttttgaggaggactctgctccatcgccgcccgccctgtaacccaccggactcagtaaactagtctgtaacacaatatcttctatttcagataagatttagcttggagaagagcaagttccgaaaatggaggggcgtcgtgtatagatccaccacccacaggttcgtagattccataaccttggattgtgttttctttttgctttctcggcgacaaattcctccgattttagtgaacatgtctctgattttggtgtcctgtggtggatctgccggagcaagtcttaaacttgacttggactgtttttactagctaattctgggcgctatttcgtcttccttgtttccatttctatctctttctctctggccagtcctcatatgttatcatttcctagctttgccactactcattactttccctttatcgtgtttatatcttagccctgatg

SEQ ID NO: 13516 - DNA, 3000 bp, Unknown
  misc_feature (1)..( 3000): cDNA_ID_2713800_gDNA_ID_2214633_Annot_ID_136086 3000 nt of promoter + ATG
ataaaatataagttgtcaattcaaaaagttccttattacactgatatactaagtattttcttatagtagaaagagtgttttatatgaaagcaacattgtttcttagaaaatattaaatttttattttgttgatccaaaatagtttatttatatttgagaaatttaatatatgagaactgtaaaatacaacgtttggagagaacgtaacactagaaaataccataaagaacacaacccgtgcactcacctcattaccgtcatcgacaagaccattcgagatcgcatcaccagtctttattatcaaggcaccagcaaatatgcaaaccttcagaacggtgcaggcttcactaacgtgataatttgtaatgttctgttttgagatcatctccaggcctagctaactttatgctaggttattcagctgtgtatgtttaaatgcggcatgcgttactgttttgataaagtagctttagaagaatgtagtgtgttgggaataagagtaattttgttttgtgtttaccaaattacagcacaacacagacatattcattcttcatgctcgtgatagtgcctagagaattaacgacttgtgatcacattattagaggaaactcctaactaataaggattaggataaacaacactacatgtggtacactcaacaactcaaagattatctcctgaaaccttatccaactgttcttcggccccaagcagtgatgtagatggctggtcaaaggcgaggacatggtctgactgatggtaagaagtgttcaagcctgattctagtattgggtgacccactacaatatcaggtgtataaccagctgcacctctcaccaatcgaggcttctttgataatctctcctctcctgtgctctcatctggagacccaatgttacaccctgagtctggtgttaaaggctcccggtaagatgagagagactcgtcaactgagagacttttgtctggtccacagtccttgccagacttgtcttgaagaggagactcagatgttggggcaggggttgcaggatctgaatcgcccgttactggggctgagggttcgccgagtactccactgagtcgttgttgctcttcaattatcttcttcaagtactttccttgtgcttctatccgtagttgcagctgtctttgcacctaagaaaaaatcacatcaaagaataatgtcatatgtaatgcaaaattcagtgctacactgaaaatcctactaattgtttcgttgttgcttgtctttcttaagtaggaatggtgaagcatacttctagttgctcgtgtaatcgtttctgaacttccatctgcaacttgagggcttcagttatctgcattcccctgtaatctcgaaacgatattgatcacttaatctgcggcgcgaggtaatatatatatagcatcacaaatcaagctcaaagagggaaatttcacgtacgacgagccgtccaacccagagagcatatctccagattctttcttatcagtttttttccctgaaaattgaaaaaaccagttttcaggtatataggaaactggtagaatgagaaagaagatgaagaaaatcaatgtccacactaccttcagaagacgaatctggaagatactttgcaagtcgatatttctgactcaaaatacacaaatgcaaaaatcagcaagggtaagagaaagagagacgagacaagatgccacacagtttgagaatacctgtaagtgactcttgacatgatatatagttaagccttgtacacccatcactctaagaacgcctttgggtgtagctcctttggaaatcaaaggaagaaaaatgtttaggaaccctaagcaaacagacgataggctttccctctcatggatagtagtaaagcatacaagaagagcaatttgattatattggtgtgcatattattaccacagatattgatgaggaaaacatgagttactaaatttaccatagactatacaagaaaaaaggaaacttactatcagggccaccaagttgagcaacggcatcaacgaagcgttcatgtagctcatgcgtccaacgcagacgttgtttggatgcatgactagaattggggcctccgttgtctgcttccatcagggctaagatataaacacgataaagggaaagtaatgagtagtggcaaagctaggaaatgataacatatgaggactggccagagagaaagagatagaaatggaaacaaggaagacgaaatagcgcccagaattagctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgataatggatttgggaaaactgatccagctgtctgcgctgctgtgcccatttcttctatcattacactttagaatcgctggggcctccgcccacatctactcttcccagcccttccacgatgtcggtaattctctcctcctctacggtggcagcgagggcatcttcgcctcttcccgatctttaatcaggtatattct

SEQ ID NO: 13517 - DNA, 3000 bp, Unknown
  misc_feature (1)..( 3000): cDNA_ID_3030546_gDNA_ID_2214633_Annot_ID_188015 3000 nt of promoter + ATG
ttcgggttgactaatgcacctgcagcgttcatgaggttgatgaacagcgtgttccaggagtttttggatgagtttgtgatcatctttattgatgacattctggtgtattctaagagtcctgaggagcatgaggtacatctaaggagagtgatggagaagctgcgggagcagaagttgttcgctaagttgagtaagtgcagtttctggcagagagaaatgggttttctgggtcacattgtttctgcagagggagtttcagtggatccagagaagattgaggctatcagagattggcctagaccgacgaatgccactgagatcaggagttttcttgggttggcagggtattacaggaggttcgtcaaggggtttgcgagtatggcacagccgatgactaagctgacgaggaaggatgttccttttgtgtggtcaccggagtgcgaggagggtttcgtgagcctgaaggagatgttgacgagtacaccagtgttagcattgccagagcatggacagccttacatggtgtatactgatgcctcgagagttggtttgggttgtgttctaatgcagcgtgggaaggttattgcttatgcatcacgacagttgaggaagcatgagggcaactatcctactcccgatttggagatggctacagtaatctttgccttgaagatttggaggtcttatctttgtggcgggaaagtgcaggtgttcacggatcataagagtttgaagtatatcttcactcagcgagagctgaacctgaggcagaggcgatggatggagctggtggctgattatgatctggagatagcttaccatcctggtaaggctaatgtggttgcagacgcgttgagccgtaagcgcgtgggcgcggctccagggcagagtgttgaggccttggtgagtgagattggtgctttgcggttgtgtgctgtggcacgagagccattaggattggaagccgtggatcgagcagatcttctgactagagtttggttggctcaggagaaggatgaggggttgattgcggcttctaaggtagagggctctgagtatcagtttgtagctaatgggactatccttgtccatgagcgagtttgtgtgcctaaggatgaggagttgcgacaagagatcttgagtgaggctcatgcgagcatgttttccattcatccaggagcgactaagatgtactgagacctcaagcggtactatcagtgggtcgtgatgaagagggatgtagctaattgggttgcagagtgcgatgtttgccagttagttaaggctgagcatcaggtgccaggtggcctgttgcagagtttacccattcctgagtggaagtgagattttatcacgatggattttgtggttgggttgcctgtgtcgcgaaccaaagatgctatttgggtgatcgtggaccgtttgactaagtcagcacattttctggccatcagaaaaaaccgatggagcgacggtgttggctaagaaatatgtgaacgagaactgcaatttttctcggccactcagcaatttttgtccgagaactgctgaaaaaactccgacacttttataccgccgccaccctaacgcctcgaagaactaatggcagcccacgcaaggcaagcccattctcctcgacgattcagcagttttcaacccctgttcgacaaatcctcggacccggtcgacgattcctcgtcctggtcgacgattcctcggacccgatagatttttctcgacgatttccactcctggtcgacaaatcctcggacccggtaaacttttctcgacgattccaagtccggatcgacgattcctcggacccggtaaacttttctcgacgattccaagtccggatcgacgattcctcagaaccgattattttccctcgacgatttcaagtcctggtcgaggaatcctggacgatttccgcaacaatcaccagttttcattttctctttacttggcatgggtttgtcatattgaacgtttgtgttcatatcaccaagtgtttgacttttcaacaactaccttgtgtttcatccatcatttgatgctagttcttagcttttacaactttcttagcttgagaactatctcacacttctatctccccaagcattctcttctggttctttttgaacaagtctgctcttgacttactcttctcactatgcaccttcgtgagtgtaaccccaagcattctcttttgtttctttttgaacaagtctgtctcttgacttactcttttcactatgcaccttcgtgagcgttttggacaagtctgtctcttcacttattcttctcactatgcacctttgcgagcgttgcgggttttcaaaacacttggcgaggtccggaatcttaccaagtaataacatttaacctcgagagacgagctcgtgtaaagttgggaattcgttaaggagctgttgctttgttagtgtagaaacacttgtgtagaattggggattgttttttttggagtgatttaggggagggtcgaatcttagcgacaaagggctgaatctcagtggatcgtggcagcaaggccactctgccacttacaataccccgtcgcgtatttaagtcgtctgcaaaggattctacccgccgctcggtggtaattataattcaaggcggtccaaacgacgcttccgccgaacggacttagccaacgacacgtgcctttgggagcctaagctcctactgagggtcggcaatcgggcggcgggcgcatgcgtcgcttctagcccggattctgacttagaggcgttcagtcataatccagcgcacggtagcttcgcgccactggcttttcaaccaagcgcgatgaccaattgtgcgaatcaacggttcctctcgtactaggttgaattactatcgcgacgcgggcatcagtagggtaaaactaacctgtctcacgacggtctaaacccagctcacgttccctattggtgggtgaacaatccaacacttggtgaattctgcttcacaatg

SEQ ID NO: 13518 - DNA, 3000 bp, Unknown
  misc_feature (1)..( 3000): cDNA_ID_3030481_gDNA_ID_2214633_Annot_ID_188035 3000 nt of promoter + ATG
catcagatataagattaaaaaaaaagcaaatttcatttctttttaaagaaaatattacgtgattagacagttatttggaaatgatataattgtcctttttacctccaaaaacaaagaaaagtgcctcatccctgaaaagtgcctcaaaaagaataagattttgtaaaagtgtctaaacgtgtcacattcccaaaataaaatataagttgtcaattcaaaaagttccttattacactgatatactaagtattttcttatagtagaaagagtgttttatatgaaagcaacattgtttcttagaaaatattaaatttttattttgttgatccaaaatagtttatttatatttgagaaatttaatatatgagaactgtaaaatacaacgtttggagagaacgtaacactagaaaataccataaagaacacaacccgtgcactcacctcattaccgtcatcgacaagaccattcgagatcgcatcaccagtctttattatcaaggcaccagcaaatatgcaaaccttcagaacggtgcaggcttcactaacgtgataatttgtaatgttctgttttgagatcatctccaggcctagctaactttatgctaggttattcagctgtgtatgtttaaatgcggcatgcgttactgttttgataaagtagctttagaagaatgtagtgtgttgggaataagagtaattttgttttgtgtttaccaaattacagcacaacacagacatattcattcttcatgctcgtgatagtgcctagagaattaacgacttgtgatcacattattagaggaaactcctaactaataaggattaggataaacaacactacatgtggtacactcaacaactcaaagattatctcctgaaaccttatccaactgttcttcggccccaagcagtgatgtagatggctggtcaaaggcgaggacatggtctgactgatggtaagaagtgttcaagcctgattctagtattgggtgacccactacaatatcaggtgtataaccagctgcacctctcaccaatcgaggcttctttgataatctctcctctcctgtgctctcatctggagacccaatgttacaccctgagtctggtgttaaaggctcccggtaagatgagagagactcgtcaactgagagacttttgtctggtccacagtccttgccagacttgtcttgaagaggagactcagatgttggggcaggggttgcaggatctgaatcgcccgttactggggctgagggttcgccgagtactccactgagtcgttgttgctcttcaattatcttcttcaagtactttccttgtgcttctatccgtagttgcagctgtctttgcacctaagaaaaaatcacatcaaagaataatgtcatatgtaatgcaaaattcagtgctacactgaaaatcctactaattgtttcgttgttgcttgtctttcttaagtaggaatggtgaagcatacttctagttgctcgtgtaatcgtttctgaacttccatctgcaacttgagggcttcagttatctgcattcccctgtaatctcgaaacgatattgatcacttaatctgcggcgcgaggtaatatatatatagcatcacaaatcaagctcaaagagggaaatttcacgtacgacgagccgtccaacccagagagcatatctccagattctttcttatcagtttttttccctgaaaattgaaaaaaccagttttcaggtatataggaaactggtagaatgagaaagaagatgaagaaaatcaatgtccacactaccttcagaagacgaatctggaagatactttgcaagtcgatatttctgactcaaaatacacaaatgcaaaaatcagcaagggtaagagaaagagagacgagacaagatgccacacagtttgagaatacctgtaagtgactcttgacatgatatatagttaagccttgtacacccatcactctaagaacgcctttgggtgtagctcctttggaaatcaaaggaagaaaaatgtttaggaaccctaagcaaacagacgataggctttccctctcatggatagtagtaaagcatacaagaagagcaatttgattatattggtgtgcatattattaccacagatattgatgaggaaaacatgagttactaaatttaccatagactatacaagaaaaaaggaaacttactatcagggccaccaagttgagcaacggcatcaacgaagcgttcatgtagctcatgcgtccaacgcagacgttgtttggatgcatgactagaattggggcctccgttgtctgcttccatcagggctaagatataaacacgataaagggaaagtaatgagtagtggcaaagctaggaaatgataacatatgaggactggccagagagaaagagatagaaatggaaacaaggaagacgaaatagcgcccagaattagctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgata

SEQ ID NO: 13519 - DNA, 3000 bp, Unknown
  misc_feature (1)..( 3000): cDNA_ID_1380526_gDNA_ID_2214633_Annot_ID_188039 3000 nt of promoter + ATG
atacatatcacagggccttgagagacttgtcttattcccaagggacaaaaacacagagatcaatggtccaataacttgagaaggatggcctgttccatcggagggaaaaatgtcacaaagttgaaatctgtttacaaaaataaggggaagaataggagggtatggatgaaaaagagacttacggggcaacaagcatgagatctcattccctgatgaagctcagaggctgatatcaaaagcttctgcaaacggtactctcctgtctgagactgtcctctattctctgcatagcatataacttgtcgctctctcaggtgctcaaatgcctgtcatgtcaaccatttagaccaccacctttaaaccatggcatctcatgagagctataaacatacccttaggcagacattttgtgcgtagtagtctgaggtatgaaaagaatcgtgtatcgccttatactctggaatacacatggaatctcaagtcattttcatagtggtgccatggtttaaaccaaatttacagattacctttcatcacactgatgaagttgtatgagctttgctccttcacttctaacctcctcatacagaccagaagataaagctccagtacggaacaatctgctcaacaaagatagtgtcaatagatattcccaaggaaaatgtatatgcaacaccgcagcttattatacctctaacggcttccaactttggttgcctttgcatacttgaaagtgctgctttgaagttctcaagagagaggaggccagattccaaattcattaaagaaacagcgcagaatctaacatcaagagatagactcaacacagagaaaatgatatcttaaggaaacatctcatgattgtaatcgaagaacttacataaacttcaggaaactgttcacagtagaattagcattaaacaatgtcttaagtatgtctttaaatctcgtgtctgatgttaaattctgcacaataggttttttttttttgaaattggttagtatcagttgttcagaacaagaatcaacatcatctaaaagctaagcatgtcatagtagtaattgggattggatattagaaccttaatcttatcattgaaccgagaaacatatccactggggaagcctgagtctgctggtagagacagcaggtgtacaaacaaactagaaacatagttcctattagttaaataagttgattggaaaaatagttgactggctattacagaaaagaagctgctcattacccgtcaagttcttccctggaaggaggaagaaacaaaaattttctgtgtgaaaagcgagatctcactcttttctccagaagttggtcggcgtcctgtggtgacagattgcatattataagattttgaaccagagtagtattaacaagaaccaaagtcagctgtcatcaaacataaaaatacatacaagaaacagtttgtaaagcccaaagcacatatatctgtatagcgatgctcataccagtcgagaactaataccgacgacaacagcttgtgaggttacagattgcatagcatcgtccagcakactgtatagcaccgctgctttccctatatatatataagcagataatagggtgagtggatagaaaacaccaatgtccaattcctttgttcatcaaaggttaaaagaaaccagaattcttgcctgtgcaaacatgtcaaattcatcaagcacaaagatgatagtcttatgtgctagtccacatgccctgaaatatctctatcagtttgtctgcgttgaatatcaaaaaggctcatttatgtaaaggtaaaaatactgaccgcaacatggctataatgaattgtgaattgtcatcgaatgatgcctggaagtgcaagagagaaagcaagtcaactgagacattggctacacagcaaagagaaagaacattcggagagaacaatgtcataccattttggagaatagtaggtggtgttccatgcacaactgtttggcaatttcctgaaaaatcaatgtaagacggtgagtgaatgaatagattaggtgtaggaaatgagaatggtgggctctctccctctcttagaccttaaaggcacaattatcatcactatgcaagagtccattcaatctgatctgcaatcacattgagatggtagtaagatcataacgatgagattagatataggagatagttccaaatgtataagaaatcagacatactactgatactgaatcaggaaactgctccaataaktcacctasakcgagatccaagacctgaaatcaacccattttttgaaataaaagaagaaatcayacgccaatgacggagatagagagtagaaggaagcagggttcgacatacagcagctttgccagagccgcgagggccgagaagcaacatcgagttgttgcatccctccgtgatagaggttgatacaatgaacttcaatttactgtgtgttgacaaatttgtttgtactattaggttaaaagcaaattcgtttcgagaaattaagcgacaagtgagtgaagcaatcagacctgtaattgctatctgacgaagcggaaagaggtctgaagacataactaggatcacagagtctcccgcgaatcagatttagggatttctccgccggagtctctttgcccatcggactggcgggaaaactgacaagccaagcgagccctctgtgtgaactgtgaagtgaacacccatcatcactactagtataaacttactctatgggccgtagtaatgggccttataaagcaataaaaggcccaataaagctcctttgctttctcctaataacgacgtcgtttacattgtgttagcaagtttgtgatggaagaaggtttaacggagaaaaaaaaaaggattgggttgttttggaaaatatcaaatgtgggcaacgaaactcgaccggaaccaatcgttccttctctgaagctctctttgcaattgaaaatcaacaacatacgatacgagagaggattcttcgagagatg

SEQ ID NO: 13520 - DNA, 3000 bp, Unknown
  misc_feature (1)..( 3000): cDNA_ID_3409341_gDNA_ID_2214633_Annot_ID_188036 3000 nt of promoter + ATG
gctagtaaaaacagtccaagtcaagtttaagacttgctccggcagatccaccacaggacaccaaaatcagagacatgttcactaaaatcggaggaatttgtcgccgagaaagcaaaaagaaaacacaatccaaggttatggaatctacgaacctgtgggtggtggatctatacacgacgcccctccattttcggaacttgctcttctccaagctaaatcttatctgaaatagaagatattgtgttacagactagtttactgagtccggtgggttacagggcgggcggcgatggagcagagtcctcctcaaaaaaattccagtcttcttcttatcgctcgatcgacgaattccaggcagtggcattgactattgctgcatttctttctgggtaagccgggcctctcggtataggcccaaaccattctaaggcccaaaccattatattaagttggttggtccaccaaagtcagcagcagctagaacaagagcgactctgcagctgctcttctcccgcttccttcctgttagttagcctcagagatcctcgttccccgataatggatttgggaaaactgatccagctgtctgcgctgctgtgcccatttcttctatcattacactttagaatcgctggggcctccgcccacatctactcttcccagcccttccacgatgtcggtaattctctcctcctctacggtggcagcgagggcatcttcgcctcttcccgatctttaatcaggtatattctatggattacattttcaactcttttgatgctctctactctactctactcatcctccctcctcactgcaggtttgagaacatcactctctggaggacaattaccggtaagggccaccgcagcaatgggttagttcaagcagtgatctttgaagcctccgatcgtaacaatatcggtggttcagcttacggaggccaaagatctatttgctgcactccagatctggccaagcttcaaggctgtaagcagggtgagatcattaggattccttctccacatgaccctcaatggcctatcctcttacctgtccgctttaaaggaaaacgctcgtctgctaagatggcagacactgagattcttatcaccaagactggaatctataatctcttattcatatcttgtgatccacaacttaagggcctcaaaatgaccggaaagactgtttggaaaaatcccgacggctatcttcctggtaggatggctccactcgtgaatttctatgtctatatgtctctcgcttatttgttgctcagtgccgtctggttcttccagtatttgaggttccggatggatatattgccacttcaacattgcattactgccgtcattcttctaggattgcttgagatgctcttttggtacttggattatgctaattttaatcacacggggatgaggcctttagcccttactacatgggttgttaccattggtgccttgagaaagactgtttcccgcattctcattctctgtgtttccatgggatttggggttgtcaaatctactcttggtggtctcacttctaaagtcctccttgttggagttacttacttcatagcttctgagatccttgatattgctgagcacgttggcatcattgacgatatgtccggaagatcaaaactttttcttgtccttcctgacgccttcctcgatgcatttctcatattgtggatatttacctctctttcgaaaacactggaacagttacaggtatctctttctttctaaatatagccatcagactctgtaagttgtaagggttttgaggcaagattcatcagaccagctataaaattctttattactgcagatgaaaaggacctcggtgaagctggaaatttaccgcaagttctcaaatgcactcgctgtgatggttgttgcctctgttgcgtggatagtgtatgaggtaccatcctgtcaagcctgatttgatgctgatttagtaaactcaaatcttacctctaggaaacaaactgctcaactaaaactggctttgtttcaagctaggaaaaaagaagctccttctttcttggaatatacccagcttgcttgcctgatgatttgtccccgtgcaggtgtatttcaaagcaacagatccattcaatgaacgatggcagactgcttggactataactgccttctgggatgttatcgcattcttgttgctatgtattatttgctatctctggaccccctcgcagaactcccaaaggtatgttacatcaacttaaaaggttttgatacctctcgggcataccaacaaataagcatggttttgtggaaacggtttcagctgagcatgttgtgggaagtcttggctacatgctagtggttcttatgtagtggtccaattttggtgttcctgggtgtgatagggatgctaatatgaaactaatgatggacagatatgcatattcgggagacgtggatgaagaaaacgaggaagctcaatctctgacaggggggaagcaagatggtgatattagcttagttaagcaagagaagaatgcggagtcggacagggaagaagatgttgaagaagataaaagagagtgaggagagtcagtatagaaacgacgtggcatctgtgtttgatcaagagttgacgaaaatataaatatcagcaagaggtcagctatatagcacaaagcaacgacgtaatacatatatatgatgtaactaaaggatagtaactgtgtgtttgtatttgtttgtttttttaatatcagatccaacattttttgagtcatctctaacccttgtctgagtgtgagatttgcctaaaattgctgtaaattacattattgatatttttattggtggttaaaattgtgaaacattaatttgtcaataatactagagtccagacacggaaacagggtctctctctcttgttgtgtataatttcaacaccgctattacagaagaagagtgaaaagggagagggagcttcctgctttcacttact

SEQ ID NO: 13521 - DNA, 3000 bp, Unknown; identical to SEQ ID NO: 13515
  misc_feature (1)..( 3000): cDNA_ID_2994531_gDNA_ID_2214633_Annot_ID_188034 3000 nt of promoter + ATG

SEQ ID NO: 13522 - DNA, 3000 bp, Unknown
  misc_feature (1)..( 3000): cDNA_ID_3030550_gDNA_ID_2214633_Annot_ID_188014 3000 nt of promoter + ATG
aggccgccaccgtaatccgcgtcggtccacgccccgaatcgatcggcggaccggattgctccgttccgcatccgaccaggacgcatcgccggcccccatccgcttccctcccgacaatttcaagcactctttgactctcttttcaaagtccttttcatctttacctcgcggtacttgttcgctatcggtctctcgcccgtatttagccttggacggaatttaccgcccgattggggctgcattcccaaacaacccgactcgtagacagcgcctcgtggtgcgacagggtccgggcacgacggggctctcaccctctctggcgcccctttccagggaacttaggcccggtccgtcgctgaggacgcttctccagactacaattcgaacgccgaagacgtccgattttcaagctgggctcttcccggttcgctcgccgttactaagggaatccttgttagtttcttttcctccgcttattgatatgcttaaactcagcgggtaatcccgcctgacctggggtcgctatatggactttgggtcatctactgcttccggacaagagcgaccgataaaatgtaatggatcaagttcaccaccgcatgtcggtacgctccaggcgtccttggctcggatttaggccaaccgcgtgcggtaacacacgggagaccagcttccgtcccgcatcagcaaaggatggtgagggacgacgatttgtgacacccaggcagacgtgccctcggccagaaggcttggggcgcaacttgcgttcaaagactcgatggttcacgggattctgcaattcacaccaagtatcgcatttcgctacgttcttcatcgatgcgagagccgagatatccgttgccgagagtcgttttagacttcagttcgcagcacagcatccgcccacactccgtctccggggaggcgaatgccagccgttcgtttgcatgttccttgacacttttcgtgctggggttttgtgatatccggaagcaacgcgcacgacaagaccgagataaaagctcccgagcatgccgatacgcgaaaccacggatccggcgggcaaggaatcggctaagaaaccggcccaccgagagtggtgatctttggttcgcgggtcgttctgttttggacaggtatcgacaatgatccttccgcaggttcacctacggaaaccttgttacgacttctccttcctctaaatgataaggtttagtggacttctcgcgacgtcgcgggcggcgaaccacccacgtcgccgcgatccgaacacttcaccggatcattcaatcggtaggagcgacgggcggtgtgtacaaagggcagggacgtagtcaacgcgagctgatgactcgcgcttactaggaattcctcgttgaagaccaacaattgcaatgatctatccccatcacgatgaaatttcaaagattacccgggcctgtcggccaaggtgtgaactcgttgaatacatcagtgtagcgcgcgtgcggcccagaacatctaagggcatcacagacctgttattgcctcaaacttccttggcctaaacggccatagtccctctaagaagccggccgtgaagggatgcctccacgtagctagttagcaggctgaggtctcgttcattaacggaattaaccagacaaatcgctccaccaactaagaacggccatgcaccaccacccatagaatcaagaaagagctctcagtctgtcaatccttactatgtctggacctggtaagtttccccgtgttgagtcaaattaagccgcaggctccactcctggtggtgcccttccgtcaattcctttaagtttcagccttgcgaccatactccccccggaacccaaaaactttgatttctcataaggtgccagcggagtcctataagcaacatccgctgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctgttaatcattactccgatcccgaaggccaacacaataggatcgaaatcctatgatgttatcccatgctaatgtatccagagcgtaggcttgctttgagcactctaatttcttcaaagtaacagcgccggaggcacgacccggccaattaagaccaggagcgtatcgccgaccgaagggacaagccgaccaatgcacaccaaaggcggaccggccgacccatcccaaggttcaactacgagctttttaactgcaacaacttaaatatacgctattggagctggaattaccgcggctgctggcaccagacttgccctccaatggatcctcgttaagggatttagattgtactcattccaattaccagactcgaaagagcccagtattgttatttattgtcactacctccccgtgtcaggattgggtaatttgcgcgcctgctgccttccttggatgtggtagccgtttctcaggctccctctccggaatcgaaccctaattctccgtcacccgttaccaccatggtaggccactatcctaccatcgaaagttgatagggcagaaatttgaatgatgcgtcgccagcacagaggccatgcgatccgtcgagttatcatgaatcatcagagcaacgggcagagcccgcgtcgaccttttatctaataaatgcgtcccttccataagtcggggtttgttgcacgtattagctctagaattactacggttatccgagtagtagttaccatcaaacaaactataactgatttaatgagccattcgcagtttcacagtctgaattcgttcatacttacacatgcatggcttaatctttgagacaagcatatgactactggcaggatcaaccaggtagcattcatcgatcacggcaattccccgccacatcctctcaaacgcaatg

SEQ ID NO: 13523 - DNA, 2810 bp, Unknown
  misc_feature (1)..( 2810): cDNA_ID_2713793_gDNA_ID_2214633_Annot_ID_136090 3000 nt of promoter + ATG
ttatctatgaaaaaccattttctataagcaaatcttatcagaaagaaggcatttttatggagtccataatttttctgggcgagacagagcaaaactgggaagacaaaggatagactccaagcatctctttgtgatcaaacggagctgaagggagataaatgctcataatatgacacagaaagggtggagatggggagcacacttcgttggtgcaagcacaaaagtgagagtctgagagagatagagtcgatctggatatggtgaattaagatctccaatttgtgcgggtcttaactgttagcatgatgtgtaattatatgagttgaagggtttgatgttgagactcaaatgggtttgtgtgtagtagagaaagttgtttgtgtaatcacgggtatgtgttgacatgcactctccctttatatatatatagcgtaaacacaaagcaaaaactaaagatacagtttgtaaaccaagtagcttttaccatgaaataaacatacatatcacagggccttgagagacttgtcttattcccaagggacaaaaacacagagatcaatggtccaataacttgagaaggatggcctgttccatcggagggaaaaatgtcacaaagttgaaatctgtttacaaaaataaggggaagaataggagggtatggatgaaaaagagacttacggggcaacaagcatgagatctcattccctgatgaagctcagaggctgatatcaaaagcttctgcaaacggtactctcctgtctgagactgtcctctattctctgcatagcatataacttgtcgctctctcaggtgctcaaatgcctgtcatgtcaaccatttagaccaccacctttaaaccatggcatctcatgagagctataaacatacccttaggcagacattttgtgcgtagtagtctgaggtatgaaaagaatcgtgtatcgccttatactctggaatacacatggaatctcaagtcattttcatagtggtgccatggtttaaaccaaatttacagattacctttcatcacactgatgaagttgtatgagctttgctccttcacttctaacctcctcatacagaccagaagataaagctccagtacggaacaatctgctcaacaaagatagtgtcaatagatattcccaaggaaaatgtatatgcaacaccgcagcttattatacctctaacggcttccaactttggttgcctttgcatacttgaaagtgctgctttgaagttctcaagagagaggaggccagattccaaattcattaaagaaacagcgcagaatctaacatcaagagatagactcaacacagagaaaatgatatcttaaggaaacatctcatgattgtaatcgaagaacttacataaacttcaggaaactgttcacagtagaattagcattaaacaatgtcttaagtatgtctttaaatctcgtgtctgatgttaaattctgcacaataggttttttttttttgaaattggttagtatcagttgttcagaacaagaatcaacatcatctaaaagctaagcatgtcatagtagtaattgggattggatattagaaccttaatcttatcattgaaccgagaaacatatccactggggaagcctgagtctgctggtagagacagcaggtgtacaaacaaactagaaacatagttcctattagttaaataagttgattggaaaaatagttgactggctattacagaaaagaagctgctcattacccgtcaagttcttccctggaaggaggaagaaacaaaaattttctgtgtgaaaagcgagatctcactcttttctccagaagttggtcggcgtcctgtggtgacagattgcatattataagattttgaaccagagtagtattaacaagaaccaaagtcagctgtcatcaaacataaaaatacatacaagaaacagtttgtaaagcccaaagcacatatatctgtatagcgatgctcataccagtcgagaactaataccgacgacaacagcttgtgaggttacagattgcatagcatcgtccagcakactgtatagcaccgctgctttccctatatatatataagcagataatagggtgagtggatagaaaacaccaatgtccaattcctttgttcatcaaaggttaaaagaaaccagaattcttgcctgtgcaaacatgtcaaattcatcaagcacaaagatgatagtcttatgtgctagtccacatgccctgaaatatctctatcagtttgtctgcgttgaatatcaaaaaggctcatttatgtaaaggtaaaaatactgaccgcaacatggctataatgaattgtgaattgtcatcgaatgatgcctggaagtgcaagagagaaagcaagtcaactgagacattggctacacagcaaagagaaagaacattcggagagaacaatgtcataccattttggagaatagtaggtggtgttccatgcacaactgtttggcaatttcctgaaaaatcaatgtaagacggtgagtgaatgaatagattaggtgtaggaaatgagaatggtgggctctctccctctcttagaccttaaaggcacaattatcatcactatgcaagagtccattcaatctgatctgcaatcacattgagatggtagtaagatcataacgatgagattagatataggagatagttccaaatgtataagaaatcagacatactactgatactgaatcaggaaactgctccaataaktcacctasakcgagatccaagacctgaaatcaacccattttttgaaataaaagaagaaatcayacgccaatg

SEQ ID NO: 13524 - DNA, 3000 bp, Unknown
  misc_feature (1)..( 3000): cDNA_ID_2703213_gDNA_ID_2214634_Annot_ID_136092 3000 nt of promoter + ATG
tatttcttctttcgcacttcaactttgtataaaaagtccacactgattcaacgttttctccgagttttttaggattatttttgtttggtggttcttatatattcactatacaaaagtacaaatgacaaacttttatcaagagaattcactatactctttgaaattatgtttgattatctatatagctaaaattcaaatatttttcactatcattaatacgtacaacaacaatataggattataggatatattgatacaatgttatataattatgttacttacatgttggaaccttgtttatcttgattctaaacaaacaatttcatgttccatgtacactactctctcatgatctactacttcatccacacagattttgacaagctaatgattatctaccgaattgatataatttgaataactaacttttttttatcaaacaagttatattgaagatagtgccttaagctccattgaaggaggaagcattacaagataaaagaacaaaattcacaaaggaatctgttaaaacattcgcaataagcgatacatgatgaaagaaaatggaactaaaatgaagcaaagtggaattaatgtccaaaacaagtccatgaacttcatttgcatgacctacggaattgagaagaaaaacgagttattgacaatccgtgacgcatgcgtgccttgatacacccaaactttgattgagaacataatagtcttaaagcatttacctccacaactaaggcagaaaaaacatattgtaaggggatcgttgagcgatccaatcatcttcagtgaattagcttgtcgagatctgcctaaacaacgcttaaaagcttccttacatatcgtccaaggataggtaagcatcgtcacactatgtaattgggcttcttgtcctcttttaacatcaacaatagatgctaagaccagttcctctattgacaatcttctgaaagtgtcttcccaaggcaagcataccagagatggtagaacacactccataaaggaggaatttgatggaagatgatacttcatgaaggaggggactgatggtaacacaaactctccaagaatgtcatttaacaacaccacatgaacaaaaaggttagaatcacttgacaaaagtttgcggaaaagagcctcatattgaggtaaaagaacactgagcctaaccagagtcataacagcctcatactgaggaaataatagcgtaagcctaattcaaatcatcacatcctcaagtgcaaggaactaaagtaaaacagagaattgaagtacgtaagataaaatcaaaagtcttttgttgtgttaaattctccattaatctcactcttaactttttttaaacacttgataaaataaaaaattatattaatgtatgaagcattactttcattctactccactaattttattaaaaacatttatcaattgaatactaatatttcaaggataaaacagccttgtagagagacacaaccttccgatgtagtgttgaaagacatgaatgacgtgaagaaagacacaaatggtcggaacaaacgacatgaaaggtcttgaaccacgaactgcacacagcagaaaaagatcgcatatgagcgataggagtaccacctgagggcacaataaaaaacaaagcaacatttaaatctacaaatctgaaagcttggaccaatttccgaactagatctaggaataacagaataaagggacattgggagaaagattcagaggtgaaagagacgacgagagagtccggtggatcgggagggttaggaggttccagaggagagagcgtcactgaaaggccaaaactgggcacacatcagcgaggccatggaagaaaggaagaggagggagaaaggagaagtttaccaccggtgggcgagaggccaaccgacggcgacgagagagaaactgatggaaaccataattacctagagatagtttagcatatgcaaggatttatacatttgttctagaggcacaaattcaaaaaaatatatatgtataactaactatttgattttcttcaagagttttcatatcaaaagagaaaagatagcaaaaagttgaagagtaatttaagtaacatttttagatctcacttcttgcatttgcatataacgatatattagagatttttgtgtcttaaattccttggtatgtataacgtctcaaagatccattacttaaaaatactcgcatgttattgtcaatgttaccaacttaccaaagaagatcatatgatgtttatagaccataaaatctaataacaagaaaagagtcaattgtaaaattactaaactaagaagaggttaggttgataacagtgaaactgtaaattttcaatcattatcgagtaatgaccattgagaaaaaaaaacttagtaaattaagaaaagtataataaattagtgtttgatatattagcatgactttctacattttaatttttattttaaatataaataattaagagttgtattgatggaggattttattcaagaattttattttaattttcttcacttaatttagttgattttttatttaaataacacatgttattttcttatgtgatgatgtgacgctcatatagacagagttggtcatgtttcatatatataatttcataccatgggttcaacatatatgtgactagttgttagaaattagttgataatatgaatataaatgatgtataaataaacagaaaattgaaatttaaatattttttttcttgcaatctgaattttatttatgaatgtaagtctttacaaaggaggtttttagctacattggctaatttcctgagtctgcttgaaacacactagtcgtatatattgaagaagctaactgatgtgttatgctattacagtgacagtttgtgaatgtaaagataactaataaaaactttgaagcccaaaaatctatatctagaagtaaactagcaatgtcccaacgagtagacatgtcgttgattgtttaatg

SEQ ID NO: 13525 - DNA, 3000 bp, Unknown
  misc_feature (1)..( 3000): cDNA_ID_2703224_gDNA_ID_2214634_Annot_ID_136096 3000 nt of promoter + ATG
ttttgtttccataagaaagaacagatcaggaaaaaccgatttacggatttccatgattctctggactgtcatggggttccccaacccacaacagttccagctcaccattcttaaggaagaggggttggcagattctgaaaatctaccttctttttcctggatacaggaatcagatcaatttttggagtagtagaggaggaagctcctagggtgcctcctgcagagaggttagtgttcttggcctgagatttagaacttgatgaaccagggatagtttgaggcctagggggaataataggagatcccgtctttttcctagatttggagttagaagtcttactcggagaaccctgggtaaaatttctcttatgagactttgtgcctagaagtttaatggcaggtttgttggcttgtcttggtagaggaggacgacctctacctcttttagttgggcagcaggaacacactctaggtttgagcttgtagccaaagaccctgggggaatttcagtactctcataagctagaagatctgagccagaagcggctgagaggataccaagagctgttgtatccatcaggtttctggtttccccttgaaaaaccctgattttccttgctgcattttctactggatcaggacaagagaggtattggactgttaaatccctcaactcactcatgacttggtcttttgtaggtggaggggaagaaacttccatcccaagacttctgggatcactgccttttaaggttggaggagtaagaggatcagaggaggcaacatctctctcaagaggggggcgacaagccttggacccacttgatgacgtagcatggagtcctgctgatgaattagatttctctcgccattggagttgctgaggtggaaaaggagcaaaccctccatcctgatggtaagacttagaggaatcctgagaatgatgtctgcgttgattatctccatatctatggaagttttctctattaaaaaatcttctctgaggggagtatctgagagtagaaggagacttggatcgaaccccatcctgattcaatcttctttttgcagagtttactgcctggtgagggatagcacttctctcagagcgctgagaggaactcctgggggcgatgaagttgtcctgaggaatgtagtagttccttgagcttgattttgaggcatggagggaagcagattgtacaggagaggggttcctttgtgtttcagacttctttgcaacaccagggcagtgcttttcctcatgggtaaggcggtggcaatgtcgacaatgatttttaaggttcttgtagtctagataaaccacagcttctcttccatcggggaagtcaacaatcgtctctttggtgataggttgtaacccatctagcagaacctttattttgactgtcgatgaggtaatctcctggtccatgactgtaccaagctcttcacctatggacttaagcatttcaggcttccagtagtgcttgggaagaccttggagttcgatccaaaaaggaatcaggcaagggaaagatggtgagataactggttcccatttttgcaagataaccatccattggtcaaaatgatatggcctattatcaagaacttgttgaaggtcctccgagaaatcaaacttgagttgaaaaactccctgtcctaggtctgaaccagtggctttacccctgagagtccatctgttagacaagaataagaagagagcccacagtcgttgtccagagggattggtgagacggccaatgagggttagggcattttcttcaatgagatctgaggtatcaaggtcaggaccgcggattcgcttacggggtggaggggagtaccctctttcaattccttttcctttctggttatacgggatacggtttgtcatgatgatgagtgaaaggaggcacttgcaggttgggttaaagcttcgcaggaaagtaacacagctgaggtagggtttaaaagtttgaaacggttgagagagcttaaatatccttctacctccaataaatgggagattagacggtaaaacaaccttggtaaagaagtttctgagactttaatgcagattgcgcaagagagaaaggagttcggagaagaactttgatgaacattgatgaacattcatatggagaaagcgttataccgttggatcttacctgccacttaagcccagtggataaaagagggattgcactgttcagatctgggtattagttggttccatggtgcctcgggtaatgggcctaggtaataggcgtgggagagatttttctgctactctcaattttgttttttcaaaaaaaaaaaaaaaactaacttatactctagtttactcgctctctctctccataaagccttccctttattatttttattggtgtattgtgtagagcctctagttcagatgcaattttgtgattgtttcaagaccgattttcaatcgttttggaatactttttaagcgtttgttaatcgagtttaggacttttactatggtaaatcggtttagcacaatacacatgactttatgttattcattcttcattcgtatatggataaaaaatcagcgatgctaaacagatctcaatatgtatgtgaacttgtgaagtagcaaattgttgcttattccactatattaagtcaagtttccacaatgtgccagacaatccctagttgtttagattccaagatttcgacaatgtaacacccgttaataattcacaacagctctcttattggcaatatattcgataattattaaatacataaatacaaaatcacattttggaatttaagacattttacaattaaaaaaaaagtggaatcacgttcaaaggtcgttgatagtcacaacttaacaatgacgcattaaagtattcaaaagtctatttaactgatctatgattgacacatagaaatgaagctatataaaagttgtactctctttttgaaccatctcacaatcaaactcaagtcaacatg

SEQ ID NO: 13526 - DNA, 3000 bp, Unknown
  misc_feature (1)..( 3000): cDNA_ID_2703248_gDNA_ID_2214634_Annot_ID_188068 3000 nt of promoter + ATG
aagtgcggcgaggactggtggtggaagagaggaggaggagggagatgaggagagagagtgagaggatgtggtggagtggattgaggaggagaagagagagaaagagaagaggagagtgaagaaagagaggaagaagatgaataagaaacggtggtgattcgcggcggcgacggcggagggtgattttgaagttagtggagagtggtggtggaagagaatcagattagtgtttgtgttgctcttcattttattttttgtccgacaaaacaaaaatagaaataatgaaagacgaaatgtgtgttttgtctctttaagaaggtttttttatagacaaaaaaaaaaaagaaggtttttttataaaccggtgatggtttagagaaatagatgtgttgcttttgtacatttttgggtttattccggttctggagcaagagcaagaaccggtgggtttgaaaactttgaaacggatgttaattatgtcagcttacatagtaacggttagtgttagagcatctctatctccatcatcagtttaagaaattcatgtgaatatcttaataataacacaataatattaataaaattatatactaaactaaattaaaatttgttaaaactttaaattaaatcttaatttttttaatatattgtggattcttaaacacaaaccaaaaaaaaaaaagatatgagaaacaaaatccaatctagatgaatcaaacataaagtaatacaaattaattaattacttaattttataaaactattattttattacaaggttgaaaattccgcactattttctgagtattttttaaaaataattaatataaatatgaatttcatatctttatcttatcttagattttagtagttttattttttttgtgattagattttatatttttaagtatagtttctttttgcaaacattaatatctaatgagaaaagtgatgtcgaaaaagtagaattatactctatttttcaattggtaacttctttttaattttagttcttattataggttatcttttaacttttaattgattcccacatttaatggatcttcacggtctatcatattgttgattttatcggtccgattgaagccaatctagatattttaagcacatttcttgctaaagctattttcatattttattgtataaagtttatttttaaagttagtaatatgtacgatcgtgacaatataaaacttgattttcaaagtttgtaacacatacgatcgtgatatgatcatatgagttattatatttaaaaatcaagatttatataattaattgtgaatcaattacgaatttaaaagaaaaaaatccggtttatggtataaatctagcgggaattgtaaatggtacatgtctagaattcgaatcttatcaaagtgaaccaactcaaatgtgtaaaacaaatcaaatctagtaaatcgaatcaaaccaaagtctataaaccaacccactttgcttttgtgatttattgttttaaaagggttctaagattggggcttcgagctcttgtttgctgctcgaattcgatctagtgaccaggtacttagtgtttgttttgtcagattaagtgtttctcaattagtggttttatttttgtttgtaggctttgaaccttttatcagtcagaatgtttttaattggttttgttgtgatacaatgttttggttatgataaaatagttttacttatttctacaagatatcagttttaataatattcctataaaaagagagaatttgaagaagaaataagtaaaactgattgataagagtgtgcagaatcgactaagtatttgggtaaggctgggcatgtgggtaatccattcgggtttgggtaaaacccgtttgggtttgaatttaatgggtattgaatatactacctaataagagtaattctaaatattcggttctgctccggatcggatccaatcgggttcaggtcgggttgggtaaaaagtttcaggtcctaaaaatatctaaaataaatagaaacgagtattttttatgtagatagcgggtacccaaacaaaaaaaaccattaaaatttgttaatttttaataaagttaatcatatttgaatgtattttactaaattttgacaattataacaaataatttttaaatagtttagttgtttgggatatttaggtctaaaattaattgacatatttagatttataattataatcttagataattaattatattaagattaaatataattaatattttggatattaaatttatgtgtaggtttttggatagcctgtttgggaaacaggtaatccctgaaccgactcggtatccacgggtttactaaaattttatccaagtaattttctaaaaccctaacctgtcctaacccagtttttttggttcgggcttagggttgggtatcggatccggttgttttgcccaaccctaaatctggttaatgacggggtcacccgctattgaaggcgagatgtgatattggttaagcacccacaatcgctaatgatctttcatgttataatttctttctaaactgtttttagatcttgaacaaatattagttcacaaaataactaaaatagtaaaatttaatattcgttaaaattggaacaaataaaaaatagtgcattagaaaaacaatttggttttatgcaacttaaattaaaacaacaaaaaagcaattaattggtaaatgtgattattcaccaaattgaagattctgttttaaaggagagaaccaaaaaaataaaccatatacactcaaaaacctaaatatcattcacaagccttaccaaaaaaacaaccctattttagttgttaattagtaacaataatcaagtttttttttaccgttcatagagacaagctaactctatataagcagattaattatgccaacaattctcattatctctcaggacaagtattgataaacaacaagtttctcgtatttccatatatataccttaaacaaaataataag

SEQ ID NO: 13527 - DNA, 3000 bp, Unknown
  misc_feature (1)..( 3000): cDNA_ID_3030579_gDNA_ID_2214634_Annot_ID_188061 3000 nt of promoter + ATG
cactaaacacttaaagaaaattcatacaccacatcacatacatatatttcaaagcatggtagcctataaagtagtacaatcatattgaagtctcaaagctataaacttgtatagatgttattcttacagaacatcgaaattaacctgtccggtgactgggtcaatgccaaacactttggtaggactgctctcaatcaagtcaattttttcctcatctgtcaaagtgttcatcatctcttcattgataataatgtcaggctcatacatatacgtaacagtagctgcaggagaccatttcgcatgatctttcccaattcctttcctagctaatgctttaagcttcaactcttgtcccctgcgtagtttcgcaatgataattcccctgaaaccaaaacaataacagtctaagaaactgcagaaaaaaaagccacagaactaccaaaaggaagactcatgcaaagggcatctaaagatgtcaaattttgtttagcattgtgtaatatctaagcttagcaattccaatcaattcataaagaacaaataatcactacaatgatgaaaagggacttacttgtgctcgcttgaatcagaagtagatgagttactagtgaaatcaacaggagtaacagtaggatcagcactgtagagatccctactagtaacatctagggtttggtcagtaacacacttagcactaaggggaaactcaacagagcagaactcgcaatgttcatctccattacaatcttcacaatcttgacagaaccgcatgctcatagcacgctcgctagtgagagggatgagactaagtcgttgagcaatgaactcgtcgttgagaacagaggaattaacctcgattttgacgagatggattgccatggtggggacttcggagatcattacgcgacggagagcgttggccattgaaacgtcggtttcacgaagctcgaacttggcgtagtcatctttaagctcacggatcttcaccgttgggaatctttggtaggtgacaccgtccatttcaaaagctgttccttctgacgactctgggactcttagggtaatgacttttcgatttcttcgccggagaagaagaagaaatttggagagagcaaagtgagtgagagtggaaaaaggtataagaagaactatagtagtttaagttgggcctatatgggcctattcttttgtttactgggcattttcaggcttctcataacagttattgggaatggtcaaaatgtctacaatggattttctgtttacatcaattcaaataatgacccaatgttattttaagactttttaatctttataatttgaattacataataataattttggaaatacaaatattaaaaagaatcgaaattccatatttttaacagtaacttggattaaaaacattatataaagagtaaaaaggattaaaaatgcattggttcataaagaataatggtaaatttgttgttttaatctttatatagtgtttttccaaaattattctttctaattacaattaaaatttttttacataattaattttaatggtaattatgtgaatggtttcggacaatgtacaagttgtactcatcattattccgcttattttcataattattccgcttattttcattgacacaattaaatcttgacctaaatctaaaagattacatataatatattttatccaacagaaaatataaattatttttaaaaatagaattttagtgggttttggggctttaagtgcactgatcatgtctggtccaaaattctaatattgctttccttttttatttttattttgccaagaaaccaattccgggtttaacttccttgtaaaaccatccttttcatatatatgatatttgcagtttagccaaaaaaaaaaagttgaattttaatcaacatttttaagcacgacggtttcaactagtagtaccatatcgcgggttataccattaccggaatttattagagattttcaaaatttacctgattgaaaattagcggattgtagtgttggagccaaactggattagtgactgagtcatcgggtttaccgggccaaccgcggttccgctcgaatctgaatacatttccctcgtcaaaataaaaaaagtcagaggacgattggtcgatgagaaaaacatttaataaaggaaaaaaaaatgaaaaaacaaatggggcctttggagcgatgtgatgacgtggcaacccccggagactttcaaatagcatattgagagttttacatgcatgtgaatatcaagggtaacatctagagtcatatgaattgcgcgtgttatgtcgttgttagtcgttcatgttaacaataatctacgtataccgtttgtgacttttaaaactaagttcatgaacctattacatatagatcaaaatctggaccataattttattggtgtattgttagaaacttaaagttcatatcactttctctatgtttcgtggcctacttgcaattttttaggaatcttttgaccattagttttttaaacgagtttaggactttgatcactaaggtaaatcgtttaaacaatttgggatcacttaattattgacatgattgtatgttttgattgggcatgtcaaacagatctcaatatttatgtaattacaaattattgcatatttcaatacatcaatgtcatggtcttcacaacgtgcctgacaaatcctagttgtttggattccaaattgttaataattcacaagagctctcccataggaagtttcttcgataattctgaatattatataatacaaaatcacaatttggagtttaaagacttttcttctattaaacaaaatagagtcacgtttggagttcgttgatagtcacaacttaacaatgacacattagaatattcaaagttttatcttattgatcagtgattgacattaaaagttgtaatcaagttatataagcgttgtaaactctttttgaatcatcttcacaaactaaaagtcaacatg

SEQ ID NO: 13528 - DNA, 3000 bp, Unknown
  misc_feature (1)..( 3000): cDNA_ID_3030583_gDNA_ID_2214634_Annot_ID_188059 3000 nt of promoter + ATG
tagagtcttaatgattttaagtgatacaagtatatatgtaaatttcattttatttaatattataaaccatacaaacctagtaaacgttttaagaaaactaacatattaatacataagaagaggacacaagtgtaaactgtaaagagggatcggatagcattttttccttagattataaaaactcaataatccaataaaatcaaatgtgataaaatagaactaaaattcatcatatagcttaagccccccatatataagatcctcacaatgcctaacaaaaggaagaatcttccccgagttagttccccagtcagcttcacatccatgagacggaggagttaggtaacatggctccatcgacttagatcgaacacatggcggattaggagtggtgaaatttgttggctgataaagtaaccatggctttaatcctccaagactatatgaaacatatccaaatgtagaccttgcgctcgtgacaatgttatcggttaagctcaaaagatacatctcagcaagcgccttttggtcgtgacttttcttgtctgtttgctgaactctctctccacttggttgataaacttcaacaatttctcctgttgaacttggtcgctttgaaaacatgttagttaagttgccagagaactctggatagagagatgcgacaagaacagatttgagtttcggggtttttgatatattgacttttgattcctctggtgtagcaaattcaggtaacagtttctctctttgtgtacatgatatgacctggtcaatgacatgtttgaaacgtccatcaggtttgccgaaaacccttatttgaatcccgagtctctcgtcggctttcgacaaatgagcgtggtagtagtcagtgaccatatcccaaacttcatttgtagggtgaaaaagataccgagccaagtggtgaaagacggtttctttctgcgggaacagcttaactagttcggtttggaaagttggattaaaccataacgatggaacaaagtaaacattggcttgaacaatcaaccatgggactttgtcaatcaaactttgatccttttggcatacaaacagcttatcactatcccttgaatcatgaaggttatgcatgtatagatgcggcgggattgaagtcgagttgatggaatgtttttcagacattgttccgtaacaacgaggatattccttattgtagccccaagcataagtataattcagcattggaaagtcaagcggaagcaaccatgaagtacctggaaatggctcgcataagagatcactaacatccttgcggttgtcgacaagaatgattctctcggtcaagagagcgtagaggaaaacagaagcaagagtaagtaatctgtttccaagcccgtaacctgccacccatacaatgtatctgcattcaccatttgattcgcttgcatcatcacgactaagtttctctattgcttctttgtaatattctgtatctggaccacaacgtttgtgaagcatctcatagcttctgagcttagagactagatattcagaaggcttgtacggggatggcttgcggtacaagaaatatttatgatacctactcaagcaagaaccttcatcaaaatccgcagttaaaagccctcctataagtttatccaccggtttttcggtttcctttatgtctactacaacaaaatgaaaacataaaaccaaaatgaggattcattgacttaacaataaaacacaagatatggataattttcttacctttggttgtagcatcaagaagtttgttgttaaagttgtttgagtatgatagtataaatagtaaggaaccaaaggagactgctatcagaactttcatctttagccccaaagtcttaacaattttgccggagatctgaaatttttgatacatgttgacttgagtttgattgtgagatggttcaaaaagagagtacaacttttatatagcttcatttctatgtgtcaatcatagatcagttaaatagacttttgaatactttaatgcgtcattgttaagttgtgactatcaacgacctttgaacgtgattccactttttttttaattgtaaaatgtcttaaattccaaaatgtgattttgtatttatgtatttaataattatcgaatatattgccaataagagagctgttgtgaattattaacgggtgttacattgtcgaaatcttggaatctaaacaactagggattgtctggcacattgtggaaacttgacttaatatagtggaataagcaacaatttgctacttcacaagttcacatacatattgagatctgtttagcatcgctgattttttatccatatacgaatgaagaatgaataacataaagtcatgtgtattgtgctaaaccgatttaccatagtaaaagtcctaaactcgattaacaaacgcttaaaaagtattccaaaacgattgaaaatcggtcttgaaacaatcacaaaattgcatctgaactagaggctctacacaatacaccaataaaaataataaagggaaggctttatggagagagagagcgagtaaactagagtataagttagttttttttttttttttgaaaaaacaaaattgagagtagcagaaaaatctctcccacgcctattacctaggcccattacccgaggcaccatggaaccaactaatacccagatctgaacagtgcaatccctcttttatccactgggcttaagtggcaggtaagatccaacggtataacgctttctccatatgaatgttcatcaatgttcatcaaagttcttctccgaactcctttctctcttgcgcaatctgcattaaagtctcagaaacttctttaccaaggttgttttaccgtctaatctcccatttattggaggtagaaggatatttaagctctctcaaccgtttcaaacttttaaaccctacctcagctgtgttactttcctgcgaagctttaacccaacctgcaagtgcctcctttcactcatcatc

SEQ ID NO: 13529 - DNA, 3000 bp, Unknown; identical to SEQ ID NO: 13525
  misc_feature (1)..( 3000): cDNA_ID_2703224_gDNA_ID_2214634_Annot_ID_188058 3000 nt of promoter + ATG

SEQ ID NO: 13530 - DNA, 3000 bp, Unknown
  misc_feature (1)..( 3000): cDNA_ID_3030609_gDNA_ID_2214634_Annot_ID_188049 3000 nt of promoter + ATG
tgcaaattgtccccgatgcctcaatgaggaggaattaataaaccatgtactattcaaattttcgtatacaactatgatttggagaatttcaaattctccgattatagtaggacaccatttcacggatgatgcagaagaaaatatatcctttctcgttgatactttttcgaacaataatctaatagaccaacagaaactaactcccttgtggctcatctagaagatctgtaaagcaagaaacaattgtgtttaataagttcagagagagtccttcgaaggtggtttcacaaacttaagcaaaagtcaaagagtggattaaaaatgtgacagatacacaggaaatttctgctacaacaagaccatcatcattgataaaacttattgtacaaaacaaattgcttcctatgtcaagagtaattttgatgcatggttccacactaacaatttacctagcgcaaatgagtaagcacaaaaacaccgcgtaagactctaactcaacaaaatatgagttcgccctagttttcttttctctctggcccaaagcccgagagagaccattgaagtgaatcatctctgctatggagttccgccgttacttttcctccgttggtctatctcctccatggaaagtctttctcactcaaagacatcgcctagttgggctgcctccgacgtatctattttccggcgagaatctcttttaacttctctcacttgttgaaaagatcttatgacatgcttgtttaatcacagtctcatgtctctaatgcagccagttgtgccctcggtggtctcccacctgttggaaccaccagatttgtttaagctttcttcgtgtaggattactctggaggctacgccggtcattcaccgagatgggttttttccgttgtctctctttctccagatctcgtggaggcgcttcaccggaaattcctcaactagtgtcttcttcttgggatccgcctttgattcccaaagaattatctcccttcatgggaaatgctacaccgtcgatttttctcttctggctcttcaaaaattcgaacgctttggactcttcaagagtctggtgactccattaacattgggttccctttcggtcactctgtgtgatggacttctcaccactataatctctagattgttagatctggtggttagagatcttgtatcggccgagcatgtctcaccattccaccatcgtgccctaaagtcaaaccaccttctccacctcgtttgagacattcctccgcaaactggaatggttctccgatgatcaacgaccgccctcctctaccctcaaaacgctatagtttctcctagagtttctagtgatggacaaaatttgggcatatttagtagtgggctatgatctggatttgcttctaatgcactttacatatcaaatacccaacccaaaattgtttttgcaagagaacatcttcaaattcctccctctgggagagaccattgttatattatttcgattttttcttaacagagattaatattgtgttgtatctctttccaaaatctagagattgtataccttttgtttttatctttttagaagattctctagaacttgtgggaggatatactcttatgttctcgaatgattacccgatacttttggtgtcagttactgtccattttgtgggtttttggggcaacaattagaaatcgagtattgacatcagcttttagcttttgatgatccggttgttaaaaaccgagacttaacttgataagtttgggccaggatggtatgctcaaaggaggtgtatggtttttgaaaggtgatccctatatgatcatctcatacttgtcggcaacgatgtttggattgcgagagttttctctcgtcgtacttgtgaccacccttttcagagattgggtgtcttggcacttcaggcgcaagtttggaacttcaaaagcatatgaaaccttgtttgtttcgtaaagcgatgtatctcaaggtggctggcttcatggcatcgtgaagcattttgtaataccgagtggctcacctccacgttggaacgcgttattcttaacatctttagatcattttatctcttttttaattgtattttcttattttgttgtttatctatccggatgttgcgtaatgttcaaggtatagcagcatgtgagtacttttatttccatataggtttatcggtttttgtatggttttccttagcggagactcttttatctgtaacttaataaaatggtgttagaaaaaaaaaaaaaaaacatacacatagcgcaagaggatggattattcgggatcatgaaggaacaacaaaagctttgggatcttcatccctagatcatgtgaaaattgaaacatataacactttaatttacttttataatattggaaagaaaacgtgaagatccggaagcaattaccgtaaaatttagaggttaaaaacttcttttctttaaatgaattaagttagagaaaaggcaatttggttaaagaaaatatagtgaaaatttgagagacaagtcagcaaagtacatgtgacaaatggagaatgtttcagttatttgtgaatctattttttatttattatatatagatttcattgttcatataaaagtctgagactcttaaatagttttttcaagatattatatattttaaggtaattatatatagtagttattatttatcagattctaggtatttggcctctaattatgtgtagtagaaagactatataaattaaatttgtaaatatatttaaataatttaaaactttaacttcaagataatatatatagcaagacaaaatgataatatttacataatacaaattatctttttaaaaaaatcctaatataaaaaagtacatatgaaataagatccacatgttttaaatgcatcagacactaagacaagttgtataaataatttttcccacaaaccaaagaagaaccaccaaaatcccaatcacaatcccaattaaacaaacaaaaatg

SEQ ID NO: 13531 - DNA, 3000 bp, Unknown
  misc_feature (1)..( 3000): cDNA_ID_2703244_gDNA_ID_2214634_Annot_ID_136101 3000 nt of promoter + ATG
ccgttgacttaaaataagtatgaaaatagccaaatagccatgggtaaaaaataaattaatctcaaacaaaagataaacatacaacaacgtattgtaatttatataaaaaagagtaaaataagtactaattacacgaaatccaaaaaaaaaaagtcaatattggaatattaacaacttaagagaaatatccaacgagaatcatggggaaaagcaatgtcatttaataaaatagcatgtcatactaaaaaatataggagtaacgtgtgattgttatgcaagtggcgatggtggttgttgatggttacgaaagtggtaatagaaaaacggatttaatgactcttgattgatcatctttatatttttgggggatatgcaaaagtaccatttttgtactacccttttgcaataatacatttttcttttatctatttttaaaaataccccttctcttaagtaaaatgaccaaatgaccctcatctaatgagaactctttaatagttttctatgtaacaaatttttccggctaaaaaaaatgcatttaaaatcattgtaaatattttaagaactctttaaaaaaccttgtaaagttgttaaaaacccttataaatcatttaaaaacctcttaaaatctttataagtctttaaatacatatataaatactttaaaacccgttttaaaacctttgtaaattattttaaaacttcttacaatgattttaaaagatttacaaaagtttttaaagagttttaaaagaatttacaaggattttaaaaaaccttgtaaatctttttaaacccttgtaaatcatttaaaaatattttataaaccctttaataaattttgaaccattttaaaacttttgtgaaccgcttacaaaaggttttaaaaagatttaaaagagtttttaatgggttttaaaacccttgtaaatcttttaaaaatcttttaaaaacccttgtaaatcctttaaaacccttataaaccatttaaaaatattttaaaaatccttgtaaacctttaataatttttgaatcattttaaagctcttgttaacctttacaaaaggttttaaaaagatttacaagagtttttaaaaggttttaaagaaaaattctttctaatacccttttcacagtaccccttttcaattctacccttttctatttaccattttcaattatactctattaaaatttttaataaccattttacccctatttgtaaattgatttaggttaacaaaatgaaatattaatattttcgcctaaaatattccaaaataaaatttcccgccaaaattttcgcgtcaaaaattttcgaaaaagaaatttcccaccaaatttttttttcaaaaacatttttcccgccaaatttttcccgccaaataaaattttcgaaaacatttttcccgtaaaattttttttttggcgagaaatagatttacaagagattttaaaatggttttaaaatattttaaaatatttacaagagattttaaaagggttttaaatatttacaagagattttaaaagggttttaaaagatttacaagggattttaaagggctttaacagacttacaagagtttttaaaagatttttaaagggtttaaaagtgttttaaaatatttacaagagatttttaaagagttttaaaagatgtacaagagtttttaaaagattttaaaagaaattattagaaaaccctttaaaaactattttaaatacgtaccattctttttctaagagttaaaaaatgattgtatagactttataagagttttacaaaggtttaaaatccttgtaaatccttttaaaacttcttaaaaactcttgtaaatcatgttttacccttttataagcttttaaaatccttgtaaatcattctataccacttacttatcttttataagcgattgtaaaccatgcaaaccttttttaaaatcccttgtaaatcattatttgacacctatttatactttgaaaacgattgtaaatcatgttaaccccttttaaaatccattgtaaatcattcaatgccacttacttgtgcttttaaacgattgtaaaccatacaaacacttttaaaatcccttgtaaatcattctatgccacttacttatgctttaaaagcgattgtaaatcatgttttacccttttataagcttttaaaatcccttgtaaatcattccaataccacttacttatacttaaaaaaaacattgtaaaccatgctaaccctttttaaaaatccttgtaaatcattctatgtcacttacttatgctttaaaaacgattgtaaatcatgttttacccttttataagcttttaaaatctcttgtaaatcattcaatgccacttgcttatgctaaaaaacgattgtaaaccatgctaactgtttgtaccgaggttgtaacaataattattaaggggtttggggagaacggagtagcttctttattaatgacgaacggaaaagacggtaatttaacagaacggagaaccgtaagtacagaacggagaaccgaaagtacaaatcggaaaaccagaaaatacaaaacgggaaagcaagagataacagagctaggcaactattctctcttaaattctctaggtaataactcctgctcccttttcccaatagtgtcttctgctatttataggctaggagctgacctagggtctcccctgcggttttacgtttttaccctctcaagtttgtcgggctgggccgagcagctttcatctgagccgacttgatgttgttgggccgagcagctctcatttgggccgagccggacgatctgatgggccgttcttctgatgggccgttcttctgatgggcgttcttctgatgggccgttttgacttattcattttgtgcttgggccaaactgggcatgaagggcaaggcccgtatcccacaattagtccccccctaatccggtaaatgagagcttgctcgaagtcggcgggtttctgtttgaaactaggatcatg

SEQ ID NO: 13532 - DNA, 3000 bp, Unknown; identical to SEQ ID NO: 13526
  misc_feature (1)..( 3000): cDNA_ID_2703248_gDNA_ID_2214634_Annot_ID_136104 3000 nt of promoter + ATG

SEQ ID NO: 13533 - DNA, 532 bp, Unknown
  misc_feature (1)..( 532): cDNA_ID_2685649_gDNA_ID_2214635_Annot_ID_136105 3000 nt of promoter + ATG
atcaagaatagttaaatcatacatgtgtgaacttaaacttttaatcattgaagttatcaatcagctcacgaggcaattcatatgcgaatcaaaagatggatttcttgaaacttaagaacactactgtgttcaatatacaaattatgaccacaagatttgatcataaacttaatttttacaatggaagttagagagcgaaaatgatgcgttctcgtctccaaatcaaaccatgaccagttcactgatccagagtaaaataggacttcatgtggtggaacagaacaacaatcaagaagagtagttaaatcatcatacatgtatattgctttatttttttttgtttgtttgtgcaaattgtgttttgttgataatcaacgcacactatgatccatacgttaatgggctttggaattgagggcccattgtaataatcaacacaaaaccctaagaaatggataaagtataaagcttcattttttacactgcaaacgccgtttcgagacttccggcgaagaagacgaacgcaaagatg

SEQ ID NO: 13534 - DNA, 3000 bp, Unknown
  misc_feature (1)..( 3000): cDNA_ID_2703280_gDNA_ID_2214635_Annot_ID_136108 3000 nt of promoter + ATG
tcgaatataaaatttgatacacttttgttttcttcttcatgctgaccttaatagtcagcaggaagttattaatatgaatttaaaaactgggataacaacaactaattaaattatacaaattaacacagataatggtaacaactattaagttatcatcagctctcgttgtatagaagccggcatacagagccggctagagaatcattcttttctacaaatatacaatcatatgtctctctctagtcaaatatataaaacataatattgttatgattttacttaacatagatgacacataatacaatatttttgttaaaactatatgacatatgagattatccactttatatcgacattgaatcatcgacatacctacaaatttcagtattattcgacataacttttcgttatttgaagaattattattattatttttaagacacaacttagtacttaactatggatgatttggtatttacaaaacaaatttgtattctttataaccactcaaactaaccacatttgaatgatgtccggtttctttaatgagatatcaatcaacaaattcacgcatatatgtcaacatgcaattagtgactccaactctcatattattatataggtaggtatatcttatacacttaaatacgacactactttatgacatcttacctactactaaaacaatatgttcatgcttagatgcacatgcaaatatgtaagaaacatcacttaaaagaaaaagagttcatcaaaacaaaacaccatattattatatggattccataattttgttttcatccactaatttaaaataatattcagcttatatttatgtatatatccgataagacactggatgatcaccaactttttactcttatgtgaacttgaatattcggtcatcagaaaaatcattaataactattggtttatttttgtaaaacaagcaatcatgtcgatgattaaagggccatatatttaatcttgaatcaggaatgacaattcatatattaaactaaatgtcacgggccgtatatacgaatacgtacgaacctccgtgataacctatcgcttgcgtaaggtactaaggtaaaataataggtggtgcaattttagtctcaaaagacacatatcacgtaaccatgatttgcgacgagatatatgcattttgattatcaaaactatataataatttgaaaaactacatttctctctgccaagaaatgcaccccactattcgaagtcaacacagacaaaaaaataaatacgaacacaaaaatgaattaaagtcaaaagctcgctagttctctttttattatattgttatacatctcatctagtatataatcaccaaccatcttcttcttccattttcttcatcttcataatctcatttcctctacgagtttctagcgtaaaaaaactaaatacttgtctttaaagaagaaaaatgctaggaaaaagaatagcttccttcaagaacttagcaaagaaaatgaagagcatcaacacgacgacgagaagcggaggagaaggcggctcggagtcaacttataacgagtctcttctgatgaatgaggcggacgaggcggcgatgatggcgtcaaagacgccgacggggacgtttgcggtgtacgtaggggaagagcgcgtgaagcgcgtggtaccaacaagctacttgaatcatcctctcttcaggatgctcctcgacaagtctcacgacgagtttctctgtttcgagcagaaggttatgttggtggtcccttgcagcctctccgttttccaagacgttgttaacgccgtcgagtcttgtaatggcaacttcgatttcggcgagtttgtcgaggagtttctataaatttaattccgacttcttcttcataattatgatttgtcctcaagacattgtcttaggtctttttttaggaaactatatattcgtaggattgatcgattgattgtgaaatttgtgatacattgtaacacccctttgttgcgtggtgtggaatttgtaaatttttccataattatgatacatattattttactttaaaacatatattagttcaaaaaatcaaatacataaagttttatctatttgtgtttcccattatcgagaaaaaataaaatctatttgtgtttcctagccttcttttgaccttaacgtttggtcccttttatggttcaaacatgttggtgagttgagtcagaagcttgtctcgaatcgtaaccctactccgagtctgtgacactgaaaagtttgaaaggctaatgagagttgagtcagaagcttgtgtatgtttaagtttgcgtttacaaatttataaaataatgtttcaaagttttttaaacataaataaaacagagacacatacatcaaaccttgctttttgaaacaatctaatcttaaaatttcatgatcttggaactttatttatgtttggaataaaaaattattagtacaacaaatatgaaaagtgttaatagattacaagatgcataattgcataccacgcagttcacgctaagctacttgccgatgacgactccaaaaaagttatcagcagttttttttttttttggtagcatcagatttggtttgacaaaaacataaatggagtacttgttccaacttgacaacttccaaggataacaaaaaatctgctgacatttgggccttaatgggccaatacgtagaatatggacattaggacacgtcatcgtcggcatgtagaaggaaagggcaaaatggtaaaagagtaatgaagaagcgttaaaattcaaaagagaaaaagaggagcggctcttcaaataatttcaaatctcatatccaccccgctctctctctctctacacctcagattccgtcgccggtgagacagaataagagagaatttcaaatatcgaagaaatttgggatcttgctgagcagtacaagtaattggattttgaaaatcagtctcactggattcgccgtccgttcgccgtttaaaaatg

SEQ ID NO: 13535 - DNA, 3000 bp, Unknown
  misc_feature (1)..( 3000): cDNA_ID_3030645_gDNA_ID_2214635_Annot_ID_136113 3000 nt of promoter + ATG
ccattgtactttaatatataatttagtgaacaagtcttaagaactgtttaggcctgtaaagcccgaaagaattagtattagtaatatataaagtttgtattgaatatgggatgatgaaacgatctagcttccagaaaaagtcttaattacacaacataataataactaccaaacgtgtcaacgctcccgtattcgtccactaacattctcccatgaaccctaagttataagtcctccaaggctacgatcacatttacaagcggaaaattgttgtgtttgatttgtttcttgttttattctcactctaagcctctggttatatagcattttttggcggaaaagctaatcgcaaaacatgagattataattatgcgacatgtcaaattgttatgaaaacattttatataataagaaatttatttggtatagtatcatatgaaacaaagagtcaatacaatatcaatgtcattatatgtgctcattatgttaagttgagtcaaggcactttactaagaacacttcaataattatatttaactatttctgtgtattcatacgtatgatacaaggtttggtgttctatatactttatcctcatcccttgaattttagttgggccaaaataatgacattaaaattataatatgttgctatataaaaaattgttacaatttggatgcaacatagagagatcattagcgagacattgggtggatcgtgcaattcatttctgttttgtcaactagcaattcaaattatggcgacattatatacattaatccatattacacaaaaactaataaactatatatgtcttggattcaaatagaagaaataaaagtcaacgagtttgccctataaatgattctatgctttcaaatagttagctacaagctcatcaatctctgctctattaaaaaaagaagaagaagcaaacacaaaacaacaacaaagaaatatggcaaagctcatagttaacttctctgctctcttgatgatcatcttgttggtttctaatggtaattttaagattttcttaacttcctttgtcctatattaatatcgatatggatgtgaaaagattaatgtgagaatggttaaaacaggactcccaaaggcggtagcccaaacatgctttaaaggtgaagctcaagagggtgtgtgtgttaaagttgacggctcaaaattgtgtgaccttctttgcagggcaaccaacacaacttggtttggggcatgtgaagtggaagacaacgagacgcactgtcactgctacggaccttgttaagtatctcatccggacgcaaaaccaaatatgaaacgtgaataattgtgtatcagtacctaaataatgtgtgcattgcttatgatcaatgtcacatatctacatgtgtgttccatgtttgtgtgtttttattttatcgctttcaataaatttgcatcagcaccgtaaatgtagctgatgcgataaatgaatgtaagattaaatctgtttattatgtttgcttttggtgttccattatctctcctatatatatgtcctcttctttttcttcattcttgtcattaatctatatgtatgtgctattttttgttgaacaaaggctaatgagtcttatctataacaccaaatcaactcctaatagtaatagaactcttaacctaaactcaaaagaagtaaagtacaaggaaaactctaatcaaaagttcaaaaccatattcctaaaccatgaaacataaaggaatatcacaacctcgaaactcttttgccgtaacgactagagttgctttttgtttttagttaattcaaatgatgacattattgttccaactatgtaatgtagccaccacatttttcttgtaattttttttgtttccttcataaaattcatttagcaaatttacacaaaaaattcaatgaaagtacatgaaatgaaatttaaagtacaatcatttcccatagttttttttcttaccaacaccaacataacagtgataaattggaacaaaattttaccaaaataaaaataaaaattttatgaacaaaagcattttttatatattttttaattattgggggtttaatgaatttgagatatttactagtcagaaaacaccaaaaccctccgtttcgtgggtttcctccagaccttgagctccttgttcaattcacactttttctctcccaactcttcttccaggtttcctctgctactctcaggtttctcttctccacttccctccagctttatccttttgatttcgtcctccatcttactgtatttacccaaaaatctaagcttttctcagtgttcttccatttctctactttgttttcatgtaatgctgcaaacttcgcaatacccatcttcaatttcttcaattcgtaatgggaaaaagcattttagtttaatttgggttttgtggttcctcacttgtttcattcttctaagtcttaaaccatccactgattctcaatttctgaggatttgatatctattgctggttaacaatggagcatagatgcgactgggttttgtttatgttaactttatgaatgtaaatcacactgctttgtggctactttgtggatttcgtgttttactttgtggctgaatcatataactctaaattgagagctttgggtttgaccatttagctttttatgaacaggtcttgttagggaagtaatcagtggaattggatttagtcttttggttctgaattttgtaaagtcctgcagtgattggtctcattatggcaacttacgtttcaccgtgttttactccttcggattctcggttactaactgttcttagaaagaatgttttaccggagaatcatttaggcaggttgaactccattagaacgattgacagtaagaaaaaccgagttgttgttgccgctcagaaatctgaatcttctccaatcagaaactctccacggcattaccaaagccaagctcaagatcctttcttgaaccttcacccggaaatatctatg

SEQ ID NO: 13536 - DNA, 3000 bp, Unknown
  misc_feature (1)..( 3000): cDNA_ID_2703272_gDNA_ID_2214635_Annot_ID_136116 3000 nt of promoter + ATG
ctggtccgatctttctgtaccttgcgctttgcttatttcagttgttagctggtaagatccagttcggtgtcatacttggatggatcgtcgtctcctctatctttctatacgtcgtctttaacatgcttgctggtagaaatgggaaccttaatctccatacgtgtacgagcttggtcggatactgtttgcttccggtggtggttttatcggcggtgtcattgttcgttccccagggagcagggccggttcggtttgtgcttgcggctttgtttgtgttgtggtccactagagcctgctctacattggtggtatctcttgctgatggtggagaagagcaccgtggcttgatcgcgtacgcttgtttcttgatctatactctcttctctcttcttgttatattttgattccatattgatagatcgtgaatcacttccgatgctgtgttagcaagtagcaaaaaaaggctgcaatataagttctttgatgtgaggttgaattgggtgggaatagcacggtgtgtaaaggcttttttggataaatttagaaaggtgtttaagaaatttgattcaatgtttgtatctgtcacttgatctttaaggttcttacttaagaattatttatacaatttggtcgatatgtcttttgacatagtttgttcctggacattagatttgtgagagtattggaattgatgttgcggatgatatgcttctgtactaatgcagaagaggtttatatgcttcctatttcatgtttattttgctatttactttcccggtgtgaggctatgaagatgtgctgacttcttgcttggattatacttaaaggtcccaagttttaggaatgattggcattagatttgcttaaagtatggctccatgtaggtagagtagaattttgagttggttttagagctgttggaaacttaggcatagtctaatgaaagagtgattagtatttagtggtttgctcggtgttggtatgttccctgattaggtggcatagataagtagggacatgggatcttggcttcaggttcgtcttctactgtcaatcccagaactgcacttacttttcctgatagtatttgctgtgtcacggaaattagagagagatttatccgcaattcatactctcttagatggaatttgttttaatgtgtcgagaagaatcagctatgtccaattgagtgagcatagtatttgtcagctttaccttctcctaaaacattcagtagaactggtgttagaaatgatctctatattttcgtgttgcaacactcgttccgagggaaccatttttgtgttccaccttttctttagaatccaaattgactcaaaggggagtaggcaattgttttaaacatacaatgtaaagatgtaaaatttctgatatatctggtggatgtacttaagacataccctacaatttcgatccttggactcaattgaaaccaaacttttaggcggcttggtctctcccttaccaggatcttgtcaaaggaaaccatatatactcatactcacctagttcttccatgatatccagatagtgataaaccatctgattaaacactcgtaacacttgcatatattgacaagattatctctcaagtgtctataagatacgtatttgtgtttcaaggtaaaattgtaagatatacatctgattaagtattcttactctcaattctttgattatcaacatagagaacccctctagaccaaaccaaatcactccaacctcttgatgttgccggtacggcattagagatttcggcagctggtaatagacagttggccagtaaaacgctacctgttctcgccggtaatctctggcaatcatacggtggagatgtggccgtatcactgacggcctccaggtttatctcgaacagatcatcttcgccgtcttcttcactacttccctcgccatcgtgttcaggttcgtttgcttcttgtttctcctcttcttctgttccacggttaaccaaaccaacacaacgtgtcattgttgattttgaaataatttccggtttaagagtccttgtggttttaaacttgattatgtggttaatacgtatatataaaggtgattaaagtagaaggtgggttagtagaacggtcctcaacgaatatacaactatctttgttgggaatttttgggtcttccaaaagattttttttatacaaagaagaaagtaaattccaaaagaaatttgttatagactcgtgacttgagatcgagaataataataacttgagtacattaaatgtgtacggtgcaacagtcactgtttagatctaactatattaatagctacttccgaataatatatgtttaggacttaggagcaaatgataacttctcttattgtttctcagttcgttgccacaaacatgtagtcaccaaaacgagtctatttttacttgtgactatagcacaacatccaatcgaattacacgaaccggttcaagatattgaatcctaagcttttctcaaaagtcgattccaattccgaatgtaattgtagagtgcatcaacgacatcattgtcaaaaataaatgataataattatataatggtattatactataaaaggttttatggaggagaaggtacacctaacacgaatcaaatatatacctaccaacatataaacacacactcttttgtttaataaactttgcacaatttttattttcactttttccgttttttcgggtctaattttctatttcggttgtaaagataataactttttttctattataataatttactcgtaaattaatcaacgaattacgtggcttaaggatattcacatctcaatcctattacgttgggttaattcacaaacaaacaaaacaagacacgaccaaagttacaagtaaaccaaacaaaatctaacctgtgcgtgttaattagaccaaacctctctcttctctcacttcccagctacttctctctctcgcgctctctctttcttttttggcaatg

SEQ ID NO: 13537 - DNA, 3000 bp, Unknown
  misc_feature (1)..( 3000): cDNA_ID_2703289_gDNA_ID_2214635_Annot_ID_136118 3000 nt of promoter + ATG
gttttctcggcaaccaaacagaaatgaagaagagattgggacacaaaaatataaaaagagagaaagagagagagagagagagagatgtgttaccttgttgttgttgattcactgaattctataatgggtggaaacagagagagagagaaacttaacggcgaaatgatgatgatgaagatgatgatggacaaacaaataaaataaaaagtattctttaattctatgatatttttgagaggtctatttttacaaaaaaaatgtttgtttggtggtgccaaattctattattgatttttgaaacagtgtttgataatgataccttggttaaaagaaaaaaaaaatcattcaattggatgactatatagttttatgttgaaatgtgtatggggggttacaaaaatgtatattgtgtagcaaagaaaaagacaggttggaagaggagccaaatttgaagtccatccactagtaatcttatcctcactctctctattttatatagttttgtgttcacaacttcacataccctttcgatgtcaccatatgggcacaaaaactattaatattttgcccaaaattggatgatatttgttttttatttccaatttttgataagttattttatatatcactgttgatacaaagttgcatttatccatatctttgtcaagctgactagtttctttatcactagattataatttaatggttcataaatcttagtcttcatgtgattttttttttctaaatataagttgtagaaaattgctttgtttacaacaagactctatagagtttttaaattagactaacatacatatacataggaacaaatatagttttctttttgtgagaatgtaaggtaataatagtatgtgcaaatgtggtagacaagtgttgcttaagatccacttccatctaatctaatatatatttagtcgagttagcataaattaaaatctagtaatgttttcagaacaatgagtagtaaatcgtttatacgtttaatcagaagtagtgtttaaacaaatagagagataatggagaaggttgggctataacaattggcataatcccattttcggccgccaagattctcgtccgtcccatgttcccactttactttccaagttttgtcaatttatgatatcttttgacatggaccttcattattggttttatgtcggctacaatttcatttgtgtgttttattattatttcagaagtagtgtttaatttatctaattatcttttacatgtgttcggccagatatttatctttccgactgtaaggtgcaagctcagtatcattatggcatgagcatttgttagtgacttggatagtgcgtggatattagtcgtctataaatgtatcaacctgataagttaaacatgtgatttactttgagaaagagattgcatcattatgttggtgctttcacagtcgacatacccatcaagtcttcttttcaggaaagtctatgtaacccattactgggtttatagtttaccctggaggaactactcataaccacccttgtcttcaatcattttacgtaagcacaacaatacaaagagagccgagagattatttttgacatgatataaacatagagacaaaatgaaagtaatatttcaatcagaaaaatatcacaaaccaacatcaacaaaacaaattaatataaacattactcttaagatgtacatatacttacacaactttaaataactttctaatgaagcagcatgatgataggttacctcaatatattgactcgagaagaagaaaaataaaagaagcgtaattgttgttagtaccgattttattttaggcccaatataatttgggctttttatgttacgtataagtaaaatttaagttttgaatgaaaaagtgggtaacgcatgcgtgaacgaaataaacgtctagtcaaaatgcgtcgttggtgacatattcaatccacaactgttgtagttgggaacatgtgacgtaacaggttccttcctcccaatttcccaatctaataattgttttacatatattctagttactgtattattctgtgggatccttaattttattatttgcttcaccaaaccgtcttaatcccacgaaagttacattttaatcaagaaaaaaacacatgaaaatcctttttcaccttataaattatgtcattatataaaaagcctagtaatcaattccttatttctaaggaaaatttgtagataattcaatttaagaaagggtttatcgtgaaagataattttagcatgattggttaacttataaatgtggcttaaaataaggttagattatttttatatatacatctgtcatcgcaaaaagagggaaaacaaaaaataagaaaattgtggctggacgactcagcaattcgtcgtcttctttccatatatcttgtttattatttcataactaatccacttcgattctgctttttatataaagttgaggtttttgagctattttttctcctaaaggattccgaaaaaagcttagacctttttgatctgatacgtatctataaatctggaaaggagctgagagtttcaaggggttttaatttcgctgagaaaacgtttaattatctttgtcgagatggattgtggtatggagaattgtaatggtgggatctcaaacggtgacgttttgggtaagcatgagaagctcattatcgatacagacccaggaattggtgagcttcttcttcccctgttttgattacgtcttttagtaaatggatcttcaggcagagtaggatttaacctcagaaagcttccaactttgtttaatttgaatagaaatatttagatggttatctcttgaatctgtttttgtgtgctcatttacttgtaaagttcaatgctttgcttaatagaaagattcaggggaaattgttcttttttgtgtgttgacttttttccaaatgactgttcaataggatcagttctaacattagtgtatgattagatgatagcatg

SEQ ID NO: 13538 - DNA, 3000 bp, Unknown
  misc_feature (1)..( 3000): cDNA_ID_2703300_gDNA_ID_2214635_Annot_ID_188098 3000 nt of promoter + ATG
gatgacacactcacgaggaaccgtgaggttgaagttgaggcgatgctcagtaggagaaagcaactaaggacaacaacgacgaggacaacaacgacgaggacaacaccattgagcttgtcttcctctgcttcaaagatgaactggtctaaaaacgatgagcttgtcattctcggggttagttagtaaattctttgcagcttctctatattcttctttatcctcttctaactttttttactctattttgtgtgtgtgtgtaaaagggtattgtggactatgagaatgaaacgaaattgagctatagatctgactgggatgccttgtaccgttatatcaaagattgtgtagaagcaaagttttcgaagattcagctcatcaataaggtcaagaacatgaagagaaagtttacatacaatcaggggagatctaaccatggggaacaactttcttttactaatactgatgatgatgaaatcttcaaattgtcattgatcatatgggacaagaatgaatcagagtatgtttctaatgagaatatagaccaagctaaggtgagtgtctttgttctgtttttcaacaatctcttagactactaatgtgcaatgaattaatgatcttgttttcttgatttgcataaggatgttccttctggtgagccagagactaatgatgtgccttgtgaggagcaagacgatagggatgtgccttgtgaggagcaagagcgagcgaatatcgagattgataatggtgtgagagagaaattggaccaagccaaggtgagtgtgttagttctgttttttctaccaatctccttgttaccatcttaaaacatgatgtaaaaaattgtgttactaatgatgtgcaatgaattaatgatcttgttttcttgttttgaataaggatgttccttgtgtggagcaagagagtgaggatgtgccttgtgtggagcaagagcgggtgagtatagagattgataatggtgagaaagagaaattggaccaaaccatggtgagtgtgtttgttctgtttctaccgatcttcttattaccacctcaaaacatgatttattgatcttggtttcttgttttgagtaaggattgtgaggagcaagagaatacggatgtgctttgtgaggagaaaggcgataaggatgtaccttgtgaggagcaagagaataaggatgtgccttgtgaggagcaagagcgggtgagtatcgagattgataatggtgaggaagagatgagtagcgaagaagatggtgtggatgaggtaggtgttatggaggacacacttgattctgggatatcgtttcaaggtttaggtaaaaatggtgtgaaagacaagagtgaagaagatgatgtggttgagttgggtgttctccaggagatatttaaggaggatacattttttcaaagtttaggtagatatcaacaaaaattgctgcttcagaatttggaaaacgttggagttgaaagaagaaaagagctcatcaacgaatggaaggcattgtttgttgatgagcagcgattgtgtgtcaagaaactaactttcgccgcaaagcttgcaaacttaggagtttctccttgattcaatgaagaaaaatctctgcttttggaatgatctcatttttttttggttgtgtcatattgataagaaaaaacatgatgtatccacgatccgttcttgttctagagccaggtaactgaggtaagtaacagttagagctaaccatagcagattctcctttttttagtgttgtgtttgtttcgactcttccttttgggttgggcttcgataacgattgttcaggcccactaacattcttttcttattgtgcgtctgtctctttcgagaaaaagacacaagcacttaaagccaagattcgcattttgccacatgccactaatttcaccttgtgttagatattatttttgtactacacactcaacgaagaccatagatcaactcaaaatatttattacacaacaattatcggagaagagattgatgtgaaatgtaatgaagacgaaaagaaaataaaaaaagaaacgacgaatttggacgtaattttcagccaaaacatatgctttgggtcccacactttcacatttcaactttatcatcacaccgaaacactaaacaccaaaatccccgacaaatttaaagaaaatttttccattttttttttttactctatctctgtgagagattctcttcaagctcaggcctttaggctttaggtttcttttgggagtcttcttgagctctgtaatcactctctagaagcttattttgcctcctaatgttattaggtacgtctttgtatctgtacttgcttctgcatttttcgatatttgtttcttttgatgagatttggggactcttccttcagaaggatttgaagattttgacatcttccattaaaagttgaatctttacttaagctagtgttcttagcattctgtttatgttagcttcatgagatctgggatctcgaggctgctttttttttttgctttgatttcacatttaatgggttttgattacattttcattaggtgaagtgagttgaacttggcttgtggttttgatgaatttctttctattaaaagttttggtttccctaccaaaaaaatgtcttctttttgttaattaaagtctaaaagtagctaatctctatctgtacttgtgtagggttcatcatttgagtctataactataatgactttcactgttcatttcctttttaaatctcttgttgtttccctttccttactttgttcatcatttctccttccctttactcaatagacactgctcttcctttggattattgctctgtgagttatttaaaataagccataaggtctcttcttatgattgttgcagggtgttgtactggaattattaggatgaaccaaggaagatgagtctctcggtctttcaaaaaccaagtcttgtaatgaggagctgtccactgttgtaaagtaagtcattaag

SEQ ID NO: 13539 - DNA, 3000 bp, Unknown
  misc_feature (1)..( 3000): cDNA_ID_3030617_gDNA_ID_2214635_Annot_ID_188093 3000 nt of promoter + ATG
ctctgtcttcttcgtcgtcgggatctctaactccgccgcgtagttttcgagaacaggtgcgatcaccggagagagagatgattcgacggttgatttcatggaagcttgttgttgttgtttgagacagagatcgccgtaacagtttgaacatagattcattgtcgctgagcttccgaagaaaccgcagttgttaacgcagagacggtgaccttcaggcgtctcgcatcgatgttcttccgccataattatttaaaagaacagatcttgaagaaagttttttggagaaaagtaatgaatctgaaacaaaacaaagaagagagaattaacgtgggaaagttttgaatatggtcaccgagtttttttgcagaaaagtttcctgcgttttctcggcaaccaaacagaaatgaagaagagattgggacacaaaaatataaaaagagagaaagagagagagagagagagagatgtgttaccttgttgttgttgattcactgaattctataatgggtggaaacagagagagagagaaacttaacggcgaaatgatgatgatgaagatgatgatggacaaacaaataaaataaaaagtattctttaattctatgatatttttgagaggtctatttttacaaaaaaaatgtttgtttggtggtgccaaattctattattgatttttgaaacagtgtttgataatgataccttggttaaaagaaaaaaaaaatcattcaattggatgactatatagttttatgttgaaatgtgtatggggggttacaaaaatgtatattgtgtagcaaagaaaaagacaggttggaagaggagccaaatttgaagtccatccactagtaatcttatcctcactctctctattttatatagttttgtgttcacaacttcacataccctttcgatgtcaccatatgggcacaaaaactattaatattttgcccaaaattggatgatatttgttttttatttccaatttttgataagttattttatatatcactgttgatacaaagttgcatttatccatatctttgtcaagctgactagtttctttatcactagattataatttaatggttcataaatcttagtcttcatgtgattttttttttctaaatataagttgtagaaaattgctttgtttacaacaagactctatagagtttttaaattagactaacatacatatacataggaacaaatatagttttctttttgtgagaatgtaaggtaataatagtatgtgcaaatgtggtagacaagtgttgcttaagatccacttccatctaatctaatatatatttagtcgagttagcataaattaaaatctagtaatgttttcagaacaatgagtagtaaatcgtttatacgtttaatcagaagtagtgtttaaacaaatagagagataatggagaaggttgggctataacaattggcataatcccattttcggccgccaagattctcgtccgtcccatgttcccactttactttccaagttttgtcaatttatgatatcttttgacatggaccttcattattggttttatgtcggctacaatttcatttgtgtgttttattattatttcagaagtagtgtttaatttatctaattatcttttacatgtgttcggccagatatttatctttccgactgtaaggtgcaagctcagtatcattatggcatgagcatttgttagtgacttggatagtgcgtggatattagtcgtctataaatgtatcaacctgataagttaaacatgtgatttactttgagaaagagattgcatcattatgttggtgctttcacagtcgacatacccatcaagtcttcttttcaggaaagtctatgtaacccattactgggtttatagtttaccctggaggaactactcataaccacccttgtcttcaatcattttacgtaagcacaacaatacaaagagagccgagagattatttttgacatgatataaacatagagacaaaatgaaagtaatatttcaatcagaaaaatatcacaaaccaacatcaacaaaacaaattaatataaacattactcttaagatgtacatatacttacacaactttaaataactttctaatgaagcagcatgatgataggttacctcaatatattgactcgagaagaagaaaaataaaagaagcgtaattgttgttagtaccgattttattttaggcccaatataatttgggctttttatgttacgtataagtaaaatttaagttttgaatgaaaaagtgggtaacgcatgcgtgaacgaaataaacgtctagtcaaaatgcgtcgttggtgacatattcaatccacaactgttgtagttgggaacatgtgacgtaacaggttccttcctcccaatttcccaatctaataattgttttacatatattctagttactgtattattctgtgggatccttaattttattatttgcttcaccaaaccgtcttaatcccacgaaagttacattttaatcaagaaaaaaacacatgaaaatcctttttcaccttataaattatgtcattatataaaaagcctagtaatcaattccttatttctaaggaaaatttgtagataattcaatttaagaaagggtttatcgtgaaagataattttagcatgattggttaacttataaatgtggcttaaaataaggttagattatttttatatatacatctgtcatcgcaaaaagagggaaaacaaaaaataagaaaattgtggctggacgactcagcaattcgtcgtcttctttccatatatcttgtttattatttcataactaatccacttcgattctgctttttatataaagttgaggtttttgagctattttttctcctaaaggattccgaaaaaagcttagacctttttgatctgatacgtatctataaatctggaaaggagctgagagtttcaaggggttttaatttcgctgagaaaacgtttaattatctttgtcgagatg

SEQ ID NO: 13540 - DNA, 3000 bp, Unknown
  misc_feature (1)..( 3000): cDNA_ID_3030624_gDNA_ID_2214635_Annot_ID_188091 3000 nt of promoter + ATG
attcccaacaaagatagttgtatattcgttgaggaccgttctactaacccaccttctactttaatcacctttatatatacgtattaaccacataatcaagtttaaaaccacaaggactcttaaaccggaaattatttcaaaatcaacaatgacacgttgtgttggtttggttaaccgtggaacagaagaagaggagaaacaagaagcaaacgaacctgaacacgatggcgagggaagtagtgaagaagacggcgaagatgatctgttcgagataaacctggaggccgtcagtgatacggccacatctccaccgtatgattgccagagattaccggcgagaacaggtagcgttttactggccaactgtctattaccagctgccgaaatctctaatgccgtaccggcaacatcaagaggttggagtgatttggtttggtctagaggggttctctatgttgataatcaaagaattgagagtaagaatacttaatcagatgtatatcttacaattttaccttgaaacacaaatacgtatcttatagacacttgagagataatcttgtcaatatatgcaagtgttacgagtgtttaatcagatggtttatcactatctggatatcatggaagaactaggtgagtatgagtatatatggtttcctttgacaagatcctggtaagggagagaccaagccgcctaaaagtttggtttcaattgagtccaaggatcgaaattgtagggtatgtcttaagtacatccaccagatatatcagaaattttacatctttacattgtatgtttaaaacaattgcctactcccctttgagtcaatttggattctaaagaaaaggtggaacacaaaaatggttccctcggaacgagtgttgcaacacgaaaatatagagatcatttctaacaccagttctactgaatgttttaggagaaggtaaagctgacaaatactatgctcactcaattggacatagctgattcttctcgacacattaaaacaaattccatctaagagagtatgaattgcggataaatctctctctaatttccgtgacacagcaaatactatcaggaaaagtaagtgcagttctgggattgacagtagaagacgaacctgaagccaagatcccatgtccctacttatctatgccacctaatcagggaacataccaacaccgagcaaaccactaaatactaatcactctttcattagactatgcctaagtttccaacagctctaaaaccaactcaaaattctactctacctacatggagccatactttaagcaaatctaatgccaatcattcctaaaacttgggacctttaagtataatccaagcaagaagtcagcacatcttcatagcctcacaccgggaaagtaaatagcaaaataaacatgaaataggaagcatataaacctcttctgcattagtacagaagcatatcatccgcaacatcaattccaatactctcacaaatctaatgtccaggaacaaactatgtcaaaagacatatcgaccaaattgtataaataattcttaagtaagaaccttaaagatcaagtgacagatacaaacattgaatcaaatttcttaaacacctttctaaatttatccaaaaaagcctttacacaccgtgctattcccacccaattcaacctcacatcaaagaacttatattgcagcctttttttgctacttgctaacacagcatcggaagtgattcacgatctatcaatatggaatcaaaatataacaagaagagagaagagagtatagatcaagaaacaagcgtacgcgatcaagccacggtgctcttctccaccatcagcaagagataccaccaatgtagagcaggctctagtggaccacaacacaaacaaagccgcaagcacaaaccgaaccggccctgctccctggggaacgaacaatgacaccgccgataaaaccaccaccggaagcaaacagtatccgaccaagctcgtacacgtatggagattaaggttcccatttctaccagcaagcatgttaaagacgacgtatagaaagatagaggagacgacgatccatccaagtatgacaccgaactggatcttaccagctaacaactgaaataagcaaagcgcaaggtacagaaagatcggaccagatagatctgaatctttgtgaacagcttggttaatccgaaaaggattgagaatcgatctagtcttcttccagatttgatctggatggataccgagctcgtcgagtaatggctcctcatcttcaaacgaagctgaacctccaccaaaagaagaagaggaagcgattgtcccgccgaatggtccggcaggtgtagcggaagacgcggctgcggatccaatgtcgaatgacatgaaagggattgcggaagaagagggacgcggcggttgaaacggtgtcgctgggaatcttcgttgctggacattagcaccgcctgaagatccaccggaggggaaaactacaggtggaactgcgaaatccttcgtcatcttctttccgaaattgagatctcaccaaatcagcaaagagattcgaaattagggtttcaagtttggatcaatgagatgaattttttaacccaattcacacgttcgtgacgtttcagagaaaattcctttcttttttttgttctcttcttcttcttgacagtgaagagacaactttagaagaaggcatctgagggtagtttcgtcattccgtctagttaatgacgaaatataaccaataggcttcttcgaaactggcatggtgacgtatatcttctgatgatattaccgttataccctcttttataaacgaaattggcccaatgggtctgttcggcccagtagtcatccgttttagtctataacgtggcacgatgtaattggttaaagattagaagaccgccggactaagatttaaccagcggtgacttcgacacttattagccggtatatttcttcgccggagcttcctcaacgatt

SEQ ID NO: 13541 - DNA, 3000 bp, Unknown; identical to SEQ ID NO: 13536
  misc_feature (1)..( 3000): cDNA_ID_2703272_gDNA_ID_2214635_Annot_ID_188088 3000 nt of promoter + ATG

SEQ ID NO: 13542 - DNA, 3000 bp, Unknown
  misc_feature (1)..( 3000): cDNA_ID_3030645_gDNA_ID_2214635_Annot_ID_188083 3000 nt of promoter + ATG
acgggcgtaattgaggacgtaagataggccattgcatcctttggcttcaacagcaaggcggaggaaaggtttttgctgatgctgcagaagttggcgaatcctcgcagccgccgtgtcactcaatgctaatacttgctttctcatcgccgaccaaatattcgaggatttcaaatttgtgctaaagatttttcagagaggaagaagacgtccaagcaaatttgttacaagttgatatttaaagagccattgtactttaatatataatttagtgaacaagtcttaagaactgtttaggcctgtaaagcccgaaagaattagtattagtaatatataaagtttgtattgaatatgggatgatgaaacgatctagcttccagaaaaagtcttaattacacaacataataataactaccaaacgtgtcaacgctcccgtattcgtccactaacattctcccatgaaccctaagttataagtcctccaaggctacgatcacatttacaagcggaaaattgttgtgtttgatttgtttcttgttttattctcactctaagcctctggttatatagcattttttggcggaaaagctaatcgcaaaacatgagattataattatgcgacatgtcaaattgttatgaaaacattttatataataagaaatttatttggtatagtatcatatgaaacaaagagtcaatacaatatcaatgtcattatatgtgctcattatgttaagttgagtcaaggcactttactaagaacacttcaataattatatttaactatttctgtgtattcatacgtatgatacaaggtttggtgttctatatactttatcctcatcccttgaattttagttgggccaaaataatgacattaaaattataatatgttgctatataaaaaattgttacaatttggatgcaacatagagagatcattagcgagacattgggtggatcgtgcaattcatttctgttttgtcaactagcaattcaaattatggcgacattatatacattaatccatattacacaaaaactaataaactatatatgtcttggattcaaatagaagaaataaaagtcaacgagtttgccctataaatgattctatgctttcaaatagttagctacaagctcatcaatctctgctctattaaaaaaagaagaagaagcaaacacaaaacaacaacaaagaaatatggcaaagctcatagttaacttctctgctctcttgatgatcatcttgttggtttctaatggtaattttaagattttcttaacttcctttgtcctatattaatatcgatatggatgtgaaaagattaatgtgagaatggttaaaacaggactcccaaaggcggtagcccaaacatgctttaaaggtgaagctcaagagggtgtgtgtgttaaagttgacggctcaaaattgtgtgaccttctttgcagggcaaccaacacaacttggtttggggcatgtgaagtggaagacaacgagacgcactgtcactgctacggaccttgttaagtatctcatccggacgcaaaaccaaatatgaaacgtgaataattgtgtatcagtacctaaataatgtgtgcattgcttatgatcaatgtcacatatctacatgtgtgttccatgtttgtgtgtttttattttatcgctttcaataaatttgcatcagcaccgtaaatgtagctgatgcgataaatgaatgtaagattaaatctgtttattatgtttgcttttggtgttccattatctctcctatatatatgtcctcttctttttcttcattcttgtcattaatctatatgtatgtgctattttttgttgaacaaaggctaatgagtcttatctataacaccaaatcaactcctaatagtaatagaactcttaacctaaactcaaaagaagtaaagtacaaggaaaactctaatcaaaagttcaaaaccatattcctaaaccatgaaacataaaggaatatcacaacctcgaaactcttttgccgtaacgactagagttgctttttgtttttagttaattcaaatgatgacattattgttccaactatgtaatgtagccaccacatttttcttgtaattttttttgtttccttcataaaattcatttagcaaatttacacaaaaaattcaatgaaagtacatgaaatgaaatttaaagtacaatcatttcccatagttttttttcttaccaacaccaacataacagtgataaattggaacaaaattttaccaaaataaaaataaaaattttatgaacaaaagcattttttatatattttttaattattgggggtttaatgaatttgagatatttactagtcagaaaacaccaaaaccctccgtttcgtgggtttcctccagaccttgagctccttgttcaattcacactttttctctcccaactcttcttccaggtttcctctgctactctcaggtttctcttctccacttccctccagctttatccttttgatttcgtcctccatcttactgtatttacccaaaaatctaagcttttctcagtgttcttccatttctctactttgttttcatgtaatgctgcaaacttcgcaatacccatcttcaatttcttcaattcgtaatgggaaaaagcattttagtttaatttgggttttgtggttcctcacttgtttcattcttctaagtcttaaaccatccactgattctcaatttctgaggatttgatatctattgctggttaacaatggagcatagatgcgactgggttttgtttatgttaactttatgaatgtaaatcacactgctttgtggctactttgtggatttcgtgttttactttgtggctgaatcatataactctaaattgagagctttgggtttgaccatttagctttttatgaacaggtcttgttagggaagtaatcagtggaattggatttagtcttttggttctgaattttgtaaagtcctgcagtgattggtctcattatg

SEQ ID NO: 13543 - DNA, 532 bp, Unknown; identical to SEQ ID NO: 13533
  misc_feature (1)..( 532): cDNA_ID_2685649_gDNA_ID_2214635_Annot_ID_188075 3000 nt of promoter + ATG

SEQ ID NO: 13544 - DNA, 3000 bp, Unknown
  misc_feature (1)..( 3000): cDNA_ID_2703292_gDNA_ID_2214635_Annot_ID_136120 3000 nt of promoter + ATG
aaaaactcggtgaccatattcaaaactttcccacgttaattctctcttctttgttttgtttcagattcattacttttctccaaaaaactttcttcaagatctgttcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtctcgcgttttggataatgttttataccgacagaaacagtacaaagacgttttgatcatttcaaaacgttagatcattgaagaaaatgaagctcatgtccttattgacgtttgtttgctgattttaattcttagatttgtgaggaaaatggaatataagttttaggtcagttgatttagacttttatctgaatcagtttacctaatcatctctaaagcatttagctaaggttgtttgttcttaatgctttatggtcaaatgtttgtaagctttttaggcataatataaggccggattcattttggtaaagacgaggatacaatagcttcgaatgtgtggccatgtttcgctaagcgatcatcaacttgatttgtcttttggtatgtgaaagaaaaggaggttccatcaaacatctttcagctcacttgaaaattatttgaaatgtctttcatacatttatgatctatcaatgaatacaaatgaactactatttttctcttcaaataattattctctttctgttgacattatgaaatttagaagttttcacaataatcaaaagtaatataaaacgtcgaaaatatatttatctttatatgaccacttgatgatgaagactcaaaccaacaaaaaactagtgtttgttttatttccgtggtcaaatgtaataatatatttctgtgtgtattaggtgatatttagaatttttgtataatttccaaaacaagaaaatacttcaaataaatttcatattaatcttatcaaaacatatctttcatattttatatgaccattattggatgaagaagagtcaaaccaaatatgaactagagtagtagagttcaatttttttttttgacaacaatgttttctttttctggtcaaataaataaaccttttttgttcatattaaggtgaaagaaaattagaaattatgaacaaatgttttaaaaataatataaatatctagatcatattgcatatatttcatttaccaatgttaaagatttgtgtatatatagaaaagaaatcttcaacaaaattaaactgctaagaaattattaaaaaaatgtaaaagaaggaaaaatatctaaaacatgaagccagagaaacgaaataggagtattaattaattaaagaaacaaactcaattaattaattcaatggaaaccgctaaattattaaccgttcgccataattaaaatttaagagacacacaccttaaacctcacctatatattttccatgcaaaaaaaaaaaagacaacaatttcaaccatcatgaacattactaaactcactccttggtttcttttctcgtgtctgattcttctatcaggtattattagtctataactttcattttcttcttcttgatctgtttaatgtatgtatcgtatatcaaattacagcaattaatttgtattaaatcagtttcatcgattaatttctttttccttttgatatacgtgctagactacataaaggtaaacagctcaatttctccatctagcgagcaaacacaagaagatggcttttttggtttcaaacctacaaagttgtttgtgttcggagactcgtatgcagacactggaaacacacctttcctgatcgttccctcgtggaggtttcccaatggaatcactttcccgggaatacctaccgggcggtttagtgatggtcgtgtttccactgattatctcggtacgtttgaactataatgttttgtttggtaatctgtcacaatatctgagtctgtaagatttataatattgtaaacagattgcaaagctcagtgaaaaactcttagattagatatgtcttagctgtacatttgcattgcatctcttatataatgaaacgcaagtcaataaattttgttcattataatttgttttaaatgttgaccatataagtatttagtttaacgttttcactctctcaaaatgcaagatatctctagtttaacgtaaatcggttgccaacagtaattataccctatatatagaaaacatatattatgcaataaatcttatagtttgacttatattgtaacatgtagcgaagtatattggagttagaacgccgatcacatacaaatgggggaaatacggacgaccgagactagctgtgaaaagagga

SEQ ID NO: 13545 - DNA, 3000 bp, Unknown; identical to SEQ ID NO: 13538
  misc_feature (1)..( 3000): cDNA_ID_2703300_gDNA_ID_2214635_Annot_ID_136122 3000 nt of promoter + ATG

SEQ ID NO: 13546 - DNA, 303 bp, Unknown
  misc_feature (1)..( 303): cDNA_ID_2703304_gDNA_ID_2214635_Annot_ID_136123 3000 nt of promoter + ATG
tcaactaaaccggtattaatagcactagctcaagtctagttctttcgatctgcaaaattgactctgcgggaagaacaagtctacttgaagcgaaaccaaacggtggtgatccgtgagatttcgtcatcatcggcttaaaatgcatcactgggttcaagcttcttcttccgatttcagtggaactcctccgcaagctcggaggtataattctattgtccttagctctcgatttttgaattcagctgatttttttggtgtttgtgtatcagtggacatacagctgtcaatgtcggaaaatccatg

SEQ ID NO: 13547 - DNA, 3000 bp, Unknown
  misc_feature (1)..( 3000): cDNA_ID_2703319_gDNA_ID_2214636_Annot_ID_136124 3000 nt of promoter + ATG
ccaaaaaaaaaaacccactattttggtttaatagacaaaatttagtctctgttgtttaattttgtttgatggaagtttatattggtccaaaatgagattcagttcaaattaaataaataaattatctatttaaccaaacttatttaaaagaatttatatgctctcaatctttttgtttgtaaagatttaaaagttaaaattttaaacaaataacaaaatggagcaacgacgaatctatcaacgtacgtacgttctcagacattacattgtacaattatttcgacaaaaaaaaaagcctcattgattatcatttatatattatatcatagagattcgtgccccttatctcgttttttttgcaagactaaacaagtaacaaattgcctagctgcctaaagaagtgaagataatactctttctaaaatcacaatattctcatagtaaaaaaaaacatatttatcatcatatcgtccaaatatttcagttttgttgtttgtttaacaatacaaattaacaatgatttaatttggagcacttgaatataatagtacaccgaccacaaccccacacaattcacaaacttgagaaagagagagaatatgcccaaactcaccaaacctaatcattttcataattaacgaaaaaaatagtttcggtaagatgatgatgtcttagttaacttttgcttactacttttttaatcattaaacaaaaaaaaatattaaaaatcgttttcacttgttcaatacatatttttaagttttatttataaggaaaaaaacttaatagcttattgcaccaaaactaatatggtccttatggatcagtttcatgtttttagttttttatgtaatgaaaatttgaattattttctaaaaatatgtgtacgatatggttcgatttaaatagaaaccatggttcaaaacgtcagattagtaacgttcataaaactgaacgacttaattatgtccacgtatacggttggtttctttcaacgtttttagatagttaatgctttgaaatcttagttagttatacaaaggtaaggtaaacggtccaaaaatgattgttctcaatcaagttttaaataagaaggagaaaaagtcaacaaggaaatgcaccaatcaataaagtgtcaccaaatatatgaggaattccgatgattagctagcgttttgaaaatacttcggctactagctatgtttttgagaagtacgtacatgtggttggtaaaagaatactggaacattgtcactagaacgttcgtgattgtacgcagtattcatgccagttgatgttgtgcaccatcaatgttcattatgtgaaccacccaaaaaggcaaaaacaatggatcatccacctaacaatccaccccaatctaggtagttctaaaatcacacgacttacatcaaaggaaaagtttcacatgtttatcaatcacaggtcacagtatgtttgaaagagatgatagaaaaaagatatcaaatttgtcccgtgttgataggaaagttggtttggtatcgtattataattttctctacacacacacgactcatgtttcatgtgttaaaaaaaaaaagcaatcgttttaatcccttccaatttatataaatctgcgggctctgtttttatataaagaaaattggatcagttgtatgaacttcgaactgtgcaaaaaacttcaaaatggttcaactattttgtcaaggcttgtaaaataaataaaaattagcacactgttaaaatttgtagtattatatttaaaaaaaaaaaagatcaaattaaacaaaagaaaaacgaaattatcacgtcttttatttattattattttaaataaataatatgacattttaaattttgtttggaaattaatcactttctggcagtacctctcagccgaattgtaaacctaaaccgcccaaaagggacagattgcatcgtggtggtaggacattcataaattattatttttccttaagtggagggccgtcacacaatactttttgcccaatagataattggcccacaaaataaaatgctaaaataaatatataatctttctgtatgattgtgaaaaaatgtgagattgtctcgaatgttaaaatttggtgccacaaacaatataaatatataatcacagaaaaattggtgccacaaacaagataacatcttataattttctcgtatacttggagagcgagttgaaagaattgcgattagaataaagcgtagtgatttggcattgaatatcatttatgctacataattctacttagcgataatataaaaaaatatcataacttatggttagcatgtaatgtcactatacgaatatcaaattcataaaactagccgtgacttatctacacagaattatttatgtttcgagaataaagacccaagagaaaacaacgacattataacaaaaaaacaacgacagattataagtaaggaagaaacaaatgactatagattagatatgaaatatttttagtaaccatctttagttataatttttgttttggagcttgctccgtatactcagttgagtatttttaccacacatatatcaagactaaattctaccactaatcaagtaaaaacctcttagcaaaatagttggagaaaaacaagaataaaatcgtattattttcctctagaactatcgatcattcgagagagagaatatgaaaaagggacaaaagctctatacatgtacaaacatgacaagtcattatccgccacgtagattggtcggttccgcttcgctggaattatagcgatgtacttgtttagcctgttttcaaaattatttaaatctctaaccgctccaatcaaataatttctccaccaaatattaataatatatcatccggtaaccggtcaccaaaatggcgccacctcagatataagtaagagcacatagtagaccagaaaaaatcatcaaatccatctcccactcttctagcatcttgaagcttaaatctcagccgtccgatc

SEQ ID NO: 13548 - DNA, 3000 bp, Unknown
  misc_feature (1)..( 3000): cDNA_ID_2713840_gDNA_ID_2214636_Annot_ID_136126 3000 nt of promoter + ATG
ttattttatgtgaaatggtatgtttacttgttctgaatcgaaggggtttacttgtttttgcagcaaaaacttgccaagagagatggtgcttcaatagaccgcgatcgtgatattgaacgactatgggaattttacaaactttataaaagacggcatagagtggatgatattcagaaggaagagcaaaagtggagggaatcaggaacaactttttcttctaacgtgggggagtatgtgcatctttaatccttgtggtttcctgtttttttaggacagtatttggattctatccctagaaaatggctgaaattctctaaatctgaaacatgcgtcctgaattgtgttgatgcttgttctttcattcggcagtgattttctgggtgtagattaatttgtttggtatggacgtttttataaattatcttgatagcttctgttcacttatacagatgggattctgtagtggagatggtttctgagatgtactgttgtcttcttctttttgtaaaccataaataattaatccttgttttttccccctccttttcataggatcttgaagatgaggaaggtgtttgccacattgagggccctaattgaagtgttagaggtgctaagcagagatgctgatccaaatggtgttgggaggtctatcagggacgaggtacttttttcccttacctgttgtgtttcgaaagctatttaatctgcttctcgcttcctgttctgatgatgccaagcgttcaaaaagtcatatctaataactctgatgagaagatcttggttcagaagttgcatctgcatgagttgataataaatgtttcctaagatcattaaatcaatcattcaagttgtcacgttatacacttatcttgtaactcatatttttgtttatgttttcagcttgggcggattaaaaaagctgatgcaactttgtctgcggaactaactccttacaatattgtccctctagaagcgcagtccatgaccaatgcaattggggttttccctgaagtaagtcaaacaagaatgaaaactttgattttcattttgtattagtagttttagcttttcaagtttttcccactcagaaaaggctctattgtctttatttaggtacgtggtgcagtccaagctatcagatacactgaacatttccctaggcttcccgttgattttgagatttccggacaacgtgatgcagatatgtttgatttattggagtatatctttgggtttcaggtatagtgataactatttgatcaaattcttccctgattgtttattattcttgttgcttactcttttttttttgtcttgagcattgtctcagagagacaatgtaaggaaccaacgggagcatttggttctcacactttcaaatgcacagtcccagcttagtatacctgggcagaatgacccagtgagtttttccttctgatagtattatttttttgtggcatactcctttactgatggacagttatgattgtcctgttggttaagaggttgtcctcttaaaatcttgacctcttaatctttttatgtagaaaattgatgagaatgcagtcaatgaggttttcttaaaggttttggacaactacatcaagtggtgcaaatacttgaggatacgcgttgtgtacaacaagtaatttttgaatctagctctgatatggaaatacaggctttcttcatgtgcatttattgacgttgaagttttctattaggttagaagccattgaccgggacaggaagctgtttcttgtttctttgtacttcctaatctggggtgaagctgctaatgtccgctttcttccagagtgtatctgctatatatttcacaacgtaagataccatattgttgttgattatacaccaattttccgctatcagtatactcatgttttgtttattagtttgctaagtgattgttttgtttcgtattctttactgtggaaaaatctaaatgtctaggttttacagattttgttgttagtgttgttttgctgttcatatatattgtcctcctgtaaaccacacacatctaagccaagaatagacttgtcagaattgctgtagcatctgatcgtctctgcatcgtggcactttgcttctgttaaacaaccagcctgacatagtttaatttagcaaattctgaaatgatgaaaaatgaaggcctatgtgatcttgagttttacaccctatgcgaagtgaaaatatatctcttctcacacagttgccttttgtttgttagatggccaaggaattggatgcaaaattggatcatggagaagctgttcgtgctgacagttgcttaactggaacggataccggttctgtatcatttcttgagcgaattatctgccctatatatgaaacaatctcagcggtgagttccgctattacaatgattttgtgcatcttaattttctattatggaaattagatttcaacagtttaatgctaggcaaaaatgatagttttaagagtgatttctttcactaaccagagcttttgggtatatagagtatctaaacccttgttatgattttttgtgttaaacccatattacttaaattagtagcagttgtctgggaagtatcattattttaagttaatttgagtacaacgttaaagatcttctaatcattttcttgacatagtatttaggtggttctggcctatatttgaagtacatccctacttcgtatttgagatcagatcttattctatgtttctgaggaattttagcatgttttaatgtggatttgacgcgtcttacattaatgtttttggtatatggttgcgtgagcccttaagttggttttgaaattgatactcatgtaggaaactgttcgaaacaatggtgggaaagctgcacattctgaatggcggaattatgatgacttcaatgaatacttttggtttgtagtttgcttatactattacatttgctagtataaactcatttcaaggagtttccattaactgtttgttatg

SEQ ID NO: 13549 - DNA, 3000 bp, Unknown
  misc_feature (1)..( 3000): cDNA_ID_3030767_gDNA_ID_2214636_Annot_ID_136131 3000 nt of promoter + ATG
attatgttaacatcagtgacttttgtgtaagtgaagataaaagtatgcatcaaagtcagaggacatgtgttgatctcgtggataaatagactgatttccttgaaattacgacaccattattacaagacaccaaatataacttctatttacaaagtcaggtttttcgttgtgctctattcaacgggacaaggtcatggaaggtgtagtagctaagttaaccctaatgtcaggatcgtagtagcttctctgcagtctgcgaatattgtctccattcactgtttaggaaaaaccaagtgggccaatgactgtagtaactttttaaaacaaaggatttttaaccaaatccatttcgtttagttggacaaaatgattaattaggataataaaaagtagggtaggttttgttttcaacaaacgggcaaaatcaccgacgtgactttcggttaacaaacagattcgattcttgaaattagtttaggtgaaaataattcagaaataaattttcttctacgcatgagtaaaaaaaatatatattacatttccaaaataaacgtttttagtccaaaaaaaaaaatgtcagagtgatagaaaacaggaaagatgactatgaaaatccaccttcattgttagtgttacatggttatttcaagggttttgatcaacgacataatccattgtttttaggctttttcaggtgaaaccatagttaaaagttttttttttcactattatgatgagagtggagttctttttttgcatacgtattacacataattaaaaagattatatgacaatattgttaagccgttataatcaatcagctactatatgccctttattttgctaattatctcaaaaaaaatcatagagaagttgcactcgtcattgtactcttgacatttactaattaaaagatttcttctgcataagaaaatgaggagacaatttaaatttggatctctagaggcgtgattaaagcagttctttcccacaaaagatggctttcattatattatactactatttaatttccgtaccacagtgtcttactctgactctgattttatttctttttaattaaataatcacataaataattcactatcacgactttcgtttttccatttaaattaaactaaaccggttagattcgtttttcttcaccaggttaatgtgaaccccaatttttctattttgttaatgatgttttataattgtgattaatacaattagaaaatatctaataattaaagttgagaccataattaaaggaaagggaactattgtgtgaacatatatatattcttacacactcgcagagcaacccttcttcacttgggctcattggaatgtgatatcccaaaaagaaaaggcaaaacaaactactactaaaaaagttgagatagtaaaaatacaattgtactttatcatataataattcaatgtacaacaaaactcaactaccaaagtttgcttattactctcaaagaaaaaaacactgattaaaaatagcaaaagagatttgtttatctatatgaaaaataaacttatatagaaattcttatatgattagttgcaattgtaggtgtaacatttaatcgttgatttgtttttttttttggggtgcatttctcttgtagttgtaacaatatttcacacttaagactttcagacaatagtttaaaaacaaccgaacagaagttgcaggtacctataacttgtgtatgaatccatccacagttttgtaaacgttgactgtttgacattttgaatgtaattttatttaattagatcctacacaacaataatcacatctataatttgccaatacattttaataaaaccacttaacaaaatggttttaacttttaatccagtaattttctgtagttggtgtcatgatttataactactgtacacatttccaagatctaacgaacaatcataatcgataataattgtacctaccaaatttggtctaaaaaaatagaagaagtgattatatatatattcttttttgtttttgatgctaaatattttttttttaatgtgattatcgtttatcattgcacctcacggtaattattattgtttttccctgattttataaaaaagatatatagagagattattgagaccaatgaagagcagaaactgttgggagtcaaaaaaaacttatctccaatttctaacagtgttctatgtcggattccatcaatctctctctcttccatcatctgtcactttctttgttttctacgcaacaagaaaccgaagaaaaaaaaataacaatttactaaagtattaattcctttttttgtgtgacaaaataaaaacccactaaaaagcaaacgattccaagaacatggaaacaaatgtgtaaaaaggaaataaaaacatcaagcgtgggctgaaaatcactacacgaaaatccaaattttggtaattctattaaattttttaagttggtaataaagagaataaatacacaaattgactggccagtacacaagttgactgattaatcgcaaattatacataattaataattaaaaaacggtaaaaaacgttaataaataaggaaataaatcaaaacaaatgaagagtgggattagtaaagtattaaagaaagcatatagagcggaagaaaactgaagatggaagattataaaaataagtgttgtgaagaagaagctattcgatttttatagtcttgagttttattttattttaataagaaaacaaaataagatttttaaaaaatagtatattatttatttattaattttcttcagggctgttgtggtttttgaggttctctataaagcaaagtaagaaaacatctacacaaatgtcccaacaatctgatcagaaaaaagtagacgaagaagaagaaattaagtcacttgaacaatggcgttggtccgaaatgcaaggccttgagcttctccctcataacaccaacaacaactcacgaagctccagagaaactcaccggaa

SEQ ID NO: 13550 - DNA, 3000 bp, Unknown
  misc_feature (1)..( 3000): cDNA_ID_2994275_gDNA_ID_2214636_Annot_ID_136135 3000 nt of promoter + ATG
ccactaaacttgatttcaaaacgtttctatagcccatctttttcatgttgtcttaattatcagatagattttactctttagactcctaagaccaagttactgtatatcattttgattatcttattttctttcactttctaactgtagtttacttttaggttccattccgtaaacattgctatcgttttgtgatgaacacaaatttcttttaatttgttctttcctcattatttcctagcaaaatgaatggaaattatatttcataaaatgaatctttaatagtttaatccatgttacagccattttcacctttacatgagagacaaatatgtacggcgaactttctagcaacaaaaaactgacatgcatgaagatggtttttttttttttttttttttgccagtcgcatgaagatggtttataaccatattgaatggtcatttttgtaagctacaacgagaggcgagcaatgagacttgccaaaaaaatatgaggaaaaatggtgacttgcatgtgtacttaaaatggcaccatatggatggatgaaactacttaaagggttgaaacgagacgattttctgttgccatatttttcttgattttgtgtggctgtgtataccataatctctaattgcaacctgaaattaaaatggtctatttatgttgcaattagtgattatgttttatattaaccttggtaaagttagttaaaattatccaagtcagcctgacgtgttacactgtggaacacgaaaacaaatctttgtagtttgtatgtgttgaaatcgtatttagctacatataataagtgaccatttctaccctaaacttccaaattactgaacaaaacgtttcaaaagatccaaacatcgattttcaaaatacaaacacaaacttacgtacgttgaagtttgtggtcattgtgatcgttaactttacgaaagattttagataatagacaagaaagttctcaatcaaactctatatttcatgtgtatataataatatgtgtccacctcatgtattacgtcactcataggaccatatgaccaaaaaaaatcaacaaaacacaatgaaacatgatgttgacaaaatggaccggtgaaaggaggaacgaaacgcaattacgcaacccttgggacattttttttttttaacttttcttatccttttactgtttatgcagttgaaagattttcagataaaattcaattttcacacagcgaacccaatatgttagcattcaaagaaaagtaaaaactcagtgagttaatattgcaattcctcttgtctctatctctataccgcagcccatgttttttgtagataggcggttcttggctgtttccatgaagctgaaactaacaaaaccaaagtaatcatttaattaaaatcactaattgtgctctttaggagagcaaaattcttttgatttatgcaagaatttaaaaaataattatataagctattggtgctgaacgaattatgtaaagtagtgtatgccagtaggtgatagtgatacgaatagtgtattacaacgaaacgtgaaattacattcttgatactcgaaaacatatacaattttttaaaaaattgttcagatatatgatacacatttttgttgatgttaatttagtaatatatgtacattacacacacatgtctcgaattcttctatgtactagtatcaaatatattaatcggtcaaactacttgacagattaaaaccatgtgcgacttctcgtatagcttgtattttaaagttttgatctgatcttaatatgcgtttattggatcatataatataacatgtggtattttaatatcataaattttggtttcttttcctaaaaatacaacaaaatatctaaaactttttgggaaatctgttagaagatttttttttgaatcaattgtagtaaatcacttcttaaaatgaattttttaaataatataaaacataaaagagaagagaagaggaggttccatcaacttcacttacaatgagaaaagactatgcaatttgcacaatcatgactttaaccaatacacatttatcagaagaaaaagaatctatctttatctttaatctctttacaaattcttttttattgataaaatttcaaaaatgatgtgattcaaaaatacaaaaatgatttgattaaaacatcacttttcttcctatatgaacttgtaataataaacgaattaccggacttcataaaatgatttgatttcgtatttaaggccatgaaatcttctaactaaagtttgtttctgataaggtataggatgtatattctttgaattgtgacaattggtcgaatgtatttttaccttaaactgatataagattctgctaatctagactcaagtcatcaagtagtcaaagctgagaaatgatgctctttttgttttcaaaagcaatgttacctttaagaaatcattaaacttgatcaactatttgcgtcacaaacaatttttgtttttaatattatccacggatgattaaagtaatgttgttcagaaacttggtgccttcgtgtctcgtaccatcacttgtgtcaaaccggcgtcaaacgcccactctcgctgacctcagcccccaacaaatacacacatacggaaatgaacatgtaatatcaaaccatataatattcagtaaaaaatcagtatcgataatatagtaaaataataaccttcacgcattccttcttcttctataaatacacacatttgcctccacttactctcgttcaaacaattcttcgtcctattaaatacaaaaaataaaaatccttaaaaatatatccttatcttcaaccaagaatgggagaggtccaagaaggtcccaaagttgaacaagagaagaagccggctgccaccgtagtcccagttgagactactgacggcaagccaaagagcggcggaggagattccgcggcagcagcagcaccaccggtcgccgcggttgtctctgcctttgtttacaaagtggat

SEQ ID NO: 13551 - DNA, 3000 bp, Unknown
  misc_feature (1)..( 3000): cDNA_ID_2713830_gDNA_ID_2214636_Annot_ID_136136 3000 nt of promoter + ATG
tgaaaagggtttggatttggaatctgctggtttgacttatatatacgtgagagatgatgcatcttcatcaatcaatcataatggttggagacagtccgatcctgacctttttcattttttccataccatgtacagtatattatacaagtttgacttaggtgatgacaaaataattatattatcatttattattaactgataaacttcatattttgaacgtagtaacgattgatcttgacatcttgaaagtctaaaacagttgtaagaaaaacatagcttcagttttcaaaacctagagctagagtcaattaccccaaggttagaagatcatacacagaatttttttgaaatgttatccgaactcaatatgattatatcaagtgtaaaaactttatcatcgaggaaacatattaaaaagcatgtccttgactatagaaatgattaggttggtccacatttagaagatgtttgacctggcttcagccattccattttcaactacttgcatattcttgcaaatatacaaagcgttggtgtccgggtcagatacgagctaatatgaagatgatcaagtgcttggttacacaaaaccaccatgtcaaagattttatgcgaaaacctaaaacacgagcatgcatgtagctcgattgttcaaccagagaaatcaaactcggagctataccgaaattatgttctgattggactaatcgacttatagacgcatgttttcatatctaagtttttgatggcctttttagtccatataagtttttttaaaatgcagcatactaatatttgaattcagactctattttgatctagacctactaggaaaactcaaacaaattgagtttagtgatatattgagaggtaaaatactaaaatggtctaactaatacaacttacatgtttagtagaacttaaattatgctttatttacaagactaaaagagtagttaaacttgaaatcttaaactgtcgccgtagaaataacaattgggtcaagaaaagttttctaatccttatcaaaatagaaaagttttctaatataatagaaaaaacacccgtaagtgggaaaacatcttctacaaacttaataagaaaaggatatacatatctccaatccacatgcgaatagttttgggtcaaatctctacgcttcgcgtaacaaattgaatttgtcaaacaatttgagcatgacatgatgaaaaaaggccagagtcatgttaattcgtcgtatcgtaactccgacttctgactttctccattctttttaacgaaacgataagtcaacttttaaccgaaaaggactacaagtcaatttattcattaatgctctacgtgcataggttatacttattggttaccctatagaagttgaaccgtgagatcaaaaatcatgttagataaaccggctccgttctttgtgacgttgacatatatttttcttaggccagagactatagctagataaataactccattcttggctgctcgtaggatacgaacccaaaacttggtcatattttatctcaaaaataagatcccaaaaaatatcgactattagagctatcgataccatacgtgtttcaaagatgtaaatttgaacccctctaccttgaaagcgtgtataaggcttattttctgaaaaaaagtgttagctcatctaacatatacaaagattaaagattggatcgttgacagaagaaaagatttacaaaaatttggatcttgtgaattagttactattgggctaaataaaagcccatgtatgtatttattggaccagacctaatttttgtaccagggcctgaggactatatccaacacaaaccacaatttcaaatattattttggcgttttaacttctaaacgctttatctttatcatgcgacttgccagatgccaacccaagccacgtgcattacgattcaactaattttttgttgtctttttttcccctttttaacgaggcaaaatagtagaaatatttttctattttcatgaaattgtagaagaaaatagtaaaatttccgaattttcctaatctatagtttcactttagataaaataatacttagcgtgacgaaggcaactggcttattcaactttatgtgtttaataaaagataaaataaataataatttcgtatatatttctctcctttgttcataaaataattaaaatatttttgattgattctttcgaaaagtaaaaaaactcatttaattacaagaatataatatatgttaacccaccatgacaaacatatattttgacatcttagataacaagtaactaaattaattacattcctttttattttattttctttttaattttatgtgaatgtaaaaaacaagaaaaaaaataaaatttatttttctctctcgcttggttcaaccgtggttgttcatcggaaaaatatcttcggcttcaatttcgttcgatttaccctaaattctcgactagtgttcgtcaatcccacttccaattccacatttcaaaccttttcaggtaatatttctcatatttttcgtgttttttttcggggtcaaacttatttttttaaaaatttcaattcaaatttcgagtttgtatttagtaaccctagttcttaatttttcaatttttcgtcttcccttatgagatttagcttaattagggtattgaattaagtagaattgggtttttgtttttgttgtgatctggtgaaattaattttagggttttattgaaggtgaaatttgtttgttcttcgttatatcttcgaaattagggtttttcaaatttgtgtcgtggatgtaaaaattatgaattgcctgtaaaatttttctgtcggttgctaaatttcttgtgattttagttgatgatcgctatgtagagtttcgccttttttttgggattttgaatgttcatggtttaggattcattgctctgatttgtaggaagttgaaatcaaaagcatgaatgcttaaacagtttacgcattattgcgaa

SEQ ID NO: 13552 - DNA, 792 bp, Unknown
  misc_feature (1)..( 792): cDNA_ID_2990712_gDNA_ID_2214636_Annot_ID_188141 3000 nt of promoter + ATG
caagattggggtttaagagagttacaggatttgttttaatgagatgggcagtgagagatgctttgacacagcttcttggtttatggtacttcggagaggttgaagatcagtactcgtttttcaggctctttgtgaggttaaagctgatgcctttcactgttatgccgccatggattagaggttttgagaaggagatatctggtttcttgttcgcttggtttctacttgatacacttgttggtttgatattagctgttgatgcgtttgttgctattgtggattcgagaaggagaggaagggagatagtgaaggaaggtttatatttgatatctcttttgttgcatcaggctgtgcagctgaagtgtcttgaagcgattctttgtgggtctttcttcagatgggttctgattcgaatggtagggaaaagctttgcttctgtgatccaatctgcgttggaagtttacttcatggcggcttggttagtgttctacttagcagctaagtgtaaagatgcacacgcagatggtaggaggtttgggagaagagaaatggagagcttgatcgatgggctgagatgataatgaattgtggatctgtaggatgagctttttgtttccaaaggagcaaaccttggcttcgatgcttaatgccagtggcgacatctctgtgctactagttgtcatgacttaggttcctttggttttagaattacagttgattgataagaattgctagcaattcgatgtatgtacgcacctaggattacttgggagctgtgaaagagggagaatg

SEQ ID NO: 13553 - DNA, 3000 bp, Unknown; identical to SEQ ID NO: 13551
  misc_feature (1)..( 3000): cDNA_ID_3030759_gDNA_ID_2214636_Annot_ID_188132 3000 nt of promoter + ATG

SEQ ID NO: 13554 - DNA, 3000 bp, Unknown
  misc_feature (1)..( 3000): cDNA_ID_2994275_gDNA_ID_2214636_Annot_ID_188131 3000 nt of promoter + ATG
actaaggtgctcctgccgaggaatacaataattgtaacaatgatagtgaaacagaccggtaccaaatccaaacttttcatattatttattagtgtaataatgttgcatggagatccatttagatgtttaaaattgagttcttgatgagttggttctactttgtctctgcccccactaaacttgatttcaaaacgtttctatagcccatctttttcatgttgtcttaattatcagatagattttactctttagactcctaagaccaagttactgtatatcattttgattatcttattttctttcactttctaactgtagtttacttttaggttccattccgtaaacattgctatcgttttgtgatgaacacaaatttcttttaatttgttctttcctcattatttcctagcaaaatgaatggaaattatatttcataaaatgaatctttaatagtttaatccatgttacagccattttcacctttacatgagagacaaatatgtacggcgaactttctagcaacaaaaaactgacatgcatgaagatggtttttttttttttttttttttgccagtcgcatgaagatggtttataaccatattgaatggtcatttttgtaagctacaacgagaggcgagcaatgagacttgccaaaaaaatatgaggaaaaatggtgacttgcatgtgtacttaaaatggcaccatatggatggatgaaactacttaaagggttgaaacgagacgattttctgttgccatatttttcttgattttgtgtggctgtgtataccataatctctaattgcaacctgaaattaaaatggtctatttatgttgcaattagtgattatgttttatattaaccttggtaaagttagttaaaattatccaagtcagcctgacgtgttacactgtggaacacgaaaacaaatctttgtagtttgtatgtgttgaaatcgtatttagctacatataataagtgaccatttctaccctaaacttccaaattactgaacaaaacgtttcaaaagatccaaacatcgattttcaaaatacaaacacaaacttacgtacgttgaagtttgtggtcattgtgatcgttaactttacgaaagattttagataatagacaagaaagttctcaatcaaactctatatttcatgtgtatataataatatgtgtccacctcatgtattacgtcactcataggaccatatgaccaaaaaaaatcaacaaaacacaatgaaacatgatgttgacaaaatggaccggtgaaaggaggaacgaaacgcaattacgcaacccttgggacattttttttttttaacttttcttatccttttactgtttatgcagttgaaagattttcagataaaattcaattttcacacagcgaacccaatatgttagcattcaaagaaaagtaaaaactcagtgagttaatattgcaattcctcttgtctctatctctataccgcagcccatgttttttgtagataggcggttcttggctgtttccatgaagctgaaactaacaaaaccaaagtaatcatttaattaaaatcactaattgtgctctttaggagagcaaaattcttttgatttatgcaagaatttaaaaaataattatataagctattggtgctgaacgaattatgtaaagtagtgtatgccagtaggtgatagtgatacgaatagtgtattacaacgaaacgtgaaattacattcttgatactcgaaaacatatacaattttttaaaaaattgttcagatatatgatacacatttttgttgatgttaatttagtaatatatgtacattacacacacatgtctcgaattcttctatgtactagtatcaaatatattaatcggtcaaactacttgacagattaaaaccatgtgcgacttctcgtatagcttgtattttaaagttttgatctgatcttaatatgcgtttattggatcatataatataacatgtggtattttaatatcataaattttggtttcttttcctaaaaatacaacaaaatatctaaaactttttgggaaatctgttagaagatttttttttgaatcaattgtagtaaatcacttcttaaaatgaattttttaaataatataaaacataaaagagaagagaagaggaggttccatcaacttcacttacaatgagaaaagactatgcaatttgcacaatcatgactttaaccaatacacatttatcagaagaaaaagaatctatctttatctttaatctctttacaaattcttttttattgataaaatttcaaaaatgatgtgattcaaaaatacaaaaatgatttgattaaaacatcacttttcttcctatatgaacttgtaataataaacgaattaccggacttcataaaatgatttgatttcgtatttaaggccatgaaatcttctaactaaagtttgtttctgataaggtataggatgtatattctttgaattgtgacaattggtcgaatgtatttttaccttaaactgatataagattctgctaatctagactcaagtcatcaagtagtcaaagctgagaaatgatgctctttttgttttcaaaagcaatgttacctttaagaaatcattaaacttgatcaactatttgcgtcacaaacaatttttgtttttaatattatccacggatgattaaagtaatgttgttcagaaacttggtgccttcgtgtctcgtaccatcacttgtgtcaaaccggcgtcaaacgcccactctcgctgacctcagcccccaacaaatacacacatacggaaatgaacatgtaatatcaaaccatataatattcagtaaaaaatcagtatcgataatatagtaaaataataaccttcacgcattccttcttcttctataaatacacacatttgcctccacttactctcgttcaaacaattcttcgtcctattaaatacaaaaaataaaaatccttaaaaatatatccttatcttcaaccaaga

SEQ ID NO: 13555 - DNA, 3000 bp, Unknown; identical to SEQ ID NO: 13549
  misc_feature (1)..( 3000): cDNA_ID_3030767_gDNA_ID_2214636_Annot_ID_188125 3000 nt of promoter + ATG

SEQ ID NO: 13556 - DNA, 3000 bp, Unknown
  misc_feature (1)..( 3000): cDNA_ID_3030782_gDNA_ID_2214636_Annot_ID_188118 3000 nt of promoter + ATG
tcgtctgtgactgtgtctcataaacaaaactgtttgaaatgttgttcagttattccataccgtgatcacatttttttttggttacgtataaagtatcactaaagtggagtgtaaaatgttttgtccttagaaaatgataagcaaaaaaatgatgatgaagcgaaacatatatcacaaattatctgaaaaagggaaatgaaattcacatttaggaaaaacagtcgacatattttcaaatgcatttaaaaaaataaatgcaaggaccaaaatgacaagtcagagattgcaacctatacattgtaaaaatatgaaattcataatatgaattcgattcttttttcaagctaaaaagttttgattggtaataacagttaggatgatctagtctttacaacattcatacactattgttttaccaattctaaattaaggattgtatcaatgggattaaaggaattttgaagaatacacctaatatggattcaggtgagcctaggtaacgaaaatgatttatgctgtatattctatggtgatcctagtatctactgttactgtataaataacaaatccaagccatccactgtcaaagaaatatgcaaaatcatgcacgaagtggccatcacacactacttttctaaaaataaatggacgaatacgactaaacaatgcgaagtagctttatatccgcatttggtagatgcgcacaagacaattgaaacaccaaacattcgtctagaaaactagcccacaaagctttagtgacccattcttctcttttcctcctttggtgttttatgataatgttttcacattcaattatttatactaataaacaaatatatatatatatatatatatatatatatatatatatcattaataaaaaactttttactcctaacttgcttgatatatattgatatgtttgcaaagttaacgataatgtttcttcacatttttttttgaaagatacatcgtaagcagtttagatggattttatcaatatcttgtcaattttaattagaaacaatatcgaaaacctcttgaactctttaaattcatattttattgtaagtttagtatatgtttcttataaatttactgaattttgttgtacttaaaagatttgttgtaagaaatgtctttaaaaggtagtgattgtagaaagaaaaaagtaatgtgattctgcgtccgaacaagtaaaattcaaaatatttaaggaggatcggtggtgtgcagttaagtgacatttatgcgagtggcagagtaagtgatggactcgaaggtaatggaaccatgtgaaaattattaattaaatatggatttgtaggtatttacttatttcatactactaaattactagtcaacgttttgacttttgagagacgtaaagtttgaacgaaatatctctaaacaattcgaaacaaaaagacatgaaaaaatgttgcttaaaattgatatcaagctttccaaagccaataaatttgcacttgagataccaaatgtttctaaattgtgacataagaaatcttatgttctcaatggtaatgacactcaaaagacaaaacatttcatttgcagacattacagtgtgaattaactaaaaactttatcctgtaaagtcatctcccaaaaaatacactgtagtacgtagagcccatggtatggcatttagtggtacatcatatttatggtaaatttaagcattggaaacattgatgagattatggacaatatactacaaatgtgcaataaatatcgaaaaaaacaaacaaaagaaaacttaagggctttcgaggttccacgtcgaaatgatttcattggacattgatgagatcatgagatctgcagattataatagtgggctagccttgtctttgagtttcgacagacattgtctcctttctagctaatgtcattttcccttctctctatttcattacatttttttgtgttttagtaaatctcattcattatttcggtaattaatacattatagataatcaactcgtggtgatcaaataattgaatgatttatcttatgggctgacagaataagatttgagtattttcaatgtcatttatcctctttgtgtacgtcttgaataacaagaaactcacaattttatctgaaactagagatataaatcacagttgaaatctaatttttttaatattcttaatgtgagtttatatctgaaaaattatagttaaaatctcgaattaacgttgtgaatccaaaatagtacatggaataaaagttccaattttttaatgatcgaaataatagaatgtattgtaattaattattgttagaacttagaagatacaatatacatgttataagcatcttacctaattgtccatagtttcaaaacaatacgaataaatcaagataaaacaaagaaactgtcagtaccgaccttagctcagttggtagagcggaagactgtagtagtagctgtaatctttaggtcgctggttcgattccggcaggtcggattttaagtttttaaatttccattttttgtttttctatacaaatcttgatcttgggcctgcctattcgttcatgggccgataattcaaaatttaaaagtaagataacgcggtttcgctaacatgaacacgacgacgttttagtattcaatccgtgttttgacacgacagttatattacatagttggaaggaacggctcgaaacgggaaggttattttgtaattttcaactttttcttttttttttccaaatccacttttcattttattttctttgagaaaacccactttacgaaggaatcaaatcgactcgttttcttaaatccgccatagatcccatccgacacaccaccgtcacatccgggttcgaatcctccagctcgagctattcgcgtttcttcatcttctctctttgtgccatggtgtttcaccctctttagggacatcacaagctttggtttgagagaatttgaaatcctcctctaggatttgaaaattatg

SEQ ID NO: 13557 - DNA, 3000 bp, Unknown
  misc_feature (1)..( 3000): cDNA_ID_2685740_gDNA_ID_2214636_Annot_ID_188115 3000 nt of promoter + ATG
agaattaagaaacatctgagctcacagctcacatcgttctggtaataaaacacaaacagtgtagtgtggtcacgtaaatcgtgtaggacttgtcatttgcttatcactatcgcctaaagtcctcacttttaggagtagactagtaaacgcttctgactaaaatacaattaaattaagaaactgaggttcactaaaattccaaaatgaacaacaaaagctcactaatactcaaataaattcttaatcaaaagcattccgatatgattttcaattactaggatccaaaattgggacacaaaatttggattagatacactgcctacaagtagataattctcctgaatattcatcaatcaagaatattcatctaataactagtaaccaaccaaaaaaaaaagaaaaaaaaaactagtaaccaaccaccattgtttatttagacttgcttttaaaaaatttgttagttaaaaatataaaatggaattagacaattagtgggttctatgtacctctaaaacgagaaaaaataaatcagataccaaagagagaagattaataagatagttttgaggaagaaatcacaattagagcttaaagcataggaggaacaacacaaacatgggttcaagtacaacaacacgacgaatcacttaagctcaacacgacaacacctttgactctatctttctcatctccaaataaaaaccaaactaaaccatcacagaagctgaaaaagttcaaaactttaaggtacaagatgggaattttgtcggacgacgtagtgataatcagtcaatcggagaaagaaggtgacccgagtgttataaccatcaattgtcctgacaaaactggtctgggttgtgatctctgtcgtatcctcctcttcttcggcctcaacattgtcagaggaggtaacaattccattccatcattttactttgtgtggttttcgaaaatttcttctttttgatatctgttctggtttgtaacctgaatgtgttcgatgaaattcctctgagaagatgtctcaactgatggaaaatggtgctacttggtcttctgggtgattgggaaaccaaacacgagatggaatctgttgaagatgagacttgtagaggcaagtccttctttttcttgggcctttggtatctcaagatgttacctttctgattctgagtctcagcctcccaagcttcctgatcttttcttattgaagctagcttgttctgaccgcacagggcttctttatggttagtttgtttctgtttgcttattgattcttctgaattttgaggtagttgtggccttactgtttctgtattggcagatgtcacagaggttctttacaagcttgagattaacattgagaaagttaagatatcgactacccctgatggaaaagtgatggacttgttctttgtcacagacactaggtatataaacaaagcttgaaaggagatttttgatgttccttggatgtttaagttaggtgtgttctgtttttgttcttgtcagagagcttttagggacggttaagaggcggaatgaagtgtatgagtacctgagagatgctataggagattcaatgatcagctatgacattgaacttgttggccctgaaatcacagcttgctcaacttcctcgtcggttgcagaaacattgttctcctcggatgtgtcgggagagcattcgagtgggttacacacttcaagcaatgtttctattgcagttgacaactcgctaagctcagctcacaccctcattcatatcacttgtcaagatcacaaaggtcttctctatgatattatgaggaccttcaaggatttcaacattcaggtttgtgcaagtctttaatgggttttttctgacccttcaaattcatatgctttgcttaaaccttgcgactgttatttacatgagactcgttttctcaaatcttatttgatgatcagatctcatatgggcgttttacaatcaaactaggaaagaactgtgagatcgacttgttcatagtgcaatctgatggccgaaagatccttgactcgagcaagctaaatgcattgattactcgtttaagagcagagctacagcaacctctgagagtggtaatgatgaatcgaggtccagatactgaacttctagtcacaaacccagttgagttatcaggaaagggacggccacaagtcttccacgacatagcacttgccctcaagaagatcgatacctgcatcttctcggtataatataactcacccaatcacatcattcgagctcataccaaaaacagtccatttttgtatcatctaaatatcgatgaatctgatgtctttactaggctgaaattggaagacacgtgactggagacagagaatgggaggtgtacaaagtgttgatcaacgaagaagacagcttaccaatcccgagaagcaagatagaggaagaagtatggaaaactttgatgggctgggaatgaaaatctttcagagtataggaccattagctaacctcagactcatcgaaagagtatggctataagatttgtcactttatgatgcaatgagtgtatgtagattaatatgatacgaggagatatatctgataagccacagtgtgtatatatggtttgagtctttctttttgtgttgatgagaaattgtaagtagagaaaagcagaacgttggaatgttgtaaatgagtactgtgtgggtttcatagtaagaagctaaagtttttctctttgttgtattgagctgagatttttctcatattatatgaagtgagtggctatatcgtaattaaacacttaatgaggggcaaaaagtgaaggagaaacctaagaaaaatggcgactctttaagaagcacacgaagacaatccgaaagctgaccacaaagttttctactttgcaatttagataaatctttctatccactttgagaataaattaagggctctcaatttcgaattctgcttctccaacgaaaaaaacgaaatctttaatg

SEQ ID NO: 13558 - DNA, 3000 bp, Unknown; identical to SEQ ID NO: 13547
  misc_feature (1)..( 3000): cDNA_ID_2703319_gDNA_ID_2214636_Annot_ID_188114 3000 nt of promoter + ATG

SEQ ID NO: 13559 - DNA, 3000 bp, Unknown
  misc_feature (1)..( 3000): cDNA_ID_2713826_gDNA_ID_2214636_Annot_ID_136137 3000 nt of promoter + ATG
cgtcaaattgtcatacaagataaaccaaaattaatttacttatatgtatttgcaggtatggttggtttgtccatgatgcgtcaggttctattatttctcaagttccaacttcagatccttgcccttcactcgaggatgacatgaatgtggataggttgaacgaggtcaacatgctccttactgaatcaggacccttgtctgtgcattcaactgctgaacaaacgacatctgtagagcccagtcagggtctagtatgtgcatctggtgtccatgatcgtcccgcaagatctagagatgattatgaacctgcttcaacgagtattactccacttgagcatttgagcggcggtaatgcacaatcaccaggagaatgggctgatagtcttactaacataagtataggtgatctactttctgaagtgcccgatgacatagatagtgatggtgttgatccacctgccaccgaaggttcacattacctccttcgagatgtcccatttacctctgactcttttgatgctgcaattgctgctcatatactaagacaccagaacaagccaagtgctcaactaccgctgacttctggctcttcctctctgtgggatgatgaagaaacacgtgatgccttctctttccaaaaaaatcgtttcgcaaattccaccgagctggctagtgttgcttctcctaaaggtgttggcagagtaaatggagagccttcacagttggtggaggtaactatatcagcctcaaattccacttccctcaattgtttacaaaactaaaccatctgattcaatactttctcttaggcttcatccggcgatgagggatcttataaccctcatgacgatggagatccaatggaagagggtccagcagaccctcatacgatggattctccagggaagaccccttgtggacttgcggatgtatactgggtaaatttagaaatctcatatatttccccaatgtaaaaaagtcatatatattcaacaacaacacatgtttcctctttgcagcccgactcgttaggaccactggatttagacattagatcgtcaaagtatacagatgatttgatccttagtgagagcctcgggggattgagccgtctgatagcaaccagccttgatgcgtttcagaactgctcgctctttgggttcgacaataagaaggacaagtctaacatggtatgaaatggaaccaaagctaaagcatggggtccaaatgttgatagttgaaaaagaaagtgacttcttgccttttgaaaaaagaaacttttatcaccaactgatagcttcactgtacaaaaatttgatgtaaccttttactcttcctttcacacattcttttgtgttgatacatgtttctctgtgtacacttttactgttaatttacatgtttatttggctaccatgccttctttcttttttttttctttttttttgttcttttgtttatagaagtttcatgacaaataagaatttcaattaatattcttaagttcttttaagagtgcgagtaaaagaacaatcgtaggacgcaaaatttaactcgctcattcaagagtagtgttgataagtccttttttttttcatttcaatattctacccgaaaaagattccaaacttctacttttctacacttgatcaccactataatcgaagatttatgaacaatagactctttaataaagtaaataaatcatttaaaactaagtttgtttgttgtcttgatcatatgtgttcaaattggttttctcttctattctctacattaaaacatcctccaacattcagttttctcactctcaatgaaccagtaatacacaccctaggtgcactagatttcattcaaaactaaatctggttcactaaaccaaaccatattgattttcaggaggaaaaccactttttttagtgtgtagtacgagtaagtttacaccctgagatgcagggttttttctttgtcttttgctaagtgcgtgagatgcagttttacccctagttagaggaaaacaatgaatttgtgtaattttaacattttcttgttatgaggaatatgctctgaataatgagaaccatacaagatacaacaatgacataagccaagttgtcataaaaggccaaatgtgctttaatgtgtgatacaccgctttacactggcctactctttcacttcacgtcaagttcgtaaacgaagagacaatctctacgtgccctccccttgaatattcagcatcatcttctttttttgaaatcaaatttgacggcttctgttgtcacaggatatactatagacaacaaaactacatatgatacaaggcatattcgagttctgatcattcacaataaaatacatgtgatagaagcaatttaaatatgtgcctgaaatatataaatcaagaaagccattaatcaaaggttaaagcaatatggattgtacgtgttgagtgtatttttttttttttgtcataccaagaataaaaacatcaggccgagacagtagtataagcgagggaagagatagattaggtcctcaattcaaaggacaccaacttttgatattttatagctagcagccgtaaatcatatttgttctatttttagcaatacaacatttcttagacaccaaaatcggtttagttaatcagatttcaagtatgattttatgagattctaagcatggatgattcttttcattggctacttttaaaataacagaaaggatctaaattttcatttgtagtaaatttgaaaacgttggcgtggccttgcatatatatttagaaaatcgtacagtggaattggtttaattggtaaagttttctaggaatgatgtagacgaaacaaataataagattatcctttaaaaattcacttataccacaatcaaatccatattgaatctcactcagaaccctgataaatatccactctcagtccatatatcactcaaaacttcaagaaaaaaagattcttcaaaagagcaaaaaaatca

SEQ ID NO: 13560 - DNA, 3000 bp, Unknown
  misc_feature (1)..( 3000): cDNA_ID_1450561_gDNA_ID_2214636_Annot_ID_136139 3000 nt of promoter + ATG
aacgatatgagaaaaatgtaaaattcaaacatgggactacattagctgattttgaaaagacttacaaattcttgatgcaataacctaaatctcgatcaacgtcagcctttaaaacagtctttagattctgaagtcgagtatagataaggtttgtaaccgaaacaagagcttttgggttccctgttttgctgtaatcatctccatccagagatagtgcaaatgacataaaactcaagccaaaaacaaagaacaagaagatgtgttgtgtccaacaaacatcaaccctaactctcattgttcttatatcaaaagtcttgccttaaaatcagaaccttccgaatcgaaatatctgaaccctctgacctaacaatagaatagatacattggaagctaccaatagaaatatccgtagagatgtcttgtgtttttctatcatgtcttgagaaaaccaatgagtatattcttgaaaaatggagatgaaggattaaaagaaagctaacgagcttgttgtagattttttttgttctcttttagaaaatcttgaaatgttgacgttgagatcaaaagttggaaagttgaaaaatgagagacttgcgtgaaagaagagagttgagaagggtcatcatggaaggaggtccagatttctagcaaatgaaaaaaaaaatgggtgagaaaaatgattggtttcttaattataacttatttccaaaaatagaaataactatattggaggagcatgacaaatgatgattctttggatttcatgagaaatttttgtttatttaaatagtgttgcttaatgatttcaagcattactaaaaaatcacaaatcaatagtgagaaaaacaatataaacattataaacatatggcattattttttaatcaatttgtttccaaaaccaaataataagattatcaaacaatattattagttgtttagtggcaaaataacattaccaaactaaacaacatgatttgactaaattatccttatctgttacctcctaaacttttaaaatcctaattttaacactctaaatcaaaagcctaattttactaatggtgacggcgtctacgttcctcctcctccgcgatctcaacctcagattccgccgtcgtggtcatcggctctaaaagcatcgctgtgaacggcatatgactgtaaccattcaccggatactgaattccgattggctgacaaagatccaacctacaactcggcgattgtggcgtttgcgtttgcgtttgcggcgacgtcatcgacgacgacgacgaggaatcgtccgccgcaacatcaacccaattcgaaatgagcttagtcccgtagccagtggcggcaataatcgacggttcagcttgactaagaagccattcgatggtttctccttcagttttgtgaccgagctcacgcgttaactggaaaatcctagcggcggcgagagccggcatcgtaactcgacggcttcgtccgttaaccttcgtgtgacggtctttagtcctggcggagatacatccgccgccgctcgaggaggatttcgaaacaccgaactgcgtttgggaacgcgattcggaagctatagcgttgaagttggactcatttctgcacacattctgaaaaatcatctccgaattcgtcgattttgtaaactaatttcagtgacgatgaacaaggattcacagagagaatcttagggttactaaaggagggagaagaagatgattcgaattaacttttggataatttgggcttttaagcccaatataaggcccaacatgatccactctgtaggaaaaaaaaaaagggagagagaacaaaatctgacttccatggcaacaaacaagttttaatttttacaaaaaaaaaattgggagtgtgtgtgtcgccttatctgttcgtcatggctctgtagagtagcctcatgttcttattcttcttcttccttagccattcgtggaagcaaaaacagagtcttttattctttggtgattctgtgaaatggaagctacgaggaacttggtttcttcatctccttcgtttcagacaaagactcatctcaagagcagctactcttctccttcctctggtacttcttattcagctactcttcatatagaaatattgtgtctttgctggatttgtctctgttagttactggaatttgaagttcatggatttcaatttgaaattagtgtatgtatacgagtttgtgttagcattttctgatttgtttttgttcgtttgttggtatttctgtagtagtgatgcttcatgatcaaacaacaactcctgttgttaactcacgtcatctcaattctctatctcgacattttcctgcgtcggttctctcacaggagccacgggaagagtctaggcctctgtcacatgcgttaagagacgatagaacatcccaggtgtgttttattagcagcaatattgtcctaagagattgaatcaatcataaagttgtcaactttctagtcctcttgtttaatgcgattgggttccttgcatttttagttgactctggagaggaggcagtttgatgaattggtttcatctcgagaagatgagaaatttgaacagcaacttcttcactctactggtttatggaatttgtaatgtctcttcctctcttaaacccaccagtttcagttttcatacaaccttttgagttttctgaatgatgtagcctttcttttgtttgcagattaatatctcctttaacatctgaaacgaaattgccggcagttgtgtctcctttagctgatgcagagctttgtgatgtggttgcactagctcagaaggctttatcagcttcaaaacaagctgcattgttagttgatgacactgaagcaaatccatctgacaacatcaaggattctctctccactaggttgctttttttaaccttgtttgtgtatcttatcaatctgctacttgtgggctgtaatgtgaaaagatttgtatttctggatgtttggttttagctcttctatg

SEQ ID NO: 13561 - DNA, 3000 bp, Unknown
  misc_feature (1)..( 3000): cDNA_ID_2703337_gDNA_ID_2214636_Annot_ID_136141 3000 nt of promoter + ATG
tcgccgcaaacgcaaacgcaaacgccacaatcgccgagttgtaggttggatctttgtcagccaatcggaattcagtatccggtgaatggttacagtcatatgccgttcacagcgatgcttttagagccgatgaccacgacggcggaatctgaggttgagatcgcggaggaggaggaacgtagacgccgtcaccattagtaaaattaggcttttgatttagagtgttaaaattaggattttaaaagtttaggaggtaacagataaggataatttagtcaaatcatgttgtttagtttggtaatgttattttgccactaaacaactaataatattgtttgataatcttattatttggttttggaaacaaattgattaaaaaataatgccatatgtttataatgtttatattgtttttctcactattgatttgtgattttttagtaatgcttgaaatcattaagcaacactatttaaataaacaaaaatttctcatgaaatccaaagaatcatcatttgtcatgctcctccaatatagttatttctatttttggaaataagttataattaagaaaccaatcatttttctcacccattttttttttcatttgctagaaatctggacctccttccatgatgacccttctcaactctcttctttcacgcaagtctctcatttttcaactttccaacttttgatctcaacgtcaacatttcaagattttctaaaagagaacaaaaaaaatctacaacaagctcgttagctttcttttaatccttcatctccatttttcaagaatatactcattggttttctcaagacatgatagaaaaacacaagacatctctacggatatttctattggtagcttccaatgtatctattctattgttaggtcagagggttcagatatttcgattcggaaggttctgattttaaggcaagacttttgatataagaacaatgagagttagggttgatgtttgttggacacaacacatcttcttgttctttgtttttggcttgagttttatgtcatttgcactatctctggatggagatgattacagcaaaacagggaacccaaaagctcttgtttcggttacaaaccttatctatactcgacttcagaatctaaagactgttttaaaggctgacgttgatcgagatttaggttattgcatcaagaatttgtaagtcttttcaaaatcagctaatgtagtcccatgtttgaattttacatttttctcatatcgtttgttgataattcaggaagggcgattggaatgaagcatttaattttgataaaaatctggacttcttaagcaattgtgtcaagaaaaatgatggtaaacaacataaaaagggttatgtttttatattcaaatacttgaacattgagatttaatggtcttgtgatatgcaggtgacctcacacttagactatgttcagctgcggagataaagttctactttagtagttttgttagaagagatgaagcaacaacggttcatgtaaagcctaacatcaactgcaatttagctaaatgggtttccggatgtgagcctggatggagttgcaatgcagatgatgaaaaaagatttgatctcaacaatggaaaaattcttccatctagaactcgtaaatgtcaaccttgttgtgagggtttcttttgtccacaaggtcttgcttgcatgatacgtaagatatccatttacatacatatatgttatatcaacattataagtactaaaactttaatctaacatattcattgttgtttattctctgatttatgtaaacgaagcgtgtccgttaggcgcatattgcccgcttgccaagcttaataaaacaacaggattttgtgagccgtaagttgttagctttctagattgagtaagttaatgaaaaatcttattagtggatgatttaaagagtttttacattgcagatataactaccaaattcctccgggaaagttgaatcatacatgtggttctgcagatagttgggttgatgctgagagtagtggtgatatgttttgttcaccaggttcatattgcccaacaacgattcgaaaagtcacttgtagtagtgggtattgattcttttatctcacaactcttgttactttttgaaaatttgtttcatatatgaaatattcatcattaaggatgtaattaatgtttttatgtattacttagacattactgcagacaaggttctacgtcacagaaacgtaagtttctaaaacactaaaacctaagaaaatgaattgttttataatatcattatcattcattaattctctttttggtgaccgttttagcatgttttaagctcgcaacatgcaatccgaataccgcaaaccaaaatattcatgcctatggagcgatcttaattgtaagttgttagttaattagaatacattttgctttaaaatttgttggaaattatattttcgttattgtatatataggcatcactaagtcttctcatgatcatggtttataactgttctgatcaagttctcgccactcgagaaaaaagacaagcaaagtcgagagaagctgcagcgagacatgcaaaagaaacaacacaagctcgagaaaggtggaaaaccgcaaaaggtgttgccaagaaccaaaagatgggattgtctgcacaactatctcaaacattttctcgcatgaaatctgctagaaaggatgccacaccagttaaagcatcgggaaagtcaaaagacaagaaaaaagaaccgagtaatttaaccaagatgatgaaatcaatggaggagaacccgagtaacaacgaaggattcaatgtaggaaccggtagtaaacctgggaagaagccacaagctccaaagggtaaacaactacatacccaaagccagatttttaagtatgcatatggtcagattgagaaggagaaagctatggaacaaaacaacaagaacttgacattctcgggagttatttcaatggctactgacactgag

SEQ ID NO: 13562 - DNA, 3000 bp, Unknown
  misc_feature (1)..( 3000): cDNA_ID_2703372_gDNA_ID_2214637_Annot_ID_136145 3000 nt of promoter + ATG
ccaaaaagggaaataatttaaacaaaatatgattttattgacgttattttaattaagcttcagtcttaactcttaactcttaagtagtttcttaaatagtgtgtcaaaaaaaaaagtaagtttcttaatactgcttctaatttgcatgtcgtagtatcagaagttttttcaacaaaaaaatcattatgaagagagtttatatgaatatcgctaaccattatgtggaattgtggataatggataaattttgagaactaattggattcatgtgttgcctcacagtgagctgacgaccgttcgatcattgatatacatacacatatgatgaaaaaaagatgctaatttctcgttgctttttttttttggtcttttcaaaaaaggattgagacaaaaaaagaagagaaaaaatgatgaataattaggtacctttccgagaagcaaaaccctcgaaactctcatcaaatatcctaaccatacctttctttaaaatttggattttgcacaaatccatttacaaatttaattactttttcttttcgtaggtatatatttatttatacctttataaatatataactttataggaagaagtatcgtatagtactacttcctactcgctatacaataaataatacaatgcgaggttgtttgtttcttatcacaaagttgtaccctatgcaacaacattcatataatcatccttttcccgagcattttgactgatcaatgcttcagtgcttcttcattatcatacaacacgttccaaccaaacttgaatcatgtatttttcccaaatcccaagttacacctaaatgataccaaagattacaaatacaactaaacatactcctagttttttcttatggaaaaggaaaattaagaacactagttagatgcaaacaaataaaaggagaaamcaataaaaatatatatatatatatatgagtgtccgaatcgaacgaactgaataatgtggaataagtttgattcgggataggttttgttttctgaataatctgcaaaactgacaaaccgaaatcgaataaaccggtcggctcaaagtctcaggtttagatatagcccaaatatgattgcaaatcacttaaaagttatacggacaccactatttgatcaacataaaaccatgttctacaataaagatttaagaattttaaaaatgggttggattggcctgaaactggattggaaaaattggtatttcttcctttaactaaatggcacacgatcaatttctaatttctccaaaaataccatttcttttggtattactaggtactagcccatgaagataaaagaattcattttactttatttcattctagtatatttcttgaacaattctaatgcaatttcaatgtcttgactatactcttgatcctccaatcgaatccacaagattttctaccaaaaccgctttacgacttacacctcaatcgtaaccatccatgaacttaattcggccaaaatcgattattctatttggcacgttatgttatggactgttcatatacgtaccacgttccaaactcgtttgtatctaaaaaggaaaaattatctcacattagtgatttttttttacttgcatcaactctattactatatactaatatatattaccattaccattttgaacgcgttacatagacattatttagtcattagtcaaatccctttactatataatcccatttgaaatgtaagaattttgaatgttgacagatgcaaataaggattagcatacaaaattactttgtaacccttatttacgtgataaaaaagtttagcctatcgttccactattaaaaacatgaacatgtaaaagttgaattttctatcttttcttgtatcaactatcaagtaatttgcaagtacctaagtaaaagaaaacaaataaacacaacgatctttattactatatttaaaacaaataaaagatagacaactattaatttgtttatatgcatatcagtcctttgcaacgtagataaaagcggtattatgcaaataaacttttcttttgtcaattgtcgtcatcatgcaaataaattttcaaatatcactgtcattattcaaatttcaaaccctaataaaaaagcaaattaaaaaaatggtttcgtacgacaaagggcttaacgaaagatgataagaacaaacattaataccgtagcttttgtatttctaacatcagtaaaaataaaaaaatcagacctcgtaaccaatgaagctgccataaaacctgagatggtgtagttaaagagggaattatgatttgtgtcagctatcaatatcatcataattagctgaaattatatttattctttggagtttttatttatttatatttgaacatttattatacaaacaaattatatacaaatagtcgtaactcattttatttttctcttcttcttttgttattatttgtcaaaataaatagtcctttatattcgtaattcgtaaatcagtataaattaaagcagaagtgaaaacataagccaatagtggtaaaaactgttattctatctctattctggttctgcaaaaagcatatatcaatttataaaaaagtgaacagactaatactagtagagttaaaatagactgtagttaagttaagaaaatgtacgatcaacagcccacaccgccacagatgaaattacgtggaacgtggtaaaaaagccacgacggtaaaatagtaatttaattaactcttcgattttccttttaactctgaagagggcaaaatggtcaatgataatttcgtttatttagtcataaaaaaaccgggaatgcaaagagatgagggcaaaatagtcaaattaaaaaaccgacgatcttttagattccttttaaaacctagacgtcccactctcacacaatacacacaagtaaccagttttctctctcattttctcagtttttctctctctccgtttttgaaaagatttttgtttctactttgggaagctttccgctaca

SEQ ID NO: 13563 - DNA, 3000 bp, Unknown
  misc_feature (1)..( 3000): cDNA_ID_2703379_gDNA_ID_2214637_Annot_ID_136147 3000 nt of promoter + ATG
ctaacttttaacttctctcaaggaattgaatataaactgatgcgtctattgtgaaaggttaagaatgttgatgaacgttttagttagtgagtttaataggttttgtttactgtgtaggctaccttgaggttggtacagctggataaagtggcagaaactctgtctcaccatgttatggagcatcatgaagtaatgggtaagtattcttgaattgagaagatcatatgcgtttggttttgtgagtattaatatttgcttttggccagtgaaggggatgaatttggtaagagaattggagaaagatttgaagattgcaaatgtcatctgcaaggtatgagtttcatattcttaacctaaattttacataaacaatacagtggttttattttctattttatctattactggtttgacttggttttggctgtttttgtgtgtttattgccagaatggaagacgaaatttgacttcttctatgaatgaggcttcaagagatcttattgtacacactcattccaaaaagaaacaagctcttctggtaggcttctcaatttatttcagacatctaggctccactgattgtttctttaatctgctttcttgaaatatttcatgtgttatagtttccttctgaaatcaccatcaatgtgctctagaactttgtgtacaaaattactctgtattatcatctatcagaaagtggccgagtatcttttttgttttaatctctaaagttacgaacaggatgtttctagcaagtagtttcttagatacaatctaagtgtaacctagcctaattttttgttttaattgctaaacatactgttgagattattattcctagcatgcctgtttgcttctctggataccatgtaataagagcgacatgaaagtttaatctttttacttgcaggatatgcttcctatactaactgacctccgccatgcaagagtaatgcagtcaaatcttgaagaccttgttgaagatggaaactattgcaaggttggtagtttaccatcgtctctgttgtatacttccatggttttcttatatgaattatggtgatgttatgttatgaaactaacaagagatgggaatttattccttattatgcaggcatttcaagtcctatcagagtatttgcagctgcttgacagtctatctgagttctcagcagcccaagagatgacccgtggtgttgaggtagttatagcttattcatgaccaaccattgtcttcataattttctatcgtcagtcggttgagcttctcatactcttttcaaggtttggttaggaagaactcttcataagctggattcactgttgttgggcgtttgccaggaattcaaagaagatagttatgtaatggttagtaagccaactcattctcatgtatctctgtagctttctcctttgtaaactaaaaggattgaattgtgggccttcagtttagtggagaactagaaattttgttcagagatttaacttgtttatgtgctcatacctttaggtcctcgacgcttatgcactgatcggtgatgtctctggtctcgcagaaaagatacaaagtttctttatgcaagaagttatctcagaaacccactcagtgctaaagagcattgttggggaggtatgtgagctaaatatcatttgttgctcctgtaggatgtagtcgtgcatgcttggatggttgaatgtattgagcttgctggtgtatagcgcaatcgttgtttttcctatttttttggtgcaagccgcaatcctttttctgtgttgcttagatgtcacttttgatcctagcagatacacgaaagtagcaaattgaaacctgcacattagtacaagttttttttacacgttgtgatttatcttatttcattctgcatgcaatctttgtcataggcggtaatgcttttttacttcatcatactgagcacgaatgagcacgaaatgagtttattaacgtcagcatatcaaaccaatcagattgttgatctattctctgtatatatatttgcttttgtaggataacagtgctgccacccaatatagtaggtatgctctatgcacttgagttattactggtacctattacattatctagtatttatctctggtcccttttgtttggattctagtatccttgctgatttttttatttttttttaattaatttcagacttacctacagcgatctatgccttcaaacaccagaatccaagtttaggcaatgtcttttgagaacactagctgtgctttttcagttaatatattcataccatgagataatgagtttcacgccagaaaaggaggtaggttccattccttgctttagtttgtatttaacattttcttattaccttgatagggttgttgaaacagcctctggttctaatttcagtactacagtataatatttgttggtagatctcatagtcttaaacacctctgcagaccttttacttattgtctgagccaaactatacctaaaacttctctctaacactgtagttagaggaaatcttagcatatggttgtaaatttactgtgtgtttgtttagtttggtggtgtggaactctaagaagacctgctttattgatagggatctatctcgaaatttattacttgatttcctagttaacatacaattaagtggggtttaatatctaagcctctgtggcgggatttaccaggttaacttactctatgttaggtaattgattgtccaagaatttggataagttctttaattttagtttaatatttttgtcttattccctttcggcttgaaagataatgggtcctaaaatcttttctctttgatggcttcattgctctgtatcttatacattgtcagcatccttaagatttttttctgtatgttgtcaatgttaatttgtttaaattatctctaatgggttctaacttctaagggctaagcttctgaactggaacaggcagaaattttggtctcacccagtcttgcaacaactcaa

SEQ ID NO: 13564 - DNA, 3000 bp, Unknown
  misc_feature (1)..( 3000): cDNA_ID_3030824_gDNA_ID_2214637_Annot_ID_136148 3000 nt of promoter + ATG
ttatacattgtcagcatccttaagatttttttctgtatgttgtcaatgttaatttgtttaaattatctctaatgggttctaacttctaagggctaagcttctgaactggaacaggcagaaattttggtctcacccagtcttgcaacaactcaaatggttgattcagtgaccggaagttcatgtgacccacaggatggtggtctattgccgggaagcatacctccttgtaccatttccgctgaagagtcggatggaagtggaacatccagttcagtgcagctggcgtctaatattgcaatagatgagtctaggaattctgaagatagagtatcaagtagcgagtcaccatggtactatttacgaaaagaaagtgcagcttttgtttcagaaactcttcagagaggacgcagaaatctttggcaacttacaacaagccgtgtgtcagttttgctctcttccccaggtgcttcttcaacaagtatacatcagttcctaaaaaattatgaagacctgagcatctttatccttgctggggaagcgttctgtggatttgaagttgttgattttagggagaagctaaagggtgtatgcgaaaattatttcactgcatttcataggcaaagcatgcatgtaagttccgttttacaatgcctattgggctgacattgccaataccacatagctagttaatttcatgcatcacctctcctacatgataacgtgaaaataaagtctttgtttggtttttctcccttacaggcgcttaaaatggtcctggagaaggagacatggacgaaattgtcaccagatactgtgcaagctattaattttgctggtcttgtgggggatggggctcccctaattatttcttcccgcagtgcctcaggttcttccagattccctcactctgataagccaagtaactcaattgatccaagtggcaacaggagtggattttcatattggctgaaaagtgggaacccgttctcagcaaagttaactcactatagagaagatcaagactactcctcgatcaatggagaagatcatgaagggaatgatagtattcatgatgatgttgtgaatcccaagataagagacataaaacgcatcaacggaggtagtcctgtttcagaagatgaaaacgaagaccttcttgctgactttattgatgaggatagccagcttccaagacgaagttttacacgtagtcaatcaaggacttcttcttcacattttagtactaatgatgatttgacagctcaaacaggatcatccctttgtcttctaaggtaatatatgcggtttaggaaatgtttgaaattataatgacagccttccgatcgcatattttccctggcacttttatgacatggaattgcattaattgtgttcgatgtcttagatctatggataagtacgcgaggcttatgcagaagctagaaattgttaatgctgaattctttaaggtacaaatcctaatacttggaaattcgtagatttctctactctgctccctcgatttcatttctaacttttctcttacgtctgtttgaaattttgtagggaatatgccaattgtttggagtctttttctatttcgtgtttcaagtatttggtcaagaaaatactaattcaggtggaaaaggagtttccgactctttcaatcgtgagttactgattcgtttgcttttgatgctcttctttgtttgtaatgttactccccaccagtgtcagtatgagtcgtgttatgacttttaaggctacaatatctgcggaaagccattttgctcaacataagtatattttgaaatgcagatcgtttgaaaagctgcttatcacggatatcacaagagtgtgagcaatggataaaacctcacgtttcatcatcaccatcttcttcacttgcctttcccaacactgttcatagtcttgcggatgtgactccagcaagtcccttaaatacttctggtcacttatcaggcgtatcttttagtctcaaggtatataacttggggctaggttttcatcaatttgaactacagttaatactgttttatgttcattagttaccctaaatataactatcctaatcatttatactctagtatttgatatattgtgtgagaagaagagcagctgccttgctttcttcttatcatctcaaggttgtataataaaaggattatcgcttgcaggaaagatgtgctgctgtggacacagtatctcttgtggctcgggtattgcataaatcaaaggctcatctccaatcaatgcttatgtcaagaaatgggtctctggttgaagacttctttggtcaactggtatgcacctcttcagatcttattttttaagaaaaaccctggttggacgtattgcctcgcttggatttgctgttgacaacatgcatacaatcttattatacagacacttctgtagcatccaatagtcttttgcctctaaaaaatattgaattatacaggacatgattagtaccttcattgtgttacgttgctaaactaatttctcctatataaaatgaagaactatctatatacaatatgtggtatcaaatacatttgaagtagtttgattaaaaggagtgattcatcaggttggttccgtacctgatctgacagagcacttacataggacaactgcgaggatactgctgcatgttaatgggtaaattgccgatcttcttatgagcttgtgttttcgaaagaagtgattagataaattgcacctctctcttcccttgcgccttctgttcgattcttactaacctcaggagttttaaaactgttacattgaatgtatgcatgttcattcagcttaaactaattttacagatatgtcgatcggatagctaattctaaatgggaaatcaaggagcttggaatggagcataatgggtttgtttaccggatgacccctaactgaatcatgaaatatacttaaatgtaataaactctttgaactaacaggtatgttgatttg

SEQ ID NO: 13565 - DNA, 3000 bp, Unknown
  misc_feature (1)..( 3000): cDNA_ID_2713848_gDNA_ID_2214637_Annot_ID_136149 3000 nt of promoter + ATG
tggatgaggccattgagtaaatgagtttgatgacaaaattacaagctaattaaatgtgtatatagatcaaaatttgttccaactttgactacaaaaataaccaaaatattaaatgataatactttaaatttaatatatatatatatgaaaataattaaattcaaaaaatgtttctaaaatatatttaattaacatttatgatttgaataatagatttctcgaactattgaaacgtgtacatccaaaagaaacacacattatcaacatatgtcaaattaaagagatcaaaatttgttccaacttggaatttaattataaccaaaaaattataatggtaatactctaattttgacatatctatatcaataaatgaagaagaatatatatatatatatatatatatatatacatatataatttatggtttacctaagaaattcttcaaactattgaaacgtgtacgtccaaaagaaacatacataaattatcaatattttccacttggtattaatcttttggtttgtaaggttgatctttttgttcgagccaacattaaactacattagatggaatgttggctcgaacaaccacattattcaacttagtttaaagagtttcaaacactgtttatcccctcatgcaaaatttgaatctcttttctaggtgatgacattcctcatttcactatctttaaccgatactgcttttgagaaagattacaaggagttaactcggctgatgacggccacgtctgatgagtggtctggtctgtcaaagggtaaatttgtctatcattagcatggtgtagagagaaccttctaatgtaaatctttgactctttgtagtgtcaattgtaaaattgtatatgaaatccctcatcaagtaaaactgcatgaatgatttgttagttgagaagatcgatcatttggaacaaaataaaaataaattaaaatattacagacaaaaaaaaatattacaaacacgtaaactaaagttcacactaatcggtggacctcaaatatgatgggggaaaatgcccgctaattactctttagggagggtgctagcctacgtggttgggcgtgccgttttgagatggagagcatccgatcaggaccagtgtgtcagtgattgagtttggagcccatttcttcttattccttttgagttagttgatatttccctaagtgactttttctattgggcattctaatggacctggttttgaaccttttttgccttcagtttagtatgcttttattaggttaggcgttcgggtattcacatatagagtatagattgattggttctatatatgcgaaaaaaaattaactgacaaaaaaaattatgcgatgtcttgtgctcgaaataaagaataacaattagaaaatacgaatctagggttcaatccatggataattacttggaaaaatcctttaccttgtagaaattgacatgctattttatacaaaaagaaacataagatgtcaatttctttgtgtataaaacatgcaagaaaattatttgttataaaaaatatagaaaatgtgaattcagatgggtttgaatgtgttttggcctgtcacctttttcgtatgctaacttaattttttttttaatttgtttttataaaacaaatatggttatagttagcctaattaattatagttgcgtcgttattattattattatttagtaacaacataatttaaaatcggaatgttttgtgtgaatagatatactatcttggaattgaaaacttttatcaaacttctgacatgaaagctaagtttggccatgtacgtatgagttaagatattaaattgcctgaatattcagatgtacttttttgaaattttattttcctcttatctgttttttagctcaagaaagtgacgcaatactgatagccaacatgtggagtagttgttgcatcgaccttacgttaattccccgaatagctaaatatcaaattgctttatcatctcttactatttgagaataaattcagttacggtatttattaaaaaggataacggacttacgcatgaatctattcgtaatcaatgagtggaaaccacttttttggtgtcatagttgcattcgtgccggccgcatcatctaagaagcaaaccaaggagattgtttttactactacgttgctcttgctgtcttgcaaaagatcaacaagtaaatatccacccataaactcaggcccgatatccaaaatccagtatagacactaggcagaacactataagtagcaatctacacttcatagacaaaaaaggctaatcaaacctagtttcgtcttaagaaaagtaataatctaaaacaacactcgctcaaaaacaataaataacataatttacgtgatgttcttctgtttccctcaaatcgaatgaatccatttttccttgagtggtggaggttcatcggaaataaccataccgatatttttcatgaccacaatactttattccgtcgtacacgtttatctacgatctagcaatcaatctacgaagccaagaaacaagaacagaatgtggatgaccaaaattttgtgctacaaaaaaaattatccaaaaatatcacaacctattgctgtcagaaaaacaaaacaaaaatattaatgttctcttatggaagaaaatatttcttttactttttggttaataattacagtaagaatttagctgacattctatctttactagtgaattttcattatataatatatagtatatatataccaaataaggttgaaccaatagcattgacttaatgacttgacactccataatatattgcttcctatagtgtctttatccctctcaaattttcttttctctctccctctcccacaatcacaagataggaaaattgatccacaaagaatcgtctgaatgaagacaacagttgtttatctggtgattctatgtctcattgtttcatgtaccaatggagaaaccaaacatgtaagaaaaattaactccgatg

SEQ ID NO: 13566 - DNA, 3000 bp, Unknown
  misc_feature (1)..( 3000): cDNA_ID_3030802_gDNA_ID_2214637_Annot_ID_188171 3000 nt of promoter + ATG
atatccgtgattcacggtactaggttgtgacaaatcactgattctccaattactagggccttgtgggtctctatgtatcgactgaggcatgttcataaaggttgcggcagaatcttgatacaaatcggtttgaaccggtacggaaatctggttctgtaagataccaatcaaatcaaggttgttgggaattctgatgttctgatgctgctgctgagtccaagtgttgggaaaatcattcatttgctcaactctaaacttatctcttcggatttgttgaaaatctggttttatcatatccatctttatgtaccttttgatattctatcataagaaattaccaacaaattaaatatgcatgagttccatatatatagcaaattaattaataaacatctgtaaattggaagaggttttttttatgatcacagaaactacaaaagcgagttgtatgaatggaataatcgttagactgttcaaaaaaaatgaaattcttactaacatgaacttaaagatccaaaattaaaaccagtttacaagaacataaagattcatgcgacagggaccttttagctaacataatatatgcattaatttctatataaccaacaacaataacaacaaaagaacgacgacctttaattaaatttccaaatgaaaaactacaaaaaaaacagggaaaacacgaaatgagagatggacgaagtaaaaacacccagaaaataatactttttatataagaacaaaaccctaggaaacttcaagaacaacaaagagaagaagaacaagaaaacaaaaaataaggtgtgagaatataactagtattcggatttaaatttggtaatatatatcataatcgtcaagatttcaatttggaactataagtaccatgagcaaaacaaatactcgcgaggagaaacaaaatgaataaggtaagtggaagtgataaagacagatagatctcagaagaaaaaagggaacacaacacataccgatcggaaggtggccggaaaaatcgtcggagctccggtggtgagtttagatatgtatgtaaaccgaccgtgggagatagagagagagactgagagagactgagagagaataatgattgcgtaaagccgtaaaatctgtaatggtttttttcttgacgtattaaggtgggttttatcagtctttctattacacggtactgtacttactctcttaaaaatctattttgtcggtttttttccacgaaaattattttcttctttaaactgatacacatgtatcaatatccaaatgaaacacatttttatacaaattgaaacatgcaataaactacggaatatctaaaaaacaataaaattaacggccctaaaattaattttaactaaattctttaataaaataaaataaaatcataagtctataaagtattagttattttatggtagtttaatggttaataattgttttttcatatagaacataggaatgtggttaaatttcagaattttaatacacttttaacttaattatttgtttatatgaggcactttaagttttagaaaactataaacacatatgcaaaacatcaaaccaaattatgtttttgcatgtcttttgttgcatgctctatatatcctaactatttttgcttagtagtccactaaattgtttcgtttcaatcacaaccactcaagaaaataattacaatagattactaaaacaagttaacaacagtgttatttatttactctttttgtcgtaatgctttaaattacatgtctctttcttttcatcggacaactgttagtgtgtttttttgtacatcaggacaactgttagtttactcatgttttctacattgtacattttggcagtcaattttacggcacggtttccattaaagatatggacgtcatcttatggtaagctgcatcttttgaggaataatacatgtagacgtccctatttataatttttgtgttacgtaacttcccttttgttattaattaagtgtgtttatttggtcaattcactcaatcaaatcaaacccaacgccaaactgcaactatttatgtgattgacgcttcagagttgaaactgccacttttgtcagatttattatctcacttcccaacttttcttttccgtaactagtgaatttattcatgggaaactaatttaatgcatggtatatgatgcgtacaacaagcaatacttatatgaaaaaagatttagaaacaaattgtattggcttaactaaatcaattaatcatgtagcaattaggtgatttggagtctattctctgtttagaaaagtagtaactgttgtctttatgagagtttctgttttacttagcgggtaaatctactctaagctaggtgttttcatccacttaacatgtattttataatctcatggttttcacaagtcttaaattgtacttattagtttggtctaaatattactccctttgtttcattatattggatgttttagggattttattttgtttcagattataagatgttttacaagtttaaatttaaatttaatttgactatttgtgactatttatattttgcagttttcattatcattttttttaacaaaatctaaatactattttttatatacaaaatgacctaatatgtatccatttaccttaaacctcttatattttaaaacagagtgagtacattcagtaagagaatggataaaaacgaatttggaatacacaaactataaaagtttcttgagtactgtttctattattgggccataaacagtgagacaaacaggcccatagaagtaggtgaaaaaggcttattaagatcaacggttctctcgttacgaatgcaaagaatcttctggatcctttttctctcagctactctctccatttatctaataaaccctaacccctcctcccacactattcgtttacactaaccacttccttatccacaccaatccagaacgttcctcaaaaagctccctccttttctctcaaa

SEQ ID NO: 13567 - DNA, 3000 bp, Unknown
  misc_feature (1)..( 3000): cDNA_ID_2703390_gDNA_ID_2214637_Annot_ID_188168 3000 nt of promoter + ATG
gagctcgtgtgttgtgatacctgtccaagatcatatcataaaggtttggtatttgcagttttccatgtttgtttgttggaattcttctattgctacttttaaaatgtttttggagcgtgaacttgatagagcttatctgtctgttttggttttatctagtatgtgcttctctaccaagccttccgagtgagaggtggtcctgcaaatattgtgtgaatatggttgagagagagaagttcgtggatagcaatctcaacgccattgcagctgggagagttcagggagttgatgcaattgctgagataaccaatagatgcattcgaattgtcagctcttttgtgaccgagctcccaagtgtatgcgtgttatgcaggtgaatatcaagcttttccattatttctagtctcttgatgtcttccttcatagtgtctcattaaaaatgtttagttgagaagatgtgtattggctaactgaaaccatttgcttatgagactgacctttgcttaattttctatgttgttgcagaggtcatagtttttgcaggttgggctttaatgctcgcactgtgattatctgtgatcaggtactttgttgttcattgctgtatagggttccttgcctcttaaatctgcttctggtcttcaccatttttggttttgttgttttctcctcagtgtgaaaaggaattccatgttggctgtttgaaagaacgtgacattgctgatctcaaggttctttgcctatttagctctttcattccctcgggtgaaaactcagtatctatctttctcattcttgttatgtcttaacaggagctacctgaagaaaaatggttctgttccctcgggtgcgaagagatcaacactacattgggcaatctgatagttcgcggagaagagaagctaagtaacaatattctgaattttttaaggaagaaggaacaacctaatgaagaaaactgtccagattataaaaccactcctgacataagatggagggtccttagtgggaagttgacctcttcagatgataccaaaatattgcttgcaaaggcactttccattcttcatgtaagtcaagaccacatttcaaactcttctgtcctttctgctgtttgtcccttctaacaattgtatgctataggaacggtttgatcctatcagtgaatctgggaccaagggagatttgataccagccatggtgtatgggtaagcaattttgtatcttcaatcagtcgagtggattattctttgtgctgatcaacaacttttgtgtgtggaacagaaggcaaacaaaggcccaagattttagtggcatgtactgcactatgttggctgtggagtaagattcttcttctttttcactctaatttattttctgtgacgcatgtttcatctttttaatgttgtcctttttttgtttcttgtgcagcgaagtgattgtttcagtgggaatctttagggtttttgggtcagaacttgcagaactccctctggttgctaccagcaaagattgtcaagggcaggtaaacagtttttatctggaaccttggatgttttttctttacaacaggtgcctactcctatagaatggttaataaacgactcactcttactgtcaatcccatacattgataaattatacagtgatacatctaagcagacatgtttttgtgtcgaatagcttaagagcagaacaatgtgtagcatcttaattgcagaaggaatttttttgtgtcaaattgtacctgggggatgaaatgcttgtgattgctcttttttgagagtttgagaatttatgttttttttttcctattgtagggttacttccaatgcctgtttgcttgcatcgagaggctacttgggttcctaaacgtgaaacatatcgtgctaccagcagcagatgaagccaaatccatatggactgacaaatttggtttcaccaagatgaccgacgaagaggtatatatctatatccatataaacttatatacactcccaatgaatcccatctctgatacacactgtgtttgtgtgttattaggtgaaagaatacagaaaagactactcggtgatgatctttcatggaacatctatgttgagaaagagtgtaccagcaccgagtgccgtgagtaaaactgaggccagtaaggaggagtaagctcaaggttgtctttgttttttggtttttggaaagttggtgaaacgattggatgctcttttttaatctaatttcgggtagtagccacgttcttgtacaggtttctcccctaacgtgtctttctttgtaatggaaactagagagaaagatacacaaaagggttagagaatttggttttggtagagacgaagtagagataagagggggaagtaaatggggaagtctaaaacattagggcattcttttgggggtttagtcatgattatccgaagctaatttttttttgtatattagtgcccaaaaatgaaattcaattttctgaaatctttttctttttgtcactgatgtttatatatcgaacaaaggaggtatacaaagccggcgagtatacggacacctgaactctgactataagaggaagatactgatgcctttagaaatgaatctctgaaccgggaattataccggtttgattaacgtcgaaccgtaatcaaaattttagggctccactaagcgggaaggagcgcctctaagaaatttgaaactcaaaaaaatcaaaacacccgttgagaaaatgcccctataaatccccataattacttccttaccacaatgcctttttaattccctttcgctttccctcttctcccctaaaattcatttcgtttccgatcgcacttcttctcaaggtctgctttacttcccgattcttagattagggttcgatttctgatttgtttaggttctcgtcgttgtttagggtttagattactgacagattgctccatttcttttgtttagtaaatttaatagacgtttgttgggtgatttaagaagatg

SEQ ID NO: 13568 - DNA, 3000 bp, Unknown
  misc_feature (1)..( 3000): cDNA_ID_1010471_gDNA_ID_2214637_Annot_ID_188167 3000 nt of promoter + ATG
caggtgcctactcctatagaatggttaataaacgactcactcttactgtcaatcccatacattgataaattatacagtgatacatctaagcagacatgtttttgtgtcgaatagcttaagagcagaacaatgtgtagcatcttaattgcagaaggaatttttttgtgtcaaattgtacctgggggatgaaatgcttgtgattgctcttttttgagagtttgagaatttatgttttttttttcctattgtagggttacttccaatgcctgtttgcttgcatcgagaggctacttgggttcctaaacgtgaaacatatcgtgctaccagcagcagatgaagccaaatccatatggactgacaaatttggtttcaccaagatgaccgacgaagaggtatatatctatatccatataaacttatatacactcccaatgaatcccatctctgatacacactgtgtttgtgtgttattaggtgaaagaatacagaaaagactactcggtgatgatctttcatggaacatctatgttgagaaagagtgtaccagcaccgagtgccgtgagtaaaactgaggccagtaaggaggagtaagctcaaggttgtctttgttttttggtttttggaaagttggtgaaacgattggatgctcttttttaatctaatttcgggtagtagccacgttcttgtacaggtttctcccctaacgtgtctttctttgtaatggaaactagagagaaagatacacaaaagggttagagaatttggttttggtagagacgaagtagagataagagggggaagtaaatggggaagtctaaaacattagggcattcttttgggggtttagtcatgattatccgaagctaatttttttttgtatattagtgcccaaaaatgaaattcaattttctgaaatctttttctttttgtcactgatgtttatatatcgaacaaaggaggtatacaaagccggcgagtatacggacacctgaactctgactataagaggaagatactgatgcctttagaaatgaatctctgaaccgggaattataccggtttgattaacgtcgaaccgtaatcaaaattttagggctccactaagcgggaaggagcgcctctaagaaatttgaaactcaaaaaaatcaaaacacccgttgagaaaatgcccctataaatccccataattacttccttaccacaatgcctttttaattccctttcgctttccctcttctcccctaaaattcatttcgtttccgatcgcacttcttctcaaggtctgctttacttcccgattcttagattagggttcgatttctgatttgtttaggttctcgtcgttgtttagggtttagattactgacagattgctccatttcttttgtttagtaaatttaatagacgtttgttgggtgatttaagaagatgggtcagatccagtactccgacaaatatttcgatgatactttcgaatacaggtgattctcagtttgattctcctcccattttaatggagttctctctcacgttttagtttcagtctaatcgcgtggtcttttatttttctctcaggcacgttgtacttcctccggaagttgctaagcttttacctaagaatcgtattctttcggaagtaagttaaaaattagggctttcctctattcgctgtataacccttgaatcatcgtaggctaagagatttacatgtttaagaaattaagttaggaaattgaagtttggacttttgagagtcgaagaaattgaagtttctgcttaggaatttgaagttttgcttctcattaacttgtttattaactttaggttgtgtaattgtcagcagtgacgaagatagtttagatatttttttgtgttatcagtcaattctcagttttctgattttgaagttaacagttttcttgttttacaatctggttttgtagagtgaatggagagccatcggagtgcagcaaagtcgtggatgggttcattacgcgattcatcgtcctgagccacatatcatgctctttaggaggcctcttaactaccagcaggagcaccaagctcagattgctaagtagaagaattatgcaaaattctccctaatctctgtttatgtctctcgtaaacgaggttttaaaatactactctgatgttttgttcctgtagttttttttattgtgttcatgaattctcttcagtggagaatcatgtgagtttggtagaacaacttttaatgttatgttaagtctggtcctttgctagactttggttggatccacgtttgaacttcttcatggttaagaatgaagacgttatttctcatgcttatgtgcttgtttcatcatttcaacctctttttattgctcctcttagagtcttaagtccataactatgaacaacaaacaaggtatcattacaatgccaatctgaaggtctaatcacgattctcatggcgatactgattcaaagaaactcatattgtgtctcaatcaccacattcaccaaacaccatatattccttactgtactactattagtgtattgaaaccaggagattcagagccatttttataaattaactagatatgtatcttatacctagtgtgaagcactgattgttggaattaaatgaaatttcgagaaaatgaacgagttcgtagtttgatggtaaataacaaggtctttggtcaaagcaaccaaacaagttgttgaatttaattagaaccaaaccaatccacccaatttcaattcattttggtaactaaccggtttataatcattcatacccaatcggcgtcttctaaagaatttcaaaactctaaaaagttaatcaaacacccctctatttcctcataattacatatctaccccaaaccactttattctcctttcactatcttccccaaatttcaaacgatcagattacagattcttcaattcctctttcccttctcctccatttcctgattaaggcttcacatctctgagagagaaatg

SEQ ID NO: 13569 - DNA, 3000 bp, Unknown
  misc_feature (1)..( 3000): cDNA_ID_3030821_gDNA_ID_2214637_Annot_ID_188162 3000 nt of promoter + ATG
taaatatttattgttaatagtttattgggggaggaaagggaaaggatatataattagatatgatgtttggttaaggttgattcctaaccgttggatgaggccattgagtaaatgagtttgatgacaaaattacaagctaattaaatgtgtatatagatcaaaatttgttccaactttgactacaaaaataaccaaaatattaaatgataatactttaaatttaatatatatatatatgaaaataattaaattcaaaaaatgtttctaaaatatatttaattaacatttatgatttgaataatagatttctcgaactattgaaacgtgtacatccaaaagaaacacacattatcaacatatgtcaaattaaagagatcaaaatttgttccaacttggaatttaattataaccaaaaaattataatggtaatactctaattttgacatatctatatcaataaatgaagaagaatatatatatatatatatatatatatatacatatataatttatggtttacctaagaaattcttcaaactattgaaacgtgtacgtccaaaagaaacatacataaattatcaatattttccacttggtattaatcttttggtttgtaaggttgatctttttgttcgagccaacattaaactacattagatggaatgttggctcgaacaaccacattattcaacttagtttaaagagtttcaaacactgtttatcccctcatgcaaaatttgaatctcttttctaggtgatgacattcctcatttcactatctttaaccgatactgcttttgagaaagattacaaggagttaactcggctgatgacggccacgtctgatgagtggtctggtctgtcaaagggtaaatttgtctatcattagcatggtgtagagagaaccttctaatgtaaatctttgactctttgtagtgtcaattgtaaaattgtatatgaaatccctcatcaagtaaaactgcatgaatgatttgttagttgagaagatcgatcatttggaacaaaataaaaataaattaaaatattacagacaaaaaaaaatattacaaacacgtaaactaaagttcacactaatcggtggacctcaaatatgatgggggaaaatgcccgctaattactctttagggagggtgctagcctacgtggttgggcgtgccgttttgagatggagagcatccgatcaggaccagtgtgtcagtgattgagtttggagcccatttcttcttattccttttgagttagttgatatttccctaagtgactttttctattgggcattctaatggacctggttttgaaccttttttgccttcagtttagtatgcttttattaggttaggcgttcgggtattcacatatagagtatagattgattggttctatatatgcgaaaaaaaattaactgacaaaaaaaattatgcgatgtcttgtgctcgaaataaagaataacaattagaaaatacgaatctagggttcaatccatggataattacttggaaaaatcctttaccttgtagaaattgacatgctattttatacaaaaagaaacataagatgtcaatttctttgtgtataaaacatgcaagaaaattatttgttataaaaaatatagaaaatgtgaattcagatgggtttgaatgtgttttggcctgtcacctttttcgtatgctaacttaattttttttttaatttgtttttataaaacaaatatggttatagttagcctaattaattatagttgcgtcgttattattattattatttagtaacaacataatttaaaatcggaatgttttgtgtgaatagatatactatcttggaattgaaaacttttatcaaacttctgacatgaaagctaagtttggccatgtacgtatgagttaagatattaaattgcctgaatattcagatgtacttttttgaaattttattttcctcttatctgttttttagctcaagaaagtgacgcaatactgatagccaacatgtggagtagttgttgcatcgaccttacgttaattccccgaatagctaaatatcaaattgctttatcatctcttactatttgagaataaattcagttacggtatttattaaaaaggataacggacttacgcatgaatctattcgtaatcaatgagtggaaaccacttttttggtgtcatagttgcattcgtgccggccgcatcatctaagaagcaaaccaaggagattgtttttactactacgttgctcttgctgtcttgcaaaagatcaacaagtaaatatccacccataaactcaggcccgatatccaaaatccagtatagacactaggcagaacactataagtagcaatctacacttcatagacaaaaaaggctaatcaaacctagtttcgtcttaagaaaagtaataatctaaaacaacactcgctcaaaaacaataaataacataatttacgtgatgttcttctgtttccctcaaatcgaatgaatccatttttccttgagtggtggaggttcatcggaaataaccataccgatatttttcatgaccacaatactttattccgtcgtacacgtttatctacgatctagcaatcaatctacgaagccaagaaacaagaacagaatgtggatgaccaaaattttgtgctacaaaaaaaattatccaaaaatatcacaacctattgctgtcagaaaaacaaaacaaaaatattaatgttctcttatggaagaaaatatttcttttactttttggttaataattacagtaagaatttagctgacattctatctttactagtgaattttcattatataatatatagtatatatataccaaataaggttgaaccaatagcattgacttaatgacttgacactccataatatattgcttcctatagtgtctttatccctctcaaattttcttttctctctccctctcccacaatcacaagataggaaaattgatccacaaagaatcgtctgaatg

SEQ ID NO: 13570 - DNA, 3000 bp, Unknown
  misc_feature (1)..( 3000): cDNA_ID_3030824_gDNA_ID_2214637_Annot_ID_188161 3000 nt of promoter + ATG
ttttggctgtgatatggtccagaaaatggttaatggagcaaaagtcacttcttggacttgcgtaagtttctctactcggattgaccgtggtttaccccaagagttctgcaaacagttgattgggatgtgtgtcagcaaaggaatggtctgtcttgtctcatgcttattgatacttgtcacaatttcataccaaaaaatttactaactcttttttttgttttaattctttgtgccaggaatttaagcctcaacctgctattccgttcatctcttgtccccctgaacatattgaggaagctcttctcgatatccacaaaagggcacctggtctccaactgttgattgtaatattgcctgatgtgactggatcatatggtaagtctgtgctaatgattggtaatatttggtgcaaagtttattccgacaatctgttcatgaagtactctttctgtctgcaggaaaaataaaaaggatctgtgaaacagaattggggattgtctctcagtgttgccaacctagacaagttaataaactcaacaagcagtacatggaaaatgttgccttgaagatcaatgtcaaggtctagtcatctgtgcttcttattgttttttatgatggtgtaaaacgggtatttgtattacagactgggggaaggaacactgttcttaatgatgctattagaagaaacatacctcttattactgatcgtccaaccatcatcatgggtgctgatgtgactcacccacagcctggagaggactcaagtccttctattgctgctgtatgtatatcttattttacttgtatctcattatactactgtttcatcataaaaggtaattctcttatttcaactacaggttgtggcctctatggactggcctgagataaacaaataccgaggattggtttctgctcaagctcatagggaagaaattattcaggacctgtataagctggttcaggatccacaacgtgggctagtccactctggtttgataaggtaagagcaaaacatctacaacttcttgtgttctttgatttttcacaagaataaatataatggacactgtttgtgattgcagggaacatttcatagcattcaggagagctacaggccagatacctcaaaggatcatcttctatcggtaagtggttctcacattccatgcttaaacatttcatagcatgagcaggtttggctaattgctttctctttatacagtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtttctcactctctgctcttctctatcaacttaattcctttaatgatccagatttcaagtaacatatttgtatttccttatcaggtactgtcgtggacactaaaatctgtcaccctaatgaattcgacttctatttgaacagccatgctggtattcaggtattgcttccagaatctagaccaatttatgacctgttttgtctcagcagaattacaacttcctttgaatgtttgaatggtaatagggaacaagcaggccggcacattaccatgtacttctcgatgagaacggtttcaccgctgatcagttgcaaatgctcacaaacaacctctgctacacgtaagagacaacaacattgtacattttccttatgacatgttttaactctctgaaactaacaaaacatataataaaatgcatatgcaggtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaatgattcacttcttctcttgccagttttaaaagccgttaataattatgaaaactatattcggctctcggttatctcttttgggtttggctgttaatattttgaaggatctggccaacttttgcgccttaggacttatgttatgcgttttggtttcagatgatgactacttttatcgtttgtgaaaagacaaagggttaattatgatttttttggacgatgatttggctcagttctttttacttatggtattttgtgctaatttcttgttacaatttattttcttcgacaatttcttttatcctcttaattgtcggcctctgcttcaactttccatggtttatcgtaatcttcacaatgaatcaaagtaatgttttcagtagaaactggttgtttttgaaaggagtcttattgggagtgatttagagagaatgagaatccatagaacaaaatcagttagttgataaagatttgattccacaacaacaacatttgctcaagttcttcatataaagagaaacaaaaaagacaattctgagatatttgcaaaggttgatcttataccgttcttttggatggatcaatttcacaaaaatcaggtttgatgattcaagagctttacccggttcaatcaccggtccggttttaaaaaacatttaacactacacagaaaatttggaagaagagtgttaaataaacactggctttaatcattttgttgggtaaaacaaaacaaaaacaaaaccaaagagagcgagtttaatcacaccattgtcgaaacaaatcaaaaggctcaacaaaagtcttcttcttcttctagatctctcttcccgatccgatttgtgactcgccggaaagaaataacacacagacagacattttctccgatcgtgaaattagatggatcaataattgatcttactggtataaagaagagatgagag

SEQ ID NO: 13571 - DNA, 3000 bp, Unknown; identical to SEQ ID NO: 13562
  misc_feature (1)..( 3000): cDNA_ID_2703372_gDNA_ID_2214637_Annot_ID_188160 3000 nt of promoter + ATG

SEQ ID NO: 13572 - DNA, 3000 bp, Unknown
  misc_feature (1)..( 3000): cDNA_ID_1811861_gDNA_ID_2214637_Annot_ID_136152 3000 nt of promoter + ATG
ttaatcgacgtcacaacttatttcttctcgtgaagttttctcaaccaactttgtttttccattaaaaaaataatattaaataacttctataacttatataggcatacaacttgagagaaattcaagccatagcaaaatttatgatggatttgtgacaatataacaacaaaataatattagtttcttaaaaaattcgatggttggatgtgattgtgaaagatcagtaacgaacatattatagcacattacactcatttcttgataatttgtggtccacaaggagaagcttttaaaaattgattacattaattaccwwwarcacttacacacatttaactttttcgtagtcwwttgwaagagyactwwwakcactaaaagtacatttaacttttcgtwymrcattaaataaaaattactcaattttmyagtygyawwwtgttgcatatctccttrctcatacttggcataactcgtttggatcatcttttagagttttttaaaattatccgataatcttttaaagttttttaaaatcatatatttttatcaaatgttgggtttgtcatttcgattatctatcttggtmyarctccggttctccgtcatccaataatcttctrkaataacttgaacgtsmtagagacgtggactattagaagaagaggagagaacaactcakcaacacaaatgaattaaacaaaagttgaattgatatttttaatcatcaaaacatacaatatagttaattcaccaccaaaagggcacaaacacgaaaccgtttttagtgattataatacttagggttatactagatctactttttactgcaatcatgatcatttattattagttaatggtacaagaaaatctaattctacgatattacccaatcttccacatcaacaacttagatgttgcttgtcttttttctttaaactcaagacattcaataacaacacttataaattcatactaatacagttttttcatacttaccggcaacggaaagtttaataaaatgtatgcttatgaggcaaatattagccacccaatacttagaaaagctttaacaactaattcgacagtgtaatgattttaggttctgatcaggcctctccaccattcaatttaactgcggcgctgtgtaggactccacatgacatcaattagttggaataagaattcatataatgtaaaaattactataaactatgttcctttacaaaatgctactaatgtaattgtgtgttcttttttaatttgttgctttttccgaagttgtactaatcagtattgctcaaagaaaatgatagtcaattaatcatatgcattctcaattttgtcatctaattaattcgatagtctaaatgaaaagaaaataattaaaagtttgggtgaagactgaagatgacaaaatactaagatatattaattagttttcaaataaatgtcattttagagtaataattatgtttttgtttgtcaaatttttactcttgctattttaatgtactttcgataaggatctttatccattgcccctaagtaaaattaataatagtgtaacatataatacattgatacaagtacaaaatgaattttattttgtagacttaatcaaatatttaaatgagtcgtgtaaaaatgacacttcatatgaaatgaaaacaaaataaaaaatgtgcatggattacattactcttattggagattttgatatgaatctgatatcaaccccaactccgaaaattaggtatagtataaaatctaattctgtgattatttttttcatgttttaaaaacttgtttaaagacaaaatttatcagattcatatcaaaatatgcaaaatatcgtaatatttggattgatagccaaagtccatcgatttagagaaaacatatgagatcttcttatctagattttgttccaaatatctaaaaattgatatgtatccaaatcataaatatgagtttattttgatatttttctttatttatatatattttaaaataatactccatactagttgaagccaaaaagaaaaaaaccaactttgggaagcatgatacgtgtcaatcaggtattagtcggtagtctatttttccccagacgttcgtgttacggtaagattttcttcccgaagaagcagagaggtccacatgttcctcctctccacaattcactcttcttctctttcgtcttctcttctggttaaattctctctcggagctgaccgtttcttcactcctaaatccaagccacaccatattgattctcttcactggtaggtttcgttcatgacgtctctctcattttgtgtttcccctttcaagctaggtttttatttgttaatggcggattctttgggtttttggcttcatcaccaacactgattactcctttttcctttctggagctctaattttgcggatttggttttcgatcggattttgtggatctttgtttatttcagatccaattcaaggtttgtgttactgttatcgagcgtataaatctgtgactgcgtaaacggattagaatgtgagatttagggttcataatcgcttcataagtgtgatcgggaatctgatttttttttcttttttttcgccatttttatcagcaatcgagcatagagtcggtaacctgattgatatagagatcatctgtttgaaattcggatttgattcatttgaatggtgaatattttcaggtgcttgcttggagctaagttttaacctcacggaaggaatctttattctgcaatcactgcaaagagaaggagtctatattttggtggagaatgttgttggacgataataaacatatgatttcagtgcaacgcggctttaagagtcgtggtcagatgaaatatctgaggtattgaaattgatgagcaccataggagatgatctaattctatctggagaagccagtttttgtgtatattttgtagataattaggctttttgctaatacagttaaagattgatcaaatg

SEQ ID NO: 13573 - DNA, 3000 bp, Unknown; identical to SEQ ID NO: 13568
  misc_feature (1)..( 3000): cDNA_ID_1010471_gDNA_ID_2214637_Annot_ID_136153 3000 nt of promoter + ATG

SEQ ID NO: 13574 - DNA, 3000 bp, Unknown; identical to SEQ ID NO: 13567
  misc_feature (1)..( 3000): cDNA_ID_2703390_gDNA_ID_2214637_Annot_ID_136154 3000 nt of promoter + ATG

SEQ ID NO: 13575 - DNA, 3000 bp, Unknown
  misc_feature (1)..( 3000): cDNA_ID_2703394_gDNA_ID_2214637_Annot_ID_136155 3000 nt of promoter + ATG
caccgcaacaccgtatatctcgttggctctcaaacggacttcacgaagtttcaaggcccttagaaccgcaatagctgaacatgtgaagcaaatctcaagtcactcatcaaacggtaacaacaacaaccgattccaaaagaggcaaagatctttgattggtaacaatgtcgggtttgaatctcaacaacaacatatctggaggcctcaaaggggattgcccgaacgtgcagtggctgttcttagagcatggctctttgaccattttcttcatccgtaaagcctcacaatttttttgatgtaatttgattttatttgatatgatgttttgatgtgatttctcatatcctttattgctaatactgttattaggtaccccactgattctgataagcagatgctagccactcaaactggtctctctcgtaaccaggtagctcaattatgtaattctttgtttggtgaaacttttaaatatgcttgtctcttgaattattgctcttggccggtcctgttttcttctattggtttaaagcatgttgatgggacaataacctaatggttttagaatttcttactctcaaataacatcaatcttatatgttaaagtaaagcatgcatatatagaattagtctagattttatgaaagacaagtgcatgtgtaactaaaaactgaaattgttctacgtgtaaatagaagattaacttttttcaaacatttccaccatgaaccatgtcaggacaaagagcgtctcattatcctcacatgcaaaaactctttagtatagacttcacctaattttaggtttggtttttgacaagatttgctgacttggtttcgtgtttttttttaaaggtatcaaattggttcataaacgcccgtgtgcgattatggaaacctatggtggaagaaatacacacacttgagaccaaagcaattaaaaatgcagatactagtcacaacattgagccatcaaatagaccgaatactgttagcagtccgagccatgaacaaacgctaacgggcctctccgggacaaaacggtcgaggttagagtacatggacatggtggggttcaatagagggaacgtgtcactcacgttagagcttaggcgtggtgtggacaatgttatccaaacgcagactcaggatcatcagtttggaactggaagccaaatgtttcatgactttgtgggttgaaaatcctctgcttttgtttcacctttatgtattttgggtagagtgaaaataacaaagttgtcttgaaatggttactcctaacttagggccacaaagttctctgatcacctttttagttattttttttgttaaaaacctttttaattatttcttttatgttatactaagattaagatccgtcccttgtgggtttaaaatttttaagttaaattaaacttaacaaaactttgatttttaaaattttattgtataacttgccaatttggctaataaggagaggcagtccaccagacaacgagtggaaagaatgatagggtgggtggcaccgagtgtgggctggatgaagttggtgaagttatccgagatatagctggaggttcgtgtaaggatttactctaaatattggtcgttgttcggctctcttggcagaattgtgggggaggaggggagggggttattatgacatgtacatcgcgtgggagaggaaagcgaactttttggaagtggaagttaatcggaggtggcggttggatttctcacgacatgccacatccgctgtcttttttggtatatttgcgccatgacggtatatattcaagggactgaattgtccggatttctcatttgtataagaaagctaattaactcgcaaatgataactaactatgctattttttacagctaggttatcattttgattatgttccgccaattttagagacacttgttagtgataacaagactgtgaatacgtgtcctaaacaaacttttatatataataaactcgggagacattgtgtcccaaatgcattacatcaaaaaaaaaaagcattttacgtaaaaatttatttattttgaataattatgtagaatttttaaataatttttattattaactatagttaaattattttctatcttataataataatataatatttaatgttttaatacttaatataattataaattatatttttttgatcattttcgatttaactgttgttgtacctaattgttaactagtcataaaacttccgcaaaacgtatcaattctcaaccgctaaattaaacgcatctgcttcataatgcttgaaacaacaaccgctcatctgtacaaactacaacagtcgcaaccacatctactacgtataaaccagtccagccctaaatttctacgtgaaattgaccagttctacacaatacatctcacatatgaaatccttccttcatgggaaataaaaacattttgctacattattttcattttacacaaagccatgcaagtaaccaaagtatgcttcgaaagcttaagacaaaacaaacaagaaaaaaacatccaagattttgacaagacacattcaaatcctatacagttcatcgcaagaaaaaggattccaagctacagaatatacttctataggggttaaatcataaaacaataaaagtatatatgcttctaagaaataactcaaaactaatgatattagagaaaatttcgaataaaaatacaacagataaaatttcaaaaaataaaaataaattaagtcttcttcagaaaatcaaaacagctttttcaacttcttctttatctctcccttctcttctggtgataactacggaaccctaatttcttctccttcttcttttggttaggataagcgaatccctacaaattgaacctttaatcgcactcgttcatagatatgaatccataactacatcgatgcgttttctaggttttcgacattaataggaagttaagggattgattttacaagttcttgcgtttgaatcgatg

SEQ ID NO: 13576 - DNA, 3000 bp, Unknown
  misc_feature (1)..( 3000): cDNA_ID_2713844_gDNA_ID_2214637_Annot_ID_136156 3000 nt of promoter + ATG
aaaattaaccttttctcaccaacccagaaaccaaatagagaaaagcaattgaattgaaacagaacaaactaaagggtcaaattcaatcactttcttcaaaaacccaataaaccagatagagaaaggtttttgaaaatagataacactgaagggtcaaatccaatcaaaacaaagtaatgaaagatgattcattttcttctttagtaagtagctaaggaaggtaaaaaggaacaaactttgtacctgacgggaagaacagaggacggaggcggaagagagagcgtttgcagacgccattttgagagaaaaggagggagctttttgaggaacgttctggattggtgtggataaggaagtggttagtgtaaacgaatagtgtgggaggaggggttagggtttattagataaatggagagagtagctgagagaaaaaggatccagaagattctttgcattcgtaacgagagaaccgttgatcttaataagcctttttcacctacttctatgggcctgtttgtctcactgtttatggcccaataatagaaacagtactcaagaaacttttatagtttgtgtattccaaattcgtttttatccattctcttactgaatgtactcactctgttttaaaatataagaggtttaaggtaaatggatacatattaggtcattttgtatataaaaaatagtatttagattttgttaaaaaaaatgataatgaaaactgcaaaatataaatagtcacaaatagtcaaattaaatttaaatttaaacttgtaaaacatcttataatctgaaacaaaataaaatccctaaaacatccaatataatgaaacaaagggagtaatatttagaccaaactaataagtacaatttaagacttgtgaaaaccatgagattataaaatacatgttaagtggatgaaaacacctagcttagagtagatttacccgctaagtaaaacagaaactctcataaagacaacagttactacttttctaaacagagaatagactccaaatcacctaattgctacatgattaattgatttagttaagccaatacaatttgtttctaaatcttttttcatataagtattgcttgttgtacgcatcatataccatgcattaaattagtttcccatgaataaattcactagttacggaaaagaaaagttgggaagtgagataataaatctgacaaaagtggcagtttcaactctgaagcgtcaatcacataaatagttgcagtttggcgttgggtttgatttgattgagtgaattgaccaaataaacacacttaattaataacaaaagggaagttacgtaacacaaaaattataaatagggacgtctacatgtattattcctcaaaagatgcagcttaccataagatgacgtccatatctttaatggaaaccgtgccgtaaaattgactgccaaaatgtacaatgtagaaaacatgagtaaactaacagttgtcctgatgtacaaaaaaacacactaacagttgtccgatgaaaagaaagagacatgtaatttaaagcattacgacaaaaagagtaaataaataacactgttgttaacttgttttagtaatctattgtaattattttcttgagtggttgtgattgaaacgaaacaatttagtggactactaagcaaaaatagttaggatatatagagcatgcaacaaaagacatgcaaaaacataatttggtttgatgttttgcatatgtgtttatagttttctaaaacttaaagtgcctcatataaacaaataattaagttaaaagtgtattaaaattctgaaatttaaccacattcctatgttctatatgaaaaaacaattattaaccattaaactaccataaaataactaatactttatagacttatgattttattttattttattaaagaatttagttaaaattaattttagggccgttaattttattgttttttagatattccgtagtttattgcatgtttcaatttgtataaaaatgtgtttcatttggatattgatacatgtgtatcagtttaaagaagaaaataattttcgtggaaaaaaaccgacaaaatagatttttaagagagtaagtacagtaccgtgtaatagaaagactgataaaacccaccttaatacgtcaagaaaaaaaccattacagattttacggctttacgcaatcattattctctctcagtctctctcagtctctctctctatctcccacggtcggtttacatacatatctaaactcaccaccggagctccgacgatttttccggccaccttccgatcggtatgtgttgtgttcccttttttcttctgagatctatctgtctttatcacttccacttaccttattcattttgtttctcctcgcgagtatttgttttgctcatggtacttatagttccaaattgaaatcttgacgattatgatatatattaccaaatttaaatccgaatactagttatattctcacaccttattttttgttttcttgttcttcttctctttgttgttcttgaagtttcctagggttttgttcttatataaaaagtattattttctgggtgtttttacttcgtccatctctcatttcgtgttttccctgttttttttgtagtttttcatttggaaatttaattaaaggtcgtcgttcttttgttgttattgttgttggttatatagaaattaatgcatatattatgttagctaaaaggtccctgtcgcatgaatctttatgttcttgtaaactggttttaattttggatctttaagttcatgttagtaagaatttcattttttttgaacagtctaacgattattccattcatacaactcgcttttgtagtttctgtgatcataaaaaaaacctcttccaatttacagatgtttattaattaatttgctatatatatggaactcatgcatatttaatttgttggtaatttcttatgatagaatatcaaaaggtacataaagatg

SEQ ID NO: 13577 - DNA, 3000 bp, Unknown; identical to SEQ ID NO: 13566
  misc_feature (1)..( 3000): cDNA_ID_2703360_gDNA_ID_2214637_Annot_ID_136157 3000 nt of promoter + ATG

SEQ ID NO: 13578 - DNA, 3000 bp, Unknown
  misc_feature (1)..( 3000): cDNA_ID_1807975_gDNA_ID_2214638_Annot_ID_136163 3000 nt of promoter + ATG
ccagtacacttccatccttcgttttcctatcaatcatggcctctaagtaaggtgttcctctaaaacattcagtagcgacaagagatccatttagtagttcagtccagttggtggtagatttcttgtcacattcattaaacaaacctacattttgtggagcagaggtatatgaatcccagccacgtaaaaaagcttcaattccttcaggaagaccagaatcccgaatcttgcttggttcttcattaagcagttccccaagcggcacttgaacatcaagagaaggacgattgatgcttgggaccccttgtttaagctgtgcttgtgaagaaaatctttctgcccgaggcaaagatgaaaagatacgatcgaaaagtgaatccccgtgacagcagggagtgataagatcaagtgtgcggtcaacaagtaacaagccagcagatcgcttacgacgcgctacatcataaacacttgacatgtctgttagaatcttcccaacattcttcgattggtcaccaagtgaaaatatttccaacttcaactccatctacaattttaaaaaagtgacgacatggtcacaaatttaagaaaaacgtacagaagaaattaaattattgacaaacaagggaaacagatatcttctagtgttctagctcacgtacttcatgaacatcgtgaattaagttcaaagcggttactgcagtgttagtttaccttaagggccagctggtaaagaaaatgtgcggtaagagttgcaccaggaggaacatcatcagtgtcagacatagatccagtacttatgggaggcaaaccaaaactaagagaatcctcatgttgacgggacaaggacgcttctgcgactgatccttgggaaggtaagacaaacgctcgaggagtgaaaggacaaataatcaaggggaagtggtgaactgagacaaccaaaccttgtgcaccacctgatgaaatatctacattttcgctttcaataggctccatagtaagggattcaagtgcagaagagaacttagaaacccctttgtctttagatattttgtcgcttttcttagtatgttcattgtaatcctgaacaagtaaggtttcatactctcgatacgcgtctggacctagaggtgaatcagggatagctgagtgagacccctgtacaacgttcagattaatattcaatgacgcaagaaaagaaacaaatattctgaagagtctcttatagatggaaaattattttgaagaaggcatagagaagcagaactgctaaattaagttagagaatacattacaatcactttgaatttgattatataacgatcactagtgttgataagtcaaatagcttgtgattgttctagaaaataaaaaagccaatatatatatccagagaaaaaaaagagattaaataaagaatgagaccaaggataacgttaaagaagagcacctctgaaatagatgtgaatacggtgcagcgctgaacaccttcatgggtgcttagacaccgtagcatataccgatgagcatcattgagaagtcgagatgtcataatcacaattctcttggcacaatcagactttgaattccaatcagccacctagagcacaaggcatcaaaagtcacatcatataaattaaatcagaagatttctcactttctaggtaaaaagatccccttcataccaaaagtatgaggataacaatcttcctgttctttatctagatcctcaattaccaacactaaccgttgattgataggatattccttagccaacattgtgcaggaaaaaaagaaacggtaacaagcttaccgcatctaaggaagtcatgttttcaagactgcagacagctcgagcacctagttccaagaacaaagggaaagctcctacaaattgaaaactttctgtgcagccagcatcgatatacacaatcgcatcttttacatcctcttctatctacaaaacaaaacatttccaaaatatctaaaccttacttgttcaggattacagtaaggtacttttacatttcccaagaacacacaaaaacgagcaaaacgagatcatggagaaatcgtaatgattcaggtgcagcagatcaaaacgtgtaacaagatgagaccagatgaaaaaaaaaaaaaaaaaaaaaaaaaagagaattcggatttcttacttcgcggatcgaattgagacaagatatcgcgacatcgatcagagccattgctctcagctacgagaattggatacaattggtcgagctagagtgaaatcgccagttagaatcaaattactatgagatgtgttgtctgaaatcagactgatgcctgaaccaccggagaaacactgctttcgcttcgccgggaaatctcaccgacgacgaacatgatagcttaacttgatatcgttcgtcgtatgatcgtcactttgttgggcttttttacactttttgggctttgaattatctttgatttattatggcccatcatatattagttaacgggtctaggatgcaatgttatcaaagggggatatattggagatgaaagtgattaactgaaacataacattggttaacaaatcatttgcactattgaaggatgggtgttggtggggtcgcgaaaaacaaaggcatgctcaagaccgaggctggtgattgggtcatggccattccggacgacgaagacaagcctgtcgtcgcgtttgattagttgcaaacaaacaataagtctcttttcgtgtgtatcgattgatttggttgaattttcttctctctatttgattgggtttatttttactcttttttgtatggttgagaatgatgtgcaagtttgtggataattctatatgccaataatattcccacaccagtgataaccttttatcgctttggacataagtgggtcagacagcatcatcaccagtccacaaccatttgtataaagttaaacaacttaagagtcaagagtcacttattatctccttacacacaccatttctctctaatg

SEQ ID NO: 13579 - DNA, 3000 bp, Unknown
  misc_feature (1)..( 3000): cDNA_ID_2703442_gDNA_ID_2214638_Annot_ID_136164 3000 nt of promoter + ATG
tttagtcaatgctggaaccaacaaggcggcatcaagcggcacatctctgaacacaaaaatgcttgatgatgacactgagaaccttactcgtaagtcttatctttaatcatttggtttattaatggtgaattgatttccctagtgtctagaatatggtagtgtcaggctctgtatctaggctaatgtgttcatttcttgtttcaaagtgttcaacgtattggaaaactgttcttatatgagtagagtctgtctatctttctgcctgtgagtctttgatggttatagtgagaggaactttttattgattgatgtgtattggatgctgaagcttcatgttttgaattatgcaattgtgaattcagatgaacgtgtgcctactgagctaaagaaagccattatgcaagccaggacagacaagaagctaacccagtcccaacttgctcaagtatattatccttctctctatatgtcccttattattaccctattttgtaactcggttcatgacaaagtgtttgtttctttttgtgtagatcatcaatgagaagccacaagtgattcaagagtatgagtctggcaaagctatacccaaccagcaaatcctttctaagctggagagagcgcttggagctaagcttcgtggaaagaagtgagccaagttctactgatgtagcaagtaacaagaatcaatgctttcgtctaatgccgtaactttgccaagaagaatattttctgattgtaagaaagcaaaaccgtttgaatgtttgtttcgttgatggaatctctatctcataaactcatatcaatataataacttgggtcttttcatcacatagttgaactgcttattgttgatttatcatgaccttagagaaaaatacagaaatacaatttagaattcaggtacaggttcttcttcaacgggagcaagaacccattcaccatcttcgttcttgatcagtcctttgttcttctctacccaccaagatcctggcaccaaacactcagctttcaagaactcgcatgacttgttcactaatgcaatacttctcttaaccatcagtttaaactctcctttcttcccattccatccagctacaacatgtaacatcgcctgcacacatacatggaaaaaatatgtaaaagtttctactctgtatcgtttgagtcaaatttgaaagattcttctcacagattcttacctgaagattatgccaatcccctggattccttgaatcgcttaggaacggtgacttctttgtatcgatcacaaagtttattcctatgtccacataccctaaaagtccccctgggtatcgagttaagagatcaatcgtgttccttacatggaggatctttaagttcttgtgactcattacttcgtctctgaactccttgtttcctacctgtggacaaccaaagactatagcagtgaccggaacatcatcactggaaccgttctcagctatatcataggcggccagaacagcctctgtagctcccaagctatgtccagtcaacacaatgctcggtttctcgtccttatacttcaacagaagctccttgatcttggctaacaactgtgaccgtagactcagcttagtgaatttcgattcggggtgattagaagtatagattgtgagccacccgagcatcaccttacacccttcttcatcttcactgtcactatcaaaagtcgtaccttcaactacaccaccagaaccatcctgctcgggtccgtgcagcaaggggtcagctgaagttggcctagcacccaaaacattgacccactcatagttcctgctcgttcctctcaaagctatatagatctcacggcgtcctaaagccttagaccgttcatcagacgtgacagcaatgtagccaaaccagttagactcacggtcccaagaatctcttgattgtgattggagaagcaaaccttcggggagagaaacacgagctgtggcgtagaggaagtttacaacctcgtagtcggaagcgttttcgagcatgaccttgtcgaagaaagaagatttgccgtagcggctggctccacagtacttggagttttggtcgttgacgaaggcatcgtaggtggcttgacaaaagtcgccacaacgtaagatgagttccctaagtgattggtctaatgggtctaagatagtgtcccaattctttgagcctaagagttcttcccatgatgtggttgttgtagccattagagagaaatggtgtgtgtaaggagataataagtgactcttgactcttaagttgtttaactttatacaaatggttgtggactggtgatgatgctgtctgacccacttatgtccaaagcgataaaaggttatcactggtgtgggaatattattggcatatagaattatccacaaacttgcacatcattctcaaccatacaaaaaagagtaaaaataaacccaatcaaatagagagaagaaaattcaaccaaatcaatcgatacacacgaaaagagacttattgtttgtttgcaactaatcaaacgcgacgacaggcttgtcttcgtcgtccggaatggccatgacccaatcaccagcctcggtcttgagcatgcctttgtttttcgcgaccccaccaacacccatccttcaatagtgcaaatgatttgttaaccaatgttatgtttcagttaatcactttcatctccaatatatccccctttgataacattgcatcctagacccgttaactaatatatgatgggccataataaatcaaagataattcaaagcccaaaaagtgtaaaaaagcccaacaaagtgacgatcatacgacgaacgatatcaagttaagctatcatgttcgtcgtcggtgagatttcccggcgaagcgaaagcagtgtttctccggtggttcaggcatcagtctgatttcagacaacacatctcatagtaatttgattctaactggcgatttcactctagctcgaccaattgtatccaattctcgtagctgagagca

SEQ ID NO: 13580 - DNA, 3000 bp, Unknown; identical to SEQ ID NO: 13578
  misc_feature (1)..( 3000): cDNA_ID_1807975_gDNA_ID_2214638_Annot_ID_188181 3000 nt of promoter + ATG

SEQ ID NO: 13581 - DNA, 3000 bp, Unknown
  misc_feature (1)..( 3000): cDNA_ID_2703446_gDNA_ID_2214638_Annot_ID_136165 3000 nt of promoter + ATG
actagtgatcgttatataatcaaattcaaagtgattgtaatgtattctctaacttaatttagcagttctgcttctctatgccttcttcaaaataattttccatctataagagactcttcagaatatttgtttcttttcttgcgtcattgaatattaatctgaacgttgtacaggggtctcactcagctatccctgattcacctctaggtccagacgcgtatcgagagtatgaaaccttacttgttcaggattacaatgaacatactaagaaaagcgacaaaatatctaaagacaaaggggtttctaagttctcttctgcacttgaatcccttactatggagcctattgaaagcgaaaatgtagatatttcatcaggtggtgcacaaggtttggttgtctcagttcaccacttccccttgattatttgtcctttcactcctcgagcgtttgtcttaccttcccaaggatcagtcgcagaagcgtccttgtcccgtcaacatgaggattctcttagttttggtttgcctcccataagtactggatctatgtctgacactgatgatgttcctcctggtgcaactcttaccgcacattttctttaccagctggcccttaaggtaaactaacactgcagtaaccgctttgaacttaattcacgatgttcatgaagtacgtgagctagaacactagaagatatctgtttcccttgtttgtcaataatttaatttcttctgtacgtttttcttaaatttgtgaccatgtcgtcacttttttaaaattgtagatggagttgaagttggaaatattttcacttggtgaccaatcgaagaatgttgggaagattctaacagacatgtcaagtgtttatgatgtagcgcgtcgtaagcgatctgctggcttgttacttgttgaccgcacacttgatcttatcactccctgctgtcacggggattcacttttcgatcgtatcttttcatctttgcctcgggcagaaagattttcttcacaagcacagcttaaacaaggggtcccaagcatcaatcgtccttctcttgatgttcaagtgccgcttggggaactgcttaatgaagaaccaagcaagattcgggattctggtcttcctgaaggaattgaagcttttttacgtggctgggattcatatacctctgctccacaaaatgtaggtttgtttaatgaatgtgacaagaaatctaccaccaactggactgaactactaaatggatctcttgtcgctactgaatgttttagaggaacaccttacttagaggccatgattgataggaaaacgaaggatggaagtgtactggtgaagaaatggcttcaagaggctttgcgtcgcgaaaatatctctgttaacgtgagagctcgtcctggttatgctacaaaaccggagctccaggccatgatcaaagcattgtcccaaagccagtcgtctttgttgaaaaataaagggattattcagttaggggcagctacagccgctgctcttgatgaatctcaaagtgccaaatgggatacttttagcagtgcggagatgatgttaaacgtaagtgctggtgatacgagtcagggtttggctgctcaaattagtgacctgatcaacaaaagcgctgtggcagaacttcaagcgaagaaaaacgagaaaccagattcctcatcacgagggctgctatcttttcgtgatgccctgcttcttacaatagttggttacattcttgctggcgaaaatttccctacatctggctcaggtgggcctttctcttggcaagaagagcattttctaaaagaagccattgtcgatgctgttctggagaatccatcagcaggaaatctcaagtttcttaatgggttgacagaagagcttgagggcagattgaatcgtctcaagtctgaggaaaccaaagaaattccctctgatgatcaattagacattgatgctcttgatgatgatccatgggggaaatggggtgacgaggaagaagaagaagttgacaatagtaaagcagacgagtcctatgacgatatgcagctgaaactggatttgcgtgatagagtagacagcttatttaggttcctccacaagttatcgagtctaagaacaaggaatctaccattaagagaaggctcattggcttcagagagcagctttcctggcgagccttctggaaacaaagggctagtctacaggcttataacaaaagtgttgagcaaacaagagatacccggtttagaataccattcttcaactgttggaagatttattaaaagcggatttggaaggtttggtcttggtcaggttagttagacctttctctctacccatgactttcattttcctacacaagatatacattaatgtttggcaatgctattgcaggcaaaaccaagcctggcagaccagagtgtcattcttgtctttgtcattggaggtatcaacggtatagaggtgagtttcttcatcacaaaagtcacctcgcattcacgttgtagggctatattttttataactgtctatgtttcctccattgttaaggttttggaagctcaagaggctgtgtcagagagcggaagaccagacattaacttggttattggaggaacgacacttctaacccccgacgacatgtttgagttattgttgggacaattcagccatttttgatatcttgcaaactgacctcactctcataatctctgttgttagcttgtaacattagaagaaacagaaatacccatgaataaattaatgatcgaatgttaaaatctacaaaacaatagttccattttcaagagataagaaaagattggttattaattgtgaataagagatttttcaaaaaaaaatctcaaattatttatatctttggtccctaaagttttataacatttacagaaaagcttttaagttaaaaatcagaaatctccttaaacccccaaaatcacatttcacacgaaaaacctcgagtgagtgaagaaaca

SEQ ID NO: 13582 - DNA, 3000 bp, Unknown
  misc_feature (1)..( 3000): cDNA_ID_2713856_gDNA_ID_2214638_Annot_ID_136168 3000 nt of promoter + ATG
aaacacatcagattttaatgcccaaatttctctcattttcttgcttcgaaaccaaatattcaaagagagcgagagagagagatagatcaagaaagaaagagtgatgcagaagcaagagttcttggaattgttcaaggccgcacaacgagcggctaagtatgcgagtgatgagaattctccagaggtctcgaggtgtatccaattcatgaagcgtttgaaagaagctcctgcatctcttgattgtgacgtggtcgttaacacaaactccattggaaacggaatccgttttctccgagatcacaaaaaccccctaattcgatctgaggcagaacttctttcagatctttggctcaagtatctttacgccaccggtagaaaacagaagtcgacagattctgtttagttaaacagattcagagaaattcagattcaggttttgaatgtaactgtattaatgtgttagagacttgggtttgaatgtatatgacattatattactgcttcttaatatggcagattttgaataaagaaaaggtttcacgagagaagattagaacactaatatgtatgacaaaagctttcttcttgattcaatgaagtcacactcatttcaaatccataaataataaagcttacttaagtactatagttggttaaactcacaataatatgacaatgttttgctactaatcacatcacttggatcagttattttttgttaaaaccttgacttggatcttacactttgatgacgctcttggaagcatcataagattcctcatttccatggtggtttgcaagttattactgttgtttaccacgcaaattttcactagctcaagacacggtaacttctccaagaaatgcttcatttgattcagctctcttgtcgttccttgatagctcaatatctccagcaccttcacttgagatgatgataggcaagaggttatgctctcgtcggtatcatagcaaacacatacatccccacatctgtttgttatgtagtgatcgagaccctgaagcataacaaagaaaaagagtaatgttaacgacctaccaatatatatatggtgtttaggatgtgtttgtgacatgagataccatgaagatgagggtttctaggtttggagagttcttgatcagaagtggcagcatttgccatcctcttgccttgtcattcccaatagatagactaacaaggctgtcgaacaatggcatttctttacatgagaaataaagcagcttcaacaaaacacaatgtgttagtctgttgtcactcaataacacaaaagttgaaataaatcatcaaaagccccaagtgaatctcattctcgataagcaaaaaaaaagaagaatgttatttataaggaaagaacaatatatagaggaggctgacctctagagtgtggctagataagtgaaggattctaacatttctgattccattgatgagatttctcatatcagcgggaatggaaccgagagatccatttcttactcccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatggtaagtttcagttcttggatttgtatgattttgtaatgtgaatagggatttgaagatttacttacttttgaaattcaggcgtcggagaagaagctatcgaaccca

SEQ ID NO: 13583 - DNA, 3000 bp, Unknown
  misc_feature (1)..( 3000): cDNA_ID_2703454_gDNA_ID_2214638_Annot_ID_136169 3000 nt of
cccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatggtaagtttcagttcttggatttgtatgattttgtaatgtgaatagggatttgaagatttacttacttttgaaattcaggcgtcggagaagaagctatcgaacccaatgagggacattaaagtgcagaagctggttctcaacatctccgttggtgagagtggagatcgtctcaccagagcctccaaggttcctcctgttttttacccattctctgtggttttcactcttgttgtcacttggttataatcgattgattcgtggttacttggtaggttttggaacaattgagtggtcagactcctgttttctccaaaggttagattttttctcatatttgaaagcttacaaatagtctggttgatagatttagtaatctagaagaatttgggaaacatagtttagttaagtctatgaatgggtgcatggtttgatgatgaatttgagattttggaatccagtaagtcccttatctggtggtttgtgataacttgataagcctaccagtccaaattaggagctgttcgtttccccgcttctgatatagttgcgttgtgcactctgttttatatgcatcgcttttggtttgctctgagagacatgatttggtttagcttcttccattgcaattttcaagaacccttgttatgtgtggcttttgcagctagatacactgttcgttcttttggtatcagacgtaacgagaagatcgcatgctatgtaaccgtcagaggtgagaaggcaatgcaactacttgaaagtggattgaaagtcaaggaatacgaacttctcagaagaaacttcagtgacactggttgcttcggttttggtattcaagaacacattgatttgggtatcaagtaagtcaatccccttaaatcatcctgtcataacacttggggttcaccacattcttggtgatactcattgatctttgtttcacttcttataaaggtacgatccatcaactggaatctatggtatggacttctatgtggtcctagaacgtcctggctaccgtgtagcacgtcgcagaaggtgcaaggctcgtgttggtatccaacacagagtaactaaagacgatgcaatgaaatggttccaggtgaaatacgaaggagtcattctcaacaagtcccagaacatcactggctaaaacaattcctcctaactctttcttctgttttagaaaaccctgtctcagttttgtttacttgtctgaatcttaatctttgtactttatatgcattattggctttagtttcagttatttaagtatctaatttcgtgtgaggataagcaagataagaaaattttggcgggtagttgaagcgtgtggagacatataaatccactagctgacacgtgccacggacggctaagcacgctttcgccgatcgccgatcgccgctagattcatctcggattcctccaaataagcttccctggttcttatcttgccacgtcagcatttctccctcgtacgccttaaattcttcacaaaaataataaaaatattaattcaaataaatgttcatcttctcctacgaatgaaattgaaattaatttgagcgatcggaacaggatcgggtcggatcttttgaagttcttca

SEQ ID NO: 13584 - DNA, 3000 bp, Unknown
  misc_feature (1)..( 3000): cDNA_ID_2703461_gDNA_ID_2214638_Annot_ID_136172 3000 nt of promoter + ATG
tggactaattacgtgtggacccttttgctgcacaacacacattaacacacaagtaacaagtgcaatcaaattcaaatgtcagactcataaaagtcataatacaccattagaattgttgattaattacttgttctttccgttatacaattcaaattgttcataaataagaaatttttatatgatgcgtacactgtaaagtatatgatgtattcaaaatttattcttattattcatttatatatttacaacgtagataaaaatacatattactccaaggttcattttggctcttccaaggttcgaatatctttagatgcgtgtggactcaaagggagcgtaggaaaagagtggagccatcataaataaacaaatactaatatttagaagcaactcgttataattatttagcaattcttttcatatttaacatgtggtaagacatttccatcctatacctaaaagtgaccaacctctctgcaccttaatttgatatctctcaaccacgaaaccaacttacaaaataaaagagttgttggttagtcttacgtacatatacgattctctacttctctttcatatatgtaatctatcaacatgtaatagtgaaacacatatacagtcaatcaaggcgtccacaatataaagtatatctggagattagttttcttttggaattagttctttggttgtaagaaaataataattgtagcaaaccagattatcggggtcgggattcatcattttttatagggtaaaaaatcaatctagtggtttaatggttatttttaaattaaagtagccgtactatatatctcaaaacataaaaatcaagttgtttctcagtacaacaaatatacaatttaaacattattaagcctaaaattaaaacaataatatctaaaatacggaatacggtaaataaaggcatttgaattcataaaataaatggtggaaaaatcaggccaatcactgagaataaaattaaaaggttaagtcataagattcaaaagtttaaagtaatttgttactgagagttaaaatgataaaaattcaaaaattatacagtaacttctcgaaactaataatcccaacacccacaagtagttgaactcaagaaaaacactcaaactaaagtttttagaggagatagttttccatgagtttgatcagagtaacacattagttgtgcgatactcaaagaaaggaaggagtgaggatgagaagagccttccatagtctcttggtaaacagtaattttgtatttgaaacctttcagaatgatatattatcactcagcgaggctgaagaatacaaatataaatgtaactacttgctcatagttgaagataagtagaagttccaaaacacagaacccatggacatgaacgctactcgagcttgaagcgggactaccctgtaaatttcacctttcatcagacctcaatcctattatacataatcacacaatctataaagaccctctccaaatgacttaatgatagagaaagaaagccataccaaaagttaagtatgctaacgggaacccagaagcgaaatcctgcagtaatcccaagaacagtaaatatttgaacgatgctatgtaatagtaaaaaaattactctctgtaattggtagctcaccataaagaagcgtaggaagagcatctttctgatacttgtttccaagctcagagagctttcccagccacaagttgttccaagcaaatataacagcaatcacagatggaccaaggattacttggttaagcagaacctaacatgggatcagtataagcagtaaaaactatatcacaacgtgttccaagtacaaattaacaaaacacgcctagatttgtaccttaagcactagatttgtcgcagttggtttaggcaaagaatgatcaaggaattggtaccacgcataagaaccaggaccatacaagagaaacccgtaagaactcatccgcagcgcacgaatccagtcatgttctgagaaaatgttccacaattccccctaagtaaaacgatccaatcataaatccttagtctcaagccaagttccaccaatgtacgagaccattttgcaagagagtaaatatgagtcaccccaacaagaattcaaatcaaacataacctaaccaaagactgtcactactcactaaacaaccatactcaccaacatttttggttatgcaaagatccagtttcagtagaattctcactataccacactaggaacttgattcatgtaatatttcaaacaatcaaaacattcactaaaacctctaaaattcaaatctatgactcgaaaataaccaaaacttggtcagagacaaacctcgtcaagctcagaagatgattgtttaagagcggttctctttttccatctccctgatagctgagcaatcgtgtcaccggtgaaagtgagtgctccggccgtcacagcttgcttcaaaggaaaccgataaccgccggcgtctctgctcacatcgacggaatccgacgatccagaattacgtttcttacctctatcaccggaagacttcttctttctccgttgatcgaagccattccatccccagaaaccaccagcgccgccgcaaccacccaatgcgtccattaaaaatgcttccttttgcgtcgaaacagagaagagttttgcctaaatcttaaaaatcgcaaatgagtcctgtccatttgttttttccggtttggttcgattccaatttattggatcttgggttttcggaaacaggtcaaaagtcaaaccaattctgaaccgaacgaatgttatcaaactgaaaggatcaaaccaatttattggatcttgggttttaatcagtattatatctttttgaggtctctatatttatttcactgaatttcgatttattttgttcagtccatatgattcggtataagaattaatctatagtttgagttaatattcggttcatttattttgatttggttcggttttatgcttagtgtacataaaacg

SEQ ID NO: 13585 - DNA, 3000 bp, Unknown
  misc_feature (1)..( 3000): cDNA_ID_2713852_gDNA_ID_2214638_Annot_ID_136173 3000 nt of promoter + ATG
ctcattgaaaagcctcgtacacctcgatctcagctacaacaagctcacaggtaaaatccctctgcaattagggaatctaaataacctcgttggcttagatttaagctacaattctttaaccggtacaatccctccaacgatctctcaactgggtatgcttcagaaactcgacttgagctcaaattctctcttcggaagaatcccggaaggtgtagaaaagcttcgttcgttgtctttcatggcgttgagcaacaacaaactaaagggagcttttccaaaaggaatctcgaaccttcagagtttgcagtacttcataatggataataacccaatgttcgttgctctccccgttgaattagggtttcttcctaaacttcaagagctccagctcgagaattctggatattccggcgtaatcccggagagttacaccaaattgacgaaccttagctcgttgtctcttgctaacaacagattaaccggcgaaatcccatcagggtttgagtctctgccacacgttttccatctgaatctcagcaggaacttactgatcggcgttgttccgtttgattcaagtttcttaagacggttgggtaagaacttggatttgagcgggaacagaggattgtgtctgaatccggaggatgagtttagtgttgtcaagaccggggttgatgtatgcgggaagaacgttagtagtggtggaggtttatcggtgcattcatcgaagaagaaatctcaagcttctcggtattacagatcttgcttcttcgccaatgctctgtttccgtttgctctgtttctaggtttacatcaacgatgggttctctaagagtgagataaagacaaaacagacagagaattaaatatttatcaaatccctaaaaaagagagaagaattgtgtttgttcccaaagtagaccgatgatttctagggaaataaattaatagagtcgattttgatgtgtattagtttcctattaaagcaatgtacgttaatgttgtgttttttttttagtttaataataatactagtattttcagatttttatatgattgttaataaaattatttcgagtcatccataatggtcctgaacaacttcatagccgtgtgtataaatatgtgtttgtatacaaaagagaaaataacaaatgaaatgaaacgacgtttttgttttctattgggtaagaattaaatttctagtaaatctgttataaaatttacatacatagagtgtaataaacaaaaataagggagcagtttggacaaagagtttgcagtgagtctgataaaacgacacaacctgattcaagtctaaccatgcaactaaattgaagacctagaaaaattaatgttaattgagtttcaactaaccatttcaaatttgtgttaagctaatttatttatcttaatcaactaacgtaatttgtttttaaactgctatttgctaaattcattatgtaggagtagccgagtaggaccctgaatggtacgctcaaaagaggtagcagcgtcatcgaacttaacgttaggacaccctatgattgatcgtatcaaatgaccaaaattaaaaagatgattgagtaaaccaattaattttggtatataaacaatctttttattatcgtacacatttttgggatgtgatgtgactaatgaaaggtttaaatatatttaaacatgataaacgcagaaaccaccatatagaggagaaactagaaaaatataatttgtcagtcatgtgtctaaatccacacctacttttttctcatgctttttttcttcctgcaaatattgcatttcctttgcctctctcacacatttcctctgtcactttcttttttatatatttttatttcggaattccattaccgtgaaaaagctttgtttacaacagtaattttgtttcaaatgctttcttgttgtctatttttatcaattactatgcctctgcttgaataacttaaaaacacaagtgatgttaattgtgttattgtagatcctatgaacaaatttaatttatagacgtgtgaagttataaatgaaagatatcattgagtgagtgatcaccgttgcagataatgtttaaagaaaaaaaaaaggaacagttccttgttcatgtcatcatgtgttgaaaacggaaggagggaaagaaaaatctatcactctcagattcagagcctcacgtggggtaaacttagaattctatttttaggtacgaatcaaaatatacgacccgtcgcttttaacatgtcatttattatacctttcactctcatttcctccatgctttttttttaaaacgtaattagacctattcattctccataatataatacataaatacaacttataagattaatagcctcgtacactaacattaaagagtaaataaccgtttgtattttccatcttttgattaatgataactataatttatgaagaacatccataaactcatgagttttattttgaacgcaacatccatatttagctttacattcatttttttaataagatttcagtcatagttcgaaaaatgaatgttgggttggttccgatggtaaagcgagccgtatcaacaaaaaaggcccaaataaaaagtggtatactgttgggcctaaagatgaatatacagaagcccatattaagacaattcggcccattcagcattgcgtagcaatcgaattgatatttagcaaatcgaggaaagcaattgactaactagataatactgataagtgggtcccacataattctgacagcttagagatggagaagatcatcaccgttagtccaagttgggtcaataaggcttacgccgttggatatcaagatatccgttagatcgcatacacgtggatactgttcaatactcctgaccgcaggggataagacacgtgttatattaacgaagagtaagaatggtttctaataatttcttcgctccctttcttcttcttctctccttctttgaattttgattttggttgaatg

SEQ ID NO: 13586 - DNA, 3000 bp, Unknown
  misc_feature (1)..( 3000): cDNA_ID_2703469_gDNA_ID_2214638_Annot_ID_136175 3000 nt of promoter + ATG
gtaatatatatatgtaagaaagatgaattatgtaaagattgcttttactagccctgtgacaaaaaatgttaaatctttatcaaattgaacgatgattgataattgaaatttaattttaatgaaaagaagtagtatataaatgggtaagaaagagagatttccaaattaaaggacaggtgatttttactcaagtatcataatcaaattgtgtatacgtccaatctcattaattagtgcataagttattgatcactaactcttgtgaaaaagaaaagaatcttttgttttgacgaaaacatattccaaataccattcatagggatactaaacccaagactttggatttcccttcatcagaaattttccaacgtttactttgagatattttttttcttcttagaacatataataaataggttcatgaaaacgtaacaatgcgttggagattctttacctggcttgttgccttaactcccacaaagattcttttgcttgaagaaatttcaagcttttgtgtatatatccaacgtcacagtgctaaagacgtttgagaaagtttctgttgaaagaagagtaaaaactcaaaaagaaaatgggtttcattattgcgattgcaaaacgttttgatgctctagttgggtaggattttattcaaattctgtctcatataataaaaataaacactatatttgtcaaatttttaacattattttcttcctttttcttgttgcatgcaggcctggagtcatgcttctctatcctctgtaagtgatatcaaatctgaatttaaatgtttggtttttacaaatgcaacttgatagttaactgaataaatgattaggtatgcatcatttcgagcaatagagagtccaacaatgttagatgatcaacaatggcttacatattggatcatttactctttaataacgatattcgagctatccgtttggagagtccttgcctggtaattacaatattattcactaaattctgttacgaattcaaaaatttatgcctataaagacaaaaaaatggtgttcttttgcatattgtaggctaccattttggccatacttgaagcttttgttctgtatgtggttggtgctaccaatgttcagtggtgcagcttacatttactccaattttgttagacaatacgtcaaaattgggatgaatgttggaggaggaacgaattatacagacgaacaaagaagagttttacagatgatgagtcttgatgctagaaaatcggttcaagactacgttgaccggtttggatgggattctgttgagaaagcaatcaaagcggtatatgatttctcttgttgatctttaatatagttatgtatatataatccaatacatatattctgggagtttaacttcattatttgtgttcaaatgtaggctgaaaaagaaactagaaagcattgagatggaagatcaagagtcaagaaaaacattactctttggtttgtacatgtatgtacatagattgtatagagcaatactataatgaaaaagatatatatgtttgaaagatttatggtgacaaatttgtgttctagtactctatgaccaaagatactattagagaagccagtccaactctttttgacaacatacatttggatgggtctcaatttgattaaacaaaacatcaggacacgattcgaattaaaatgagaatacaacactctttttgacataaaaataaaaataaaattcaagctcgcgctatatcacaattggtgttttgctaatttcctaaatctaattttattctaatttaattatgtaaaataataaaatcacatctttggaagtttttaaatgtaattcatataacgacaaaaaaaatgtaattcatatgacgtaaaaaaaatgtgattaattttgttagggtcattaatctatattctatactttaatactctgagatccgtgattattattatttgtccatctctatccacaaaccatacataaaaaattgatatatgacgtcagaaaaagataatacaagtctacatatctcttcgtccatttatttaatttaattggtaaagaattgagtgcgcaaaattaataatttccaatttatcaaaaaaaaacacattaataattttattttttattttgttcaacttaaaaaaagaaaagaacacacattaataatttccaaaaacccctcttttctcatagattgaagcgtatactctaatttgaccaatctaatctagggtttctagtcacttgaagcttctcttaaaaaacctgtctcactcctcgtcaacctcttcctctcccgctgtcgccaagattgaatcttttttcaggtttgaatctatctttagagtaatgagtttctctgatttcccgacaaaacatgtcttaaacgctggcttccttctgttgttgtccagttctgctttcctcttatctgggttttaatagatcctttcacagaatttgtttgtaagtgatatattttttccacttgtcacggccacgattctgattattcttctaattcgttgttgagctgttatgaaaacgatgcagaatttgaaagttcacaactttttgcttcttatctattcgcttaatgcttttttatctgttatgtttcgtgttcttagctggatttagttatgtgcgtttttcaagttcattaatgtgtaggaatgtttttctgtgtgaatgacttctcttcctcctatgtatctcgttgcatgactaaagtcagtggctgtattacgaaaaatctatactttatttaggttgagtataatttcaatgtctaaagctcttaaactagctccctgttaagtagaaaacttattgatgaggaattggccaagtgattatgattattgctatcgtgcatttgggcatgactgagataaaaccttaactttacatattttctgtcaatcagttgtggcttcaccggataataaggaattcagtaagagataagttcatcctgacaacatg

SEQ ID NO: 13587 - DNA, 3000 bp, Unknown
  misc_feature (1)..( 3000): cDNA_ID_2994546_gDNA_ID_2214638_Annot_ID_136177 3000 nt of promoter + ATG
tcaacagaatcccatccaaaccggtcaacgtagtcttgaaccgattttctagcatcaagactcatcatctgtaaaactcttctttgttcgtctgtataattcgttcctcctccaacattcatcccaattttgacgtattgtctaacaaaattggagtaaatgtaagctgcaccactgaacattggtagcaccaaccacatacagaacaaaagcttcaagtatggccaaaatggtagcctacaatatgcaaaagaacaccatttttttgtctttataggcataaatttttgaattcgtaacagaatttagtgaataatattgtaattaccaggcaaggactctccaaacggatagctcgaatatcgttattaaagagtaaatgatccaatatgtaagccattgttgatcatctaacattgttggactctctattgctcgaaatgatgcatacctaatcatttattcagttaactatcaagttgcatttgtaaaaaccaaacatttaaattcagatttgatatcacttacagaggatagagaagcatgactccaggcctgcatgcaacaagaaaaaggaagaaaataatgttaaaaatttgacaaatatagtgtttatttttattatatgagacagaatttgaataaaatcctacccaactagagcatcaaaacgttttgcaatcgcaataatgaaacccattttctttttgagtttttactcttctttcaacagaaactttctcaaacgtctttagcactgtgacgttggatatatacacaaaagcttgaaatttcttcaagcaaaagaatctttgtgggagttaaggcaacaagccaggtaaagaatctccaacgcattgttacgttttcatgaacctatttattatatgttctaagaagaaaaaaaatatctcaaagtaaacgttggaaaatttctgatgaagggaaatccaaagtcttgggtttagtatccctatgaatggtatttggaatatgttttcgtcaaaacaaaagattcttttctttttcacaagagttagtgatcaataacttatgcactaattaatgagattggacgtatacacaatttgattatgatacttgagtaaaaatcacctgtcctttaatttggaaatctctctttcttacccatttatatactacttcttttcattaaaattaaatttcaattatcaatcatcgttcaatttgataaagatttaacattttttgtcacagggctagtaaaagcaatctttacataattcatctttcttacatatatatattacctttttcttcattagtattctatttgattatgattattttgtcataaagctagtaaattaaacactcgatatgagaattatattacttcacgctaattaactcttaacacaacaagaactagtgcatattcaactttcaaagcatatactatatattgagaatatagaccacgaaagtcaatcaaaagacctaccagctctcatcaagttctttcttgaaatgattttgcagaatttccaacttaattaattcgacatgaatgtgaaaatgtgtgttgctcgttaagaaaattgaatagaagtacaatgaaaatgatgaggaatgggcaaaacacaaaagagtttcctttcgtaactacaattaattaatgcaaatctgagaaagggttcatggataatgactacacacatgattagtcattccccgtgggctctctgctttcatttactttattagtttcatcttctctaattatattgtcgcatatatgatgtagttcttttgtctaaattacgtaatatgatgtaattaattatcaaaataaatattcaaattgccgttggactaacctaatgtccaagattaagacttgaacataagaattttggaaaaactaaaccagttataatatatactcttaaattgccatttctgaacacaaccaaataataatatatactatttacagttttttttaattggcaagaacactgaaatcttattcattgtctcgcttggtagttgacaagttataacactcatattcatataaccccattctaacgttgacgacgaacactcatataaaccacccaaattcttagcatattagctaaatattggtttaattggaaatattttttttatatataaaatgccaggtaaatattaacgacatgcaatgtatataggagtagggcaataaaaagaaaaggagaataaaaagggattaccaaaaaaggaaagtttccaaaaggtgattctgatgagaaacagagcccatacctctcttttttcctctaaacatgaaagaaaaattggatggtcctccttcaatgctctctccccacccaatccaaacccaactgtcttctttctttcttttttcttctttctaatttgatattttctaccacttaattccaatcaatttcaaatttcaatctaaatgtatgcatatagaatttaattaaaagaattaggtgtgtgatatttgagaaaatgttagaagtaatggtccatgttctttctttctttttccttctataacacttcagtttgaaaaaaaactaccaaaccttctgttttctgcaaatgggtttttaaatacttccaaagaaatattcctctaaaagaaattataaaccaaaacagaaaccaaaaacaaaaaataaagttgaagcagcagttaagtggtactgagataataagaatagtatctttaggccaatgaacaaattaactctctcataattcatcttcccatcctcacttctctttctttctgatcataattaatcttgctaagccaggtatggttattgatgatttacacttttttttaaaagtttcttccttttctccaatcaaattattagggttcttcagttaatccttataaaccatttcttttaatccaaggtgtttgagtgcaaaaggatttgatctatttctcttgtgtttatacttcagctagggcttatagaa

SEQ ID NO: 13588 - DNA, 3000 bp, Unknown
  misc_feature (1)..( 3000): cDNA_ID_2992072_gDNA_ID_2214638_Annot_ID_188205 3000 nt of promoter + ATG
taataatttaaataatcaaataattaattattagtatatactataacattatgggccctaatcaacatttaaaatatgggctttaattacatgttagaaaaaccactattattttggtcttaatatgtcggaacttattttgaaatatagtagtagtatatgatagttggggacaaggtcaacaaggatgcaacattgaacattcgatgagaaaatttagtctgatactcaactttatttctcatagattcatctctcgcattattatgatcaacttgtaagaacaaattctaggacggacttaaaaagtcacaaatacacttatgatgcaaatcagaaatgtaaaacttggagttgttactttattttaaatacttttgctgttttctgaatgactttttaacatgtaaactgaataaataaaattcatcacatttacttattctaactatttctgacattctcacatttattatccgataaatttaattgaaaaatagtttaagtcaaaagtcacataaatttttcattaacggatttgcattttgtcaaagtgatcagttacaaaacaaaacaatgttgaggttttattggtatgtgatttatatcatactagtattacaactcgtgcagaattttgtattttcataaaattaaattgtgatttttttttatcgaagtctattatggacctaaaacaaatctagagatgtgtttaaaaaaaaaacaaatctcaatataatctctatatatgtaaaaaataatcactctatcatcacaaatattaggaaaataatatattgacaaaacggttgggaaaaaaacacttaccaattaataatgcatttaatttcttcaaaactaaaaatcgagaagtacattcatttttaccaaagagagaaatacgtattaccaaagagagaagtacaatgatagatatatgtttaacagtttatgtacctcatgttaggggatgaaactagtagtttatgtacctcatgttaggggatgaaactagtattgttattgcctctttctggttttgctcgatgatccaaaacggttatgttttgtattggcactgtaccttcaggacatttggcggtactgacgtgtgcctctgatgttcgccattcacttttcttgctagttccagtcattctaggaatcataagtaatcgagcaacaaaatttaaaaagtaaagaaacaaaatttaaaaagtaaagaaacaaacctgtatcttgagatgtattaaacgaggatgggcaaaagctggttggttatgtttggggaagcaaatgacaagatctccatcggaaacctgttaaaatagatttcaaacatataaaatactttagtaaaaatgtaaaattttctcctggtgaattacctagcttttttttttgccatccctctacccttatatttcttctatattacaagccactctcttattattttttatttttttttgtctttgtcagcagttatatagtttactttcgaacaagtaaattctttttgcaagagatttttctctacattacttacgttgaaatagtaaaattgttactggattttacaatccaaattaataaaataaaataaaataaaaaccaatacaaaaattagttccggtaaaggccataattagatttggtttttgtggtcggccaaatataaacaaacaaaaattatgtaaaacataagtagagtataagcaaaagataagcaaatatacaatttgttaacgttttctagtattttatctacaagatgaatcaaacttgtctcggctatgtacttaaaacaaattgaacttcatcatatttcaaggccgttgagtttttaagatatgtacaaaattttaacatctaagtttggtccatcatgtgaactaactatgaaatctaatttggtccacgatatgagttatatgttcacttgaactaaatagaaaaggtgagtaacaacatgaaattgaaaacataaacttgcttcactatgtaaactaaattgatccatagtgtgggagaaaccaaactatgatcatgcatgcaaccatgactgtaccaggagacagactaattattagctggtttattacatttgacaacaagtctctcacgcgtcagagacaacgtgtcaacgtggagttaaataatcggatacagtgtgagagaaactaaactatgatactccttctctccccttctcctccgtttattcgtttcaggatcactctatcttttccagtttagagcgtaaaattctctccgtcacaattcatttagggcaaaatagttgtgtgtataagttttaatatagacgaaatattgaacccattacctttttttttttttttcacaattgaacccattacctatgcgaagaaaacatgaaacagtggggataaagaaggagtggttttcgaggacccgtgatattcattttttttttttttcatcacccgtgatattcaaactcatcatatttatacacacagactataaagagaaacagactataaatagaaacatacattattttgataagttttggaatattcgacaacagaaaattctctctatgtgtgtccaattatattcggtttatgtaggtggtaatttagtaattaattaccagtttaccacacagaataatggtcttccagtcaaagtgattgtaatgtgatttatacaaatacattttgatattagtatttaatttctccaacatgaactttgcattaaatttgatatattcaagtatagtaattttttttataagtattcaagtatagtagttttaagattctttctacttaaagaagataataaaaagaaatgaaaatctctctttaccaaaataacaaatttatttatggaagatctacttactgtaaaataaaaacagaggataaaaacttgaaactttccaagaaaaatagtcctataaataagactttcacgaaaacctaaaagataatagaacctatg

SEQ ID NO: 13589 - DNA, 3000 bp, Unknown; identical to SEQ ID NO: 13587
  misc_feature (1)..( 3000): cDNA_ID_2994546_gDNA_ID_2214638_Annot_ID_188198 3000 nt of promoter + ATG

SEQ ID NO: 13590 - DNA, 3000 bp, Unknown; identical to SEQ ID NO: 13586
  misc_feature (1)..( 3000): cDNA_ID_3030920_gDNA_ID_2214638_Annot_ID_188195 3000 nt of promoter + ATG

SEQ ID NO: 13591 - DNA, 3000 bp, Unknown
  misc_feature (1)..( 3000): cDNA_ID_3436496_gDNA_ID_2214638_Annot_ID_188192 3000 nt of promoter + ATG
cgggattcatcattttttatagggtaaaaaatcaatctagtggtttaatggttatttttaaattaaagtagccgtactatatatctcaaaacataaaaatcaagttgtttctcagtacaacaaatatacaatttaaacattattaagcctaaaattaaaacaataatatctaaaatacggaatacggtaaataaaggcatttgaattcataaaataaatggtggaaaaatcaggccaatcactgagaataaaattaaaaggttaagtcataagattcaaaagtttaaagtaatttgttactgagagttaaaatgataaaaattcaaaaattatacagtaacttctcgaaactaataatcccaacacccacaagtagttgaactcaagaaaaacactcaaactaaagtttttagaggagatagttttccatgagtttgatcagagtaacacattagttgtgcgatactcaaagaaaggaaggagtgaggatgagaagagccttccatagtctcttggtaaacagtaattttgtatttgaaacctttcagaatgatatattatcactcagcgaggctgaagaatacaaatataaatgtaactacttgctcatagttgaagataagtagaagttccaaaacacagaacccatggacatgaacgctactcgagcttgaagcgggactaccctgtaaatttcacctttcatcagacctcaatcctattatacataatcacacaatctataaagaccctctccaaatgacttaatgatagagaaagaaagccataccaaaagttaagtatgctaacgggaacccagaagcgaaatcctgcagtaatcccaagaacagtaaatatttgaacgatgctatgtaatagtaaaaaaattactctctgtaattggtagctcaccataaagaagcgtaggaagagcatctttctgatacttgtttccaagctcagagagctttcccagccacaagttgttccaagcaaatataacagcaatcacagatggaccaaggattacttggttaagcagaacctaacatgggatcagtataagcagtaaaaactatatcacaacgtgttccaagtacaaattaacaaaacacgcctagatttgtaccttaagcactagatttgtcgcagttggtttaggcaaagaatgatcaaggaattggtaccacgcataagaaccaggaccatacaagagaaacccgtaagaactcatccgcagcgcacgaatccagtcatgttctgagaaaatgttccacaattccccctaagtaaaacgatccaatcataaatccttagtctcaagccaagttccaccaatgtacgagaccattttgcaagagagtaaatatgagtcaccccaacaagaattcaaatcaaacataacctaaccaaagactgtcactactcactaaacaaccatactcaccaacatttttggttatgcaaagatccagtttcagtagaattctcactataccacactaggaacttgattcatgtaatatttcaaacaatcaaaacattcactaaaacctctaaaattcaaatctatgactcgaaaataaccaaaacttggtcagagacaaacctcgtcaagctcagaagatgattgtttaagagcggttctctttttccatctccctgatagctgagcaatcgtgtcaccggtgaaagtgagtgctccggccgtcacagcttgcttcaaaggaaaccgataaccgccggcgtctctgctcacatcgacggaatccgacgatccagaattacgtttcttacctctatcaccggaagacttcttctttctccgttgatcgaagccattccatccccagaaaccaccagcgccgccgcaaccacccaatgcgtccattaaaaatgcttccttttgcgtcgaaacagagaagagttttgcctaaatcttaaaaatcgcaaatgagtcctgtccatttgttttttccggtttggttcgattccaatttattggatcttgggttttcggaaacaggtcaaaagtcaaaccaattctgaaccgaacgaatgttatcaaactgaaaggatcaaaccaatttattggatcttgggttttaatcagtattatatctttttgaggtctctatatttatttcactgaatttcgatttattttgttcagtccatatgattcggtataagaattaatctatagtttgagttaatattcggttcatttattttgatttggttcggttttatgcttagtgtacataaaacgatgtgttcacgtgaaaccggtgaaggcgcgatcagacaggcgcggtggttaataaataagttaataacttactcgttactagggccgataatcgtggttttgaacgcgcgtttacgagaattgcgttagccaattgtattcatcatcatcatcgtcatcatcgttggggtgagtatacatacgattaaagaaacccaaaaactccggcgtctgtttaccgctatcatcattcttccgggaagaggaaaaggtttcttcgatcgtcgaagagattctttggacaagtcccctccttcctggttcaatcttcgattcagctctcttttaatttttttggtaacctcctcctctgcatctactgttttcgatttggaaatagattggttcaattgtgaattggaattgagggtttgattgattggatcatctcaattcataaatcaaatcctttgaatttagatttagaaagctctagagtttatgaagatctgcatcgttcttatgagttatatgattgatggattttttagtgtaaaggaacctactttaatgatcaaagctaacgttttgtttaaattttgaggcaaaattcaaatttattcatatgaatattctcataagctgatgaattctgtatctttgtacattagtgatatagtctacttgtgtgtatccttgttaattcatatttaaagtgtgttttttcttgtaggttttgggaagctgct

SEQ ID NO: 13592 - DNA, 3000 bp, Unknown; identical to SEQ ID NO: 13583
  misc_feature (1)..( 3000): cDNA_ID_1450637_gDNA_ID_2214638_Annot_ID_188188 3000 nt of promoter + ATG

SEQ ID NO: 13593 - DNA, 3000 bp, Unknown
  misc_feature (1)..( 3000): cDNA_ID_3030936_gDNA_ID_2214638_Annot_ID_188187 3000 nt of promoter + ATG
tgtggcatataaaattcattatttagtaatataaatacatcacacaaaagtataggcaagcttgggtggcaagaaaccagaaggcggcggtacagaatttttgcatataaacacatcagattttaatgcccaaatttctctcattttcttgcttcgaaaccaaatattcaaagagagcgagagagagagatagatcaagaaagaaagagtgatgcagaagcaagagttcttggaattgttcaaggccgcacaacgagcggctaagtatgcgagtgatgagaattctccagaggtctcgaggtgtatccaattcatgaagcgtttgaaagaagctcctgcatctcttgattgtgacgtggtcgttaacacaaactccattggaaacggaatccgttttctccgagatcacaaaaaccccctaattcgatctgaggcagaacttctttcagatctttggctcaagtatctttacgccaccggtagaaaacagaagtcgacagattctgtttagttaaacagattcagagaaattcagattcaggttttgaatgtaactgtattaatgtgttagagacttgggtttgaatgtatatgacattatattactgcttcttaatatggcagattttgaataaagaaaaggtttcacgagagaagattagaacactaatatgtatgacaaaagctttcttcttgattcaatgaagtcacactcatttcaaatccataaataataaagcttacttaagtactatagttggttaaactcacaataatatgacaatgttttgctactaatcacatcacttggatcagttattttttgttaaaaccttgacttggatcttacactttgatgacgctcttggaagcatcataagattcctcatttccatggtggtttgcaagttattactgttgtttaccacgcaaattttcactagctcaagacacggtaacttctccaagaaatgcttcatttgattcagctctcttgtcgttccttgatagctcaatatctccagcaccttcacttgagatgatgataggcaagaggttatgctctcgtcggtatcatagcaaacacatacatccccacatctgtttgttatgtagtgatcgagaccctgaagcataacaaagaaaaagagtaatgttaacgacctaccaatatatatatggtgtttaggatgtgtttgtgacatgagataccatgaagatgagggtttctaggtttggagagttcttgatcagaagtggcagcatttgccatcctcttgccttgtcattcccaatagatagactaacaaggctgtcgaacaatggcatttctttacatgagaaataaagcagcttcaacaaaacacaatgtgttagtctgttgtcactcaataacacaaaagttgaaataaatcatcaaaagccccaagtgaatctcattctcgataagcaaaaaaaaagaagaatgttatttataaggaaagaacaatatatagaggaggctgacctctagagtgtggctagataagtgaaggattctaacatttctgattccattgatgagatttctcatatcagcgggaatggaaccgagagatccatttcttactcccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaa

SEQ ID NO: 13594 - DNA, 3000 bp, Unknown
  misc_feature (1)..( 3000): cDNA_ID_3030940_gDNA_ID_2214638_Annot_ID_188186 3000 nt of promoter + ATG
ttggggtggagtcatcaagaaaaggattgatggcagtcactgtatacccatgaatttcatcgtaaaccatacgctgtacagggtcactgagaatctgcaatgcaacggtaaatcattaaacgaaaaagcatatggaccttactaaacgcttacaaaaatctataaggaagtcaagtaaaaaactcacctcatagatatcgttaatgaacatgcagaaatttgtggtttcggggtcattgccactcaagtctggatggcacgatttcatacagttatagtaagctttcttaatctcctcctgcgtagcatctggaagctattgacatagcaaaggagagttattaaagtcacaatctttgatcttaatgattgtaacctgtcaaaggcttcacaatttcgacaaagatgaatctagctacaaccatatgaaatgcagagtatttttccatgatacacaagaagtttcaatcataagcaaacaacttaaaccaaaaaaaaaaatcatcacttcaaaatccctatatgcatatatcaaatcggattgaaatagccttggttcttacgagtccgagaacggcatagtaatcatcggcgacatcaccggtggaaagagaagaagcatcctcagttgcaactctcaatcttccgattgaatcggttcgcctctttcctgcgtaccgaggtaagtaccaagatgaagaagcaccggtggtcttcgccgagaaccgcggcgacgcacctgatctggagctaagagctgagttctggaacttcaaaagatccgtacaaacaggggaaagtatctgcgccattgaagaacttcaaaagatccgacccgatcctgttccgatcgctcaaattaatttcaatttcattcgtaggagaagatgaacatttatttgaattaatatttttattatttttgtgaagaatttaaggcgtacgagggagaaatgctgacgtggcaagataagaaccagggaagcttatttggaggaatccgagatgaatctagcggcgatcggcgatcggcgaaagcgtgcttagccgtccgtggcacgtgtcagctagtggatttatatgtctccacacgcttcaactacccgccaaaattttcttatcttgcttatcctcacacgaaattagatacttaaataactgaaactaaagccaataatgcatataaagtacaaagattaagattcagacaagtaaacaaaactgagacagggttttctaaaacagaagaaagagttaggaggaattgttttagccagtgatgttctgggacttgttgagaatgactccttcgtatttcacctggaaccatttcattgcatcgtctttagttactctgtgttggataccaacacgagccttgcaccttctgcgacgtgctacacggtagccaggacgttctaggaccacatagaagtccataccatagattccagttgatggatcgtacctttataagaagtgaaacaaagatcaatgagtatcaccaagaatgtggtgaaccccaagtgttatgacaggatgatttaaggggattgacttacttgatacccaaatcaatgtgttcttgaataccaaaaccgaagcaaccagtgtcactgaagtttcttctgagaagttcgtattccttgactttcaatccactttcaagtagttgcattgccttctcacctctgacggttacatagcatgcgatcttctcgttacgtctgataccaaaagaacgaacagtgtatctagctgcaaaagccacacataacaagggttcttgaaaattgcaatggaagaagctaaaccaaatcatgtctctcagagcaaaccaaaagcgatgcatataaaacagagtgcacaacgcaactatatcagaagcggggaaacgaacagctcctaatttggactggtaggcttatcaagttatcacaaaccaccagataagggacttactggattccaaaatctcaaattcatcatcaaaccatgcacccattcatagacttaactaaactatgtttcccaaattcttctagattactaaatctatcaaccagactatttgtaagctttcaaatatgagaaaaaatctaacctttggagaaaacaggagtctgaccactcaattgttccaaaacctaccaagtaaccacgaatcaatcgattataaccaagtgacaacaagagtgaaaaccacagagaatgggtaaaaaacaggaggaaccttggaggctctggtgagacgatctccactctcaccaacggagatgttgagaaccagcttctgcactttaatgtccctcattgggttcgatagcttcttctccgacgcctgaatttcaaaagtaagtaaatcttcaaatccctattcacattacaaaatcatacaaatccaagaactgaaacttaccatttggaatttgggttgcgaaattatcaccggccgacgggaaaggagagacggagaacgaaacgactatttaaatgttagaagccctaatcctaagtgtaaagaacggcgactatttaaatgacagttttacccttaaaggcccacgcttctctcacgtgactttctttcccaaacagactacttaccttttcttcatcagtctttctgctttactctttcctcatgtggaaatggaggaaattgcttataataagttgtttcagtttcttcgtctcttctcttaaactttccaaaaccctagtattcgatgttttcacttttgatctcacgattaaattggtattgaaagtggagagctttcacgactctgtagcaagtagcactttagcaaggtatgttgtctgctctgtttcgtctttttcatttctatggtaatcaatgtgattgaagagatacatgataacttttgtattagactttgcattgtatgaaaaagaacagacctttgaactcatcaactctgtctagttactgtttctgaatccaattgctgtggttttaaggttttggtatcaatg

SEQ ID NO: 13595 - DNA, 3000 bp, Unknown; identical to SEQ ID NO: 13581
  misc_feature (1)..( 3000): cDNA_ID_3030947_gDNA_ID_2214638_Annot_ID_188183 3000 nt of promoter + ATG

SEQ ID NO: 13596 - DNA, 3000 bp, Unknown
  misc_feature (1)..( 3000): cDNA_ID_2990498_gDNA_ID_2214638_Annot_ID_188217 3000 nt of promoter + ATG
tcaagaatcaatgagaagtgttttggtggtgtgcccacaagcacgtccatgaagtattcaccagaaccgagcgtcataccagactcaagtgttgctatcagcttccccggtgaaacctctggagctcccaccaaagaaatatctgaggtaatcttcttcctaaccttctcgtttttctgtttcttcgatttgttgaaccgagcatgaagcgtcttaattcttgtgaggtcttggatttgaagatcaacaactgaatgtgttgttctctttgtttcttgtttaatccttgattgaggcttcaccgattctctggtatgttccttggaaggatcatgttccttggaggagaaaccgcaatcgttgcttgttgaagaagaagcagaactgaaacgcatcgtatcttgggaattaaacatgttaagggatgaagagtaatgctcatgtttccctgaaagagttctacagtctccggaaaatggtgagacagagaacaaaatcaggccaagaagaaatatactgagtttggtcgacattaagctgctgctgagattactaatattaataaaaccattcaagaataaggaagaaaagaaaagagaagagagacctatgagtgattttgaattatagcttctaaggacaaaagaggagctaacataaaaaagagtagaggattttgtgaaagtcaatggaatcgaaaatattaaaataagttacaattcgatatctatttgactgagacagaaagccatatcataccagaaagcaagaaaaataaacaagaaaacattttaaaaaataagagaatattgtaggtggtgatggtcttctcttcagtgagactggttcaaacatgtggaatctttagtatttttgtttttctgattcgtagttttcgttgaaatgtgaagttacccgcttaacagtagttggtagtactacaaaagtaaaacttcaggtaagaattacttaatccaacttttactatgataaacaacctaatttccaatacgctctcctctacgtatttttatattcaactagattttgtggtgtatatatatatatatatatatataagctcttgagcaatagtcacataattagctcaaaagccagccacatctataacgggattttttaattaaattaaagatcaaatagatgatatactttaattgactgtagaagagtctttctaagtgtgtttgactgtgactaaccacatatgaacagttaagaaaattctttatttaaaataaataaattaaaagatagaggaaacaagaacggagaacctatgttggaaatgcccccaaatctttggaaaatttgtaagtagaaaagttattattttcctttaatttgcaacactattcttgtattgtaaacaaaaatacttgaatcaattattttgaaagaaatgatctaaagatagtgacataattcaatagatttttattttaatataccagtcaattttgttttcctaccattcatattacacaaatgaggaatttcatgaaaggctgcctttcagaatttctgtgtttatacgaatcaaatagtttgttaaaatctaaaatgattatttataaaatgaaatcaataaaagatcaagttcagaaaaatgtatgttgttttacttagatgtatttttgtaaataaagcaaaagattcgaatttgactttcagagttaatactgtttaagtgtaacgtattcctaactatattgtgatgaacaaactgattagcattcaatttgttataatcccaaccaaacatttcatttttaagtgtgcacgtaattccaatatattcccatgtctatctttcaaatctacttttcaattttcatattcaattaacaaaccctacatgtgtttttctttttcttttttgtcaaacgctacatgtgtttagtagattaatatttcatttcagttttttaaaatatgtagtgttatattataaccgatttgtttgacgtaaaaaatgtggtaaagttgtagccaaattgcttgtttttctaatgtgaagaaaacatcctgaatcactaataagacaactattgagaacaaatcggtaatcaatatcaaataataagtaatcgtatgttaaaagaataaaaaataacaaataaacaccattttcgtacgtcgttagtttttattaggtttggattaaactattaaaacaatatgattgttacgaatcatgcggttcacggggtcagacgaaatcataagtgtggaggtgcaactaccagaactacgtacattattaaaacctaccattatacatctcttctacatgtgccgtttcatttattacctcaccacccacttttctcactataaccaaaatttaatacccttccacactatttcttcgtttttttgtcttccacatatttcacttatttgtgttttctcacctgttatagcaaaattaccaccttgcattcatgtggcgtttcacttatatattactgacacgtctactaaaattcaacataatttgaatgtgctatgaagggttgtaaacaattagagtcaattttatcaatatgatgtatctaatttttatacttgactggttttaggtagatatctgttaatgagcgcactgagcatgcatgcattatatatcatacacccaccaacttctaattcaataaatacttccaactttgtccacttttttggttatttaatcaactttgtgtagagtttatatatgaaaccaaaaaaaaaaaaaaaaaaaatctcaaataaaagatatgaaagatcaaatatcttaaatctaatgttcctaataaaaataattgattcaccgaattcgaataacttaaaaagtacactgaaattaacccaattcatatacaaagaattcgtacatatatatctaaaattttagtttattaaatactacatgttatgtatataactgaatgaaattcctaggtaccatcgccgcatgctaaacaagttgttagc

SEQ ID NO: 13597 - DNA, 3000 bp, Unknown
  misc_feature (1)..( 3000): cDNA_ID_2703430_gDNA_ID_2214638_Annot_ID_188214 3000 nt of promoter + ATG
tcaatgaagacatagtagttatatggaattttgcttaaagttttcttatgtcaaattcttaaacttataattgagaaatttgtccctatgattcaagtaagaggaaaacatatgtaaatgtacggtttaagactttttgtttatggttgttgaaatatgggcttggctttcctcttttatcttgattttgataaatttatatatgacactttacctcaataacaatttgtgtattagaattctaagcttcttttttagcagtaaattgttacgtatgttttatcataattaagtgttgttttgaagacgaagataaaaagatagtacatgttttatttttgtatctttttatgtgtgtttattcacataaatgttttaaaacggagcatcgagtcttggaagtcgaaactataaaaaaacggaggtagagagaatgtgttcatacggttattgttgtattgagcattgaaaggaccgtggtactaggattgtcggtctcctaataatagccgttgtggatgcttatgtcttattggtggtcaaagcaaaggagaaaagtttgaaaggagagacataaaaattgatgaatcacacacgaaagaaaaacttttcctctttaatccatctttatatctttacctataaaagtgttacaaaaaggaaacgcaataatacacacatacgggtgtatatagtatatacgacaattggatttgctttaaataattatttctatatttgaaaacaccaaaaatcttcgagtgatgaagcttacctatatgtgacttcttttgcttaatgatgggatcgaagaatgccttgcgaatgctagccatgacggcataaaatcaaaggattcaagcataagtttgattgaatctcattcgtttcccatccacctcaataccaaaattttgtagataaattacttaaatcgatttgaagtacgtagtctgttgaatttatgatctgattctaatgacacttgtcaacttgcgccatcaccccatatgggttcattatctatatcattagattttttttttttttttgtaaaaagaaatatgacatatgggagtcaataatagcataaattacacacatggagaagtaatataaatctagtatcaataatttgatcaagagtaatcattcttttctgactttccatcacattttctccatcaaatcacataaattcaaaaactaacgaatcacaaaactttgggagaataacacttgaggacgaatctagctaaaaggaggtgtaagacacgtgagaagcacgtgatcacatggcagcaacaacaatattcagtaaaattggccattcttcctctgcaaaaacttggccttagcctgtaactccacccaccatcaaccaatcacacaacgaccaacatgctagtgcaaacgtttgtagtataaattattagggacttaccatatccaaaatgatctttattaaaacttaaaatgaatatgattatgtttaaaagctgataagatttattaatctgtaggcataaaactttatccaaaagttatgcttcaagtaaagcctccatcaaaggcttttaaatctctctctctctcatatgaattcattttctccaagaaaggcacattggtttcttagatatgacttatggagttgtaacattccccaaaacaaagacaaaaatttctctaaatgtgcatttgaatgctatatattattctcctcgatcaaaataaaaatactaatataaagtcttcaataagcttatagtatattataataaaatatttgaagtacagaaaatttttttgtaaattttgatagaatccaaaactagacatgtgaaaggaagaaaaaaaggtatattgaagagtgagaataatattgacctaaaaattccaaagcctgtgtttgggaattccctcccctatctatctctctatccacttcaattttttttatgaaataatttttatttatttatagataagtaaaagtaaaaattgtaaaaatatatatctttaattcttcaagtagctataaatgtcacagttgacaaatccactgtctttgctttcccttcactgctcacttcttctctctttcttgtttcctccattgcaaacaaagctttctcccactaaaccatttttcaccaaagtttttttcttctgttccccattaacccattactgtgtaactctatatacacacacacacacacttccttgctatattaatattttttttggcttttaaccataaccctgaatcaagttccttgtgggtaaattaattttagctcaaactctacaattcattattggtacatctctgccaattaatttactgttgtttgcttcagaaacagattaaaaaaacggagccttttctttttccattgtttcatctgttctgttctaagatgaagacaaatctaaaggacaaagctttagtctctctcccaacatactaactaaggtaacttcttcagtcttcttttttttccataagacccagaaatctttccttgaatgttttcttttgatatcattatgtgattgattctctgtaaattgtctcttgcttcaaagttaagtgatgcttttttcgatgatttttttaaagccgagattctcttgtttcttcaagctcccatcttttgtggggacacgtaatgcccataacttatttgttgatatgccgctatatttttacttataccaatgaaagtgtgcgtttttttaatttcttactgtgtctgtgaaggttttttttaactcacatctattagattgttccatgtggcctcagattgagttatctaccattgcttctacgctttctgttttggtggctaaatgtgaaatgagaagtgtgaaagatttctttttagtccttgtgtgatgtatgcaagtgtttatatgtgaatgtgatacactctcttgttttaggtgattatagtgaagttgtaagagaagcatacaggaccagagatg

SEQ ID NO: 13598 - DNA, 3000 bp, Unknown
  misc_feature (1)..( 3000): cDNA_ID_3030890_gDNA_ID_2214638_Annot_ID_188208 3000 nt of promoter + ATG
caagatgctggtggctgaaatcgacgaaaagcacaagggagactatgactttctatgcttgccgacagactttaaggtattatactataagagagagtgaactcatgatgcacttgtatgacctgagaacttactaacaatctagcttttttctggatacagaataaatgcaacatgggtcacgcttttatcaacatggtctctccattgcacatcgttcccttccaacaggtttctttaccttttctcttcagtattgtctttaaaacttctcttcactagtcatgaagttgactatgtattgtggatatggtaattatccgattcaatggcttgagattgttatagctaaaagatattcataatgtgtgtttctgcagactttcaatggtaaaatatgggagaaattcaacagtgggaaagttgcttcattggcatatgcagagatccaaggaaagtctgcccttgcgtcatacatgcagactccaagttctatgaaggaacaaaagcaattgtttccagaagtctcctaccatgatgatggtcaagacgccaatgatcacgtatgtttatccgatacaaaatctcatttttgtttttgtttttgatacatgatttcaaaatgcatatgcagtatcttcagatttttccaccgatttcaccttgtatctatgaatcatacaggagcaactgttttcaagcatttggaacataaccgcgcctgattcagattggtcttacacaatggatcttatcgaaaatccgagggagaacggtaactccaagaatgctgcagaagagtcctcttgaatccccactaaaactagtagttgggaactctaactcaccatcaaaggtaaactaagtgtacaggtctggcgcggttatggaagaaacagaatgtacagtattaaggcttgttttctccacggaacaaagtaaccagtttttagggattacttcactcgaagcaaccgattaaagaaacatccctattagtacattacgttgtatactttatattcggaaacttctctctatatcagtcatgtgtatataacatcctcttgcgtgtacattatcctttccatgtgaaagacatgatcagtatttagttgtacaacaggttcgttataagtttctgtctcaattagttatcattacaaaaccgttacacgtctctctctatgtagacatctatccatggtttcaatgacggatcagactcttcttcaacctttcctagccaaacccaccaccaaaggcttagcaacggaatcggattcaggtattattctgcggcttttctctatacttctcgtcggagcaatctctttgtgggcaaaccatgaggcttcaaaaggcttctccataagtatcatcaatgatgctaaagattctccttccggtaaaagattcgcccttttcttcgaatctgatgatacggcagtgcggatattgctcgatgcaagcttctttgtggagaggtttctctacgagggtgttcctcatcgtctccgtaagcctgtaaaccacgttaccgtccaattctgtggaaacagtagtgatagagtagataggttctcggtaacttcaggtgcaagtcatggagagtatgtgatcagattaagcccatctctcacggaaagaaaaaagtttagcaacgccgtggaatctgcattgcgacgttctatggttagaatatggctatggggagacgagtcaggagcttcgccggagcttgtggccggcatggtggagtatttggccgtggagagccgaaaacgacgtcactttgaaaagtttggtgggaattggaaggataaggaaaagtctgtgtatgtggttagcttgttggattactgtgaacgacgtagcgagggtttcatccgacggttgaaccatgggatgagacttaggtgggatgatcggacggtggatcttgcttcgagtggtgcgtgtggttcacgcaaggatgtgttgcgtgagcttaagatggacgacagtggattgataattgagagacgaacatgatatgttctcgtgctgccatattgtagcacacatggctccacgtcattatttcaatgtgtataattcatcttctatattcttatcgaaaaatgttttttttttttttttgtcgttcgaaaaatgatttaattttttctcagataaataaaagaaattatctgaaatttctttgttgttagtctcagaaaaagaaattattggagcccagttttggtgagtggaaacttttggttttgttatttcaaggccttgtccaacaagagtaggatcaggacctacgggcctatttatatagtatatttatttgagtgtcagtgtcacactaatcaaggtttaattttaaaattgcagtattaaatattaatgaaggtttttatgcgagctgatagcggcctcaaataaatatattctcgattggatttctttaaaaaaaaaatcactttaaagttgacaaaaaaactcagtttaaagaaaattaaggtggaattatctagttaagtgttactctttaatatttggctaattgcgttggttcatgcctgtttaagaaggaaatataaaaagttttgacttaggaaaatgaaaatgaaaatgaaaatgatgcagcttcccagcttttttacagattccagatattgatcagatttttgataccgagatttctcttctctattgatttgatagagtttgggaaggttttcaaatatcaaagaatggaaataatgacaacattaatggaaatacattcagtaaacagtacctaaagttttatttttatttgaaattaaaataaagataaacgtatcatttacagatttggggtacagaaataaagtgcaaggaatcaaaattgtcagccgaacaacaaaaaaaacaagggcttttcagaaaaataaaaaacctttaaaccctttttttgtgtatccgattccgtcgcaagtacattcggactctttcacggcgtca

SEQ ID NO: 13599 - DNA, 3000 bp, Unknown
  misc_feature (1)..( 3000): cDNA_ID_3030898_gDNA_ID_2214638_Annot_ID_188206 3000 nt of promoter + ATG
atcggatggaataattggaaaaaaggaagagtttttgtttcacctttttgcgattatcttgctgcatcgtgactcaattgaaacacagactaaaaacccaggaattagaagaaccctagaattcgatctgaattggggggagggaaatagaaattcagatcagccgcattggccccatcgaccactactccaaatggcgaagctagaatccgacctggttctgctccggcaatcgatcaccgacagagacagaatcgcaggcgaatttctcattcacctctctaattcacccaattacccccaacgaaatcgaaacaacaacaaacaatcgcagttcaagataaatcgaggaattgaagatagcagagtgcgaacagcattgctttagacgcacgttttcgtcggcacgagatctgatcaccgacacacaagggatacagagagagagagagagagagagagagagagacgaagaagtagtgaaaatgaaaggagagagagagataaggaaggaatctagacggagatttatatatagaggttaaagtgtcgcgtttggtaagctgctttggtcactgtgatccaaaaaaacaacccattagtaaaacgaaaaaataaattatttgatcaagtgttaataaattaattaggacattattgatctggtcattattagtgtatgatctatttttgatctttattgccattcattcatgtcttctttatccaattctttcgttttgtcacgtacttatctcatagatataatgttaatagaatgttatcatctttatccttaaaagcttttttgctaattttagttgctaaaactttgttttattcactttatcatttgctatattgtatatactgctaaattatattttcaatctatatttcatcatcttcatttttgtaaggaatttttagcttattttttgtattaagtttctggtaatatgattctcaattattttgctgtaaaaaaaaatatatattattttgtttttttccattaatattgtatatcaaataaccttcaattaaaaacaacaatattaatttagcttttggttgtggcatgagtgtaatatagtaatattaggggtagaaaaaaaaacaaactctcacttaactagcccaatgggccatgccatttttttaaaacacgcagggcttttcatatccgaatagttaacgccacgtcatctctgacgcgtgagagatttgttgtcaaatgtaataaaccagctaatcattagtctgtcttactgtctccttcttgtggttaaaatcaaaagtcaaaccagctcacattagtgtaattatttaactaaattataaaaaagataatcatattttgattagctaataactaaactacttgacgattgagcgaatcttatatttagtcttacgggattaaacaaaaaatatcaatcagaccttgttacgtaagcacaaatcatagtgtttggttgaaaaacgaagaataatacatttttttttatagtgtgttagtactgttttactttatacttccatattcttttttcaatagacatgttttttctaatcttctttttggtgttaatttgatttaaattaagttaaatttttgttgttttatgtatttggccaaaatgatatttgcatcataaggttcatgtagaagaaaacatatcttcatttttttttactttctagtctttttcaatctagtggacctaatcctttttcaaaatgatcttcaaagaatttttgtacctagtcttgaataaatgtgaggaaatctttctttctttttatgtgaaaaaatgtgaggaaatctaatttacgtctttcatttttctgcgaacataaaatgggtaaggagatatggaaaatgtaagattcggtttgcaatttttctgcaaacacaagatctctgttttctgcaagaacagaaccaatttcccaccagggtaactcattttgaccacttacaagcgccaggcaataatccttcttcaaggcctttcaccactccccaagttctctgctttggatcatataagctctcaaaaatcataatccaataccaaaattcatgataagttatatgttttattcattatcaagaaattgaaaaacaacaattcaaaaagttcatcttttagaatcatatactagaaaacacataaatcaagctccattcaccaattattgatgaagtcatgaagataaatcgattattatcctctgatgcaacaacagcgtggaggatttccaacacaatgtccagtccggtaaatagctacattagtacagtcatagaagcatgcatgatcatcccgtctagcatcacatagaaaaaggcaagcaccatattttgctggctcgatcactgcacatatatacaactccacattaaaactataaatctgtagatacatgtccaaataacagttttagtttcttcaaggttcttaacaacatatacatatacacagatacatgtaatattgtattactaattctatatttttaagaattttttgtttcctgaattattgttttggtagtgatcaaagatagttgaaaataacaaaaaaaaataaacatcttcgcaaagaaacaacatacctgactcggcctcaacatcgtaataagaaaacgaaattgtcaatataattacaagaaaaacagttgcagaggtttttttgatacccataggttctattatcttttaggttttcgtgaaagtcttatttataggactatttttcttggaaagtttcaagtttttatcctctgtttttattttacagtaagtagatcttccataaataaatttgttattttggtaaagagagattttcatttctttttattatcttctttaagtagaaagaatcttaaaactactatacttgaatacttataaaaaaaattactatacttgaatatatcaaatttaatgcaaagttcatgttggagaaattaaatactaatatcaaa

SEQ ID NO: 13600 - DNA, 3000 bp, Unknown
  misc_feature (1)..( 3000): cDNA_ID_2703480_gDNA_ID_2214638_Annot_ID_136182 3000 nt of promoter + ATG
ttgaggccgagtcaggtatgttgtttctttgcgaagatgtttatttttttttgttattttcaactatctttgatcactaccaaaacaataattcaggaaacaaaaaattcttaaaaatatagaattagtaatacaatattacatgtatctgtgtatatgtatatgttgttaagaaccttgaagaaactaaaactgttatttggacatgtatctacagatttatagttttaatgtggagttgtatatatgtgcagtgatcgagccagcaaaatatggtgcttgcctttttctatgtgatgctagacgggatgatcatgcatgcttctatgactgtactaatgtagctatttaccggactggacattgtgttggaaatcctccacgctgttgttgcatcagaggataataatcgatttatcttcatgacttcatcaataattggtgaatggagcttgatttatgtgttttctagtatatgattctaaaagatgaactttttgaattgttgtttttcaatttcttgataatgaataaaacatataacttatcatgaattttggtattggattatgatttttgagagcttatatgatccaaagcagagaacttggggagtggtgaaaggccttgaagaaggattattgcctggcgcttgtaagtggtcaaaatgagttaccctggtgggaaattggttctgttcttgcagaaaacagagatcttgtgtttgcagaaaaattgcaaaccgaatcttacattttccatatctccttacccattttatgttcgcagaaaaatgaaagacgtaaattagatttcctcacattttttcacataaaaagaaagaaagatttcctcacatttattcaagactaggtacaaaaattctttgaagatcattttgaaaaaggattaggtccactagattgaaaaagactagaaagtaaaaaaaaatgaagatatgttttcttctacatgaaccttatgatgcaaatatcattttggccaaatacataaaacaacaaaaatttaacttaatttaaatcaaattaacaccaaaaagaagattagaaaaaacatgtctattgaaaaaagaatatggaagtataaagtaaaacagtactaacacactataaaaaaaaatgtattattcttcgtttttcaaccaaacactatgatttgtgcttacgtaacaaggtctgattgatattttttgtttaatcccgtaagactaaatataagattcgctcaatcgtcaagtagtttagttattagctaatcaaaatatgattatcttttttataatttagttaaataattacactaatgtgagctggtttgacttttgattttaaccacaagaaggagacagtaagacagactaatgattagctggtttattacatttgacaacaaatctctcacgcgtcagagatgacgtggcgttaactattcggatatgaaaagccctgcgtgttttaaaaaaatggcatggcccattgggctagttaagtgagagtttgtttttttttctacccctaatattactatattacactcatgccacaaccaaaagctaaattaatattgttgtttttaattgaaggttatttgatatacaatattaatggaaaaaaacaaaataatatatatttttttttacagcaaaataattgagaatcatattaccagaaacttaatacaaaaaataagctaaaaattccttacaaaaatgaagatgatgaaatatagattgaaaatataatttagcagtatatacaatatagcaaatgataaagtgaataaaacaaagttttagcaactaaaattagcaaaaaagcttttaaggataaagatgataacattctattaacattatatctatgagataagtacgtgacaaaacgaaagaattggataaagaagacatgaatgaatggcaataaagatcaaaaatagatcatacactaataatgaccagatcaataatgtcctaattaatttattaacacttgatcaaataatttattttttcgttttactaatgggttgtttttttggatcacagtgaccaaagcagcttaccaaacgcgacactttaacctctatatataaatctccgtctagattccttccttatctctctctctcctttcattttcactacttcttcgtctctctctctctctctctctctctctctctgtatcccttgtgtgtcggtgatcagatctcgtgccgacgaaaacgtgcgtctaaagcaatgctgttcgcactctgctatcttcaattcctcgatttatcttgaactgcgattgtttgttgttgtttcgatttcgttgggggtaattgggtgaattagagaggtgaatgagaaattcgcctgcgattctgtctctgtcggtgatcgattgccggagcagaaccaggtcggattctagcttcgccatttggagtagtggtcgatggggccaatgcggctgatctgaatttctatttccctccccccaattcagatcgaattctagggttcttctaattcctgggtttttagtctgtgtttcaattgagtcacgatgcagcaagataatcgcaaaaaggtgaaacaaaaactcttccttttttccaattattccatccgatactatctgttctgtctgagatatttatgtgtgtgtttcggttaatcttgtttgtttcctgttactgtctttaatctttttgccgttttggacaactctgtttatgatcaatgaacgttacaagtgtcatcaaacaaacaacgcataattgtcatcattcaagacaagatgatgtgttgttgagacattttttttatttcttcatcagcaaattgacattcaattgcattgatccttcattaggcgtcctttgtagcatcagtagagaaccttctgcatctgattcttgtatagtgttatctctattgtaatgtttctgacttggaagtaatggtatttgtaacagaataatctggagatg

SEQ ID NO: 13601 - DNA, 3000 bp, Unknown
  misc_feature (1)..( 3000): cDNA_ID_2703484_gDNA_ID_2214638_Annot_ID_136183 3000 nt of promoter + ATG
tctatttagttcaagtgaacatataactcatatcgtggaccaaattagatttcatagttagttcacatgatggaccaaacttagatgttaaaattttgtacatatcttaaaaactcaacggccttgaaatatgatgaagttcaatttgttttaagtacatagccgagacaagtttgattcatcttgtagataaaatactagaaaacgttaacaaattgtatatttgcttatcttttgcttatactctacttatgttttacataatttttgtttgtttatatttggccgaccacaaaaaccaaatctaattatggcctttaccggaactaatttttgtattggtttttattttattttattttattaatttggattgtaaaatccagtaacaattttactatttcaacgtaagtaatgtagagaaaaatctcttgcaaaaagaatttacttgttcgaaagtaaactatataactgctgacaaagacaaaaaaaaataaaaaataataagagagtggcttgtaatatagaagaaatataagggtagagggatggcaaaaaaaaaagctaggtaattcaccaggagaaaattttacatttttactaaagtattttatatgtttgaaatctattttaacaggtttccgatggagatcttgtcatttgcttccccaaacataaccaaccagcttttgcccatcctcgtttaatacatctcaagatacaggtttgtttctttactttttaaattttgtttctttactttttaaattttgttgctcgattacttatgattcctagaatgactggaactagcaagaaaagtgaatggcgaacatcagaggcacacgtcagtaccgccaaatgtcctgaaggtacagtgccaatacaaaacataaccgttttggatcatcgagcaaaaccagaaagaggcaataacaatactagtttcatcccctaacatgaggtacataaactactagtttcatcccctaacatgaggtacataaactgttaaacatatatctatcattgtacttctctctttggtaatacgtatttctctctttggtaaaaatgaatgtacttctcgatttttagttttgaagaaattaaatgcattattaattggtaagtgtttttttcccaaccgttttgtcaatatattattttcctaatatttgtgatgatagagtgattattttttacatatatagagattatattgagatttgttttttttttaaacacatctctagatttgttttaggtccataatagacttcgataaaaaaaaatcacaatttaattttatgaaaatacaaaattctgcacgagttgtaatactagtatgatataaatcacataccaataaaacctcaacattgttttgttttgtaactgatcactttgacaaaatgcaaatccgttaatgaaaaatttatgtgacttttgacttaaactatttttcaattaaatttatcggataataaatgtgagaatgtcagaaatagttagaataagtaaatgtgatgaattttatttattcagtttacatgttaaaaagtcattcagaaaacagcaaaagtatttaaaataaagtaacaactccaagttttacatttctgatttgcatcataagtgtatttgtgactttttaagtccgtcctagaatttgttcttacaagttgatcataataatgcgagagatgaatctatgagaaataaagttgagtatcagactaaattttctcatcgaatgttcaatgttgcatccttgttgaccttgtccccaactatcatatactactactatatttcaaaataagttccgacatattaagaccaaaataatagtggtttttctaacatgtaattaaagcccatattttaaatgttgattagggcccataatgttatagtatatactaataattaattatttgattatttaaattattataaattttttgatatacattacatatgaccataggacatatagataaattcctgtaaatattaacatattagatgtcaaaatatttttccttgtagagtttaaaacaaattatcagtgtccatcaaaagctggtttaggttcgtgtcaacggttgggccgaaaaaataaacgaatttcaaaaattatagactctaattaagtaggattacttattttgattgtaatcactacataaataaaataattaaatatccattttttctctctctctttctcagtttttttttttttgggtaagcgtttgctcgttgtgtaatttcccggcaacggaagagaggaggaggaagagtgtaagcaataaattcctcttcttctacgaaacatttgctcttctcctctttctcttctcttctcttctcctttgcttctccgattctcttccttttttttagtttgatccgactactcaagctttttttctgttcatggtttcctccatcatcgcaggtactacttcacttcttcttcgatgaaatttctgctaatcggtttgatttttggttattattcatatgaaattttgtattccttatttgtttgactgctctatgattatcatgtagtttgattgtgactgttctggtttttttttactcaaaactgatcatggtttttaacgagaaaacaagttgatactctctttggttccgtggaattcactgatcatcgaatcggtttttgacctgtttcaaaggtttaagctttgatttgagtttattgctctgtctctgatgatgttttgtcgccacaagcagcaaaattttctattcatcgagttgaccaactcatggtcttgcttcgattttcttcttctcagttatgtttgttgatgtatggactactaggaaacacatgagtagcttgtgatcgagaactaatgatcttagcaagttactgttctgctttatgatgcaaaatcagaaatcaactagcaggtctttgatatttgattcatatctgcagttgcagaaggcaaaaag

SEQ ID NO: 13602 - DNA, 3000 bp, Unknown; identical to SEQ ID NO: 13598
  misc_feature (1)..( 3000): cDNA_ID_1017476_gDNA_ID_2214638_Annot_ID_136185 3000 nt of promoter + ATG

SEQ ID NO: 13603 - DNA, 3000 bp, Unknown
  misc_feature (1)..( 3000): cDNA_ID_2703495_gDNA_ID_2214638_Annot_ID_136189 3000 nt of promoter + ATG
ccttttccaatggtgagcaatcagcaccatttttgcaagcccattttaggctcgaaatcactcttctaaagtaggcatatggattttccatgcaccagagtgtgtatgtaggtataatgcttgtgttctgctgtgcagcaagtgtaccagtcgcttctgatgttcctgctactgaaactagtgcaaagagggttattaacatcttcgtcttcattttctgagaaatttcttgctttttggtagaaaaataaatggagaaactggtgatgattatatttgatgatgatgatttgttgtctatcatgtacatttgcatgtatttatatcattgcctggagacgtatttaaagcctatgcatgtgttgaaccaactattgaaatttataacaggcatgattatatgtctttatctctaattaatgccatgacatgctatgcagtttacactgaccatgtatagtgcctctgttgtgtgtgatcattacaggaaagcgtcctaaacggaatctttcaaagaaacttcatcgagaatgttggtttggaaacgcacagcacaagttattgatccaaatccagaaaagtttggaagtttgtgcttgaaggttagtttatcattcgatgtcagttttaatgtgtttgtgatttatctactaagttttccgtgaggtgcaaggagaaaactttcacatattttcgtcttcactggctagatataagtacataacgattagcttcagcatcaccaaacatgttattctacccacagaagtactgattttaattcaaggtagttagataatgaaatagggatttagggaaataggctatgatgtttaaggtgatagacgtactaatgtttttggcattgctcatgaaagtacccaatcataaacatgagaaaccgcgtttatttccttaatccccagatatctgaaacgtcaagagtttgtatcttgttagtgaaaccctcaaaaatcctctagagatttacagattatataacatgttgaaactgggatgagagtggagtaaaatcagaagttggttgctagctcagtttcctaaataattgctggaacggtgcaactgcaattggtatcacacaggtaaagagaaatcaccagtttgtatgattcttcacatgttctgctattaatggccaacattcactttggatcaaggataaaaatattgtaatattttcgtattaaattagaggattgtgcttaaaattcataatcatttacttttgcttttttcagttttttctttttactgttgcaggtacaaactacaaagggagataagcttcagtttcttaaccagacttacggttctctctcaacctacagacacatttatctttgattccaaggtaaatgagataataagattaaggcatttgatatgatgaaacgtggagattagagcagtagtattaaggtttcgacatgacacgctgcgcaggcccccaagagtagatatcagaagccgagtttccattagtgagcagattttgaggcagtccatgaatgtcatctaaaggacgggatcttccattctggtagtactgctggttctgcatagaggcagcttcatcatcatccataggaagacgatcaaaaacagcattcatgaaagatgcagccatgagaacaacaggaccagatgcgattagcccaccaaccactcctccaccaacaacctgtccttgaggtccggctaagtaaatggtcagaccagttattccaagtggtgctggtggaggcaagattgatccaagcaatgagaggatctcgtaacgtccgtgtaatgtgacaattgctcctgatgaagctggttgccttaatgtcacattggtgacacaaccattggcactgagaatgcagagacctctctgtttccttcttgcaaaatccgataaagtctcacagatgtcacaacctgagctgatctcaacggcgttagctctgagggaatttggactgtcgtgagtcacaatgattggtggtttgggtttgttcttggagccagcgggtctgccacgtggcctcttagccatctctccttcgattgatgaaaccggttggacggctttgggtaatgctctcaggttgttgttggtgttgcctctctctgttgcttcatggttcctcattggaacagacttggatcctacagaggttggagttagagctgtacctccagccattgttatgaatgttgttatatgttcaactgaaagattcagaaaatttgtgaggagtttgtgagtttaagtaaggagattttggtgaattattaaatggtagagacaccaaaagaatgattgtgaggagtaggagatggttaagttgtcaccaaaaattgtgattaatagttaacaaatttattttgcaaaaaaagaaaaaaaagaaaagtttctggcagcctacttctcaacagatgattaagtatttgattcatgacaattgtcttctttaacagagagattcataataatgcttaaacatcttgtagctatttacaaccaaatttataccctttttgggaccaaaactaaaatcaaatactgatcgagagttgagaaacaacaaaaaatgagagtcgtccactgctctgtattttatcgccttccatactcgactcttattgggcttttaaattggtcctacagagaaggtccaataaggcccaaaatatgtaaatgtacacgtgtggttggttcttagccttgacttgtcgtcctcgacctgtgccacattcatctctctctctcagtcaaattgttgttttctttcttcgaatcggtgcagaaaattcagggaagttctggggaaggttgttgcgtttgactcctttggcttagttttctttcgaattccgtgcttcctgatgatcttacgtgaaattgcagcctaaaatttcgagattgttttttttactcagaaaacgagatttgactgatatgaatcgaaaatctgtgatttaaagtgaagc

SEQ ID NO: 13604 - DNA, 3000 bp, Unknown; identical to SEQ ID NO: 13597
  misc_feature (1)..( 3000): cDNA_ID_2703430_gDNA_ID_2214638_Annot_ID_136190 3000 nt of promoter + ATG

SEQ ID NO: 13605 - DNA, 3000 bp, Unknown
  misc_feature (1)..( 3000): cDNA_ID_2990498_gDNA_ID_2214638_Annot_ID_136192 3000 nt of promoter + ATG
tctgaggtaatcttcttcctaaccttctcgtttttctgtttcttcgatttgttgaaccgagcatgaagcgtcttaattcttgtgaggtcttggatttgaagatcaacaactgaatgtgttgttctctttgtttcttgtttaatccttgattgaggcttcaccgattctctggtatgttccttggaaggatcatgttccttggaggagaaaccgcaatcgttgcttgttgaagaagaagcagaactgaaacgcatcgtatcttgggaattaaacatgttaagggatgaagagtaatgctcatgtttccctgaaagagttctacagtctccggaaaatggtgagacagagaacaaaatcaggccaagaagaaatatactgagtttggtcgacattaagctgctgctgagattactaatattaataaaaccattcaagaataaggaagaaaagaaaagagaagagagacctatgagtgattttgaattatagcttctaaggacaaaagaggagctaacataaaaaagagtagaggattttgtgaaagtcaatggaatcgaaaatattaaaataagttacaattcgatatctatttgactgagacagaaagccatatcataccagaaagcaagaaaaataaacaagaaaacattttaaaaaataagagaatattgtaggtggtgatggtcttctcttcagtgagactggttcaaacatgtggaatctttagtatttttgtttttctgattcgtagttttcgttgaaatgtgaagttacccgcttaacagtagttggtagtactacaaaagtaaaacttcaggtaagaattacttaatccaacttttactatgataaacaacctaatttccaatacgctctcctctacgtatttttatattcaactagattttgtggtgtatatatatatatatatatatataagctcttgagcaatagtcacataattagctcaaaagccagccacatctataacgggattttttaattaaattaaagatcaaatagatgatatactttaattgactgtagaagagtctttctaagtgtgtttgactgtgactaaccacatatgaacagttaagaaaattctttatttaaaataaataaattaaaagatagaggaaacaagaacggagaacctatgttggaaatgcccccaaatctttggaaaatttgtaagtagaaaagttattattttcctttaatttgcaacactattcttgtattgtaaacaaaaatacttgaatcaattattttgaaagaaatgatctaaagatagtgacataattcaatagatttttattttaatataccagtcaattttgttttcctaccattcatattacacaaatgaggaatttcatgaaaggctgcctttcagaatttctgtgtttatacgaatcaaatagtttgttaaaatctaaaatgattatttataaaatgaaatcaataaaagatcaagttcagaaaaatgtatgttgttttacttagatgtatttttgtaaataaagcaaaagattcgaatttgactttcagagttaatactgtttaagtgtaacgtattcctaactatattgtgatgaacaaactgattagcattcaatttgttataatcccaaccaaacatttcatttttaagtgtgcacgtaattccaatatattcccatgtctatctttcaaatctacttttcaattttcatattcaattaacaaaccctacatgtgtttttctttttcttttttgtcaaacgctacatgtgtttagtagattaatatttcatttcagttttttaaaatatgtagtgttatattataaccgatttgtttgacgtaaaaaatgtggtaaagttgtagccaaattgcttgtttttctaatgtgaagaaaacatcctgaatcactaataagacaactattgagaacaaatcggtaatcaatatcaaataataagtaatcgtatgttaaaagaataaaaaataacaaataaacaccattttcgtacgtcgttagtttttattaggtttggattaaactattaaaacaatatgattgttacgaatcatgcggttcacggggtcagacgaaatcataagtgtggaggtgcaactaccagaactacgtacattattaaaacctaccattatacatctcttctacatgtgccgtttcatttattacctcaccacccacttttctcactataaccaaaatttaatacccttccacactatttcttcgtttttttgtcttccacatatttcacttatttgtgttttctcacctgttatagcaaaattaccaccttgcattcatgtggcgtttcacttatatattactgacacgtctactaaaattcaacataatttgaatgtgctatgaagggttgtaaacaattagagtcaattttatcaatatgatgtatctaatttttatacttgactggttttaggtagatatctgttaatgagcgcactgagcatgcatgcattatatatcatacacccaccaacttctaattcaataaatacttccaactttgtccacttttttggttatttaatcaactttgtgtagagtttatatatgaaaccaaaaaaaaaaaaaaaaaaaatctcaaataaaagatatgaaagatcaaatatcttaaatctaatgttcctaataaaaataattgattcaccgaattcgaataacttaaaaagtacactgaaattaacccaattcatatacaaagaattcgtacatatatatctaaaattttagtttattaaatactacatgttatgtatataactgaatgaaattcctaggtaccatcgccgcatgctaaacaagttgttagcatggcaacacattatttgtcaccatcaatattatgcattattttgaccactcttgtctccatcgccggagcaaaaatcccggcgattatagtcttcggtgactcttccgtagattccggcaataataacttcatatcaaca

SEQ ID NO: 13606 - DNA, 3000 bp, Unknown
  misc_feature (1)..( 3000): cDNA_ID_3031051_gDNA_ID_2214639_Annot_ID_136197 3000 nt of promoter + ATG
cggcgcttctatctcctttcttttcccttgacctcctccacgcgtcttaggcggcatgactgatttcgaatcggaaatagaacggaaatactggtgaaagcaagaagaacgctcgattgaatttaaagaaatagggaatgttgtggttaatttcagcggttactaaggagaagaagtcaaaaaatcgaaaacggttgtaatgagaacaagaaacaatttcgaattggaaaatccctggaaatattaaggttttttttatttgattttcaaataaagagtaaaagtggttcgggtggtttggttcggaaacgaaccatgatttttctggtaattaataggttcggataaggatatactagtaatatccatctatttcgaattaagaaaaaataaataaattatttctgttttttacaatgattttttggcttcctctttgcaaaaaggactgccagacgatttttcgattttggaagaccgtggagatcaaaacagtctcttttgtctactcagtcccctcttgatctggtacgtttacatctgcaatctcctcatctctttaacccattttcatctcttcccttagagtttcaatcatcgaacaaaattattctgatttggtcattgatttgcttaaagaatgatctttctagttcaaagccaagttttttcagtacccatctcgatatctctttgtcccttgttgcaaaaatgtcgaatctttcatatgtctcatgttgagtaaaagctgcatacaaagtgttcgtaaaaatgccgcaacgaaagttacttgacattccagatcagattattatttttacatatagtatgcctatagaattatttcttgaaaatttgggcatgtcaataaattcttgttgcatagcgcattagcagattctaagtatagcacagtaagtaagttgcaatttggtttgcatatcgatttagttttagtatggtcagcttcttattaggattatcaaggaacttaggacttgcggtctatgtggtgaagcttctgtgatgatctctgaagtgtttttgttgaggacattatgagagagagaggtatagtctccaccatgtccaggataggtgtgttcttgtaatagggcttctggtaaaagaaaaagagagacttttccacatgagcttaaatctgtcgcattttactttctgtgattgaactttatatgcaaaactgtccattaaaagttaatttctgcttgatgcttgtgttggagtagggcttatggttccagtttggctaaactgtgtttttctttatctttggcatagaaagaagatccctgtttctggttatgatgtctcgacagagtcagttatttacattgcttaggagaaggtttcattcaccgtctaatgatgccccaacggagaccttaagaaagaagatagccgatttgcaaaagagtaagaagcgaaggaacccaataaagaaccagtttctagttgaggttccagaatcaagatcatatttagacacagcaacgatgcctatgttcctcgctgttgtaggtatcgcattatttgcaaaggtgctaatgatggtaagccttcctctgtcatctctttgaatgcgtctttcttgtcagtgactttagcagctgttaagtagaagttgtttcgtaattgagctgttagattgctttatacttttttgtgcaattgaattaggaaggatctgtggaaattgctgattctcagtattggtttgttgttagatcgatgattcgaaatcgcaagaaatgattgaacgcaagataaagaatgcaccacaggggcaaggcacggtacgaatgatcgatcgtgaggagtgggatgagtttagagaagtaaggccaagaacaccttttgagtcaaagcttgctcgcccaaatgcacaaataagaactggagaacctgtgcgcaaggtaaaccgctctattaaatcaccaatccttgcagtatcttaccaaatcatatcgtcactcgatgaccaaaccttttgcttgtttcctttttaatcaggatgacttgaaaaactggacaatagacgtgctaacaaatgctcttgaacgaaccgaagaaagtgttcgccgtggttccagttagattttctttcctcaattcaattggagcttcctagttaatagacatatatatatcttgagaatttggtactcaagaacactctcggtcatctcctaagcgaacataggcatcatttaggacagttgagagaaggaacagaagctgtcttgtaacggagaaatctttgaaatggagatatgaatattcttactttgttttggaactgctttgtgtattcatatgtgtttgactcacacatttcatcaaaatgcttataaagggtttgattgataactcggactcggttatgggtgtaacgttttaatatttaaaatcgcaaaattggaaccgcttttttaaactgagtgaaatatagcgttttgaaaaaagacgtttctggtggcttctgaattgaaaaatcagcgtttttacttttcacaatattcaattggagaatctttagaacttcaacgaagtagcgtctccggaatttcaggtaaacgtggcaagaaaaagccaaacggagaagcatccacgtgtccctccattagccatctcccacgtgtccattaccgtaccgacgaaacattccttaaccaaaggcttcccgaaaaaggacagagtccacaagcttcggattgttcacaacttcaaagcatcgaaaaggtttaaactttacgtttttctctggaacccgattcgaagaaatcatcaagaagtttcctttcactgatttctcaatctattcgtaggtaacccaattccaaaaaacgtttcttttttctcgatgccttagcttctttggattctgttgtgatctaccgattttgaatttgcttgatcgatcatcggatcactgtgattagtgttattgttcctttcctttgtgtagctttcgcgctt

SEQ ID NO: 13607 - DNA, 3000 bp, Unknown
  misc_feature (1)..( 3000): cDNA_ID_2713882_gDNA_ID_2214639_Annot_ID_136202 3000 nt of promoter + ATG
aaagagactcttgagatgcttgcttctctaggaatgtctgacactctcggcatctctgcagtcgacccacaacaagctatggcaccaatccctgctttcggcggcggcagggcacccagaagatactaagatggacgattggctctcttttttcacagttagggacaagaaagacttgtgtggttgtttattgtttcttttgattatgtcttaaactcaatgtgagactctttcgtattaatggtttttgagttatgtggaaccaaaattggagttcaaacattgatgatagtctcttatcatatatcctagtttttgcaacctgttaatccaggaggtgacggaaaacaccagaatgaaatgtgtcccaactttgatgatagtctcttatcatacatcctagtttttggcacataagattataaaacaaaatggtaagagattcttgtcgtaagcagaaaggtgggaagtagttactgaaagaaacctcaagaagtactaacctcatgatcttttcaactaaacgatcatcctgagcgatatgatgaacctttgtagagctggtaacgttgattacccaagatcctctatcaacttcacagagtaaatggtaaagtttcacccaatcaccaggtttaacccgataaaagagatgactgcttagatgaactctcaagatcgttccaacggttggaaagctgagcagtacatctcttgacagtaaagtatgaacagagagactgctaaacattgtacaccaaatagaagaagagtaagcgtaggatatggaaagcgtagagtcaagcctgaatgaatgactcagctcaaaacagataatctgaagattgaaaactcttttccttgctagttaatactcacttagccagaatagatgctgggggtgcatcagtcccgtcccaaacaaaaacagcgctcgtatcttcatcggcatggagaatctccatcacaagaaacagcagaaaacaaggtagtatcagtcaacaaaacataaaaggtatacagtttgagccaaaaaaagatttgtaagtaacaatgaagtgctttctcatgttaatagagagtatagagcatattaccctacacaccaaatcaaagcgttttcctatctacggagcaaggttttgttctgtaagatatactctgcatagctaagtaccaaaacaggaaatgaaagcttattggaactacattggtaacaaaccaaatcctcaccttcgaacaaggcaaaggaagaaacccatctactacaagcagcgtttactctttttccactatcaaaagtttgcatctacacaataaaaatccaaactttattacctcctccacaaaacacacaaggaaaatgaagactctttgtgccttaatgcgagtaaacagaatcatgtcgtcgtggttcttgatttgaggaagttgttcaagagtcctactatatacattaacagtaagtccaggacttggatacgtatcatcaattatccggagagtacaaatccaatctaagaaaaaaatccaactttcagattttgggtaaaatgttagagctttcacaaaacaaattatatgtatttgagtcaaatttagggggtttaggataagtaccattgttgcgacattgttttggttctctttgttcaaggacgataccaatgagactgacttcttggttgatgagtttaatggcgtctttgattttgatgagcttcggactgtctctcttcttcgccatctcccggctttgctacaacgttttcaagtattatcctgacgtcattagacagtgataatatggtgaaaatgaccatttgatttcgggaaacatgtcattatttttttttgtcaatatatgtcatttcataacttaactttaaagatgttttatacatcaacttaacgtatggttatttatatatatgaactaaatgttaactaatgatttgaaacatgagaatgtgcagaaaagacatatcactatctaggtataaacatttggatttatttgaattagaataattcgggttggagaattttcggattttatgattattctatttgtttttggttaggaaaggtgacgaattttgatcattttccttcggttttcaaagaaaaaaaaaacaaaaaaaaatagtcataaataaaaattagtttaaccttactaaattttgtctaaaatttgcaaaaaacaaattatatataattttaataaatataactaaatttttcttgatatcaaattatttaagatatgttatttaaaatatgttatttgttataaaattatagctaaatataactaaatgcaccgaattacatttagttattaattgttttcttagctttttcaatctcgtaaaattgttccattaatttttgtttttttcaagtttgaattaactacgtaaattaggtttggagaaagcaaaattagaatacttttgtaatcgaatgtctttgaagatttatagaacaaaagaaattgagcaaaattattacatgttccctagatgagtgtcaggaacttggtatatatggagtttagaagtaaggttaagaaaaaggttggcttcgaggaactggagtgcatttaagtggatgaaccgtgcataaggtactatacaagaagttttgaagggagaacttttgaaggaatgaactaaggaatgaacttttgaaggaatttgaactcttcctaaccaaagtatagaagacttcctaaccaaagtagtgtagtaaacgaaaaacaatcaaaatgtgacaaatcaaaggtaaagactagaccagtctctgctcaactgtatttttcaccaaccattgcaaaaaaaaatcgccgtcttactattaacccacgtgttaatcacaccaactaccaaaaatattcataatccaacttctatataaacttttgtttgaccataaattacaaaaaccatttgaattttctttcttcttcaaaagttcgaaacttttttttttccggca

SEQ ID NO: 13608 - DNA, 3000 bp, Unknown
  misc_feature (1)..( 3000): cDNA_ID_3594295_gDNA_ID_2214639_Annot_ID_188266 3000 nt of promoter + ATG
tctaaggttcctatttctctactttttcaacttctactacagaaaacaaaatcaaggacatcatcctagagattagtgtcaaattacgcaaaaacatgttcctactggagaagaagcttccatacataaatcttggtactattcaagaaaactgtgcttttcgaaaaccacaatgaagctttgaatttagtatgtcttagtcgttaagcgacactgtttagcaagcattctattcactaaagctcaatgattctctcgtacaagtttgatgaaacaagttttgtgttgtttacctcgtaactccttaagtaaacggaaagagaagccctttgaatcaacagtcacaacaacatgtggcttaaacttaaccgcagcatcaatagtctccttcaacttcacctagtatctcaaaaactagactagtcaatcaaaagaatctagagtagctttatatcaaaccattcaaaaggttactcacacggaatttatacaaatgtggcaaaagctcccatacacccattacagccaaatcctccattggaaacaacgaattcaatcctttcttgcacatcaaggatctatcaatttgtaagaagcaaagatacaaatgttccaactttatgaaattttcaattgagaatcaaaacttttcataagaaacttctaaattgggggaaacccaagtgcttaccctccaactccattgaaacggatgggtaaaggagagagctttttaagcgaggacataagacgagaaccgatgttatcgccggaaacttcgccggagacgatgaaaactctgagctccccatcgattgcagccttgtcaatcaccgatttagcagcttgaaatgatgagtatctcttagtgaatgttgagagagggaaacgaagtttgctctttgtaatctgaaacatcatttcggagaagagagagaatcaaaaactctgaaagagtgaaagtgacgttgttaaacaatgaactgcgatgaaagcaagatttctcatggggactttaatgggcctcttaagcccacttcttatcagcatgttattgaggcccatcagtcatagtgatacttgtttaggagacagtgatagttatagacttacagtgagtgattgtagatgttgaatggcctatgtttattgtttttggatctaaaacttatcaagtaagagtttttttcttctgttaaattagtactccatctgttcttttttgtttgattgtttagaaaaaaaaattgtttaaaaaagattattttttaggttttcaatgcaataattgttagttataattgataaattgtaaacttcgatacaaattattaaatattattggtttagagttattgaaaattgtaaatcacgaaaaacagtaaatttaaaagcaacatttcatatgttttcttaatatttgtgtttttcctaaaggatcaaacaaaaaggaacagattgagtattacttaggataagtttggggtttatagcaaaaagtttgatatttggggcttatagcaaaaagttggactgacaattataaaaatagtaaccaagactatcaaaatatttgataaatttagcttatctttttattaacctttaggattctgattttcttaaactaacttttttttaaggttggtcatatggataaaaaagattaaactgttcaattttgggttgtctgaaatctatataaaagaaaagctacaaacacaaaagcttattattccaaaaactctttaaatttattttctctttaagggaaaaatagataattgacttattcatcacaccatttctgcttttagatatttgtgaaatcctctctatgtttcttaatcgtctcatttaatcccggcgatagtaaatattgtaataaaagagatacacttccaatcatactttggaggaatgacatggtctcataattaagtcatgttgttggatgtttcgtgtttttcgtcctaatttatttgttatgtttcttgttgtgggctttagtttaaagagctatgttcatgtacttcagttctcattttggctataaaacatatacttcatgatcactaaaaatgcaaaaagggtgaacttatatcacatcacatcaaattcttgcatttaacaacgttaaggcgatggaatttgataaaactatgaaaatgttacttacatcaaactttaaaagcaaaaatatcatttatttttccaaagttaatcttaatattttgatggagataggattaaatctaaggtccttcagaatatttggcggattttaagagcaatagagaagaattctccactttttttttattattaatttctcgcagatgtaaaagcggataatttggcacgaaaactccgtatcgaaccacatcatatcacatttataaacaacatactccacaaatagctcgtttgagttgttgtttttttagtaaatcggttgacaaaaaaaaaaagaggattaaatctaaggtccttcatgtaatcaagatcctaatttcagaaagtttaactattttgagaccatatcgtttaaaacccaaaacattattccaacttgaattgatgatgagataagatatgtagaccctactcaactaaatatatcatttagtctctcgacagataattcctttcataaactgaaacctaactgaagaattaatacacaaatatttccctttttagtcatatccctaatcatataactacaaaaatttagagagtacacacatagcaaagtcaatccaacggtaaaagagagcagtattgatggagcggcaaacgaccaaacaacaaatcgtgctgaaaataataatgtctcaccagaatttttcagcattaattgaaacacacaacaaacctctccttattcaatgaaaccacatttcaaacactcatgttttcttataaagagaggcctctattcttttatacagctcatggaatcacactatcacaatcataaccacaaaaacaaacact

SEQ ID NO: 13609 - DNA, 3000 bp, Unknown
  misc_feature (1)..( 3000): cDNA_ID_3030995_gDNA_ID_2214639_Annot_ID_188265 3000 nt of promoter + ATG
cagtgccaatgttggtggctctctctaaaggcatgcatcccattggaggtaacccacctagtgagatctttctagcaccaagtccatgcaacttcttcacaaattctttcgcgattccggctagaaaatcttggtaaagactgacggaatattgcgaagaacggcccggaaaggcaaagtaattctcgaggaaatcgttggtccctatgcttatgaggtagagagagctttctatagtctctgtgcctctgtcttttccttggtatgctttaagttttgtttggtattctttgtagtattcgagttgtttccatagaggtagtaccgactacaatcgcaatcagtggaatataattactacatgtaggataatatcccaaaacaacatttgccaacaaaacaacatgtagtacaaagatttgttacattatataaccaagacaactatgatagttatactatatatctcatcaatcataaatgtctataaagacgtgtagttatgtaacatatcaatgtaataaatacaagggagagaaaagtccgtaccagaacatcagaagtggcgttgtcatagccagtggcagcagaagcaaaggtaacacctgttgcaaaatccgaaatgttataagaaggatccaagtacgccggaatgattggtttaagccctaaggcttcggacataaaatccgtcgcaatctttccgttacaaaaccgtccggtcggctttccaccaacaaagtcccgtccatatggctcaaagttgcttctagcaacagttgggatatagttgttgttcccggcatcaacggaagagtcgccaaacacgatgatcgcgggtattttaccggcaaatgttacggttgaagacatagctattaggaaaagaattgtgaagagacttttgaggtgtcccatagtgtttgtttttgtggttatgattgtgatagtgtgattccatgagctgtataaaagaatagaggcctctctttataagaaaacatgagtgtttgaaatgtggtttcattgaataaggagaggtttgttgtgtgtttcaattaatgctgaaaaattctggtgagacattattattttcagcacgatttgttgtttggtcgtttgccgctccatcaatactgctctcttttaccgttggattgactttgctatgtgtgtactctctaaatttttgtagttatatgattagggatatgactaaaaagggaaatatttgtgtattaattcttcagttaggtttcagtttatgaaaggaattatctgtcgagagactaaatgatatatttagttgagtagggtctacatatcttatctcatcatcaattcaagttggaataatgttttgggttttaaacgatatggtctcaaaatagttaaactttctgaaattaggatcttgattacatgaaggaccttagatttaatcctctttttttttttgtcaaccgatttactaaaaaaacaacaactcaaacgagctatttgtggagtatgttgtttataaatgtgatatgatgtggttcgatacggagttttcgtgccaaattatccgcttttacatctgcgagaaattaataataaaaaaaaagtggagaattcttctctattgctcttaaaatccgccaaatattctgaaggaccttagatttaatcctatctccatcaaaatattaagattaactttggaaaaataaatgatatttttgcttttaaagtttgatgtaagtaacattttcatagttttatcaaattccatcgccttaacgttgttaaatgcaagaatttgatgtgatgtgatataagttcaccctttttgcatttttagtgatcatgaagtatatgttttatagccaaaatgagaactgaagtacatgaacatagctctttaaactaaagcccacaacaagaaacataacaaataaattaggacgaaaaacacgaaacatccaacaacatgacttaattatgagaccatgtcattcctccaaagtatgattggaagtgtatctcttttattacaatatttactatcgccgggattaaatgagacgattaagaaacatagagaggatttcacaaatatctaaaagcagaaatggtgtgatgaataagtcaattatctatttttcccttaaagagaaaataaatttaaagagtttttggaataataagcttttgtgtttgtagcttttcttttatatagatttcagacaacccaaaattgaacagtttaatcttttttatccatatgaccaaccttaaaaaaaagttagtttaagaaaatcagaatcctaaaggttaataaaaagataagctaaatttatcaaatattttgatagtcttggttactatttttataattgtcagtccaactttttgctataagccccaaatatcaaactttttgctataaaccccaaacttatcctaagtaatactcaatctgttcctttttgtttgatcctttaggaaaaacacaaatattaagaaaacatatgaaatgttgcttttaaatttactgtttttcgtgatttacaattttcaataactctaaaccaataatatttaataatttgtatcgaagtttacaatttatcaattataactaacaattattgcattgaaaacctaaaaaataatcttttttaaacaatttttttttctaaacaatcaaacaaaaaagaacagatggagtactaatttaacagaagaaaaaaactcttacttgataagttttagatccaaaaacaataaacataggccattcaacatctacaatcactcactgtaagtctataactatcactgtctcctaaacaagtatcactatgactgatgggcctcaataacatgctgataagaagtgggcttaagaggcccattaaagtccccatgagaaatcttgctttcatcgcagttcattgtttaacaacgtcactttcactctttcagagtttttgattctctctcttctccgaaatg

SEQ ID NO: 13610 - DNA, 3000 bp, Unknown
  misc_feature (1)..( 3000): cDNA_ID_2703519_gDNA_ID_2214639_Annot_ID_188263 3000 nt of promoter + ATG
gttgtcgaccgctaataatttagcttaaaagagtcattcctaagaaatgttgtttacataggtaatatgatgcggttcgatacggatttttcttgtcaaagaatccgctataatatttacactaccaaaaattaaagatgaagaaaaacttgtgaattctttcttattgttccgtaattcctccaaatactctgagaaagtcgtccattcggttggagaagacactatattcaccaggtctgaacagtttgtaaaaagttatttaaactttattaaatacgagaacagtatttgataagggaaactgaaattaaattatttattttacaaaatttaataaatgtgacttctcgcaacgtcaaaaatatatgtacatatatatatataataaatgttacgcaaattatgtagaattcattgtcattatgtatgcatagtaattaacttttttacgtctacataaacgatttcgatcgttgtaaatgacattcattatttcaattacaagagaagtaataaaacatttttctcctcttttgtctctttactatttagtattttgatcactttacaagtttaaaaataatctactatttatatttatatccaccataaaaataattcacttatttgtaacaatttgtaaatttataattcgctataagtgttaaaatataggagattgacataaatgacactaaaaaggtttattattgcaaaaatgacacattcttttaaaacttgtacaaatagcacacaaaaattttaatcctctaaaaattaattaaaataaaatatagaaaatacacaatatctaatctcatttcttccaaatccaacagctttgccttcgaaaaacccgacgacttcgtcgctcaccggatcaaatctgaaatcttcaatgacactctcaactaagcccttgaatgagatattctcatctacctcacaaagggatccacctttgtttgtgtctacaagaaaacccactaaaacttatcattttgttcacactctccacaaacagagtatatctctaccatttatataccaaccctaaagaaagcaacaactaatacaataaacaaactagaagatctatagtataaaaacaccaaaaatctacaaaactttcaaatacttggacatgacttacaattatttcagagattcgcttgttttttaatgtttgtggatgatatattcctgagacaacaagactagctgcacaaagaggcaaatatgtcatgttaggtgttcaaaatcgattgattttgatgcttatttgcagtgaatcaattcacgaatcaacaaattcgcctaattccacattgaacgcccattataccaatattaatcgtctaatttcgtttccgaaacgtttcgaaaacgagaaacgcactacgggaagagttcccatgcaacatagattattattaatagagccaaaaaaaccggacactagtaaaccaaaacaaacatgggccattatttataacaaggcctaaaaatgaaaaccaagcccaacaagaaaactcttaggcaaagcaacacactctgtcatctctaaacgtggtgccgtacaaatgaatttcattgacttgtttacacgcgtccaactcgtcatctctgttttgtctatcgccggattggaatattcgccggcaaagagagaacagtcgaatgattctttcttgacctggtaatcatgtggaaaaattaacgattctcaaataagcaaccaaatctcttttgatttctactgagaataaatgattcagttctttttgttataatcttttccacaataccatgctttaatagatcttcatgcgctttcttaaacttccatatctctattgaatttttagatcttgagatctaatccgattagaaggttaattttttgaagctccatactcttccgtcaaagcacaaaccttagagactttcttcttcaaaattgaatgtcacatatatcagaaccattaatgtcacatatatcagaactattagagatttaccttgaagtccaatgtttttaaacccgacccggacaatgaaccggactaccttcttggttactgggtcattgggtcaaccaggttgaaccacgaatcaattttttttttttttttttaatagagattttagagttttagaatttttataaatttaaaaacaaaaataatcatatcatgtttataaaatataaaatcagattatgtttaataaaaagtaaaatcatttacaccaaaaaaaataatatatatatatatataatatataatatcaaacaataataatgtgattaaactttttaaatccaactaaatgtttaatactgtaacaaatatagtaggagattaccaatgccgaaaataaactaataaaatattgtgaattcacacaattaataccgggtgtctcactcaccattcgatttattttttaagacggcactgtgaagtcttcgtcgaaatttaaaatatcaaatgagtttaacaactgaaattttttttaaaaatgattaaataaagtataaaatcctatattttatttcaaaatgaagagagttttttaaaaccgacacccgactggttcaaccggttcaccaggtcatgggttaatggtgagtttttgtggggttttttcgtttttgaacttgtcgggttttagcactttatccaaaccggaaaaatgttcggatcacgatcaaccagtcggaccggacggtccgagtcgggcatgaaaacattgtaaataaccattccattgttgtcgcgtttgactcgaaaagctcctacagtgcacggtttgatgattaatcagtctggttaacgattatttgcaagaatcaattaatttccggcttaaccgattggttaaatatgattaaaccattggttaacttcatatctagaggacgaatttaaatccctgataaattctaaaaagtcccatcatcgccgtcgtctccgtcaccgtcgctgtgaaatg

SEQ ID NO: 13611 - DNA, 3000 bp, Unknown
  misc_feature (1)..( 3000): cDNA_ID_3031023_gDNA_ID_2214639_Annot_ID_188254 3000 nt of promoter + ATG
ctccatcggatccattaagtattcaaggtttgagatcaaagcttgatgtatatacatccaatgcttttttttctttctttttgtgtgcacaacatccattttgctttcttacttttttttcccatgttggggatttcgtatcattattatctgaataaaactcggatactgcaaactaatttttttttaatttttttttttgcacttcactgtgctctttgtttttttaatgttgttaatttaatttggtttatggattatgcctttgttataattattatctctactgcgtttgtctaataccatatctccaccaaatttactaagcagtactttcctatcatcacaaatacatttctctttcatttgccgctagaaataagatttggtacattaataaatgtaattgttatcaagttttcaattcaagtaattttagtcaccactcacatttccattgtgtgtttaaagattggagggttcagagttaatccggtattgtaatatactttataaaccagtactacttctcctccatgatcggcataaagcaaacgtctcgaggtatgtcatttcacggagagatgatgaaatagtttcagaagtacagctgccagtgattagtgaagtatatatagagactcctaagcctagtcaaagggaagagatctaacacaaaaaatcagaaagtatctaggtgtaagagttctctattcctcagaagaacttgaaggtttcatcgacaacaaatttcaagaagagcaaacatgagcggaagttcaaaggaaagtgtcatcattgtagcaagattggacacaaagctgatgtttgcaagagcaaagccaaggatatcaagagccagacaaacctaactgaagaagatatggttgcagtggtcactgaaaatataacatagtggaagacaaccaagtggagtggtactaggacatcggtgcaaccgcacacatctactctgataggaccatgttctccacctatgtgaagaacaagtaaacccttcatgggtaacacggcgatgttgaagattgaagctgacttcaggacgtgagcttattctgtaaaacgtgaagcatgtacctgacatgcagaagaatctcatctctggaacagtgctaagcaacaatggctttaccgttaactttgagtctgataaggtagtgattaagaaacatggggtgtatctgagaaagggttttgttaaggctggactggtcaaaatgtctgtaatgacagcaggaatctggattagcccagaacatgtgtgtgtgtggggggggggggggaagctttgcttaccactaactacatcctcaacaggataccacataaagtgactacaaagtcaccacatgaactttagaaaggcacagtaccttcgtacaaatacctaaaagtgtgggggtgcctagcaaaagtggttgtaccacctcccaaaaaggtcacaatctacctatacatttttgcagccattttgtgaaataaatcttgtagttgagacttatttacaatgactgccactagattttaattatttttttttaattaatggtttgaattttttatagcaattaattgggtaacaaacaaaaaatattcgaaatatatggcaatcccatatgtcacgcaaaatacaataaattatctttttcttatctcacctacgatattcactaaatcttaaaacatccaaaatttgaactatttgaattaactgtattaatttttggcaataaattaaaacaaacattgtaaaacaaaccaaaatacatttgcgaacccgtaaaatgagcaaacccaattacatgtgcacctaaaaacattccttatcttggtttgaatattccatggaattcaaaattccataacttttttggcataaaatcacaatcacaactaattccatatacacgatcttaacctcaaaatggtgcacaatcaaatcaaatcttcaaacaaaggaatatcctcaaaattccagctcttaacttactctcatatacattattaatatttaaacttataaataaaaaaaagatatcatgagaaatatagcgggacgtgtttgaattgatataaaatatagcggaacgggttcggattgatataacacaagttaaatttttattttattattttatcataaccaatttttttagttataacattaatataaaattatataattttaatactatattaaaaatagtaaaatttaatattattatatatatgaataaaatatttgttccgtggtgtaccacgggttaaattctagttgggcttaagaccgtagactgtatcttcatcggatatgcgcacaacagtagtgcttatcgatttttggtgtataaatcaggtattccaaatatccatgaaaatacagttatggaatcaacaaattcatcgtttttaaagatgttttcctttataaaaaagatcaaaaacgaacttctgaacaacgagatgcagcaacctcggaagctgaagacaatactttgggtactattactgttgaagaaacagaacaggaacttgaagaacatcctaggcggatcaaaagagcttgaaagagaaatctttatgtgatgatttcttgatggcgtttttagctgaaaacgtaccaaaacctattcagaagcaatgtctacccttgatgcaccttattggaaggaagcagtcaatactgaaatagactctattttgcaacatcatacttacgagatagcatatctaccccaaggctctaaaccattggggaagaaataaaattttcacaataaaaaagaaaacgaatggtgatattgataggtacaaggctaggcttggggtacaaggatttcgacaaaaaaaaaggtttagatttctttgatacctattctccggtaacgagaatatcttcaatcaagatgctcataggcattgcagccttactagatcttgaaatccatcaaacggatgtaaaaacaacctttttaaatg

SEQ ID NO: 13612 - DNA, 3000 bp, Unknown; identical to SEQ ID NO: 13607
  misc_feature (1)..( 3000): cDNA_ID_3031035_gDNA_ID_2214639_Annot_ID_188249 3000 nt of promoter + ATG

SEQ ID NO: 13613 - DNA, 3000 bp, Unknown
  misc_feature (1)..( 3000): cDNA_ID_3031051_gDNA_ID_2214639_Annot_ID_188243 3000 nt of promoter + ATG
ccgccatccgcaacctatcctttgatctagccggttccatctccattagcttggtttttacgtcttcacgtctaattaccccggttttgaagtacctgttggcgaagttcatattaccagcactctaataattagctggataggccttgcagttgaaaccagagatcaaagcatgctccctaataccatagcggatgggaactccattaacaacgaaccaaacctccttcttcttctcaatagatgtcgttcgaagaaaaagcatccacatcctcattaacttgtgggtatatccggaaggtaggtgatagatgtgcttgaaactcggatgctccataaaataattattttcaacattcgttagaggatgttccaagtcagcgaaggtcttcaacacctccgagatataacacctcgttgctaacttcatcttcttggtatactccgacgccgggaagtacataccaagtggctgcattgccatcgcttcctccatatcctgaaagaaacaaacattcattcatatatcactcaattgtaaatagtatgccacattattactctgtatttccaaaaagtattccccgaaattaccagtattacacaaatcgtactattcatatatcactcaattgtaaatagtactgccacattattactctgtatttccaaaaagtattccccgtaattaccagtattacacaaatcctactgttcatatttcactcaattgtaaatagtactgccacattattactctgtatttcctacaagtattccccgtaattaccagtataacacagatactcctattttactatatagtatttctcaaagttactagtactaactactgataaatcacaattgtagtattactctaaggtattacccacatccgccaatattacctaaatatcaacatagcatttcccaatgttactagtactgtccacagttcacaattgcattattacccaattagatcggtattacgaaatggaatacttaccacatttgcgatgtcctcgtctatggtcctctcctccacgggtttttccactatcacgtcctcgtctctctcgtcctcgtctccctcatcctccacggacttttccacattgacgtcctcgtcgctcgcggagctcctctcctcctcctcctcgataacggctaggccgtcatcttgtctctccgcctcttccacgggattagcacacgcgagttctttgtttgtctccgtctcctctgaatcggaatcggagcccaaggtttggctactactccctgattattcttcttcacttccttcttctttttcattttcatcttccacctcatcagtttgcatattctcttgagtttcttcagccggaatatgcttcagagcatcataaaacgtagaatcatcaagcatcgggctctccgtcgttggagccgtcgttggagccgttgtcgttagagccgctgtcgttggagccgcattggttgccatcgccgtcgcaatcgtttgtgccgtcgcagtcgtcttcgccggcgcctgaaccttcgctttcttcgccggcgcctgaaccttctctttcttcgccggcgcctgaaccttcgctttcttcgccggcaccttctccttcactttctccgccggcgccttaactttctctgtcttcgtcggcgccggcgcttctatctcctttcttttcccttgacctcctccacgcgtcttaggcggcatgactgatttcgaatcggaaatagaacggaaatactggtgaaagcaagaagaacgctcgattgaatttaaagaaatagggaatgttgtggttaatttcagcggttactaaggagaagaagtcaaaaaatcgaaaacggttgtaatgagaacaagaaacaatttcgaattggaaaatccctggaaatattaaggttttttttatttgattttcaaataaagagtaaaagtggttcgggtggtttggttcggaaacgaaccatgatttttctggtaattaataggttcggataaggatatactagtaatatccatctatttcgaattaagaaaaaataaataaattatttctgttttttacaatgattttttggcttcctctttgcaaaaaggactgccagacgatttttcgattttggaagaccgtggagatcaaaacagtctcttttgtctactcagtcccctcttgatctggtacgtttacatctgcaatctcctcatctctttaacccattttcatctcttcccttagagtttcaatcatcgaacaaaattattctgatttggtcattgatttgcttaaagaatgatctttctagttcaaagccaagttttttcagtacccatctcgatatctctttgtcccttgttgcaaaaatgtcgaatctttcatatgtctcatgttgagtaaaagctgcatacaaagtgttcgtaaaaatgccgcaacgaaagttacttgacattccagatcagattattatttttacatatagtatgcctatagaattatttcttgaaaatttgggcatgtcaataaattcttgttgcatagcgcattagcagattctaagtatagcacagtaagtaagttgcaatttggtttgcatatcgatttagttttagtatggtcagcttcttattaggattatcaaggaacttaggacttgcggtctatgtggtgaagcttctgtgatgatctctgaagtgtttttgttgaggacattatgagagagagaggtatagtctccaccatgtccaggataggtgtgttcttgtaatagggcttctggtaaaagaaaaagagagacttttccacatgagcttaaatctgtcgcattttactttctgtgattgaactttatatgcaaaactgtccattaaaagttaatttctgcttgatgcttgtgttggagtagggcttatggttccagtttggctaaactgtgtttttctttatctttggcatagaaagaagatccctgtttctggtt

SEQ ID NO: 13614 - DNA, 3000 bp, Unknown
  misc_feature (1)..( 3000): cDNA_ID_1665243_gDNA_ID_2214639_Annot_ID_188236 3000 nt of promoter + ATG
accaactctagacaattgctcgagcaattgctccggctcgggcggtttagagatctcctccacaaccaaaacacttttccgattattttttgcggatgttacataaacaaagacatcctcatcatcacaaacgttcatttcttcctctactccgaacaaccgtggattgtacctcatatgcaattttaccttatttgcatctaatccaagcttcgtcattatcctatcttctaacattgagaaagtaatcttctcccctaatgtcttcatcatcacattatacatgcgaccttggaatttaaaatatatgatcacgttctctttcattgtaacctgccaaaacaatacacatactcagtcaatattactagtattaccgattctagtacattttcagtaatactagtactaattctgaaatattacatgtgtgagtaatactattacatatatgaaatactacgtgtctaagtaatactggtgctattaaaacatattatctatataaataacggtactactatagctagttcgaccagtattattttcgcgacaagaacaaatattcgatttgagttcaatttagtatgaatcagcatgtgaaatcaattgcttacccattaacagaccaaatgaagcctaaatctatacttaaacttctaatgtaggtgctaaaacacaataacccaaatctaattggattgaatctcaaaatcttcaaaatatgtaattcaaagcttttgaagctctctccatacctggacttagtagattgatgcagcttgcaggaggagaaaaacgacaatgcggctcgccggagctcgccggaggaagaagcccgaagaagaaaacgagctcgcgctcgaggttcgtttttttttttgttttcagtttttgttttttttttcaaaatgttttcagaatattaattattcattcaaaataaaatataggggtaaattcgtcttaacacaattcattaactcaaagttgatatgaagactctaaagtggttttgcagattatttgttccacaaaggggacacaagagatgatcactctccaaaatcgctaatcttcagaaataaaaaacaattagtttccttctgaaataacttcggttatactttggttaaccgaaccgaaccgaaaattgtgaagaaccgaaattactcatgagagatgagttaggttttgtgaaatggtctggaaccaaaccaagtcacactctctcagtctcacctagtctagaaagaaaccgaagtagcaacactcacgtgggcgaagtttttgtgtggacaaacaacaatattggatatgcagacgtttgcttcggaagtgtttgtttcatgcttgcccatttttgccttcaaaagatgacaattaacacaaccaaaaataaacaatatgacaatggaagtagttgaacaaagatgccgatacatacgcccccattttattttgtcatttttagataaccatcttctttttgttatctataacacaattatcaattagttaggacttatgagtcataattagtactttttcatcaaaatttagtcttatctttcccaaaaaaatctaaatttagtcttaattattaagggcatcttcaaccctactatattttagagtaaaaattctaaattattctccaaccctactctatattaaactttaaaatagagatttatctataattgctctctatatatagagtaactctattctttattctattttagagttgaatttttttatttatactttgatccacaaatttaaactttttatttaatacttattatcatttcacgaacaacaattacaacatatagttttataaaaattaacaagcaaagaaatactaaaattaaaataaacaacataagaaaactaaaacataaaactagtaatttaatattctggtaaattggttgtagatccgccaagataattaaaatattgtccaaatgaagtagatggaggaagagtttcttgatcttgatattgttgttggacacatcatttttgtaaaatctgtgcttgttcagtctcaaaatatgttcgaacatttgggttttgaaagaaattcaaatcataaaatattttttttttcttcttttatttgatcatatgtgggaaaaatactctaatggtgttgtttaaaataaaatttgtaatgttttattattgtcatatgatgtaatgttttttatatataattagtgtttaatttaaataatatcatattgtatgagaattttgcaaaactataatatatatgatcaaattgtaaattatataattaaaaagtactagtatataaaatataaatataatattgttaagaatattcttttttatagtagaaaatagaaaaatacattagaattaccctattttatagtaagatatagagctacaaattggagatggtctaacccaacaaaattagtgttactttagtagttctttatttatttcacatggctaattattttcttatagttcattaaagagtactttattttgttaaactttaattaaagagtactttatttttgtaattaatatatatgaactggaaaataattagccataaagatcatatgatccaatctatgccattaaaatgctctgacaggttccgacttgtttctcttgtcaacgcccaaattcgactttttttttgtttcccttaacaaaccaaatttcactgtttcattcttttacgcgtcgagagtctcctccatgagaagcaaattctcagcttcttccgatgatctagcttcacttagatctcatgtaagtttgtttatctcccgatctgattttctgtctctctaacgttgttgttgattgatcatgagattttgcatttacccaattcgtttcaggaactgatttggcgagtttgatgataaagtttgtatttttctttgtgggttgatttcaaattgtgagaaagattcaagattttttgtcgtctcaatg

SEQ ID NO: 13615 - DNA, 3000 bp, Unknown
  misc_feature (1)..( 3000): cDNA_ID_2713874_gDNA_ID_2214639_Annot_ID_136205 3000 nt of promoter + ATG
actactgaacagaaaacaaatgcattttggagcttttaattggatacgtgaagcttggtcatggagcaaacgttttgaagaagttattttcagttggacgccgagaacgaacaaccaaccggctgatatgcttgcaaaatctcatctgccacaagacacttcctttatttatcattactttgtaccaaattttatcacaaacgccctacactgtaatcactattaatcatatcaattgaaagaaattgttaaaaaaaaaaaacctggggaaataaaccaaaccgaacttacggaaccgaaaccgaagaattaaaccgaatcgaaccgaaccgaaaatttgaaataaccgaatggatagtaaattctataaccgaaagaaccgaaaccgaatcggtaccaaattgaattatttcgggtaatcaaaaatatcggaaatataattatatttttaaaatattagttatttttatactaaataattaaaatacttgaaaatatatataaaataataaaaatacttaaaaataactgaaatatcgaaaaatatacaaagcaaaataatcgaatggatactaaatatttaaaccgaaagaaccggaaccgaaccaacatttcaaaataaccgaatggattaaacattagaaccaaaagaatcgataacctaatagaaaccaaaaccgaatgaataacctaacgcccataactacttatatctctctctcgtctcgccgtttttttcccaaaatcggttatttttgttttcttttatcccaaattcgaaataacggttaaccgaaataaccaatcggttcagtgcgaagaataaatctgagaatgtttggcacaaaagagaagacttttgatctgtggagattgcagtgagaataagtaatgataatggatataaaatttgattagtgtagaacttggatgagatattgtcgatcataatatttgaatatatatttttgaattcatatattgagaatacatatgccatgaaatattatatagtgaggactagaaataggagaactatcttgatgagaactagccaggaggcctagacaacaacactcaactccaccatcccaacttttcagacatttcccttcttcatatccttcatgtaagcatgttgcattgcattctggtgtgctataacatttcatctcacactgtttgattcctctgaattgccctatttgattcatatatcaacagtaaaaaaatagtcaatagaacatttaaagatttttattgcccccacataattttttttcttcttctttgcatctactatttactatttagactcaagtggatttccaccaaaaaaaagactcaagtggcaaaactatcattttcttaagataatctatgaaaaaaatgagataattacttataaacagataaattttttacctgaaatcatgggaatatagatgaaagtcaacatcatcaatgaaagtattataagagatgacatttttgtgatggccattagatgtttcttgagaatacaccaagttttttttatcggaaaatatagttagattcaaaagaaagaaaaacctagaaaaagtaatcaaaatcagtgttaagaatccgtaataagaggacatctcttgtcttctttaaaaaaaatattcaacatttttttatgaagtttaatattatatttaggatttacctttctttttggtcaaaatattgatgatttaccttttggttttataatatttctattattcattttaatggttttgactagaattgaataaattaacatcatatgaaccattcaaactcactttaatagatcttccataacatgaaagaatttatcaataatcttccatgatatatttttttaatatatcttccatattaatatattatatagtaaataatatttagcaaatattttatttaatagttttttacatgataattttagtcatatggtttcatcatctagttgcgttccccctttggtattatgtttttttttttaaagtagaattccgcaaataccgattttatgataccgctgtttttggtctatttaaaaaaaaaatacaaaataagatatcttaaaaatggtgtttgtcaaataaaacattgtttataccgcatttataaacagtcttaaaaagttttttaattaaagtgttaataaagtatcatagatttttgaacaacttttccctttataatatttttgaaatatgatatcaaaaaaatgctgtttgtcaaatataattttgttttgtttcattaagtataatcatatgtcagtttggtacaaaaccaaatcaaattggagacaaaagaccgaaacaatttcggttctaacaaaaaccagatttgaattttggtacacaaccaaatcaaatggaaacaaaatacttggtataaaaccagaattttggtttggtataaaaattggaaacaatagaccgaaacaatttcggttctaataaaaaaccagaatcgagatcactgcaaaccgaaccaatgtaatcctcttcggttccaatttttaaagtcaccgtgctttttcgtcattgtctgagaggaagaactgttccgttgacggagcttgatggcccaaccaccgaatcgtcatttctcaatagaaaaaccctttctttgtgattgcttcgttccacgaaattgtaagccaaaggaacattcatcgatccataatcaatatgcacttgcttctaacctcgttgacttcttcttcttcaacctttttgttactcgattaccaattcattgcctggaaattcttgaatcctatcaaagtcttctcctttgatttgtataataaacctaaagtgtctcacagatacgataactcagtttcctcttaaggtctttcttctctcttactaacatttacttttgggttctgttttgattgattgaagcgacatgggtttgacaaaaaactttgcttttcttgtgttttgttgtcaaagatactgtagc

SEQ ID NO: 13616 - DNA, 3000 bp, Unknown
  misc_feature (1)..( 3000): cDNA_ID_3031023_gDNA_ID_2214639_Annot_ID_136208 3000 nt of promoter + ATG
aaattactccaatatggtacattttgttatgtttatatactcattttggggagcaatacagatatcataaatcaaactaaaaacatgctcaaaagatattttgaaatgaaagacttggatctagcaaatgttattttggttataaaaatcatatgaactgatgaaggccttaccttgtctcaaacccactatgctgagaagatacttgatcgtttcaagcattcctcaaatgggattgcaaaaactcgagtagatcctcaacttcacttgaccaaaaactcgggtgaacctatgcaacaagtagaatatgcaagagtaattggcaatttaatgtacttgacaaacagtacaagaccggatctaggcactctgtaaatgtacttagtcgctacacaagcaatccagaacataagcattggaaggctataactagatttttgaactacctacgttataccaaagatcatggcttacattattgtaaagaacccgcagttttggaaggttacagtgatgccaactggatcgcagatttcaaaaactttaaatccacaagtggatacatctttacacttggaggtgtagcagtatcttggagatcttgcaaacaaactgtgttagccaaatcaactatggaatctgaattcatagcgttcgatacaactatagcggaagacgaatggctcaataatttcttagaagacatcccaatgtgggggaaacctgtgcccacaatacgtgtgcactttgatagccaattagctataggcagggcacaaagtaccctatataatcgtaaatcttgtcacatcagacgacgacataaaactatttgacaacttatctcaacttgagtaatcacgatcgattacatcaagtcagctgacaacctagcggatccatttacaaaaggtttgaatcgagatcaagtttcaagatcatcaagaggaatgggtttaaagcctaccacctaagaggaagtttgatggtaaccccacctacaaagattggagatcccatgacacaagttcaaagagacaactaaatcaaactaaatttgttaaagcactgagagactgttgtctctttctagttcctaaaatgatgtatagtgcttcgtgtatgtgtaaaggaaaaagcattgcttttaaagatttgaacctagctttgtaagatttgtgaagtacttacaagatacttctttaaaatacaagcaattagaaaatcatcttgtgagtgtgaaatggggccgtttctagtagaatatgtgaggctatactctccaagttcactcatgattaaaaaggcatgttcaaggccacagtgaacacaaatagagaacctcgttctaagagaaaatgaagttgtgttatacatgttgtctaagtttgcattaaactctggatggttcaagacatcatgttcaccataaggccgagtaaactcgataggtactaacaatgagtaggttcaaagctgaaaaacaccaccaactcagacacagttagttttcgtgtatactctcgaaggtctatctagtctagctagttggattagtccatatgattagtaaattcgtcatatgtttagacttatttctattcatgtgtgggattgttggaaatttttgacataatatttttccgatgactttccggccaaacggctgaacggaattgttgggtcgttagtgcattggaaagctggtaaagagtactacaaggtggtatactcatacgtcaaaaatgaagttgtattgaatgagaaataaaggtgtaaagtgggaaactttggccaaaccaaaccgaactgaaccgggcatgtgtcgggctgcggattgtagggttgtcacgacgctaacttgaaggctatcgggcttgtggaccgtcatgcgtgtgagttattctgcttgttgagttgaatcttatggaaatattcaatattctcaaaatatgtcatattctcaaaatatgtcatattctcaaaatatagtatattctaaaaatatgcaatatcttgagaatattctcgaaatatgccatattctaaaaatatgccatatcctgagaatattctctaaaaatcctatctccctctactatataaagaaacatagcctctcattatttttcaagatcggaaacacaaaacactctaagttctaaagtctatgctctctcttgcttcttaaaagtaagttcttagtttagtagtttcgagattatatcgtagatcaagtttgcttgagtctaatactcgtgtgctcgggtattagtttgtgatcggatgtatcctgacattcataaatcgtgattatccaaaaagcagttacggtcgatttattgaattaaagaaaaatatatcatatcttttctccgtgttttactttttgtctttatttactgttgttctaatttattattgttatcgttgtttcaaataaatttgtacttgtttctcaattcggtttttgagctcttacaatctcaattcaataaaaagtcagtttttagcttattgctctagacggattgagaattttttgaatttattttaaaaaaaattctaaatcttctaaaaatagttttgctattatctttgggtgcttacgcggaaggtgtatcgaagaacgtttttacttctttctttctcctctttctaactgatttgcaaatgctacgtagcgattgttgtggacagtgtcttatacaaacatctctagtttccacgaacgctcatagttgagtgagtttgtgaaacgtgaaacaagtttctgcaaacgcttcttaagctagtttgcaaaactaattcggtgtaatttagttacctgaattttttggttaatatactaattagatcagtttttccgtgaacaaaaggactgggatcaacaccaacagcgaggtcgttgacacccccacagttcttgagactccagatgagatagctttgcatcttgcgaaagaacttgaaaagacacagatcgacgattctggtatg

SEQ ID NO: 13617 - DNA, 3000 bp, Unknown; identical to SEQ ID NO: 13610
  misc_feature (1)..( 3000): cDNA_ID_2703519_gDNA_ID_2214639_Annot_ID_136214 3000 nt of promoter + ATG

SEQ ID NO: 13618 - DNA, 3000 bp, Unknown; identical to SEQ ID NO: 13608
  misc_feature (1)..( 3000): cDNA_ID_3594295_gDNA_ID_2214639_Annot_ID_136217 3000 nt of promoter + ATG

SEQ ID NO: 13619 - DNA, 3000 bp, Unknown
  misc_feature (1)..( 3000): cDNA_ID_2703558_gDNA_ID_2214640_Annot_ID_136218 3000 nt of promoter + ATG
tgaagacggatgtggtgatactccctgcaaatttaacaatacttttgaaatttttacaaatctatcgacttattaaatcaataaactcaatctaaatccaattcccattaacatttcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctgcaaatttaacaatacttttgaaatttttacaaatctatcgacttattaaatcaataaacttaatctaaatccaattcccattaacatctcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctacaaatttaacaagacttttgaaatttttacaaatctatcgacttattaaatcaatcaactcaatctaaatccaattcccattaagacctctaaatatgattgtagataccattgtagaattacctgtcataaatgtggtagaagcattaccgaacctttgaaaatgtaaaggtggaagatatgactaaaccatcatgacaagcgtctggatttttggaatctaggattttttgaacatatagtgtggtgattttttggggagaagagatcattgttgatgtatgttgcctgagttatggccgcgacgaaaaaatagactgaaatgtgtgaaaagatggtataaatatctttacctaggtttctaggttttgattactgggcatgtgaaatgggttttaataaatgggcttgggcttgtaaaattgtggaattaagctattgtaatcacgcatatgagttatctaattggataacttattagattgtaataatgagggaaaaaaaaagattattataatgagaggtccacatttaaaatgatgtgacactcttagcaaataaatataacatggcaaaatttagaagtgttgtcaaaaaacgataagcgtaaaatggaaattgtgactgaaccaccataagaagcgtctggatttttggagtccgagagatttagaaagtggagtgtggttgttttttttagagggggaatgttgttgtttatgccattagagtcatggtggcgtcgaagaacaataagtatatgtgggaatcagagatgtgtgtaagagaaacaaaaatttatttggttgggttttgaattttcaagaaaatgttaaattatttcatcgagtttctttttttttctctatgttaggaaatggtatggtcaaaatctattgatgatggtgatgcctaacattaacaaaaccaatagaagggagacaagagacataagacatcttcttgaaattcatcaacattacaaacttactaaaactcctcctcccaatcccaaatgaatatgtacttcttaaagccacgtgtctttctctttttcattaatatttatttatttttttaaaatgtgaaattatttctttggtttaatatctctggatcattcttctacaatgatcacaagtatttagatcatgtgtaaatagtcccatcatgaagttttaattaccaatcggtattgcacatcaccgattggtactgatccacctgcacttttgtcgatcttttgggacaacgaaaaagaaactaatttaatatattttgttatccgctcgaagatattaattataagctttaatttggaacttctttatatcaattatatatatatataacttctttgttaatagaaaatgggaacgatccaaaacttaagacatttgatctccacaaggccgtcgacgtacagagaagaagaatggccaaaaataagtaaataaaagagaagaaaccgaggggaagatgattttgcattgccacgacccacgagcatccatcggccatcgcctttttggattcacatggcaaagacaaacttcgatcttccttttttctcgtgaagttattatctctctaatttctagtctggtcgaacctatatttcatcatatatatcattatttaattcatatgctgatgcatgggacattatcatgttaagtcattacaaaaaaataaaaataaaaataacttacgttggactctcagtttaccttctcctatggatttcacttccttgtataagaatatacatcttactcaaatcatgatttatatgcaattttcttttgtgagattttttttacatataaaccagaaatgttgaaagaagaatatccaaacacaacaaaataatagaagaaatctcacgtagaacatggaaatggaaaaagaagtgaactcgtgaaccgatatatttaccaaaagtgcacacatagacaagtctttctcattaaagcccaatttcacactttcacattttcgtgacgtcttttgaagttttgaatacgaattaatgttcatgtacgctataaagacctaaaaggttgtcatatttctccactttcatcttctcttcacaactatcctaaaccttttttccttttcttcttcttcactctctttcttcccggcgtcactatggcggctgccgccgggtaaaggcagcgaactcgaccacatcaagaatgaatccgttgatctggtatatatatttacgtcttcttagttttctattatctatatgttttaaaaaatctttggccctactaattttaaattttctgttacataaaagatacatatatgtatagtacgtaactagtaactactttgatctaatcagttaatatatttgtcccatgcgatttactcatgtttccattagaaatgattagtcaaaattatataaatgatgggtctaggtacgaataccc

SEQ ID NO: 13620 - DNA, 3000 bp, Unknown
  misc_feature (1)..( 3000): cDNA_ID_2703554_gDNA_ID_2214640_Annot_ID_136223 3000 nt of promoter + ATG
tattaaaaaattaatcattatctcatagatattaatacatttaccaataatttatctcgtggaggttacattgacttctacaaactattcaaatcgataactctaattcgctaagtaatccccaaatcttttctcagtatctttggcataaataaagccaaatcttctcgagtgaatagcaataattatacatcatggcttatatattgtatttttctgataacaaatgtgcattatttctatcatccactaactaataattaaaaattcaatattgaccgtactattataaaaaaaaaaaacaatggttggaagtttgaaatacgtaaacaacaaaaaaacaaaaaaaaataaaacttcgttcgttagtaccgtatgaattcatagatacaacatatacaaaataagtattttacccaacatgtgtcttctttcactggtttgatctcattcgttttgcatgggctaacaaaacaattatttcaaatacgcgaagattattatttctatgcgaccattttatagaaaagataatttagataagatataaaggagacatttttagaggagataacattgaaatatatagtataatatatttttagagattcataaattataaatttagaaaaggacattaaaatttgatatagaaaaggaatttaaaagtaagtaaaagtttacaaaatcagaaatgaaaaaataaaatgcttttaaaaaaaatgtagacgtgcacgacaatcatatatattagtcggttaggtcaacgattcccatgtcgctaatttataatgcattccgttgacaaatatttaaaaatgtttcaattatacatcttgaggtctgtttttgcacacataacacgtcatatatcattgacaaagaaaacacgtcgtaattttctttttctttttctttcatgtagtcttcttggcttaaaagaattcagctaagtaagtatggttgatattttcttctacaagtgataaaactttggaatttttgaataagtataattacaagaaaacactgcatataacaactacaagaaaacactgcatataccaaaattatcgaaacatgtatattccgacaaactgaaatcaccggaaaacggtggtgtattgaaacaaagagttgttttaactgaagtttgaaagtaaacaaaagattaaaaagtaatttatagtaatgttaatatttactcatgtttctgctttggtgattagtaataaatcttctaaaatctatatgccattttataaatgcgattaaaaatttaccaattaaaccttatttagaaaaatgtagagaaaacttcaaattatctcctcaagtaggattagatcgagctgcaaattggctctttttattcatttaatttcctccattcctaactgtattggtattgtttactttatttctataagcaacaaaaaaaaaagaatcttgtggacaggtgacaatttatgagtcagccagaattgccacgtgtcggaagatcagttgccgtggtaaaaggtgttttttagattctcaaaaaaaaagtagttaaagagaataatatcaaagagtcaactccacagttcacagatccaccgttggatctaacttttggattatcaacggcccagataatagttaaccggaatcactcggttaccgaggtagtcaatagttctgtgttttaaaaagaaatgcgtccatgtgatcacttttattttatttgtagtcagcttttgttttcctactttgtcgtttttctttatcgctgttctcaactaaagacttgtagactatactaataagatatagtcaacgattgtcgctgttattatagcctttaatctctattaatgattgttaattgttccacaatctgtgtagattaattaggtaaaattaaaagtcaagaaaagattgttttcaatttactagttttccagtcaagacgttttctagaaggctatgaggtaagaaaaaaaaaatatatattaggtgcaaagttaatatgggagtcaaatattattttcaaataattattattgtcaatgcactgcaaaattagtaataattctagaaagaaattgaaataataaaaatatgctgcaaacacgagtttggtatgtgtgcaccatataatattgacaagttgtagtgttggttgaagctaaaaataacacaaaaacataaaaagaacatgaataacgcctaaaacttaacacgaataaaataaaaaaacataaaatatattatcaaaagtcaaaatcacaaaagaaattaataccattttacaattagctgaaaatttattctatcaaaatccagtcctattaaagaaaaatatgtgatttgagatgaaattaatattacatattttgatttggttcaagaataaattatggattttggttaaagaccttctaatattccaaagaaacaaaaaaaaatcagcccaattgttcatacaaataaaaacaattcattacctttaattttaaatttattgacttgaacttgaagacataagatacctaataaaagaaaaaatagatatgagactttaaaaaagctttatgattttctttagacaccatcctttaatgttttttatttgactttttgtttctttgaaattcctttaccaccattttccccaaattcaagtttacgcacaatgattcctttattttaaagacacgattataaattcttgctttgcacaaaagaagaccctacatatctcacaactcaaggagaccaaactttgattactttattccatagaaatcttcaactcaatctcagccgttagatctaaagcaccgatttgactaaactccatcttaaacctactcaaccggtcactcggtcacacccataaccccatatatcacgccaacgccattcttttttcttccagtttcgctctctcattcatcaaaaaaaacttgcacatcttctcagatcttcaagtttctcctctggtttctcatcatg

SEQ ID NO: 13621 - DNA, 3000 bp, Unknown
  misc_feature (1)..( 3000): cDNA_ID_2713894_gDNA_ID_2214640_Annot_ID_136226 3000 nt of promoter + ATG
taaagaaaaacaatcaaactctaataacaattttaagaaaaagatgaatcatgtggcctccgtgtctaggtcccagactaatccgtgggtccaccacggataaggcactggggccgaagtttaagaatccaagtggccacacaggttatgaatcaagatttgaataaatatacctgaggaagaggcaaacaagcgatgaggtcaacgatgaaatctgatctcaagtatcttctagcaatcaacttaggatctttcacaagttctccacgaccaaacactctagaagtacgagaaacataagctgttctgaatttgatcacaatgtgcaaaacatagaacaaatctgctaatgttctgaagaaagtgataacaattccaagcttcaaatctgtagtcatacaagaagatcgtccaatacgtttgactgaagaaagaaagaagaacaaagggtcgacgtaaagtgcaacgagacaccagaagaggaaaactctgttccattgaagcactgcatcaccaccaggatctagaatcttgtctctttcgatctcgaaattctctggaaacactttgaatctaccaaatcttgggattttcaaacgtgttttgctcttctttgggagtacttcttgtttcataaatggagccgttgttgatttgaacaatggtactcgcttctctcctacttctatggtttgtttctcgtctccatagaatctgtcacacccatcaaccaaccaaaaaaaaaaatagagtttgtgtttaaaaaataagatcaagaaacgaatcattccaaaaagaatgtactaatgcaatgtataacgatcataactttattgggatcgtaaatgcaaaaagccaactttattttccatcattgagagaacccaaaaatgaatgttctaaagaagatgaaaaatctagaacctgacagtattgtctctcttgaactccattgtttgtagcaataaaaactttaagctaaaacaagaatagattgttcttcttgtttaggcaatgagaaacgaatcagagcatgagaagatattattcatgttcagaaaatggcagagacagagagagagatgggtttgactttacgtgaaacaacaaaagatgaagagagagagagaataagtagaaacagctaatgtaatgcagctaagagagggtaaaaacgagtgaaagagtaatactaacaaaacttttgttgttgttgttgttgtttttattttaatgttctcttggaaattgtaaagaaagagagacagagaagagaacgtgggttccattaaagccaaatttgtatataaaatttttgttttgaaggagatgatgatgatgatgatgactctttctctctcgagtctcatactatctcccgtgtgttgcgtacaagattctgtattttacatttttatatatgacttgtggaagtatataatatgtctacatttaataccatcacaaacttacaaaaagaaaaactcttatactgtattctatatattgagtaaaaaaagttatcaattagaattgagaaaatactaatgtttaaaatttcgctagacgctaatcggacggttgaatagtatctaatatccaataaattaagcagaagtaatattatttaggtaatgtgggagtttctcactaaaactagatagtcttaattgtttgtaaagttgtgtcttggagcaagggttgtttgcattagtccggtcggtgaagttttcttggctagactgctaggatgaggaatcaagtgctggacgtattgaaacattatccggacatgataaagacaataacaaaattgcaattgaacttcgtaatcatgaataagtttgttacatttgcttaaattaattaacatgtcttttcttttagttacatatgagtatattaatttatgagaaatctgtgaaaaaaaataaaatgacttctcaaatttttacccctaacaattctgatggactgtatctttatagttgatgttttagaagaaaataaaatgtttcaaattagatgatgatttcaattttaatactaaattaattatttttgactatttatatcatagaattattttattattggttgatttgtgtctaaatagattatcaatgtttctttaatttagaaaaaaaaaaaaaaatctaaacatcaactataaaaatacggaggaagtatattggatggtttgctcttgtgttattaattttagagatgttcgtgtaatcatctctcttgtggccttgtgggatcagtttgcggaaaatgtgtacaatttcacacacacacacacaacaaaaccccaaacggtactcctatatataatcgagtgtttcagtgccaaaatcagctgttttatggttgaacaaaataatttcatcgtactttatagatttgtgattaaaagacacatccccacgcccaatttcttgaagtgggccatttcaagtctttttattttgtaagacaaatatgccaccattcaattctactcttattaaaatttattttttgctaaataaaatatgtaataaaagtataatataatacttacaatgtgatgcccactctgttatttcagactcattaggcttgcatgctattcttgagaacgatcaaatagcaagattaaatgacttgaacaggacgaacaccactatcacatcaaagagagtacgatgactgtggaaactaaaaatgttcattattttgaatacgatcatttgctaactaatagtatatcctctcctattaatgagatattctctcatatcaatcatgttgatgtaaattgattctgattgtatcctctcccattaagatgattgatatgagagaatatctcattaataggaggggatacgctattacaaaccatatcgttatcgctaaacttttctaactcgagttttattttaataatgcgtattaatgtacaagttgttccactcaactcccaagtactccttcctagtgtggctcgcaatg

SEQ ID NO: 13622 - DNA, 710 bp, Unknown
  misc_feature (1)..( 710): cDNA_ID_3031070_gDNA_ID_2214640_Annot_ID_188304 3000 nt of promoter + ATG
cgctagagaagtggaagagtttacgatctcacatatcataaagctcataaaagaagagggaggtttggggttaacatcgatatctgaggcgaataaggtgagttttccacatcaataaaatacagagagccagcggcttcactgaataaagtagaagcctatagtggagcatccacatcatttctggtttgatagatggtcactgctgggtaaactacttgacatcacgggatcacggggcagcagagacttagggatacacatccattcaacagtggaaagtgtgttggcaacatataacgctgaaaccatagagtggattatctgaatgatatggaagaggggatcgattcacaacgtcaaagaggttcattgatcgaggaggatgtggtttgtttgagagattaaggagtcaaattcaagcctaaagtcagttcgaaagctagatagcaattaactctgagacagccaatagaggaatagtataaaggtttatggttcacccacacaacaaacaattactcattcatggcaccaaattagttgtttgagcactggtgcttctgtggcttgttccttttgtctggaaaaccagtggaaacacggaatctttcaaattttaatccatttgaattgggatgatttaactaatgaaaaaaaaacacttaaccgaggccaaaccgaataaaccgacaccccaagagcaaatg

SEQ ID NO: 13623 - DNA, 3000 bp, Unknown
  misc_feature (1)..( 3000): cDNA_ID_3031078_gDNA_ID_2214640_Annot_ID_188301 3000 nt of promoter + ATG
tactaaaccggacgattttgctgaaccagaatctgttactaaaccggacgattttgctgaaccagaatctgttactaaaccggacgattttgctgaaccagtatctgttactaaaccggacgatttcgctgaaccagattctgttattaaaccggtcgttgttactgaatcaaattctgctcttcaaaccgactctgttttcgaaccagactctgattccgacgtggcacctgcttctattgcttccgatttacaaaattcacgagttgattcatctgattcatcgacgccggataagaatcttgcttctggtgatactttggctcaaattgatgattctcctgatattgtctcaactcctaatcgtaataatcagccattgttcgttgttgacagtccgtttgttgaagctacgtctcctcgtcaaagaaagcgtcagattagacagtcggttcgtctgcaggattacgttctttacaatgcaacagtctctccaataaacccccacgctcttcccgattcttcttctcagtcctcgtcaatggtccaaggtacatcttctctctatcctttgtccgattatgtttcggatgactgtttttcagcaggacacaaagcttttcttgctgcgatcactgctaatgacgaacctaaacacttcaaagaggctgttcggattaaagtttggaatgatgcaatgtttaaagaggtcgatgctctcgagattaataagacatgggatatcgttgatttgccaccgggaaaggtagctattggcagtcaatgggtgtataagactaagtataatgctgacgggtccattgaacgatacaaagctcgtcttgttgttcaagggaacaaacaagttgaaggggaagactacaatgaaacttttgcgccagttgtgaaaatgactacggttcgtactcttcttcgccttgttgctgctaaccaatgggaggtttatcaaatggatgttaacaatgcctttcttcatggtgatcttgatgaagaggtctacatgaagctacctcctggttttcgtcattctcatcccgacaaagtttgtcgtcttcgcaagtcattgtatggtttgaaacaagcccctcggtgctggtttaagaagttgtctgatgccctcttacgttttggttttgtgcaaggtcatgaagactactctttcttttcttatacacgtaatggtatagaactccgtgtgttggtatatgtcgacgatctcttgatttgtggtaatgatggttatatgcttcagaaattcaaggagtatttaggacggtgtttctccatgaaagatttggggaagttaaaatacttccttggtattgaagtaagtcggggctctgaaggtatttttttatcacaacgcaagtatgcactggacatcatcaccgacagtggcaaccttggatgtcgcccagctttaaccccgttagaacaaaaccatcacttggccactgatgacggtccgcttctcgccgacgccaaaccctatcgaagacttgttggtcgtttgctttatctccttcatactagacctgaattaagttactctgttcatgtcttatctcagttcatgcaaactcctcgtgaggctcatttagctgcggccatgcgtattgttcgttttttgaaagggtcacctggtcaaggaattttgttaaacgcggacacagaattacaacttgatgtttattgcgattcggattttcagacttgtcctaaaacaaggagatctctaagtgcttatgttgtgttacttggtggttcacccatttcttggaaaactaagaaacaggacactgtctctcactcttccgccgaagctgagtatcgagctatgtcagttgctcttcgagaaattaagtggctacgaaagttgttaaaagaattgggtatcgaacaatatgcgcatgctcgctttatattgtgataataaagctgctattcatattgcagctaatccggttttccatgagcgtaccaagcacatagagtctgattgtcattccgttcgtgatgcagttcgtgacggcattataacaacacatcatgttcgcactaatgaacaattggcggacatatttaccaaggcacttggccgttcccagtttctttatctcatgtccaagttgggcattcaggatcttcacactccaacgtgagggggagtattgtgataaggtcgtatattctcttgatatgtttaaatccctatagtttaggagattgagtttatcacatacaatgactcgcttgtataaatacacatgttttgtgcatcaatgaaatcaagttagttcaatacctaattctacaggaatggtcggcatatctgttgtcaagagatggaactcttgctttgggaaatggttggaaaagcttttgtgaggctaatggcgttaggttaggagagtcttttactttggagttcgttaatgtacaagatacaactccggtacttaagttctcttttcgagagactaaacacaaaaatgttaattagaaatagatgacatgtaaaaattaggcctaggcgtataagtttgtagttggcttattgtaagtttgtagtttgtcccttagttccttaatttcttagggtatatattgcttactgagacatccatattgttccattttggtactttgtgcacgccattgtatctggcaaagttgagaatgtcttcagcataccatacccaaatttgtggattttattggcccaaatctagcccatatgttatatatccaggcccaatttatctgtcaagagatggggaatcttttacgatttggtcggaaaatgaaaacggagcaagacagagagataatcggagattccaattttctgtgttaatttcaacaagcatgcatttatttaccaatttgtgctcaaaatagaaaacaaaacaaaatttggtacgtgaaaagaaaattttcaagggattgtttgtttttttctgttcttcttcatcaatg

SEQ ID NO: 13624 - DNA, 3000 bp, Unknown
  misc_feature (1)..( 3000): cDNA_ID_3031082_gDNA_ID_2214640_Annot_ID_188300 3000 nt of promoter + ATG
atcttcgaatcggtgacattgttgttttcagacaagagagagatatgtctttccacgttacaatgttgggacctagttgttgtgagatccaatatggttcgtgttcagacgaggagagaaacctcggtaagttgtgttctgtctctgactcttcaagaaatgtggtctgagtttggaatatggatcagttagtagagagaaccagtttaactatgtaacacttagtatctattctttttcagagaagaagaagaatccaaatggagaagcaaagtcttcttcactagatccttcttgtttttcggctaatgtggcgccttcgagtctacgttatgacttaatggtattctactcttaaatttgaattccaaattaaactatgaattcatgttgttttataatgaatttttcagctttttccaatgggttttgtgagggaaaatggtgtagtcggatctggaaagattgttctgatgaatgaaaagggcagatcatggaattttaacttgagacaaaagccatcatgcggaacagtttatgttagaggagggtgggtgagtttttgtgatgccaatggacttcaagctggagatatctacactttcaaactgatcaaaagaggaggaactcttgttctacgtttgttacccaaaggggcagagtcttgttcactagatccctcttgttttgtggctaatgttgcgccttcgactctacgctatgacacactggtattcgactcttaatttgaatcccaaaagaaactctcatactagtgtctgaaatatattaaacttattttgtattgttccagtatcttccaaagcgttttatgagggaaaatggtgtagacaaaagacgtggagagatgattctgatgaatgaaaagggcaaatcatggactttagatttgaaactaaagaaatcatgcggaacttccctcatcagacgaggatggagaagtttctgtagtgccaatggactaagagctggaagtatcattactttcaaactgattaagaaaagtggaactcttgttctatgtttgctctccaacgagccagaagaagaagtgtgctcagaagctaatgaagtagagtctctttcgacagatcaagaaagccatgaagagagtagccacaacgagaaaatctcaagaagaaaggaaaagaagggtagaatgatatggaaagcttcgtcttcaccatccgaaaaccgatttgtgacattaaatcttacaccttataacatcctacgttctgcactggttagtttcaaaactccaagccattgtctttttacagtccatcaaatttgaatcttttgtgtgaatctttgtttcagcgtcttccgatacccttcacgaggatgaatggtatcaatgaagaaactaaaatgactctgttggataaacatggtatgaagtggttaacgactctgcggttggtggactacaaaagaaaaagactgggaatggtaggaggctggaaaggattcatccaagctaacggtgtgaaggcaaacgaatccatcatgttggaactgatttgggaagaagaaacaagttgcgtccttaagttctgctccaaggtgaagctagcaatcaaatgaaaatgtatatgagtgtaatattgaaatgaatcaatgtttgactcttttatttggtaagatataactcttaaggtctaattgtactattgtagtatgttttctaagtatgttgtaattgtatgatcattggccttacggtgtgggatttgtgaatgtttgtttagcaaagaaaaggagagttcaactttatcagtttaaattagtgactaaaacattttgtgaagatttttaccgcacaaaataaagataccaacaaaagacataatatgatgagatgtacatatgaggagtgtgatagaataacttaactaatattgaagatgaatgtgaatcaaaagaaaaagttgtaaaaatctcaaaatattatagttatattcttgatacagttgggacaagtcactgatatccaaattataactgtaatagaaattcaatttttttaaggatatatgattttctatttaatttaagttattttcagcgttatatctaaaagaattgttagttacttagtttgtttagaaaaacaaaaatctgaaagaattgttaaaccgattcaagtaggttgataacaatttaccaaagtcgtaactaagtttcttggatgtttaatatcaatatgagttttgtgatattagtaattaacaaaaaaattatcacaaatttgttatctaaaatatattttgattgggctaccaatcatgaagttactttttaattaatgtgtaactagcaacccaaaaacaaatgtatttcgatttctcattattcaggttataaaacaaaacaaaagttgaattttaggagtccaaagcctggtagtactcatacaattttaaccattagacaaaaagaatattattattaatggattgaatctctttttttttttttttttttttgaggtttcaaacacaatcagagtgaattcgattataattcaacaatgtattttacatatgattgccaaaaaaaactactaaccttttctagaaagaacacttatctattgaattgtatatcacacaatgtagtagtatctaataatcattaacattaactttttcataatggaaaaaaatccagaaaaatagtagttggcctgtaataactgtaaattaactaaattacaaagaaaaaaagtaaagacaaaaaacaaatgattaataaataaaaaggaaaataattgtccaaaaataattaattacccaaaaggccccatgtgaacaaagattttaattggcccattctctcattctctctttaactctataaaacacagagcaaagaaaaaacagaggaggttgattctctttggcatctccgaatcgaatctgagaagagaagaggaagaaaaacgaagatcgatgttcgagagggaattagatg

SEQ ID NO: 13625 - DNA, 3000 bp, Unknown
  misc_feature (1)..( 3000): cDNA_ID_3031093_gDNA_ID_2214640_Annot_ID_188296 3000 nt of promoter + ATG
tgttattgcgtgcggaatatagttccaatccagtgtctaacatctgcataactatgtttacgtctccaagaagagcagcaagatgcaaaggtgtgtctccgtacgcgttacgggaagagagaagggaaggtcggagctcaataatcttggcgaccagttctcggtgaccgagctttgcagctacgtgcaaaaccgtgttgttggtgttctgttcctcgcttctctcctccagggaagattctctcgcttccaccaaaccaagaaaagctggaaggtcattttgaaggatggcatcgaagatcggatgcatctttttctcaacaaaactagaacaaaagtaagaaaattcttaaatcttgggagtggttagactacaagggttgttagcatcttgacgttttggcttcttggtctttctttttcatttaacactggttgttgttgggtatatatgaagtgtgtagtgtgatgtttttttaatttttttttgttttatacaatgtagtttaattttcttggccagaagactttgaccctatatagtcaacactcaacagcttacagttacagacaaaaaaagacgcgtttataattgaataaaataaaaaacaaaaggcttggccatgccactggttcctctctctttctttgacgcgcaattaaagctaatgtcagtctcaagcacaacccttatgacttggtctttgagtactaaaagattaaaaagttctcatgttctgagttctgacttacctatcttctccaagattgctcctagttacaataagtgagctatggagagaaaggggtaagatgattcaatttaatgtagtacaaacttcatgccattgatgacaccatgaggaacatagcttccgtattccgttgatgggttcaacttgtacattcacattccatagactcatcctatcccccgttgtaagacgattgtgcattgcgagccacactaggaaggagtacttgggagttgagtggaacaacttgtacattaatacgcattattaaaataaaactcgagttagaaaagtttagcgataacgatatggtttgtaatagcgtatcccctcctattaatgagatattctctcatatcaatcatcttaatgggagaggatacaatcagaatcaatttacatcaacatgattgatatgagagaatatctcattaataggagaggatatactattagttagcaaatgatcgtattcaaaataatgaacatttttagtttccacagtcatcgtactctctttgatgtgatagtggtgttcgtcctgttcaagtcatttaatcttgctatttgatcgttctcaagaatagcatgcaagcctaatgagtctgaaataacagagtgggcatcacattgtaagtattatattatacttttattacatattttatttagcaaaaaataaattttaataagagtagaattgaatggtggcatatttgtcttacaaaataaaaagacttgaaatggcccacttcaagaaattgggcgtggggatgtgtcttttaatcacaaatctataaagtacgatgaaattattttgttcaaccataaaacagctgattttggcactgaaacactcgattatatataggagtaccgtttggggttttgttgtgtgtgtgtgtgtgaaattgtacacattttccgcaaactgatcccacaaggccacaagagagatgattacacgaacatctctaaaattaataacacaagagcaaaccatccaatatacttcctccgtatttttatagttgatgtttagatttttttttttttttctaaattaaagaaacattgataatctatttagacacaaatcaaccaataataaaataattctatgatataaatagtcaaaaataattaatttagtattaaaattgaaatcatcatctaatttgaaacattttattttcttctaaaacatcaactataaagatacagtccatcagaattgttaggggtaaaaatttgagaagtcattttattttttttcacagatttctcataaattaatatactcatatgtaactaaaagaaaagacatgttaattaatttaagcaaatgtaacaaacttattcatgattacgaagttcaattgcaattttgttattgtctttatcatgtccggataatgtttcaatacgtccagcacttgattcctcatcctagcagtctagccaagaaaacttcaccgaccggactaatgcaaacaacccttgctccaagacacaactttacaaacaattaagactatctagttttagtgagaaactcccacattacctaaataatattacttctgcttaatttattggatattagatactattcaaccgtccgattagcgtctagcgaaattttaaacattagtattttctcaattctaattgataactttttttactcaatatatagaatacagtataagagtttttctttttgtaagtttgtgatggtattaaatgtagacatattatatacttccacaagtcatatataaaaatgtaaaatacagaatcttgtacgcaacacacgggagatagtatgagactcgagagagaaagagtcatcatcatcatcatcatctccttcaaaacaaaaattttatatacaaatttggctttaatggaacccacgttctcttctctgtctctctttctttacaatttccaagagaacattaaaataaaaacaacaacaacaacaacaaaagttttgttagtattactctttcactcgtttttaccctctcttagctgcattacattagctgtttctacttattctctctctctcttcatcttttgttgtttcacgtaaagtcaaacccatctctctctctgtctctgccattttctgaacatgaataatatcttctcatgctctgattcgtttctcattgcctaaacaagaagaacaatctattcttgttttagcttaaagtttttattgctacaaaca

SEQ ID NO: 13626 - DNA, 3000 bp, Unknown
  misc_feature (1)..( 3000): cDNA_ID_3031100_gDNA_ID_2214640_Annot_ID_188294 3000 nt of promoter + ATG
ttgttgatttgaacaatggtactcgcttctctcctacttctatggtttgtttctcgtctccatagaatctgtcacacccatcaaccaaccaaaaaaaaaaatagagtttgtgtttaaaaaataagatcaagaaacgaatcattccaaaaagaatgtactaatgcaatgtataacgatcataactttattgggatcgtaaatgcaaaaagccaactttattttccatcattgagagaacccaaaaatgaatgttctaaagaagatgaaaaatctagaacctgacagtattgtctctcttgaactccattgtttgtagcaataaaaactttaagctaaaacaagaatagattgttcttcttgtttaggcaatgagaaacgaatcagagcatgagaagatattattcatgttcagaaaatggcagagacagagagagagatgggtttgactttacgtgaaacaacaaaagatgaagagagagagagaataagtagaaacagctaatgtaatgcagctaagagagggtaaaaacgagtgaaagagtaatactaacaaaacttttgttgttgttgttgttgtttttattttaatgttctcttggaaattgtaaagaaagagagacagagaagagaacgtgggttccattaaagccaaatttgtatataaaatttttgttttgaaggagatgatgatgatgatgatgactctttctctctcgagtctcatactatctcccgtgtgttgcgtacaagattctgtattttacatttttatatatgacttgtggaagtatataatatgtctacatttaataccatcacaaacttacaaaaagaaaaactcttatactgtattctatatattgagtaaaaaaagttatcaattagaattgagaaaatactaatgtttaaaatttcgctagacgctaatcggacggttgaatagtatctaatatccaataaattaagcagaagtaatattatttaggtaatgtgggagtttctcactaaaactagatagtcttaattgtttgtaaagttgtgtcttggagcaagggttgtttgcattagtccggtcggtgaagttttcttggctagactgctaggatgaggaatcaagtgctggacgtattgaaacattatccggacatgataaagacaataacaaaattgcaattgaacttcgtaatcatgaataagtttgttacatttgcttaaattaattaacatgtcttttcttttagttacatatgagtatattaatttatgagaaatctgtgaaaaaaaataaaatgacttctcaaatttttacccctaacaattctgatggactgtatctttatagttgatgttttagaagaaaataaaatgtttcaaattagatgatgatttcaattttaatactaaattaattatttttgactatttatatcatagaattattttattattggttgatttgtgtctaaatagattatcaatgtttctttaatttagaaaaaaaaaaaaaaatctaaacatcaactataaaaatacggaggaagtatattggatggtttgctcttgtgttattaattttagagatgttcgtgtaatcatctctcttgtggccttgtgggatcagtttgcggaaaatgtgtacaatttcacacacacacacacaacaaaaccccaaacggtactcctatatataatcgagtgtttcagtgccaaaatcagctgttttatggttgaacaaaataatttcatcgtactttatagatttgtgattaaaagacacatccccacgcccaatttcttgaagtgggccatttcaagtctttttattttgtaagacaaatatgccaccattcaattctactcttattaaaatttattttttgctaaataaaatatgtaataaaagtataatataatacttacaatgtgatgcccactctgttatttcagactcattaggcttgcatgctattcttgagaacgatcaaatagcaagattaaatgacttgaacaggacgaacaccactatcacatcaaagagagtacgatgactgtggaaactaaaaatgttcattattttgaatacgatcatttgctaactaatagtatatcctctcctattaatgagatattctctcatatcaatcatgttgatgtaaattgattctgattgtatcctctcccattaagatgattgatatgagagaatatctcattaataggaggggatacgctattacaaaccatatcgttatcgctaaacttttctaactcgagttttattttaataatgcgtattaatgtacaagttgttccactcaactcccaagtactccttcctagtgtggctcgcaatgcacaatcgtcttacaacgggggataggatgagtctatggaatgtgaatgtacaagttgaacccatcaacggaatacggaagctatgttcctcatggtgtcatcaatggcatgaagtttgtactacattaaattgaatcatcttacccctttctctccatagctcacttattgtaactaggagcaatcttggagaagataggtaagtcagaactcagaacatgagaactttttaatcttttagtactcaaagaccaagtcataagggttgtgcttgagactgacattagctttaattgcgcgtcaaagaaagagagaggaaccagtggcatggccaagccttttgttttttattttattcaattataaacgcgtctttttttgtctgtaactgtaagctgttgagtgttgactatatagggtcaaagtcttctggccaagaaaattaaactacattgtataaaacaaaaaaaaattaaaaaaacatcacactacacacttcatatatacccaacaacaaccagtgttaaatgaaaaagaaagaccaagaagccaaaacgtcaagatgctaacaacccttgtagtctaaccactcccaagatttaagaattttcttacttttgttctagttttgttgagaaaaagatg

SEQ ID NO: 13627 - DNA, 3000 bp, Unknown; identical to SEQ ID NO: 13620
  misc_feature (1)..( 3000): cDNA_ID_3031107_gDNA_ID_2214640_Annot_ID_188291 3000 nt of promoter + ATG

SEQ ID NO: 13628 - DNA, 3000 bp, Unknown; identical to SEQ ID NO: 13619
  misc_feature (1)..( 3000): cDNA_ID_2703558_gDNA_ID_2214640_Annot_ID_188285 3000 nt of promoter + ATG

SEQ ID NO: 13629 - DNA, 3000 bp, Unknown
  misc_feature (1)..( 3000): cDNA_ID_3031093_gDNA_ID_2214640_Annot_ID_136227 3000 nt of promoter + ATG
caacaaaactagaacaaaagtaagaaaattcttaaatcttgggagtggttagactacaagggttgttagcatcttgacgttttggcttcttggtctttctttttcatttaacactggttgttgttgggtatatatgaagtgtgtagtgtgatgtttttttaatttttttttgttttatacaatgtagtttaattttcttggccagaagactttgaccctatatagtcaacactcaacagcttacagttacagacaaaaaaagacgcgtttataattgaataaaataaaaaacaaaaggcttggccatgccactggttcctctctctttctttgacgcgcaattaaagctaatgtcagtctcaagcacaacccttatgacttggtctttgagtactaaaagattaaaaagttctcatgttctgagttctgacttacctatcttctccaagattgctcctagttacaataagtgagctatggagagaaaggggtaagatgattcaatttaatgtagtacaaacttcatgccattgatgacaccatgaggaacatagcttccgtattccgttgatgggttcaacttgtacattcacattccatagactcatcctatcccccgttgtaagacgattgtgcattgcgagccacactaggaaggagtacttgggagttgagtggaacaacttgtacattaatacgcattattaaaataaaactcgagttagaaaagtttagcgataacgatatggtttgtaatagcgtatcccctcctattaatgagatattctctcatatcaatcatcttaatgggagaggatacaatcagaatcaatttacatcaacatgattgatatgagagaatatctcattaataggagaggatatactattagttagcaaatgatcgtattcaaaataatgaacatttttagtttccacagtcatcgtactctctttgatgtgatagtggtgttcgtcctgttcaagtcatttaatcttgctatttgatcgttctcaagaatagcatgcaagcctaatgagtctgaaataacagagtgggcatcacattgtaagtattatattatacttttattacatattttatttagcaaaaaataaattttaataagagtagaattgaatggtggcatatttgtcttacaaaataaaaagacttgaaatggcccacttcaagaaattgggcgtggggatgtgtcttttaatcacaaatctataaagtacgatgaaattattttgttcaaccataaaacagctgattttggcactgaaacactcgattatatataggagtaccgtttggggttttgttgtgtgtgtgtgtgtgaaattgtacacattttccgcaaactgatcccacaaggccacaagagagatgattacacgaacatctctaaaattaataacacaagagcaaaccatccaatatacttcctccgtatttttatagttgatgtttagatttttttttttttttctaaattaaagaaacattgataatctatttagacacaaatcaaccaataataaaataattctatgatataaatagtcaaaaataattaatttagtattaaaattgaaatcatcatctaatttgaaacattttattttcttctaaaacatcaactataaagatacagtccatcagaattgttaggggtaaaaatttgagaagtcattttattttttttcacagatttctcataaattaatatactcatatgtaactaaaagaaaagacatgttaattaatttaagcaaatgtaacaaacttattcatgattacgaagttcaattgcaattttgttattgtctttatcatgtccggataatgtttcaatacgtccagcacttgattcctcatcctagcagtctagccaagaaaacttcaccgaccggactaatgcaaacaacccttgctccaagacacaactttacaaacaattaagactatctagttttagtgagaaactcccacattacctaaataatattacttctgcttaatttattggatattagatactattcaaccgtccgattagcgtctagcgaaattttaaacattagtattttctcaattctaattgataactttttttactcaatatatagaatacagtataagagtttttctttttgtaagtttgtgatggtattaaatgtagacatattatatacttccacaagtcatatataaaaatgtaaaatacagaatcttgtacgcaacacacgggagatagtatgagactcgagagagaaagagtcatcatcatcatcatcatctccttcaaaacaaaaattttatatacaaatttggctttaatggaacccacgttctcttctctgtctctctttctttacaatttccaagagaacattaaaataaaaacaacaacaacaacaacaaaagttttgttagtattactctttcactcgtttttaccctctcttagctgcattacattagctgtttctacttattctctctctctcttcatcttttgttgtttcacgtaaagtcaaacccatctctctctctgtctctgccattttctgaacatgaataatatcttctcatgctctgattcgtttctcattgcctaaacaagaagaacaatctattcttgttttagcttaaagtttttattgctacaaacaatggagttcaagagagacaatactgtcaggttctagatttttcatcttctttagaacattcatttttgggttctctcaatgatggaaaataaagttggctttttgcatttacgatcccaataaagttatgatcgttatacattgcattagtacattctttttggaatgattcgtttcttgatcttattttttaaacacaaactctatttttttttttggttggttgatgggtgtgacagattctatggagacgagaaacaaaccatagaagtaggagagaagcgagtaccattgttcaaatcaacaacggctccattt

SEQ ID NO: 13630 - DNA, 3000 bp, Unknown; identical to SEQ ID NO: 13624
  misc_feature (1)..( 3000): cDNA_ID_2703576_gDNA_ID_2214640_Annot_ID_136230 3000 nt of promoter + ATG

SEQ ID NO: 13631 - DNA, 3000 bp, Unknown; identical to SEQ ID NO: 13623
  misc_feature (1)..( 3000): cDNA_ID_2703588_gDNA_ID_2214640_Annot_ID_136231 3000 nt of promoter + ATG

SEQ ID NO: 13632 - DNA, 3000 bp, Unknown
  misc_feature (1)..( 3000): cDNA_ID_2703592_gDNA_ID_2214640_Annot_ID_136232 3000 nt of promoter + ATG
tttaaaatattttccagcaacttcctttgccatttatgagagaaaatggcttggtcaaacctgggattataaatttgttgggtaaagatggtacaaagtgggaggtaaatcttcgacgggaagccaacggaaccatgtatttgggaaaaggctggaaagatttcactatagctaacggcttaaagaccggcgaatctttcacgttggaggcagttttggagaatggaactcgtatgctcagtttggtcagtacacagtccacaagtgatagaaaccagcaaggagagtgtttaaaagatagcgagaaagagtcaaattctacagaacctagcagtggaaaaaggaaagccatgataaacagaggcgtgagaagaaagtcatttccagcaagccaaaaccggtgtgtgacattaaaacttactcatgacaacctcatcaaaagtagacgggtgagttcatcaatcaacccttgttttagagggtacgttagttttatctcttgcactcatattaggtatgttatccgttcatttatgctccagtatcttccgttgtcattcacaagagataatggcttggacaaacctgggatgatttttctgttgggcaaaactggtagaaagtgggaggcaaatcttctaagggaagcctcaggaagaattgttttgacgggaaagggctggaaagagttcgccatggcaaacggcttaaaaagcggtgaattgttcacgttggaggcaattttggagaagggaactcctatgctcagtttggtcaatacacagtccacaaattatagaagccaacaaggagaatgttcaagagatagcgagaaggagtcgtcgatttgtgctgaacctagtagaggaaacaagaagtggaaagctactaacaacagaaaggagaggagagactcgtcgtcagcaatccaaaatcgatatgtgacattaacactcacaccagaagatgtcagagcctgtacactagtaagttccatcaaactactcttgtttcaaaaaggggtcagtttctgtcttgattttaatttgttacgaagtgtgtttattcaaatcttttgcagattcttccgagtcaattcatgaaagctaatggcatcaacaagcttgggaagaaaactttgttgggtcaaaacagaaagaagtggtttgcatatctactgtcaaaaagtggatttgtggcactgggatctggttggaaaggtttctgtgaagctaatggcgttaagacaggagaatcattcaatttggaatatattgatgaacaagacacaactcctgtgtttaagttctgttccaactccgtagagtatgtaaagttcacaagccttccttaaaaactaaaggcctttttgttagttaagtttaaattattatgattatgaacttgctattttgaatgaaccatctttaaagagtttctcttagaatataatgacaacttattgtggattgaaataaggttaacagagttgattgaaatctaaataagctaatgcaatagattcttgactaaaaatcctaaacgaaaacaccacacattaaaaaaaaaaaaaagggtcctagaaactagcttagaaaagaaaaaaaaaacaaggttacttgtcatcaatagttttgtcatagaacactaacgtcgagcttatcattccagaatcagttggcatagagaggaacgagagcgaaatagagtgtatcatcggcgtggaaagaccataggcgaatatttgtgttttcctctagaaggcaatctgtaaccacttgattccaccctgcaaccaaattgtatagaagaatgcccctcatgtccctcaacctcaaattcaccggaaattcccttagatgagaatccacgagtatcgcgtctactccttctttgcgaaccctattggcatcttcttctatggcccttttttcctcgtggttcaagaattccaactccacgatctggctgacaggtattgagagacgactttggtgtggatcgacatcggtttggaataattctttatctatgatcttcttcgaattgtcttcaacgtctccaccgttcttgcttctcatcaagctgataagccaccctggcgtcggctctcttgtcttggaagaagaagcatccgtactgcgttttgccttcttagattttcgttgttccatgggaggagacataggagggagatcatgtctgtttctactgcgtcttgttggagattctcttaatgagtggtcgtgaatatgggatttagactccatgacggtagaaggagtagtaatcgtcgagcttttgtttcttcgaagtatacataactgaagtttgttatactcctcccgcgttggctttgagttactcatcatcagtaatgtttccacacactcgacatcttctttagacacctcttttttgaagatcattgtttatgaactctctcttctgtttttttctctctattgtatatatatagtgagagatttactcctcgtaatagagagatttactccacgtgatagagaaagcattattactaacaatttttcttttttctttttggaatctgtttttgagaattatcttccaatttttatatatatattttttgttattcttatggctagatagttataactaaagtcaaacataaccacaaaaattcaaactaaatcgaaccaaaattttaaaatacacgagtatatccttaaattttttacgaaactatattataccgaatgaatatctgaaatatccaaaaatcgaatggatatccaaatccgaaacactctaaataataacaaatgaatccaaaattataataattaacccaccaatattagttatgtttatactcgaaataatcaaaatacttaaaaaaaaccaacatatctaaatgttgttggttatatttgtcaaaaataaaacatattttgcaaaataaaaccaaattcattaaaattgttttggtatttcggatagtttggataaaaaatg

SEQ ID NO: 13633 - DNA, 710 bp, Unknown; identical to SEQ ID NO: 13622
  misc_feature (1)..( 710): cDNA_ID_2703596_gDNA_ID_2214640_Annot_ID_136234 3000 nt of promoter + ATG

SEQ ID NO: 13634 - DNA, 3000 bp, Unknown
  misc_feature (1)..( 3000): cDNA_ID_2703670_gDNA_ID_2214641_Annot_ID_136238 3000 nt of promoter + ATG
tctctgtttcaattaaaaagaaaaaaaatccaaacgataatcattgtgataaatcacaagatgatatcatcttgaacactaacattaagagtcttattctggagaacaatgcttcctatgactgctacttcatcttccacagttacagcctcacctgcagaaacaaattaatcagaaaaaatataacgaaaaatttgttgaacaaaaagaaaacaatgaagttaccaagaatggtaatcccaagcctgtcattgtaatctccactagcttgaactcttgaccatctacctatagaagatttccatccgataattgagtttataacaacagcattctcctgcatttaacaagagtagagaacattaaacaacgaatcttttggattcataacaagaagaacattctaaaacactgattccaaattaccttgatttcaacatcgtctaagattatgcagctaataagccttacaccaggtccaacacgaacatttgctgatatcgacacatttggaccgatcttgttccaaagaaatttaagtgtgtcatttcatttgcaaactgaatgagaagtttagctagaattcatgagatgaaacaaataaactcacctttgcggttggatgcagttttacggatgggtgaatataaacatcaccaattatagttggtttcctattagtaccatctcctgaagctaaaatatgaggcgatgtttcgcggaattgggaaagatataaagccgagcatttcaaagatttcctgtttaaagcaatttcttagcataaggagtaatccaagaacgtctgaaacaatgattaccaccaacttaccccggagtcttgatctgttcccagaaatccttgttctcatatgtgtatagttgcttctttccagcaagaggtgacaatatatcttgatctaatctcacaaaatctgcaggaacagaccttgtagcggattggtagttgctagctgccaagtttaaagagattatacaatgaataacttatgaaaagaccaaaagaatcatgaaaatgatgaagcaggtctctaattgataatattgcaagtctctgagagaggccaataatgaatactcacatgtgtctcttatttggctatatacttcttcaattgcattgaagatatctgaagtaaacacatagacaccacagtttatcaagtcactgacctgcattgagtagataatttaagctaaacaaatttcagagcctgtgaaggaattaagaaaacaggattgtttagcagataattacgaaagtctcgggcttctctgtataatgcaggagttctttagtatcaggatcagctatcaattcaccaaattggctagctgcttctgcagaaacctgaagtgaaaaagcgatattcatgtttatgtttgatctttatgtttgtttccttagtgacatctaaaataacatcaggataacgaaccttgattactagcatagttccaataccaccatatcttcgatgtgcgtctacgaaaagtagtgaagtacatcaaagtaagaaaatgaaaacgatgaagcagattagcgatttcaaagggagattaccaagtatgccttgaagagggaaagaacagcaaacatcacagttgaggaggaaaacatgtgactgttcaaagagacaagaaatggaagatcaatcaggaaaacaaatgactgatgaggcaggaactaaagttgggaatttcatcagaaatcaaaccggtttctcttccataattctatcacgaaagtaataaagagcaccagctgaaccatggggtttatcttctttcaagtatctatataacaagaacatcgttcaattctcgatttcacattacacaccaaaaaccaaaaacacaaatgctactacaacttaccgcactggaattttcagctcgttagatattgaagacacatacaaagcaaattctcgttcctcgtaaaatccaatcagaaaaatctgagccagatttgatatctgtccatgccaaatacaaaacaaatataatatgatcaatcatcattacaaagttgagaactttcccatcctttgagcctgaagaaactatgaaaagttcaaaactttgacactacaaatcatacaacaacaagaaaatattccaaagtgtagagtactaaaatggaacaaacccacataaagacaaacgatccatgtcaaatcaaaacaagttatgagcaatccacatttcaaagttgacaactttcacgactcaagcaataccaaacttttctcagggatcaaaagcaagaaatagtaaaaagaagaaacctttttacaagcagagataggatgatgaatcataggttgaccagccaaaggaatcaatggtttcggtgtattgaacgataacgggcgaaatcgagttcctaaaccaatccacattagcaaaaacccaaaaccaaaatcaaaaattcatgttttgaaaatagaatttgagatccaaaagagaatgttatacctttggtcggaccaccaaccatgatcacagcgacgactttctcctccgacatgtcgagattcaataaaacctagattcgttaaagttaaacacacgacgatgatctgattttgtattgaaaggtcgtatctttgtagtcggatattctcaagttttttgaactaaagttgaaaaacagagtaatcagaatggagcctaataaaacgtcttttttaattccgttttgtttttgcgtttgttagcgttttataattgcgtttgtgaatgaccaaactttatgaatcttcttctatagcttctctctctgaacttcatcaatgtaaatttcaatcttttcttcattaatgtgttccgtttgattttgtttcttcagtgaaatgaaattgagattggtttctgattttatcttcttgccagtgaaaccctagtaattgtgattttgctgggcaagaaattagggttttaggaggttttgttacttactcaagagtgaaaaag

SEQ ID NO: 13635 - DNA, 3000 bp, Unknown
  misc_feature (1)..( 3000): cDNA_ID_2703682_gDNA_ID_2214641_Annot_ID_136241 3000 nt of promoter + ATG
gctgcaattttggatacaattgagcacggaagccatcaacatcctttatattactacactacatttgactggaagccttgtagccgatgcagagaggagggcgccgttttatttcgttgtgatgagtgtgactacattttggatggaaactgtgctctttttccaaaaaaggtaatgagaaatagatacgatgatcatcttctcttcttgtctttcggtgacaagaatgtgagtggtgactattggtgtgaagcatgtgaaacgaaagtgaacccaaaggaatggttctatacatgcaacgattgtggaaccatattacatatatcttgtgttgtgggagatttctcatatatcatgccaggttctcatataacaacatggagagctaacgtggtatccaacacctctatttgtagaccagtttgctatatgtgtaactctcgatgcaaacttccttctgttcttaagctttctgacaccaaagttgatgtatacctttgttctttcaaatgtgcctattttattaggaaataaaattatgtatcatttttctagttaatgttaaatctatatacacatttttagcagcactttttgtctttaatgtttgaatttctctcactaatattttagttaagatgagtcaaaatttacccggtttaattatgttcggatattacataactttaatggatcggattatttacctggttttattgtgttccaatcctgagaacattaatttttgaaaaaagttaccatttctatcaaaaaaataattggaaacgaaattaattatttaattatcaaatttaatatatatatatatatataatatctttaaactaatcatattttttatttaccttaactaattttttaaaatctctctatctagaataaacataaatatatgatttaaacgataaaaaaataatatatatgtacaatatttcatattacttaaaaaaatgggtaatagtttagagttatattatagggaaatttgggtgtataaccataaaaaatttaataatttaacaagtaaccattcaaaaagttggatatgatattcagcatatattgtgtagtatatacacatttgcccttgtttatacacgtgcttctctcctctctccaacatgatgcatatatcatcatctctttcttctccaacagtttttttttaaagcaaaattcttttgtaactcttttcacaacagtcattttctctctttgtcatcgccaaaacaaattcatctacgacaatggagatatagcaaaggaggatctcacatcagcctcacacaaaaagttttcaatttcgatgacgatgagtaaatatttacaaaagtgaattttaaaaacatggattagctaattagtttttaaaattgcttataataaataggactataaatctcacaggaaattctagtgagattaagtcaaacaaatcattttttattttaggaaaagtttgcaagatattattctattttgtaaattaaaaataattttttattcatttatttattttaaccaatctgttacctaataaaaacatatttaattataaaatttaatatacaattaaaatgaaaggatatatctatttgggtttacaaaaagaatattagggttttggattttatgattaaacaatgttaaatattggtttgagtttataaacaagtttaaattttacaactaaacgaagtcaaatgtcggtttgggtttagaaagtacaattagggtttagattttataattaaacgagtaaaaatgttggtttgggtttataaacgagaattagggtttagattttgtaattaaacaagattatatatcggtttggatttatacaagaatggttaaagttttgattttataattaaataattttaattatttattagttgaaatattttgattggctagaataaagaatggtgaatatgagaacccaaatattgttctttgtgaatatactgtttacgtttatgttatactaggtgcgtttaaactgaattgtttgttttgattgatattcattgtcatgatagagtgttttcattggccaaaccacagtgtttgaaattgaaatactatttgatattgcatctctactttcttgtctatactatttcagtttttagaacaccaattttttttacttacaaccatttttctattttgtaaatattggttcattttaaaaaattcaaaccactacataatcagaaaaaaatctaatgttttttttaatatagctagaagtctaaatcagtttattttagagagatttttagaaagaaaatgtaatggggtgtgcaaaataatattatccaaaaacataaaattaatcttttctcttgtatgttcaccacgtcagctcgtccaaagccttgcaaatgaggagtttgtcgacatttcatgtcatctacatgttacttacttagttttagattttatagtgctatatccttaaataatttatgaaaagtagttacttttgcaattcaccctatattataagatgaaataaaattattttgaatacgaatgaacaaaaaacttgagtttttaaacttccaaaactaaaaatgttcggtttattatggttctttattttaaaaaatataaattttaaaataaatttaaaatattataaatatttaatttttattatacggatgaaatcttacaatggactaatttaaatcgattataataataaacgacaaaaaaaaaaaaaatcgattataataataaacggtataatacatgtgaattcctagaattaaagaatattttgcccatctcctgcaagttataagttaattacaatatgatgaaagaagaagataagagagatccaaagagataagaataacattaaagttactctctcggtgtgggtatgacgacgaattgacttaaaattttcgttagtcatcttttgtcaatttcgtttcaatcatttttgacacaaaaagt

SEQ ID NO: 13636 - DNA, 3000 bp, Unknown
  misc_feature (1)..( 3000): cDNA_ID_1012546_gDNA_ID_2214641_Annot_ID_136242 3000 nt of promoter + ATG
gcaaaataatattatccaaaaacataaaattaatcttttctcttgtatgttcaccacgtcagctcgtccaaagccttgcaaatgaggagtttgtcgacatttcatgtcatctacatgttacttacttagttttagattttatagtgctatatccttaaataatttatgaaaagtagttacttttgcaattcaccctatattataagatgaaataaaattattttgaatacgaatgaacaaaaaacttgagtttttaaacttccaaaactaaaaatgttcggtttattatggttctttattttaaaaaatataaattttaaaataaatttaaaatattataaatatttaatttttattatacggatgaaatcttacaatggactaatttaaatcgattataataataaacgacaaaaaaaaaaaaaatcgattataataataaacggtataatacatgtgaattcctagaattaaagaatattttgcccatctcctgcaagttataagttaattacaatatgatgaaagaagaagataagagagatccaaagagataagaataacattaaagttactctctcggtgtgggtatgacgacgaattgacttaaaattttcgttagtcatcttttgtcaatttcgtttcaatcatttttgacacaaaaagtatggaacttcaagtccttgttcttcgtccaatcttcttcttcttcttcttcgtcttcttgacaattctacaacaatcctcttctgctcgggttcttacaatcaccaagcctgatagacatgactacgccgcaagtgctcgttggcttgtctctcagaattcttggggtgttcttaggtatctaattctcgtctctttctgcttatcttgcttctcaagtttagatgatagcttttgctccactctcaattattaggagctttattagggctattgaatccaatcagtgataaaagattgaatcttttgaaattgaaattggtaaaggttatatttttacagaagtttgtagcttttttagcagattgaatcctattgttgataaactttgttgggttcttgagacttgctatggatttgcttcatcaagctttaatactattgaaattgatattgactttcaagtactgttgggttcctgagatttggtagttcgtcaagtttgattcttttgaaattgaaaggtttttaggatttcagatttgacactaggagtaacaaatggttcctctatactctgtagttaccactggtcactctatacactatagttacctgagatctttattagtgaaagagattgttgcattgttgttatcagcaaggtaatgtgagtgtaacagttgtgtattactaattctttttgcggtgttgtattcctcttccagcacactatccgttgatcataaaggcgctcccttcgggtaatcttgttttccatgaatcatatcacaatgtgttttcttgctttgacattattgagatctcaatggtctctatttgcaggaatgttgtatcgtttagtgatggtttacccgagaaaggtaacggtataccttacttttacttaacaacacttgatccaactgcaagaaacgcacttaaagaccagagagcttcacttgcaattagtgaatctcctcttggaacttgtacaagagatccaatgaatcctacttgctctaaactaacccttaccgggaaggtaaaagagttttttcttattgacacgacaaagaaacttactgtaaaatgctttggtctttatcttattataatgtttcagttgctgatattggaaggaggatctgaggaagcagaagtagccaaaaaggctttattcacaaagcatccagagatgatgggtgattaattgtttcactcatctcttaagatacagattcatgatagatttgtattatcatgtgatggttttatcatttgcagattggcctaaggatcatgatttccgcttctttaaactcgagatcatcgatatatttctcatcaattggtatggtggagctaaacctatcactgtagatgaataccttcatgccaagtcgtaagtacattgcgtgaacccttttaaaaacatcggtaatctctgagaaaccgaactatgaaaattttcgaatcgtatgcctttttcgcatttgatctcttagttcttttgaactgttttcaggatcaaactcgcttcctttttataataactcacaagaatcaagcaaatggtgaagcaagaaaatgtatattggatgaacaataaaaagtgtgtaactgtttctgtaaataactctttgttttggaccataatagatattaaaatctcttgtaaattacctcaaagcaatttcaaaggtatccaaaatacttttcaatttatgcaattgaaccaaaacaaattcttccacgtgaaccgaaacgaaaatcggttttgatttctcatttaaaccgaataaaccaattttttttattcattagtctaaaatttaaattctattatctaaacataattgaaccggaactttcataagagaattgaatccaatacactaaaacaaaataaaactagaaatttatgtaattgaaccacgttggagtcaaattaaaaccaaatcagaattctattgcaattgaaccaaactaatttcaccaactcgaaccgaaaccaaaactcgattttttcattcataattctactcaaattctttatctaaaccgaattgaaccgaaagttttgaagcaaagtttgaaccgattcgatggtcgaattccggttatttccggtttgaggataagctttatcattctctgagagtctctctctctgtgagtggcgagcattggtttctggaaaatgaacacaaaaaaatatctgaaaatttcgatctaaaaagcataaacgaatccaaatttcaagaggagaagaaaaatcttcaagtccacgacgaaacttttcatcgatcttcaaattccagaaaaaactcg

SEQ ID NO: 13637 - DNA, 3000 bp, Unknown
  misc_feature (1)..( 3000): cDNA_ID_3031152_gDNA_ID_2214641_Annot_ID_188333 3000 nt of promoter + ATG
tagagtcgagactttttatatgtgtagtgaaacttaagaaatatgattgtgattgtaaaagttgatattatgatttttcattgaagtctttgctttgaagctaagtgaaactcaaacactctccacaacacagttggttggttgtgtaatatttggacatctttttaattatgataaaatatgacgtggataaaatatgccagctcggataacagtaaacgacgtcgtttcttatttctgattgattctctgtagagaagaggaagagaagaagaatggtgacaagaatggcgacgaaggtgagtttggaagggaagagagtggttttggtaccgtacatggcggaacatgtaccaaagtaccatcaatggatgcaagattcggctcttcttgaagctacgggatctgagccgttgagtcttgagcaagagtatgagatgcagctttcttggactcaagatcccaatagtatgaaaaaactctaaaccctatttagatatatatcttaaatcttccatcttctttatcttagatttgatcagtttcagttttactcaattagggtttagggttttcttttaaactaccctagaatctcaatgttgattgtttttgtttgatattttagtctttttctgtgaatttgatatcacctaagctccaagttcttggatatttagctatatagtgtcttatgaggttcattgagttcgtctcttaaccaataaacaatgattagagtagattcatgaccttttatatttgattaggtctatcttctttttcaaatgtagtattttctaatgcccatgtttttggtttcagagcggactttcattgtcttggacaaggatttcgttaagggagacctggctcatggccaacctcatgtagaaggtttgtttcctgagtataaaggagattactttagcatgcatcagtatggaatcttctatctagctgctgtgacaatgcagtactctctgcctttagttaataatgtagtggaattgttattagaacaaagtgtgtatagtggccggaaaatgagaacatatctacaagactgcttctttgttagtggtttagatcattggtgactaggttggctttaagagttcttccttatcttatttggttaaaaagaagtccatttagtttagcttgaatgctctgtagtgtttcttctgtgtatgttattttcacatttagtcattgtcaatatgtaactgaagcttttgtgcagcaatgacaggtgatgtgaacatttacatgaatgatgtggatgatccaaaggttgcagaagttgaaataatgatagctgagcccagaaggtaactttagtcttcccaattcgagtcctatacaacgcgaatacactttagctgatgttacttctggcacatgattcttatttttttgttacaaccatttggtagagtagccgtggtaaaggactaggaaaggaatctgtgttgataatgatggcttatggtgtcaagaacttggagattcacaagtttacagccaaaattggggaatcaaacacagcttccctcagcttattccgcaaactagtacaacaactcaatctcttgtctcaaatgtatgtgctccattgcctgtgtttacaaaggaaaatggctaaacacactttgttgtttgttaaaagggtttcgaggagtcttcttacagcggtatcttcaaagaggtaaaaagtagtttactacttcatacactccaacaaaggatgttacttttggcatatactagattgagtttctttaatctgacaggttacactcgagtatccggtgactaatctccgtcgagaagagctcttgaagttattggatgaagtcattaggcacactcattcatcgaacaacccatcagactcactgctatcaggagaagctactgcataaagcattttcttcagtgtttattgttatttttctcttcaacttgggaaagaatttgaaatcattgtagcatgtatgagtttataaattatgattactaatatacatggtccattgtttcaattcaaagttgagtcctactatttgttgagcctaggcctgggaaaaatacccgaatccaaaaaactgaaccgaacccggcccgacccgaacccaaacccaaaattttaaaatatccgaagggattctaaacttcaaaactcgaaaaccccaacccaaacccatccaaacctgaacccaatcaaatacctaacatatctgaaatatataaatataaaaacaatttattagtaataatcatatttacaacaactcaagtgcttaaaatatttggattttaagttttttttttttttttttttgtcatccgattataattagagctcaaacgagccaaaactgaggaatgttgtttacataagtgatatgaagcagttcagtgcgaacttttcgcgccaagctatccgcttttacatttgcatttacatttacatttgtattttaacttattttgtatatttttgaatactttacctacttttagctatattaggatataaatactcaagtttttcaaaaaaattgtgtattttcaagtaatttgaatatatttttatacaaaattttgagttttggatattccgggtaaacctaaattcgaacccgaaccaaacccaaaatcttaaaataccgaatcttagatttccaaatccaaaataaccaaacccaaaaaaaaccaaaaaaaactaatccaaacccgatccgatccaaatccgaaccgaacgtccaggcctacttgagcctatacagggataaatataattagcgaccattctatttttcctatgatacacttccaaactgaacaaaacgcaatttttatcattattgtaaacaaaacgcaaacgcaaacgcaaacgcaaacgtgaataaaacttgaatccactcataggagaaacttccaccactgattcttgcataatccgaaaaatctctgcgaatactcgcagtaatg

SEQ ID NO: 13638 - DNA, 3000 bp, Unknown
  misc_feature (1)..( 3000): cDNA_ID_3031164_gDNA_ID_2214641_Annot_ID_188328 3000 nt of promoter + ATG
aaagaaggttgaagaatgttccaagacaaagatgttggatggttggaccatctaaagggaatgatgctatggaaatggcaatggagtttaataagtcatgggagactgatttgagagttggatttcatgattgccgacattataccaatggtttagtgttatacaagctttaatttaatcaagaagactttggtttttatttgtttctaagtgtttttggtttttaatcttttggaatacagaacttgtccaacatcttaccggagaaatgcaaattgtggagcgacttccaagaagctaatgctatagatgaaacaaatggtcatttatcttatctactaagattttagacccgacaattatgatgtgataattagtagttgaagataaattgaatattagtattgtttattagtaagagtggttagtttttctatatttacaacttttgtcttacattattcaaatttattgttgtaagtaaagtaactaataaaaaggttaagccaaaacaaaagagcaaaatgaaacataattgaaattttcttaccccaaactggaaaataatacaaattggagccgtctgatttaggttcttatttggttttcggtttatcggtttgattaaatgtatgtaatttgtttggtttgctcggttctctttggtgtttattggatttattataaaaataataataataaactatttaaaaaccatatgtgattcggtatgatttggtttggatttgtttccctgtgaattatcaaaattataaatcagcaaaaccaaaatgaatatctttttcaatttgcaccgaccaatcgattgaaaaagagcaatatttaaagactaactcatatagcaccacactatacatatataatcgaaattaacatatatttacagtattaaggatttttaagaaactacaatatttggtgatatataatatatatattaaagtaaatttatatacagtagaaactttataaattaataaatataataagttaataaacacgataaattactaaatttgttataaaattaaaattaataaaataataagataataattttttgaaatccttgtgtaaaaatatgatcctaataatatcagtaattaattatcataattcttaagcatacattttaaaataatctagtataatatgaatctagtgttatttgtcttttcgtacggatctcgttgaagattatctgtaattttctatattgcatcaaaactcctggtgtcgttttctcgatctgcctccaaaagttttgaagagttttatacttaataattacttttttacatgtcactatttccaaaggttccacattatctttgaacattcattctatttcgataatcaagggtgtaaatggatacctagatttgttaagatgaaagagtcgaattgtgggttcaactttattcctcaagaaattcaccatttgcttttaacaaaatttcaacccaattttattggggcccaccataaagctgaaaatttacactttttagctgaaaattgtccaacctcaaattaggagaagaacaaattgaacgtgataaaaatttataatatatttctatctctattacatttaaattaattaatttgtttagagaatctagaaaattcaaatactaaactaattcagttcaatctttgaataatttgtaatcttttgttgtcgaatataagatatacacgaaccaacaactataatatcttcttataaatcagctcaaactttggacaattttgaataattcatatttttattttattaaaaccaacagctaaaatctgttcctataaatatactaatcccatcaagatttatctttacacaaaatattatgaactaaacacattttcttctttcaaaaacaatagttgttagtcaatcatgagtgaaagataatatttctctctacttatatgaagatgggaattatatgaagatcgtccgtgatcaaattgctgagcaaatgtggtccgcaagtcgaaatagttctcatcgacattgttagattttattttaaataatatttttttatatttaactattcagctaaatggttactatttaacatacattttatttctctgcagctaatttatctcattcagctcaatcaccatctagaccccaagattatcaatcacaacttcatcgtagatataaggacatactatcttgcaggaaaagaaattaataaaataaaaaaataaaatttaacataattgaatatacaaacgacaaagcataaattttataaaaataaaaataaaaggattataatattatattttgtgtaaatatttctaatttattaatttatggtatatgataaattaatatcattacaaattaataaaatttcaaggtcccaacattattaatttatagagttttcactatatcctaacttataattcataaaagaaattccggatttctatttctcggatggattatagatatggtagaattcaaaccatcagataaatcatcaccactcgaacatgggaccgctatacgagcactctttagttctatcattctatgtgtaaaatcacctttcaaaacctaaactacatatcccactcagttttgtttcttgtcaatttttttttgttttcagataaataatacccaagtaaaataagaccccaccatctctgttaatcatggggccagttcctaaagcgaagcctcacgtttctatctccactatttccctttttttttgttgaaacttagaaccaaaaatatatccatgacaaactcaagcactactacgactagataacaaataaacaaaaaggaatttttttcccaattggccacttgcactttttagttttcacccaataaatacctctaagtaacctctctttcttcctcctcaaaaaaaaaactcatttgctctctccaaacaccaaaacccaaaataagtttcaaaggagaaaacactaaag

SEQ ID NO: 13639 - DNA, 3000 bp, Unknown
  misc_feature (1)..( 3000): cDNA_ID_3031168_gDNA_ID_2214641_Annot_ID_188327 3000 nt of promoter + ATG
ccaaattttatgtggacttgtagattagaaaaaaataaatttgaaagtcattgaaaattgttgaaaaatgtatttataaatttaaacaaataataatgcaacaataaatgataaacaaagaaaataataaaacaacaattaatgattgagaaagacactaaaacccccactaatcatatacatataggtaaaagaaacaaaatcaagaagagtgtttatggttaaacaaagcaaaaatgatcaaataaaaacaagattatgatgttgttgttgtaaaacggcatagtcaagtcacaagcgcaccaccagacggtgccgcaacaacaacaacaacaacacctacaccgcataagttacattacaacacaccctgtctttaaaaactctttcctttttaataataaatctttctttaaataccatctctcttcttcctcctctgcttctcttcatcttctaagaaagaaacaaagaaagacttcacattttaccattatttgctctgagctcaggtcagcttttctctcttcccctctctcctctctcttctactttatggtacagttgaattaacaatgccattgaactactacttccatgaatgtatcttctttacacttgttgtcttaagtttctatttttgtctgatccagatctagtttcttctcttgtgtcttgtgaacactttagcttcttactgtctttatgtttgttgttgttgtgtcggtttgtttttcatttttccagtaatgttgaagaaacaagttcaagatctgacttaactaacttacactagttttagtttgctagtagctatataattctttgatcctgttaaagaactcaaagatcattcgttcttgaaaacagatccggatctgagatagggttcttgataaagattcgatatttgaatcctgatttggtttcttgtaatgcagtaggagagttcaagaaacaatggcaaagatgcaattatcaatctttatcgctgtcgttgcgcttatcgtctgctctgcatctgctaaaaccgcaagccctccagctccagtgctgccaccgacaccagctccagcaccagccccggaaaatgtgaatctcaccgagcttttaagtgtagctggtccgttccacacattcctcgactaccttctctcgactggagtcattgagactttccaaaaccaagctaacaacactgaggaaggcatcacaatctttgtccctaaagatgatgctttcaaagctcagaagaatcctcctttgtcaaatctcacaaaggatcagcttaagcagcttgttctcttccatgctctgcctcattactattcgctttcggaattcaagaacttgagccaatctggtccagtgagcacctttgctggtggtcaatactccttgaaattcactgatgtttctggcacggttaggattgattctttatggaccaggactaaagtcagcagcagtgttttctccactgaccctgttgcggtttaccaagtgaaccgcgtgcttctacccgaagcaatctttggtactgatgtccctccaatgcctgctccagctcctgctcctatcgttagtgctccttcggattctccttcagttgctgattctgaaggagcttcttcaccaaagtcctcacacaagaactccggacaaaagctgctacttgcaccaatctccatggttatttccggtttggtggcattgttcttgtgatcagatggttttgcagattgagttatgtttttaagttacaatgtgaaagattgtattacatcatttgaattgtctttttgatttttgaaacccattttttattatacatttttatcattattattgtttgtcattacgattgttgtgaattgaaattgttcctccattttgcttttctttagttaattttgcttcatttgcaagttaagatgataccaagaggtttaaagttcattctctttgatataatctgaagataagtcaataaatggcttgggatttgttcaatctggataaataatatgcagaatttgtttcactagtctgattacggcagtaactaggcctcggcataatacccgaaccctaaattttcaaatacccaaatgggtttaaatttcaaaatccgaaaaacccgaataggtaaccaaacatatctcaagtataagtatatattagttatatttatactaatatatataaaatattagaatttttcagatattttagttatttttgtgtatttttagatatattcaagcaaaactactcgtgttgttttgggaatttttgaaaatttcaagtaatttaataaatttgcacagaaaattttgatatttgaatatataaataagtctgaacctgaactcaaaccgaacccgatccaaaatcttaaattacccgaacgggtcttaaacttctaaatccaaaaaatccgaacccgaaatatttgacctaaatacccaaacgcccaggactagcagtaacgagccttaacccgttttgagtaaagctttttttttttatctctatggttacaacgccattacgagacgcccttggattcataattatgggagtagaaccatcaactatccacaaaacaatgaaatttcctactccatggagaataaaagagatcaaaagagagtaggagtataaacattcatgtaaccaaattgtgttgaaaggcaaatggcaaccattataacatttctaaagtcaatagatatttaaagagatgttattattatgtagattatcattctcactcttgtgaattgagatagttcctccattttgcttttctttaattgatattggttcacatccaagctaatgtaacccatctcataacagatttataatttcgtgtataatataatctccaaatcactaattatgacctcacattttaggataatgttttttttttaaatgcttatggtcaagaaagaagataacgattcaagccacacgaaacagaagaagaca

SEQ ID NO: 13640 - DNA, 3000 bp, Unknown
  misc_feature (1)..( 3000): cDNA_ID_3031184_gDNA_ID_2214641_Annot_ID_188322 3000 nt of promoter + ATG
gcggtataggcctgcaactcttctgcgataatttgctgcgtcgggttaactagtgtgttactttgcttttcacagagcaattcatgagcctcacgagtgcgctttggcaagtcccctaatttctctttccccataattctcaagctcggctttaaggtctttagcttctttaagaatctatgcaaagctgaagtagaaataaacaaaggagcagaagcattctagtggctctctaccgcaggcaaaaactgaggtaatgtcgtgaggacattaacaaatttaaacggcttgcgaccccctatcgcttcagcctcaagcattatccttccccttgtatgatcaaaacaacctccagactcaaaaacactataagagtgcgggaaagtagtacaccatgaatcattaacaagaactcgatcaagttttttgcatatcaaaccatcctcccgcttgttacaccaggtaaagcgaggaccatggtatccatcgagaatctcgttaaaatcaccacaaagcatccacggtttgttgcgaaacatgggtgaatcgtggtgatgtctaatgtcttcccacaatattttcctctcctccacataatttgaagcataaataaaggagcaaaagaactcttcctcttttccctccaataaaactgaacaagtaatacaggagttaagcgaacacttgcactccacactacccaaatgcggcctaaacgatgtgatttgtagtaattagtcagtgaagaccaatcctgaaaagtagacgaaattatatctgatgatttgccctcattaactcgcgtttcgagaagaccaccaaactgcatagaactttgagataaccacttgcggacgatggaatgttttgaagatttatttagaccacggacattccaaaaaaaaaccgacatatgattacttctttttggtgacccggcgatctgaaacactctggttaccctttgtgttttgattgacggatcctttaacaaccttgtgcatagttttagaagctcgaggaaaagagggacgagtctcctgcgtacctaccacctctgaagagaccactagctcagctgattgcttagtaacaatctcacctttttcttggctctctaaatcgtcggtgtagtcttccaaagctaaaatcttattacattttaggccttgttaatacttgaaactaaatagtttgagtttggatcttgattaattttattatataaaatatgagttttaaaattagttactcgcataaccatgacacgtgttaagtttatcatttagatgttaatatgtgttagaaagttttactttcttcttaacaaaaaggaaaactacaaaaaagaaacatattcacatatactaattaaatgtctatatttacaaaatttaactttaatttttcttactaaacatgaaaactaacaataagagtttatataattaaattgtatttgtattgcaaaatagaattgtatttgaattttaataaaatcaaattaaatagtattttattatgataaataaataaatatatatatatatatatagtattagaaaatcaaatttgtaagactgaatatttttcaagaaaatattaaattaaatattgaaaaagtatatgagttgctatttaaaattcaaatattcaataaattagagtgtagaaaattaaaatacagtttattacgatgaaatggatacttaagatgtatagtaaaatttaatgtgtatgattggaatttttattaattcaagtttactaaattaaatattagaaaaagtgtgtaaatcactatttactattctaaaatttaaatattatctataaatctttgaatttatatcttacactcgcataccttatccagtactatataaatgatagttcttatggttatgttctaaatttctcttagaaatggacttgtacataagatctttttttggaaatcatgatgggcctctaggacagccactctaccgtcgtatccacttgggccagacatgcttatgcttaatgctgattccgagagattttaaattgataaatgtggaaaaagggtattcgaaaaaccttatcatagtttaggttcacatttcgtgtggtgattgaagaatgcctaataaatactttatatcattttaaaaaaatattaggagattctgtaccaaaacccgtaatcttcccagattagtacactacaacatttactaattttttcctaagcgacactcgaaccgacgatctctaagcttttcctaagattaccagttgatctaacgacacttggaagataaatactatgtctctaaaattttaaaccaaattattcattgcatatgataaccaatattttcttgataatgtgtaggattaaagattgagaaattattattattattattcttattttttattttattttagtttttgttaaagattgagtaattttttttttttgtatgattaaaaattgagtaatttagattgagaaattatctaaattaccattataagaaaattatgtttgaagagtttttgggtggtttaagaagggttcataattaggaagggtatcaaacgcaattctgtggcaatgttggatttttgctgtaatttttgaggaaagaaaaaacataacaaaaggtactattgaaaatcacttttaatatttgtcaagttctaataaaatctacataaattgatagaaatatccattatttagataaaaatataataaatcattaaatatttagatatttacaatcttacagaaataatcttctataaaaagcctctggaatcactaatgtaataacctattattcttaaaaatgtcagagaacaaacatttaaataaagaaaataaaaatactaatcaaaaacatctctcccgcctctgttttatttcaatctaagtaggaagaaatataaattaagcgatctttctctaaacaagatttgagcaagaatcatcatattcaagagatg

SEQ ID NO: 13641 - DNA, 3000 bp, Unknown; identical to SEQ ID NO: 13636
  misc_feature (1)..( 3000): cDNA_ID_1012546_gDNA_ID_2214641_Annot_ID_188317 3000 nt of promoter + ATG

SEQ ID NO: 13642 - DNA, 3000 bp, Unknown; identical to SEQ ID NO: 13635
  misc_feature (1)..( 3000): cDNA_ID_3031196_gDNA_ID_2214641_Annot_ID_188316 3000 nt of promoter + ATG

SEQ ID NO: 13643 - DNA, 3000 bp, Unknown
  misc_feature (1)..( 3000): cDNA_ID_2703629_gDNA_ID_2214641_Annot_ID_136248 3000 nt of promoter + ATG
tgtttagagaaagatcgcttaatttatatttcttcctacttagattgaaataaaacagaggcgggagagatgtttttgattagtatttttattttctttatttaaatgtttgttctctgacatttttaagaataataggttattacattagtgattccagaggctttttatagaagattatttctgtaagattgtaaatatctaaatatttaatgatttattatatttttatctaaataatggatatttctatcaatttatgtagattttattagaacttgacaaatattaaaagtgattttcaatagtaccttttgttatgttttttctttcctcaaaaattacagcaaaaatccaacattgccacagaattgcgtttgatacccttcctaattatgaacccttcttaaaccacccaaaaactcttcaaacataattttcttataatggtaatttagataatttctcaatctaaattactcaatttttaatcatacaaaaaaaaaaaattactcaatctttaacaaaaactaaaataaaataaaaaataagaataataataataataatttctcaatctttaatcctacacattatcaagaaaatattggttatcatatgcaatgaataatttggtttaaaattttagagacatagtatttatcttccaagtgtcgttagatcaactggtaatcttaggaaaagcttagagatcgtcggttcgagtgtcgcttaggaaaaaattagtaaatgttgtagtgtactaatctgggaagattacgggttttggtacagaatctcctaatatttttttaaaatgatataaagtatttattaggcattcttcaatcaccacacgaaatgtgaacctaaactatgataaggtttttcgaataccctttttccacatttatcaatttaaaatctctcggaatcagcattaagcataagcatgtctggcccaagtggatacgacggtagagtggctgtcctagaggcccatcatgatttccaaaaaaagatcttatgtacaagtccatttctaagagaaatttagaacataaccataagaactatcatttatatagtactggataaggtatgcgagtgtaagatataaattcaaagatttatagataatatttaaattttagaatagtaaatagtgatttacacactttttctaatatttaatttagtaaacttgaattaataaaaattccaatcatacacattaaattttactatacatcttaagtatccatttcatcgtaataaactgtattttaattttctacactctaatttattgaatatttgaattttaaatagcaactcatatactttttcaatatttaatttaatattttcttgaaaaatattcagtcttacaaatttgattttctaatactatatatatatatatatatttatttatttatcataataaaatactatttaatttgattttattaaaattcaaatacaattctattttgcaatacaaatacaatttaattatataaactcttattgttagttttcatgtttagtaagaaaaattaaagttaaattttgtaaatatagacatttaattagtatatgtgaatatgtttcttttttgtagttttcctttttgttaagaagaaagtaaaactttctaacacatattaacatctaaatgataaacttaacacgtgtcatggttatgcgagtaactaattttaaaactcatattttatataataaaattaatcaagatccaaactcaaactatttagtttcaagtattaacaaggcctaaaatgtaataagattttagctttggaagactacaccgacgatttagagagccaagaaaaaggtgagattgttactaagcaatcagctgagctagtggtctcttcagaggtggtaggtacgcaggagactcgtccctcttttcctcgagcttctaaaactatgcacaaggttgttaaaggatccgtcaatcaaaacacaaagggtaaccagagtgtttcagatcgccgggtcaccaaaaagaagtaatcatatgtcggtttttttttggaatgtccgtggtctaaataaatcttcaaaacattccatcgtccgcaagtggttatctcaaagttctatgcagtttggtggtcttctcgaaacgcgagttaatgagggcaaatcatcagatataatttcgtctacttttcaggattggtcttcactgactaattactacaaatcacatcgtttaggccgcatttgggtagtgtggagtgcaagtgttcgcttaactcctgtattacttgttcagttttattggagggaaaagaggaagagttcttttgctcctttatttatgcttcaaattatgtggaggagaggaaaatattgtgggaagacattagacatcaccacgattcacccatgtttcgcaacaaaccgtggatgctttgtggtgattttaacgagattctcgatggataccatggtcctcgctttacctggtgtaacaagcgggaggatggtttgatatgcaaaaaacttgatcgagttcttgttaatgattcatggtgtactactttcccgcactcttatagtgtttttgagtctggaggttgttttgatcatacaaggggaaggataatgcttgaggctgaagcgatagggggtcgcaagccgtttaaatttgttaatgtcctcacgacattacctcagtttttgcctgcggtagagagccactagaatgcttctgctcctttgtttatttctacttcagctttgcatagattcttaaagaagctaaagaccttaaagccgagcttgagaattatggggaaagagaaattaggggacttgccaaagcgcactcgtgaggctcatgaattgctctgtgaaaagcaaagtaacacactagttaacccgacgcagcaaattatcgcagaagagttgcaggcctataccgcttggcagcattgagcagatctggaagaaggctac

SEQ ID NO: 13644 - DNA, 3000 bp, Unknown; identical to SEQ ID NO: 13639
  misc_feature (1)..( 3000): cDNA_ID_2703637_gDNA_ID_2214641_Annot_ID_136251 3000 nt of promoter + ATG

SEQ ID NO: 13645 - DNA, 3000 bp, Unknown
  misc_feature (1)..( 3000): cDNA_ID_1012699_gDNA_ID_2214642_Annot_ID_136261 3000 nt of promoter + ATG
accaaattgatcattgaggattgagaaactactaaacacaagagaaagagagagtatgtgtgtgtgtttccttcacctgacgccaagaatgagagcagcttcccttttcgtcatcgtaggctggaaaccgccctcataaaatttcttaattttgggccttggtggccttgccttgaatgcttgccatgcttggattccatatctaccagcaagtgctgttgcagctactgcaacccccgctataaatggtgtcgcctggtgtaccaaaaacgcataacacaaaattaagcatttgtatatgctttattcttcttaccatcatcattctccaatgaatcaagctcacttgtcacagttttcaaaatctattgattaaaacttgcaaagaggactcatttctgctacagtaaatgacaaatacattgcaaacaagaatccaaagggacttaagacacactacattcatgaaagaagtattttgcagtcagttttaaatcttatcttaactaaacacaagactcttcaagatgagaaaagccaaggcagtgactcttcaaagattcatttccttatcaacaaaatgagccaagagagattcatatccaagaaagatcgatttagcttaagaaaatcattgaccagtattaaacacgattaacagagcactgattcatgatattataaaacttagaatccaaaagattcacagaacaagactcacaactaacggatgaaccctaatttctggaagagactattagtgttccgaattacgtaccattcagaaatctaggattcttcgtttcatccacagcttatttggatttgcgaagccgcagaggtggctgatgccgtcagagctctccgatcgctgcaaccaaaatgggaactcaatcaaaacctttgaggctgagctaaaccggttttaacgccaaccggttcaaaaccggttttataatttctcaatagaattagcaattggatcaaaccggtcttttcttatttgcatttttttgggtattagtgatgagaaggggaggaggtatccaagtatcttaaagagcttacaaacccaacaaaaatccacacccaaaaaaagagtataacaaaagaaacgaatttggattacaagttcttgaaagcagagtcatgagcatcctttggaggagtgagcctagccaacaatgccttgttagggcaatgatctgcatccacaaagtagaaattcccatcagccttgaagctcacatacggtctttgcgtgtctggataacgtatgtctgagaatttcagtgtctttgcgctaaatgtgccgagccaagtcatcatctcgacctcaaaagtgtctgaaccaggctgccacctcagcttgtgcacgtagggactaacaaaccagtggagagcagcggttgtggatgcgctaaggaagatcacagtagaggcaacagcacctttcatgatcacattcagtcccggggaagtcatgaaagtgatgaccgggccaagagagactgatagacagcaagtggagagtgagaggagtttcactttctttatggttgatgagattggtccatagtaaaccacacctccatccttctcttctttcttctcttggggtccgatgctgatcttgtgctcatcatcgtcctctctagtctttgctccaaatgatgcccagcttctctggctaagggatggaacctggaatctgaccttcgggttcactgatgatgaccatgatcctgctattgaccggtgatgatatcctgaaaagaaatgaccataggcttgatgaatctgtggtatctcgtgaccacatactactgcttcaaacaacagctaaggctcacaatgcttcaatgaagtggaaaaaccctaacttgccatttctcatccaaatgaagcacaaccccagtttcaaatccgtttgagaccaagactacatattgcctaaccaattgctaaaactcaaaatgctacaagtgaacgggaaaaaccctagcctgccatttctgatccagattaagctatggtatataatgctcaagtcaatttcaaatctatttcagcttatcggatgcaaagtactttcaccaatcaaatcgaaaagggaaaccaaaatcacgagagtggtttgagaaaatggatatacaaaacccataaagacaatatatagcagccatttctactctaaagccgtaaggattgagcttttcccgtaaattgtataaacaccatgatcggacttgtttcccggaaaatgaaaggtgtatagtggagaaaaaaagaacctgaagtgaaggtggaggaagagagacgtcgggattgggagcgaagcaagtgaatcagagctgatcttcccatcgccgtttctgttgcgagattgcaaagattcaggtctcctcctccaaatgaatgttgtagggttttagagattttattttcctttatatattaataaaacttgtagctttataaatttcttttagtggtctagtggttactgtttctctcttcaagcatgaagtctcgtgttcgaactttttttctttgaccttgataacacttgcacacctttttttttttttttttttttatcttcaacacctaatggacaaaattttatttttgtgtattgttttatgtctctctacaaaatcacatgactgattgaggaatttggatccgaaacgatgactagagtctagatatgacatgtattaagggataaccattagttactcgagttgtttagctaagtaagagtccgtgtacgtttttcggtttcttattggctcttcgaatcaaaaatagatgatgatacaatgtaacataggcaaggacaaagtcatcgttgtaaataaagtcaatgatgtaagaaatacaaatataaccgccatttattaatctcacttactctgtccccaccatcactcactgattttattatcatcaaaaacattgagatcttcacccttatcatttgatccaaccatg

SEQ ID NO: 13646 - DNA, 3000 bp, Unknown
  misc_feature (1)..( 3000): cDNA_ID_2713944_gDNA_ID_2214642_Annot_ID_136262 3000 nt of promoter + ATG
acattggcaatggcttgttgtcgagaaacgactgaaaaagaagaaaagctcgacgagggcggaaaagaggtacctcatgtcctgctccatgtattgtcaccagagtcagccctttgtaaacttggctccatccaccaacctgttctttcagtactcatgcattagtttccacagaagaaagaaatgagactgaggaaactgagtattgagttgtttttttctacctgtccatcatcgttccaagggtaccatttggagagtggttgtaacttgagggctctaatggagtatcgtgttccagtaatgggaaccactgaatcagtgtctccgctgcatccaaatttacagaacaagatatcaatcatgataccaaaccgggatgtacaagatgatgatcaaaaggagaagtagatatacctgaaaacccatatcctgagacctgcggcgatgagttctttgtagattggaagcatagacagaggagaatctgcccatttctctccaacgatgtcactaaacaagaaaactatgtcactgaaaatgaaccacaagagaacattttcttaaatttgttgacccactataatgtgttttttacctgcaccctttccatggataagctagtcctgttatattagcatgcatagccttttgaacctccggagaattgaaatacatgccggagtatttctctgtgcaagggtcataggctctccacatccatggcttagataaacaaaaaacgtagcaagtttagagatttgtcaaatcttgttacctatggactatgtcttggtagaataacttgaatctatagaagcagccataaagcaaatcaagtaatcaactcagacaatgaattggaatcaagtagcagagagaatccgaaagatttttttgcagtccagaatccagatatcatgtaatccccactctactttcttggactaaccaaagtacatctacttgttgaaataggctcatatattggtcattttgaatctggtagcacaaagagagggtctaatacactagatacgtagccaattctgcatataaaggtttgactttcatgttctgtctctagtaaagttggaacctcctaatgaccaaaactaccttactcgagctggtaatagtagttaaaggaatatgatgggcagtgatggaaaactcacatgacgaactctcgagaagcgagacctaagagctgcagcctcctttttacaagtgacagtgtaaatgctataaggatcaatattgccttgctccaagtctgcagcttccatggccttggtgcatttagaggacgggtgctcggatgatccaaattcacacgtgatccgtaagttgtggtaagtgagatcagatatcaacccatgagcccaccaatattcaaataaacccacgtaatcatggtagtcatcaatcacagcattcccaacctagaaacaaactcacgtttataccaacacaaaaagaacatgttaatagatttgtgcttctttttttcttgcttacaatgaagcctttaaagttgatagctggattgcgtttctcataaacaatctgtgacaactgaggaacataatgacctaaagaagaaaagtgaaaatgcttagctaagacaaagtttccaattgaatagaatcagtaataacaataacctgcatagctttctccagcaatgtagaactctctgtgtttgtattgaggaaacctctcaaaccatttcacaagaaacacataagcatcttccgctagaaaaaatcaaaccaaaatcatcaaatgattgataaatctagagaaagagaagtcaaaggtcaagactttaccagttctctgatctccggcagtatacaaatcggaggtagtattcgaatacgagaaaccaacaccagcaggagattcaaggaagagcaaattcgccactgacccaatataaagagtgttaatttaaggattgtgaaatcaaaatttggagagaaatggagaaacagagagagatgtacatttgttccaagagtaaggattgtggtaaagagttttgccatcaggattgattctaaaaggtccgatttcttcagcggcaccgtaagctacggaggaacaaccaggtccaccgttgagccagaggacaagaggcttagactcagggttttcactcggtggtgactcagtgagccagtagaatagtgctcttcctgctgactcgttgacggtaatgtaaccagagaagtgagagaaggagacatcgtttggttcaccgggaaggtgaaagattcggtctttttcttgttcgtgtctggaacaagaagcgtaatggagtagaataaggaagaagaagaagaggagaaggagtcgagccatggttggatcaaatgataagggtgaagatctcaatgtttttgatgataataaaatcagtgagtgatggtggggacagagtaagtgagattaataaatggcggttatatttgtatttcttacatcattgactttatttacaacgatgactttgtccttgcctatgttacattgtatcatcatctatttttgattcgaagagccaataagaaaccgaaaaacgtacacggactcttacttagctaaacaactcgagtaactaatggttatcccttaatacatgtcatatctagactctagtcatcgtttcggatccaaattcctcaatcagtcatgtgattttgtagagagacataaaacaatacacaaaaataaaattttgtccattaggtgttgaagataaaaaaaaaaaaaaaaaaaaaggtgtgcaagtgttatcaaggtcaaagaaaaaaagttcgaacacgagacttcatgcttgaagagagaaacagtaaccactagaccactaaaagaaatttataaagctacaagttttattaatatataaaggaaaataaaatctctaaaaccctacaacattcatttggaggaggagacctgaatctttgcaatctcgcaacagaaacggcg

SEQ ID NO: 13647 - DNA, 3000 bp, Unknown
  misc_feature (1)..( 3000): cDNA_ID_2703684_gDNA_ID_2214642_Annot_ID_136263 3000 nt of promoter + ATG
gcaaagactagagaggacgatgatgagcacaagatcagcatcggaccccaagagaagaaagaagagaaggatggaggtgtggtttactatggaccaatctcatcaaccataaagaaagtgaaactcctctcactctccacttgctgtctatcagtctctcttggcccggtcatcactttcatgacttccccgggactgaatgtgatcatgaaaggtgctgttgcctctactgtgatcttccttagcgcatccacaaccgctgctctccactggtttgttagtccctacgtgcacaagctgaggtggcagcctggttcagacacttttgaggtcgagatgatgacttggctcggcacatttagcgcaaagacactgaaattctcagacatacgttatccagacacgcaaagaccgtatgtgagcttcaaggctgatgggaatttctactttgtggatgcagatcattgccctaacaaggcattgttggctaggctcactcctccaaaggatgctcatgactctgctttcaagaacttgtaatccaaattcgtttcttttgttatactctttttttgggtgtggatttttgttgggtttgtaagctctttaagatacttggatacctcctccccttctcatcactaatacccaaaaaaatgcaaataagaaaagaccggtttgatccaattgctaattctattgagaaattataaaaccggttttgaaccggttggcgttaaaaccggtttagctcagcctcaaaggttttgattgagttcccattttggttgcagcgatcggagagctctgacggcatcagccacctctgcggcttcgcaaatccaaataagctgtggatgaaacgaagaatcctagatttctgaatggtacgtaattcggaacactaatagtctcttccagaaattagggttcatccgttagttgtgagtcttgttctgtgaatcttttggattctaagttttataatatcatgaatcagtgctctgttaatcgtgtttaatactggtcaatgattttcttaagctaaatcgatctttcttggatatgaatctctcttggctcattttgttgataaggaaatgaatctttgaagagtcactgccttggcttttctcatcttgaagagtcttgtgtttagttaagataagatttaaaactgactgcaaaatacttctttcatgaatgtagtgtgtcttaagtccctttggattcttgtttgcaatgtatttgtcatttactgtagcagaaatgagtcctctttgcaagttttaatcaatagattttgaaaactgtgacaagtgagcttgattcattggagaatgatgatggtaagaagaataaagcatatacaaatgcttaattttgtgttatgcgtttttggtacaccaggcgacaccatttatagcgggggttgcagtagctgcaacagcacttgctggtagatatggaatccaagcatggcaagcattcaaggcaaggccaccaaggcccaaaattaagaaattttatgagggcggtttccagcctacgatgacgaaaagggaagctgctctcattcttggcgtcaggtgaaggaaacacacacacatactctctctttctcttgtgtttagtagtttctcaatcctcaatgatcaatttggttatagcattagcatagtttccattgaagaaagtgtaacgttgtttgaaatgtggggttttgtgattgaaaacacagggagagtgtagcggcggaaaaggtgaaggaagcacacaggaaggtaatggtagcaaaccatccagatgcaggtggtagccatttcctagcctctaagatcaatgaagctaaagacgtgatgctaggcaaaactaaaaacagcggatccgctttttgatgcaaatttcaatcaaaagacttccttatgaatcatcttatgttataggactgtaatgtcaaaatgcagattttatgctaatttataagcttgtggtctgtttgtgacacataaagactcgaatcttttctttcacttgttgtcgctgaaaagaacacaaaaataaaaacgcaaagcagaagggcgttctagtcttttcggttttaaaaaaatccagtaatagaaactctagtacacgtgtcatgtggctccagcgacgtcttacgtcaacctctatccattcattcccctattagcaactccctccacaaaactatttttaattttattttttattggcaaaacaaatctattatttaatccttgtttttttttttaattattcgacaatcgaccgtctaattatcttttaattatcattagctcttgctaaaggcaaaatcgactcatttttcttgttttaatgtgaagttttaatcgcttataaaagcctaaaactggattatgattaatgagacccggtcatgatttatccactacatgaaagaaaatacgtaaatatagtactagtattaatttattaattattattattatctgttataatatccatgtctttatcttcttctaattttcattttcattttacgtttttttaaaaaggcaaaaaaaaaaaaaaaaaaaggagaaagaaagaagaagaagggaactaaagagggtcatcatcatttcatggttacctcctcttcctctcttcttactctcaccatatctgctctctctctctctctgtttcaagcttttgctcccatttttcatttccttcgtattctcgctcgagcttagcggttgatgtaccaatgaccaaatcgatatttgaatcgccgtggctacctttctttttcttctgatttctctatctctcgcttgattctaccacttttagggtttctattattcccagggactttgggtttctttaagaagttcgattcgtctccgttttctttttagggttaacgaagtctgtggtgttggatttcgatctttttttttttggtatcttccccattgactgttgcggtgataagagagtgacgca

SEQ ID NO: 13648 - DNA, 3000 bp, Unknown
  misc_feature (1)..( 3000): cDNA_ID_2713942_gDNA_ID_2214642_Annot_ID_136264 3000 nt of promoter + ATG
ctggtactcttaagaaaagtgagatattggcatcactaaataacgcaggacttcctgctaatgaagaaaatgctatagccatgatgagatttttgaaggctgataccgaggagtctatctcatacggacatttccgtaatttcatggttttgctgccatatgagcgcttacaagatgatcctcggtaagtatagtactttgttttgaaataaaattgatgttttattttgtagcggcttgtctttgcactaatgagtaaaatgccaatttgaccactagaactgtttggattgaaccggaccagtttccccttagtttctcccattcatgttgatttcctcaaacacttcaaacttataatttttgttgtcataccaatggtgattgatgctatttttacttgtatagtaacatctggtttgaagctgcgactgttgttgctgttgcaccccctgtggccttacctgctggagatgttctaaaatctgcattagcgggagggcttgcctctgctctctccacttccttaatgcatccgattgacacaatcaaggtgagtcctcttggtgcttttgcaagctgaatataagtaaatgctctgtttagacaagtttaggtgagaacttggctactacaaaagtctgcgtaattgacatctgcttctacaatatttgaatatttaaatagatgagtatgccaattattcctcctggcttcttgtggcatactgttgacggattcgttatcactttcatgccagacacgtgtgcaagcatcaaccttgtcatttcctgaagtaatagccaagcttccagagattggtgtccggggagtgtataggggttctattccagcaattcttggacaattttcaaggtcttttcagttgtttcaaatcaaagatattttcacttctacctattaaatttgatttccatgtggcttaatctctttcatcattgtagccatggcctgcggacaggaatattcgaagcaagcaaacttgtgttgatcaattttgctcccaatctcccagaaattcaggtgattatcactctctactcactgtttggctggtttcgtcaagattctaattttgtgcttcaagtatatgtattattatgtgttcttatagttcatggcatctagtaagtaaaccatatgttagaggaaaaatccaatatcaaggctatttcattgcagtacttagcttccttgatgcaatggttgacatggtagttggtagatcattgtatactactatttgttgcatctccttggttctaaagttctagtagttatgtaaagtttatggctagaataatatacacttgatgctgctggggctaaatggtctcttaattgcttggtttgataaagttgtgtatggtttctgaagtagaacccatccgcttttggttaacagttacatcgtttgcatttgtgctttctgatctgtgttttgtactcggtaaccaatgtgatcatttaatgcaggttcaatcgattgcatcattctgcagcacactattaggcacagctgtgcggattccatgtgaggtgctgaagcaacggttgcaggctggcatgtttaacaatgtaggggaagccattgtcgggacgtggaagcaagatggtccaagtggctttttccgtgggacaggcgcaactctttgccgcgaagttccactatacgttgttggcatgggactgtatgcagagtccaaaaaggtaagaaaaccgaaatgattggattatcataagggtcactactgtaattgttatattgattggggtttatgtgtgtattgtagatggtggcgcaagctctgggaagagaactggaggcatgggagacaatagcggttggggcggtgtcaggaggtattgcagcagttgtaacaaccccatttgatgtgatgaagacgagaatgatgactgcaacgccagggagaccgatctcaatgtctatggttgttgtatcgattctgcgtaatgagggaccgctaggtttgttcaaaggagcagtcccgaggttcttctgggtggctcctctaggtgctatgaactttgctgggtacgaactagccaagaaagctatgcagaagaacgaagatgcagtgctagcggatcagcttggtcagaagaagctttgctaatgggattttactttgctttgctgctacgaagttttttgggggcagcttaagccggagactcacctcttttgttaaaagctactttgcaaaattttgacaaaaaaaaaagggttcattgttttgttgtgcattgaggacagtttcatttactctttataaaaactctgcttcaaaaatgtgattttttgccctctctacaattggttgttgctttgacagttgcaattacttcaatggtatacagtagccttaaatcgccatattacgaatcttaaggtaaattcgttgcttctttttgtcaccaaacataagagacattggcaaatgttggtaaaaagaaataacgttgtgaatgtaatacactcaaaccaaatgattctgtcaatacaaaagcaactctgtaaacgtaacatgagaaactcaacaattcacatatgttttacaaaatctactttctgtggtattcctgaccaaagcatcaaacttgggctcgtattcaggagttattttgtccacgtacttggggatctaaatgcctgcagtaataagagattccaactttggtacttcaacacgtttcttctctcaatcctcctcacaacttcagtagtaaaaaagacaatcactttgaagggaaacacaaatgaaatgactgtcgaattcagtcaccggtaaacacccttatatgttctgttattttctttttagtcccatactttttttaaattcacaacaaaacccattattggagttttctgattatttttaaaaacagtttcgagtgaataaaaaagctcagatgcaatcatcactttcattttcttgtggtgtcaagtcaacg

SEQ ID NO: 13649 - DNA, 3000 bp, Unknown
  misc_feature (1)..( 3000): cDNA_ID_2703702_gDNA_ID_2214642_Annot_ID_136266 3000 nt of promoter + ATG
ggtcccaacgacgctcaattggatctctctaaaggaatcccacggtactctttcccgattctctaaaactcagattctttgttaatctgcgtttaaattccacatctttgacgctaatttatcattctatgtgatatgtgttggtgttggttccaaaaatagttgtattgattagttccaagttgtgagatttataacaaagtcctagcttttaggttaataggtttcagattggtttgttctcaatgtgtgatataatttcgtggcaggctctatatacttaggctgaaagaaacacccttagggtttttcaagatcacgcatcacgcaaaggtgacacagtgtctaggatcaataggaggtgatatttggtatatgggagtggctaagccatctcttattgaagatgatgatgatggaaggagagtagatacagtaaaagcaaagtctggtcacttgtacattccacctgaggtggaagagattcgcgtcttcaggttctcgggaccaaagtttgtgaaactgcaccgtggtacatggcatgctggacccttgtttagtggcagctccatcatggatttctacaacttagaactcagcaacacaaatgtgagtcagtgagtgatggttttaaattgttaatacaatgtagtgtgatgaatgacttgacaacattgttgctgttgatgatgttgttcaggtggtggatcacacgtcacatgatttcacgaagaataatggagtcagcttccgctttgacacctaagaagaataatggagtcaatcctatcatgagtgtgcttctgtttttccttgtgtgtaatgtaattgactaattgccaataccaatactgtgtattgtgtactgtgcacacaaattggttatatgcaataaaataccggtttaagttaaccaaccctggttcataaaatcctaataattcttgaattggttttctaaaaaaagaaagcaaatcatgaatactaaagaaatttgattacatcatttggtgtttctagtaatctgctctgttgccagttataaagtagtatatttaattattaagcattattaaaacgaataatacgtataatataatcgtagccgttggatataattacacgtgcgactatctttcgatcgcactaaaagcaaaggaaaggctaaaaagaagctcgagggtcgagatcgatcaaaattgtaaatcaatcataacacattttaactagctctaacacaaactctaaaattttagattaattcagacttggtaacaattttgacttaactacgagcgtcattaccattctatgcatcgttttacacgaattacactcacatctcaaagatacatgtccacatgctacgtaccgagtatcgaccacacccgataaacaacgggacaagccctagaatcccgaaaaggcaaaaaggtcccttgttttctctcttttttcatgttaaacacatactttttaaattaacaagaaagcccagatatttttggtgttttcttactgaatctagacttgaagagaattttaggaaaactccaaaaagctcgtacgctaattcttatcttcacttccatttttcctgtggtgatggtgagagttcaagtgttccaacgatggcgaaatccccggtagaggtgaaactgatcccgatcgaagctactcctgagaatttcgcagactatggtcaagtcatcgaagcctctcgtgacggtgcaggtttcggtcccaacgacgctcaactggatctctccagaggaatcccacggtactctttatccagtttactaaaatttcgttaatacctaagattattgattaaaacacatgcttcttctaatcatattcgttgttgattaatgtctaaattcctcatctttgatgctaatttatcaatcaagctatgtgatttgtattggttcctagatagtcgtgttgatcagttcctaataacaaaagacttatagattttgtaggaacgtacttatttactacaaaattcaacaaaacgaaagaccaattcaaactagactcttcttactacttcaagtaattaactgacttcatttacaagtcctagcattaggtttcagatttgtttgttcttttttttttttacaattagctaatcatcatattctcattatgtttaatacttgggacaggttctatataatgcggatcagagatacaccctttgacttttccgtactcactcaccacgcgagcgtgacacagtgtctaggatcaataggaggtcatgtttggtaccttggagtggctaaaccgacacttattgaagatggtgatgatggaaagatggtagataaattgaaatcaaggtctggtcacttgtacgctcctcctgcggttgaagagattcgcgtcttcagggtctcgggaccaaagtttattaaactgaaccacggtacgtggcatgttggaccactcttcagtgacagctacatggacttctacaaccttgagctcagcaacacaaatgtgagtgagaatggttttattgttaataatgtatggaatggtgatgaatgacttgtttttattgacgacattgttgttgttgatgatgatgttcaggcggtggatcgcacgacatatgatttcatcaaaaataaaggagtcaccatccgagttgaccccaacgatgttgacacatcgtcctcctaactcaatcttatcatcagtgtgtgcttctgttttcatgaataaattgagcaatcgtgaataaaatttgtatgcaactgtgtacaaattgttttttttttttttttttttttttcaataaatatcgaaaatacttgttttctcatattttcatgttaatcccatacttttaaaattgacaagaaaacctaaatatactttggtgtcttctgattgattttaaaaacattttgagtggatacaaaaagagctcaagatacaatcctctttatttttattttcttgtggtgcgtttcaacg

SEQ ID NO: 13650 - DNA, 3000 bp, Unknown
  misc_feature (1)..( 3000): cDNA_ID_3031275_gDNA_ID_2214642_Annot_ID_188361 3000 nt of promoter + ATG
ttctgttattaaagacattgacagaatatttatatgaagactgcgtgagagtgtgagactaatttcggagaggtttgtaagaaaaaagtttacaaaaacatatgcgaatatttaatatatattttactcattttcggcccataactttttttgggcccaaatacctttctatagatattaataaataatgaaatttagtgaaacacatgaaatatgttgcgactatcggagccaaattcatgagtcaaaagttgaaaaacacaacaaatttgaattcattatttaaaactgaggcccagaatctaataaaatttccgattttgttacccaaattactcattttaagcttcccttcaacatcactttgtttaggcccaacgcaacaacccttttttaaattataaaaaataaaattctattgtccaaaaagaaaaacaataataagaaaaaagttctttacagagaggttttttcatgggtaaactattgattgaatgttaaggtcatgtaaaaacaaaaaggtttggtaggaatataatcaactattaagtcctcgaaatatatgttcagaagttgtccacttcaacaacttccacactgtatttaacgactaccttatttgaatgtgtaacgtttaagcccttcttcttacttacagcaacagtctgtacaagaacaaaccagctctaaccggactggtttgctttttcatacctgaaccagattagttatggtgcttatcagatagataaacggaatactagttagtatacatcatgttgcattctacaatcattttaattgactatattatcgatatgcagaaacggcatgaaatgctttaatttgtgacatttccttgaaatattgaaacacttatgtaatgaaaataaaaaggaagttcttaaactattttaaaattgctagaagagctttagatgcattgtacctagcaattacaattgttagtcgtaaagtaagatcacattgtttaatatatctaaaaagagtgtggtcaaatgaattagtgaattactttgtatgagtatagaataatatattagtttcatacacgcatgctccattcatgcatatatggtggtaatatcttttaaaccgtgttatattttgcgtcggtggcattagttgttgaagctccacactgctgatcacttgcagttttgcacccatgcatatccctgatgtgatacgttttgccattgatcgatctctactaaactaattcctttatcaaaatttcatcccaatgtatgtaacatcatcatacctcattaagtacctcctaaggaaatgactgctcctaagagaaatccgtttcttgtcgattttttcataagtttttttatatgttgatggtatacttctacaaattttctattgatagataattctgaagtagatgttattgacatgttacgttgagaattggaaatttttgagtgggagtcgagtaatatgtatgatttgattaattaatcatacaatttttactaaagcatgagtaaattcctgtcagaaactcaataatacgagacgcgatttaacaatgatcgatacacaaattatatttttacgtcaaatttatatatgaagaagatgtttctcataataatcaaatatattccagtttttaagactttgacttttagatagagagccattgacaattatatcatgcatgattcacgtcgtcaaagtaagtatgaaaaaccacgaaaaacgatttaacgaaatgtcaatattcaaacaattgtagaagagcctagaaaaaagttgaacataattatatagttcgtttgggtccaagaggaccgttaatggcatttaattaggttttgtcggtaacaaaagaagaaataatcaaaagagaacaacgttttttaatttaattagaagtaagaggctacccataacttataactgcgatcgtggaaaatgtaaacgaagtataggatgatgaaattgaaaatttgggtcacccacccatatcgcaggggcaaagaagaagaactttaaaaagatgcttcgtcatcaagtcaaactaataagtttaaccgagaaaaatgtgaagaatcaaatcctgatagccggttgttccgtcgtcggtcgaatgatctaaataatgtaattgtctaacagagattgattttatcgtgtcggcatgctcagttctgcctaaaacacaagagcattaatgcattttattatacgaaacaaaggcaagcaaaataatgtcaaaacaaatattaaagactgttgattataagaatatatccgaataacgacttattttgaagcgttggttccagataactcttactctactctttatatcaattgtcaatacaaagcaatgaaaaaactatttaggcaacgaagcagacgactaaaaacaaaagagttctaatcaaacaaaaaataaactccaaagccaaccagagagagcagtatagcaatgtaaaacataaataaaacaaatatgttactgaaaaatcatgttttctgatacttgaaaaaaagaaagatcaaatcatataaaaatcatttttaactttttattatttatatatagagctgtctccacataattactattattccaaaaataattgttcaaattttatgtaaacaaacgtcatcaaactattccatgaataaaattgttcaaattatgtctattcgcttacgttaaatatgtaacaatatgttacatgtatgatacatcagaaacgaaacgacgacaacaatctcgtggtaacaatgtaaatgatagtgaattagtgatgaggagccaactataaagatttatcatatcgtggaaaatactttaataagaaattgtatgctaatgtttatgtataatttctgaaaataattaacaaaaataaaaggagatatttttttaaataacaaagtgattttgaaaaataaagagaggataataccattttggcaaaattgtatattgtgatattcatg

SEQ ID NO: 13651 - DNA, 3000 bp, Unknown
  misc_feature (1)..( 3000): cDNA_ID_3031279_gDNA_ID_2214642_Annot_ID_188360 3000 nt of promoter + ATG
gagacaaaaacaatcgttttcaagtgttttttttcttcttgatttatatctcttaatcaacgttttatatcttttcttaaggtcctcataaaagtctttttctcatatcatcatatgtattggctaacggtttacccaataagacaaatacgctgttaaatatctggttttgtttaacaaaaaaaaaattgctaataaataaaccatatgattgagaaagattgtcagactgactatcaaaaacgcctaattgattcgatcccattatcttaagttccaacttgtcctcaaactcttttttttttctttgacgtctcaatatttaaaatgatctctcaaagttcaatacaagccaagaaacatatttgccaatattcaaaacgactttaattactctttcttggtacgtatgtatagataaactcgttcacattgcttaaagaaaaactaatccaacaaaattgtgaaaaattcatccttaacctcctttctcttacaaatcttcggcttcgaagagtgtatatacagtgatcagttagtgaccaaaaataacaaatttacaaggaattaaaagaagaattaataacgagtttaagccggagattagtcaagatttcgatttcttcggttataaaataaacaaatcactaggacattcttgtggcggccacggaggaggctaaagggacaacctcggcgaggggagtagacagaggagttggaagcggcgaagtccgacacacaggacacgtaggattgagtctaagccacgtgtcgatacatttaaggtggaagagatggttgcaatctggtagctgccgcagcagatgttttcccttgtagtctcctaaacaaatggcacaacacgacgccgttgttggtccctttgcttccgagtagagaatctttggatagctttgaatggtgtcctcgtcaagaccggggacaacgtcgatgatgacatggtggtgatggtgatggatacgtgttgaatcttggttggtttgtgaaggtgaagaagagagctggttacgtgtgcaatagtatgaggtgagggtgatggtggtgatgaggaggaggaccccgatggagacaccgattccgtatcgaaatcctcctatgtcgtccgtgccgaggaggccgttgtagtccggcatctcggacggtggcggtggttggaaattgttcatggcgggtttggtttgatggttttgtttaatgggtttgggaggaggaagaggagaaataatggagaggtttttggtcagcgatttgatataagacaatgtaaattgaagcatcttggggttatcaaaagtcaacgctaagagagagagagagacaaagggaggaaatgcatgtgaatgaggataagaaagcttgtcaaagcaaagcaagaattgtgtgacttgtggatggttaaaaaaatattcaatgtataaattttctaatattgtattggtaatactgtaatagtataacgcatatataaatatattgacccattaattcgttgtttatttcaaacataaaacacttagttgcacaattgaattggatacagggctaatgaatttaacgtgtgacatgtattaagatttgatttaggaatgtagggaggggccagtggctaagattagagaaggtttacgctgaattagtttgaagtcaacgttgtacttatatactaatcttgttgtttatgtacgtttagttatctcctttattcaggcttatttaagtccaatcatgtcacctaagcaacgtttagtttccttcacttgcttttaaagtcgcagtgttatcttattttagtattagaatatttaaaactttgaaatctctccatattagaagattaatataaagttttgtttttctcctaaaagtggcaagacaataaaataaaatataattgtaggtaaataatttgtatatactaggaaatccaaatttaaccaattgagtcgtgggcattaacatttgtattacataaaattatattttggcaaactaccataggataaaaatcattcacttaacggccaagttactaacacaaggcatctttgataatggaaaacaatctgttggacagttgttattaatgaagaaaatgcgtcattgcatgctcgcatgatgtatattttaatatacactagctatgatagtatataaacagatatacatgtaattaagaatggagataaatgaacgtatattatccaggggcggattcatttggtgaagaatgaatgtattcagtgaattttaattgatattcgaatacaccattgttattgaacacttaattattgccgccgctcttccaatttttcaattctttttttccccaatcagtagagtaactatgggcttttaaaacccatagctccggattcccaatcatatattctatagtctatgtcatctaaaacaatatgaatttagataaacaatttatgaccttcaagccatatatttgggccggatactcaaaacatatgaaattacactcaaacactaattgagctacttaggccaaatatataaaggaaacacttactactaggcataaaaagtttggaagaaataataagagagaaaaaaatgttataatcctgacattgtttttttattgttaactcactcttggaataagttgtccaagtctcatagttgactcagtttggtggtgtcacaaattagttccatcattactaatttgctatcagtttggtgatgtatcaaatactgttgatctagtaatttcacaaaaagcgcatatcttccggctaatgatattagatttactcatatgtgtaatgtgtatgtatggttgaaagttgaagctaaattaggtttaagtcactcatatcatatgtgtgtgttatcttgtatagtgtaatacaaaattcaatacaaaattttccaataagcaaaaatagtcgtcagtgcgagttcaactttaaactgtttcaaactttatattcattacga

SEQ ID NO: 13652 - DNA, 3000 bp, Unknown
  misc_feature (1)..( 3000): cDNA_ID_3031294_gDNA_ID_2214642_Annot_ID_188354 3000 nt of promoter + ATG
tcgaacctcctactaaggaaagaaagaaaaagaaaaagaaagtgagctttgcagaagatatggtggagccgtcagggaacaacgaagagtatcgccggagttttcgcaaatcatcaaagttggaggatgaaagatgaagtcaacattcaacacatgaatttttctgtgtatttgttttccttatttggtaaatattaagtgtacaccgctcttcacaaaattaggagctagaccggaccacataccccattccatgtctttttttttttattatgccaagttgtcaatggacgtagatgtagatgtgttgttgatgttctcattcgtatctcgagtagcgtataattagtaccagccaaaattggtacactagcgtattaattagaaccagccaaaagaaagattcaagatgacgtagtacttgggcttttggtataaagcccaggcagatttggagtttacatttttggggagaacatatatttagcttcttttttgtttttttctccaacaacatgcattggttaaaatatggattatgacttacaacgatagtaatacaaatcctggtcgattaacaatctaatagtcgatcaatcatcactgctagaaacagtgccgcctaacagtacccctgaaaccataaatgggtttctagttaggtaaacaatataaattagtaactacaacataccaatgtaaggacgtgaatttatatttgtcctatcaatctttaattttataagaatgaattagtatgaatcaatggtaaattaattgcagggatactttgattaataatgtcatattacaagatcttcataatatctcgaatggccatgcatctcgcatctaccctaaaagtttatatacaatgcatgctttttctcaattattgtcaaatttatattctttctctaatagaaaaaaaccttttaaatcaccaattgacttttcttttcgaaataatggaatcatatatattgacacctaataaattaaaatgattaagaaaaacttaatagtgaagaattccgtttctgttacgagtgaggaggagctctatggccaaatttaatatcaagaaattgaaaatattaaaatgaataccaataaatgtttttcttctctatataatgttggtgggactgactgggaacggagcttcgaatcaaagaagaaagccaactaccaaagacagtgtcggttcgacggcgatggcaaatctaacggcaggagaaacgtcgccgtttcagatcatttattaacgtcgaaaacgagttttattaaaaaaattattttatttgatccaaaacgagatttatttttatattatcaaatcatacgttacgactttttacgcgctttttcaccacacgtaccattagcaaatcatacgttatgacttttgcgtaaaaggtaaaaacttgttttacatctgtctcacaaaacttgtaacttgtatattcattttattgatcaagtagatgtagatccccatcacaagatgtgtgttttattcattatgacgacatatttatgtgtgatatataggataaaaagataaaattagatttatgttggatgtatttgtcttaagtcttttaaacaaagattcttgaaaaatgacacaatgttagatcaaaagttttaatcgatacatttagactaaagacatcttaccttccttcactggttttcttacaatgatttcaatatgtagtaaaataaaatgtgttgtttattgctatatgagactcatgggtctagaaagtataaactataagtcatttggataggggtttctctataatttcacccacgaaaatggattacaatgtaacttcatttcataaacacttttaacaatgctataacattcgactatgtttatcaccgaagattcacttattaggctttcttctagtacatccagagaaaacttcgcatgtgttcgactggagcaatttaaaaatgaatgattttaagctaagtaaatgatttttagtatcttgagaatatggacaaacaaacaaaaagtttgtaaagaatgacaaagaggaaacccatgaaaaaaagatacaatatatggaagctcacagacgatgacggcatgagagttattatgacatacaaaccaatcgataaatctttaacaatttactgaaatatttgactaataatcttttggttttggaataatgaaccgatcgaccgtcatataaaatataaatgattggatccacgtacgttggtggccgagcctctgaaaacgaatttgatttatctattttgctaactaatcacctaacgtagtttttgtgtctcaatggttgtacaaaagataaagtctcaagaatttattaacaaaagaagtggccacgaagaatggaattttgttgtatcaatgaagcataagtagtaccatagtattttaaaattcgaaatgcaaatcaaatttcaacgtgacaacatatgttgtataatagttaatcatagtaaatagcacacattgcagctaataattggatttacaattgtttgagtcgtacgttttgatctgttgtttacaagaaaaaatacaaagatggaaagttctaacttcaagtgaagttcagatatcgaccgagtcagaacacgacacgaggctcgaagacagaggcatagtgctgagttgttcaacagaagcaagtaaaaaccttttgtctgagagagaggctccgagttaggcataagccaaacaacttgacacgacacataacctttgcttctcgtgtagacccaactttttacccttaccaaaaatataaaataaaatatgcaaaaaacacacccactcaaaaattaaaattttaatgaaagaaagaagaaacttcacatcagcatcagaatctctctttctctctctctccttcttcacaagcaaaaaaacaccaaaccatttttctttcttcattgtgccgacacttctttcccctctctctctctctctccaccgcc

SEQ ID NO: 13653 - DNA, 3000 bp, Unknown; identical to SEQ ID NO: 13649
  misc_feature (1)..( 3000): cDNA_ID_3031298_gDNA_ID_2214642_Annot_ID_188352 3000 nt of promoter + ATG

SEQ ID NO: 13654 - DNA, 3000 bp, Unknown; identical to SEQ ID NO: 13648
  misc_feature (1)..( 3000): cDNA_ID_3031222_gDNA_ID_2214642_Annot_ID_188350 3000 nt of promoter + ATG

SEQ ID NO: 13655 - DNA, 3000 bp, Unknown; identical to SEQ ID NO: 13647
  misc_feature (1)..( 3000): cDNA_ID_3031302_gDNA_ID_2214642_Annot_ID_188349 3000 nt of promoter + ATG

SEQ ID NO: 13656 - DNA, 3000 bp, Unknown; identical to SEQ ID NO: 13646
  misc_feature (1)..( 3000): cDNA_ID_3031306_gDNA_ID_2214642_Annot_ID_188347 3000 nt of promoter + ATG

SEQ ID NO: 13657 - DNA, 3000 bp, Unknown; identical to SEQ ID NO: 13645
  misc_feature (1)..( 3000): cDNA_ID_1012699_gDNA_ID_2214642_Annot_ID_188346 3000 nt of promoter + ATG

SEQ ID NO: 13658 - DNA, 714 bp, Unknown
  misc_feature (1)..( 714): cDNA_ID_2713919_gDNA_ID_2214642_Annot_ID_188377 3000 nt of promoter + ATG
ttgaggaacaaacatctccttggtctagtagaatagtttgagaatccttttcctcgaccaccatgccttccattactatacactgatatgacgacccaccattgtaatcatatgaacatcaaagtgtctctctgtaacacagtgggttcacagacacactcatttggtctacactttttaacgttcaagtgcttggagttgagatacaatgtacattaatgaggacgatactttgtagtatgaaccaaatcatagccttcaccaagtccctctaagaggaagaaaaccttcatatatctccttaagctcacacaagtgttgtgatcaaacactctgccatgttttgccagaggacatggggttcttccataaaccagactcctcttggcccatcaacatatccatggcccatacagagccttatcatgtgaatgataaaataggtttggggttattcttgaaaatatcttaaattcatggaaatatatgagagaaaacaaaaatatgggtagcggaaaataaatagtagcccactccaattctcgtcgcaccaatagagtaattcaactgccccaaattgctctcgactttttattctcggattagcgtttgtgctttcgcatcagagaatctctcagttcttctcaatttaggtcatcagatctcacaatcaatcgactcgaactcaaatctcacttcatcaatcaaatcatg

SEQ ID NO: 13659 - DNA, 3000 bp, Unknown
  misc_feature (1)..( 3000): cDNA_ID_3031258_gDNA_ID_2214642_Annot_ID_188370 3000 nt of promoter + ATG
tctctttatttccacatttagtccttatttaaataactaactaattaaaattagtgcactattatgttagcagatttcggtttactagtatttagtattatatgctaagtcttttctatgttttttgcaatgcatttcaccattagctaaaaaagggctatacaaggtttttgtgtgatatgtatagaagtaggaactatatatacagctcatatatacataaaacgtatgtccatagtaataacgagcatatatgtataattaagtatcatatcatatcatatctattaaggttgaaatttagtaatttactttctcaatgtaacagaagcccaccatgcttaatgttgtgataaataatatgaataaatcaatgaactcctctaattaacaatttaacatgtatataataaaagtctatagaataaattgtacttgttatttagcagaaataaaaataaactgtacttgtttggtcactagtaacacacataaatgtgaaaggtggagagaaacatcgatttggtgtatggaggaggaagcgtggggctaatgggtctcatttctcaagctgttcatgatggtggtcgtcatgttcttgggtatctatctatctctatacattttttattattaaaaattattaaacaataaacaaactagaggtgttaatttatctatacattcaaagcgacaatgcatcattctttttttgttcttcccatgttcttgtcctgtctttcaaatgagtaacattatcataaatagcaattggactgcttcaaaatatatacttgtaaatgaataagataaaatacttttatcaaatatttcttggaaaatcaatatttgaaacaatgctctggactcgcttttcaatttgttagtttctttgccaaaatctaaggcctaaggggaacaaggcagctgtctttagttctacttaaacatagactttagtttcgaaagaaaggataagaatctttgaccattacaaattaagatgactcgaaattattgattccatatactatttataagtgataattatttacattagatgttgatattatgcgcaggatcattccgaagtctctagcaccaagagaggtatttacaaatctaccatacattctaactagcagtgtgaagagcttaacaaatgtatagtttattctgtatcgtccaaatatatattcagtaaaatatatgtgaattgaaacattttaattatgatgaatgtggggtttagataaccggtgaatcaataggagaagttataacagtatcgactatgcaccaaaggaaggctgaaatgggtcgccaagcggatgccttcatcgcacttcctggtttgtttgtttttattattctttttcaatctatgtattttgtaaagaataaaaaagatgtctatatatgatcatgaaggttaataaaattaatttgtttggtgttattggacaaacaaaataggtggatatgggacatttgaagagttgttggaagtcatcacctggtctcagcttgggattcacactaaaccggtaattaattaaattcgttggtgaaccccaaaaaaaaaaatatcgtttagatatgacttatgagtacacatacgttgagactcgagtcagtaaaaatacggttatctcggcaaaccattaaaaaaaataaaaaatagagatgttgtcatatactatgtattttatggagaaatagagattttcctgatgaacttacacaaataagaagaagcaaatttctttgttggctatatatgtgggcatgtggcatgggttgaagtctatattcacatggaataatgtcttaactcttacctcttgacaacaacaacaacaaaaaaatgtcttaactcttacctaagattttgtcccaaaaaaaaacactcctacctaagatcaaaaaaataaagagaatcatagttaaggttgtgaaaactactctaaaatcatatcgtacactaattaatgcatataaaaaagattagattaaaacatgtaatatacacacacgaagactttgtatacataatacatggtcaaaaaaatgcgaaacctgagaatatgaattaagtatataacataatgcgaagttaaaaaatgcaggtgggactattgaacgtggatggattctacgattcactattgacgtttatagataaggcagtggacgaaggcttcgtctcctccaccgctcgccgtatcattgtctcggctccaaacgctcctcaattacttcaacttcttgaggtttttttatttgcctttcattactttttgattattctatttaatactatagactaaatgaacgaatcccaaaataggataattaaattaatttgtaatcgcaggagtatgttccaaaacacgacgattttgtatccaaaatggtgtgggacaataccacggatgctttcactttggaaggcgactcgttttagatatagttcatttgtatcttagtctacttttattttattattaaaaatctcgttttttattggccatttcaaatttttgatttttgtataccatgtattgagcttatataacaatggaacttgccaaaatcaaattacttacaagccacatgattacataatggataaaaaaataacacaaaaccaagtccgtaaagtatcgacaactaattataagctaagaaaaaaccaatcattttccaagcattgagacttccattcttaaaataagaatatgaggcccaatgggcttggcaagaaagttaaacaaaaaaaagaagaagacaattttacaattttgtcaagttttcaattgaaataaaccggttaaatcccaatttaaaccggatcaatcaagatatggtaatccccttctccttctccaaaaatcacaactctgttccaagtcttatcctttcatcatcatcatcacttaccttcttcacagagagagagcttcatcatcatatgtaatgtgagatgtctcttgaaca

SEQ ID NO: 13660 - DNA, 3000 bp, Unknown
  misc_feature (1)..( 3000): cDNA_ID_2703718_gDNA_ID_2214642_Annot_ID_188362 3000 nt of promoter + ATG
aggaaattttccataaaaaatcaatactgataggaatttggtaatcaccacatgtatatttactcacgcaacaaataaaattataataaatactatttacatcttattagaatttaaaaaaacacgcatcaataaatgtattacaattttttctgagtgttgttgtttgaaatttagtgagactattaaacatgaggccaaccctacaattgttttgatcaacaataagatatgtataaatatgaacatactagtttcaaaaatgcttttgaaaaataacaagataccagtttttatgcgctatggatgatttattttacataactggtagtttgtttatgtggacggtaaacgattcaaaaagataagcaaatttgtccacatatgtttttgttgttctacatacaaattataattatctatatcgtataaataaaataaatacaagttactaaaaaagactttctcatgaacttaaacactctttgcaattaatcaactaaaattatctactatatttctaattatattttaaataaaatacttttagtcaaataccctttaaaaatagacatacgtggtaaactaaaagaatatatgaaataaagaaataaaagtaaatatacatttaacgggacccactctttccccatcatgcttcattatcattatcgttatcatcttctttcttcctctctcctctctttctcaataatttagatttttgtgtgattaaatattttaggtttctgcagaaggagacgtttcctcgtttttgtgctgtttggatcttctgacacaattcacttttccgtataagttttcaatttctctaatcccattatgtatatttaaaatattatactcttaacctatttgagtgtttggaagaaaaatataaactaacggtaggactttcaaaaatgaaatctattcattttctagaataaagtgttgatgcgttttaagtttttatgtgtatgtggtaatataaaactttgtaaataaagtatcttagttaatctgctgaggaaaataatgaaatgaaattaaagaaaaaaacagttgaaaaaagaaaaaatgaaaagaacttggtaacgtaaacattactaattttattacttataaatcataatcagttcaaagttcgttgccatcctcagtgtacactctgaacttgctagatgataaaagtctgcaagaatagtaatccgaagaatactttatgttcaggattgtagttatatcaataaagaaagatttggattgagatgcgtgtgggatttctttttattaaataaatacaaatataatgttttaaaagaaaatgatatgattctaaattggacacgacatacatatcactatgtcttgatgtgataacatttacttcatctatgaaattatatcgtctataaataactaaataaagggtgtttggttgttatgatatgtgggttcattacctggtcaatacatgaaaaggccaaagtcatatcatacaagttcctctgtttttcaagtataccaattctaaatttataataagatacgtatcacatatatattaccaaataatgtatacatatgtctatgaagttgaaatatttcgaatttaatattatctcttgtactggatgtcaaactagaatttcaacaacaaacaattatatgcacattttctcacttagttttatgaattttagctccctatgatatatatgtactttgtaacttatttatcaccatgctatatagtgataataacatgaagtaaaggttttttgaacatgcagtatgaaagaatgctatgtctttttcttaatttattcattaatctttttctatttaaaaaaactgttgaaccaattgctctagagtacactaatttaaatgattacataaagctatatctaagtgtagagtttaatatcaattttgaaaacaaattccaacatggttggaatgtctatttagcatattaaattaaaaagataagtaatattagctggtggtgaacgtaaacacacacacacacacaaattgttttgcggatacaagtatatatcaatatatgaatgtaaaattaagttacattagtgaatatttcatgtcctaaacattggttattgtcccatttaacaaaaaatccactttggttataagatataccgaccacaacactaaaataaaataaaatagaaagaaagtgatgaaaaatggtggcgtactaaggactgtgggaagattaatgagtgaaggaaaagatgggtatcttttatctctcctttctttatcctctctctctttcaatatatattagtcatttttattttgttatatattatttctcagctttttaaatgtattttatatttcccctttgagcaagaaaagagttgcagagatctttgagtctgacacagagaccaaactcacatagcaatcacacacatctccacaaacacaggtatgcatataaatatatatatataagtgtatattcgtgtgtatgtgtgtgtgtctgtctctctctctttctctttgatagaaattctctaatgtaactttccttttgcagcttgagatgatcatgaaacacgtgcatcctcagatctctatcaatccaggttcttcatcttttataatattcattttttctttcaatttctaactctattattttattattttattttcaatcatgattatgtcttaatttccatatccttcaatctctctttctcataatccataattcatcccttcttcttcgtcttcttgatgtgatcacgattctttttttcttcgcttcaactgtatatatatacagatctatattaaacttatagtggttttgtttttgctcctttttcatacttttgtttgtttttctatgatatcaatcagcttggtgaaagaaggtcaagaattgaaagagaatcaaagaaaacgacgtcgtttcattcgtgtgtaacaactactaattatacatagatg

SEQ ID NO: 13661 - DNA, 3000 bp, Unknown
  misc_feature (1)..( 3000): cDNA_ID_2713934_gDNA_ID_2214642_Annot_ID_136272 3000 nt of promoter + ATG
tcatattgggccctgagaaattgactaagacccaattgttcacagcaatgtcaaaaaatttacccaaaaaatctttctttcccatcttttaacttcaacttttattactttttatataatctattttccttaataagaaaattaaatactgaataaattctaaatatttgatacattctaaacatttttattatgtaatggtgaatgtctaagtatttctcaaaattttagttacaactctgatctactaagaaagtatctatgaaaaaaaagaataagatacaaggtaataaaatgagtggatcttaaacgcgaatacaataaatcaaacaatttgagacgcatcatacgttaaaaatctattaaccagcggtcttccggttcagattgagaaatttgactactttagtttggtttgatttggttcaaacttttttccgacccgtgaagaaaaagaaaatcctcacgcgccggtaagtcggtttcacgaacaaagaggcctgagtataaaaaaacaaatcggacgcttcgagtttttcttgaggaagaatccacacacacacagaagaagaatctcatcacgaattttagctatgggttggatctggattgacgattcatccgcctctaaagccggtgctgatctcaccgataaaccgctcggagattctgccgccgccgccgaaaattgctccacgaccacggtggtaagatctcagtgcaagacggaggaggtcgagcctggaaagttcgtcaggaaatgcgacaaaacagaagaaatcctccgccactgttttgggaagtgagtgtttcggatattttctcgcttttgatcataaccctaattaagcaaaagataagcttttagattttgaattacatgtggaaaacaaatctccagggtttatagatcaaatagatgaagtgtgtttgttttgagctctgagttaaaaaattttgacgtttttgtggttatgtaaaagctaaaagccaatagttaaagattgactctaaatttgtgtttctgatgctaagcttactaatatgaattgcagaaagatagttgtgtttatgcactggaatggttacattgcttacttcttgtggtttgatgttgttttcttcgaaaggactctctatcactgaaccattatggtaaaaatgtttcattataaaagttcttatgattttatcatctttgtagtgttataacttgcatgttttttttggttaagtaagtggagcaactgctggttagtcttttttgggttaagtaagtggagtattctcatataagaagaagatgcatagagtatcacatcacagtttctgtgtattcggcgagcttcatgtttgtttgtttgctacctgtgatatgagttattccatgttaaatgtaatgctttcctttggaagacaactcttgttttctttctcgccctttcatgtgtgattttgagattgagccattaaaatgttcaagcaccttgattgtttgttacctttcgcgcctctagacaatcactaaatcgatttacccttggttctgtatctgctttaggccctctgaagtcgttcaatccaacacagagcacacagaagaggatgtgacagaccagatggtgggaagatccgctcttccgaatcagtttgaggataaaaacccgctaaacttcccgggactccgcagagatgtagacgccatcgaacgccatttcttgagcggaatgaagagtttctttgatgcggctgaagagatgacaagcagcttatttgatatcatgggagaccatcacccaagcaccaggagaggagggatacccattgaaaaccatcccaaggtagaggagcaccgcaatgacgaaactgcccctacacgaccacactcctctggcgagattgatctctcgggcttggccaaggacgtttgagaaaggtcgtctgcttcttcttcttcttctttttttttttcacaaaggtcgtcttgttctagcttttggcatatataatcttaaaaatgtaatgtgactttctaagaagcgtggggattgtagtctaatgttagcggcttgcacgtttttccgagtgggtgctactactatctatcaatatcatcatactactatattactatgtgttatgcttgtgtcttttattatcactttgtcttaaaagttattttacatttttaaacatgttaccttatacaattcgtacctttcattaaatggtaataaaataataatggtcaaagtagagtgatatgcttgagtggaattaaagatttgaaatctaaccttacgttttttgaaagattggttaccattttgtggcatggagtaatttagaaaataacaagaaatatacttttttggtcttcaattgagtttgaagatttttcttaacaattaattaattacggagtttaaagggaccaaattgttaatcaatgtattcacacagacactaaataatctctaacacaacctcacagagtcatatgttagaggagagaatcaaacaagtttatttaattgagaaaggccaaaaaccctaataaatccccccaaaaaattcagtcacgacgtgagacccaattccttttcgtcaaatcatcttccttctcaattcccattttcttattcttcgtttttcattttgtgcattgtgtgtgtttcttaccaaaggagatgattcgtagcattttgtgagaattgattaaattattcagccgacctcgagatctttctcccttagatcagaattcatttgtgggagatttatctgtctttcttcatggaagtggttatgttgttagataggagagatctttgtctctatgagatcatgttaagggttttttctcttgcgtgaaaaggaaggaaaaaaaggaagaaaagggacttttcctctctatctttttacgattctctgtatacgtttctcgtgtagattattgtatagcatatagttgattgggagatttagattgtagaaatg

SEQ ID NO: 13662 - DNA, 3000 bp, Unknown
  misc_feature (1)..( 3000): cDNA_ID_2703714_gDNA_ID_2214642_Annot_ID_136275 3000 nt of promoter + ATG
tttttctcatatcatcatatgtattggctaacggtttacccaataagacaaatacgctgttaaatatctggttttgtttaacaaaaaaaaaattgctaataaataaaccatatgattgagaaagattgtcagactgactatcaaaaacgcctaattgattcgatcccattatcttaagttccaacttgtcctcaaactcttttttttttctttgacgtctcaatatttaaaatgatctctcaaagttcaatacaagccaagaaacatatttgccaatattcaaaacgactttaattactctttcttggtacgtatgtatagataaactcgttcacattgcttaaagaaaaactaatccaacaaaattgtgaaaaattcatccttaacctcctttctcttacaaatcttcggcttcgaagagtgtatatacagtgatcagttagtgaccaaaaataacaaatttacaaggaattaaaagaagaattaataacgagtttaagccggagattagtcaagatttcgatttcttcggttataaaataaacaaatcactaggacattcttgtggcggccacggaggaggctaaagggacaacctcggcgaggggagtagacagaggagttggaagcggcgaagtccgacacacaggacacgtaggattgagtctaagccacgtgtcgatacatttaaggtggaagagatggttgcaatctggtagctgccgcagcagatgttttcccttgtagtctcctaaacaaatggcacaacacgacgccgttgttggtccctttgcttccgagtagagaatctttggatagctttgaatggtgtcctcgtcaagaccggggacaacgtcgatgatgacatggtggtgatggtgatggatacgtgttgaatcttggttggtttgtgaaggtgaagaagagagctggttacgtgtgcaatagtatgaggtgagggtgatggtggtgatgaggaggaggaccccgatggagacaccgattccgtatcgaaatcctcctatgtcgtccgtgccgaggaggccgttgtagtccggcatctcggacggtggcggtggttggaaattgttcatggcgggtttggtttgatggttttgtttaatgggtttgggaggaggaagaggagaaataatggagaggtttttggtcagcgatttgatataagacaatgtaaattgaagcatcttggggttatcaaaagtcaacgctaagagagagagagagacaaagggaggaaatgcatgtgaatgaggataagaaagcttgtcaaagcaaagcaagaattgtgtgacttgtggatggttaaaaaaatattcaatgtataaattttctaatattgtattggtaatactgtaatagtataacgcatatataaatatattgacccattaattcgttgtttatttcaaacataaaacacttagttgcacaattgaattggatacagggctaatgaatttaacgtgtgacatgtattaagatttgatttaggaatgtagggaggggccagtggctaagattagagaaggtttacgctgaattagtttgaagtcaacgttgtacttatatactaatcttgttgtttatgtacgtttagttatctcctttattcaggcttatttaagtccaatcatgtcacctaagcaacgtttagtttccttcacttgcttttaaagtcgcagtgttatcttattttagtattagaatatttaaaactttgaaatctctccatattagaagattaatataaagttttgtttttctcctaaaagtggcaagacaataaaataaaatataattgtaggtaaataatttgtatatactaggaaatccaaatttaaccaattgagtcgtgggcattaacatttgtattacataaaattatattttggcaaactaccataggataaaaatcattcacttaacggccaagttactaacacaaggcatctttgataatggaaaacaatctgttggacagttgttattaatgaagaaaatgcgtcattgcatgctcgcatgatgtatattttaatatacactagctatgatagtatataaacagatatacatgtaattaagaatggagataaatgaacgtatattatccaggggcggattcatttggtgaagaatgaatgtattcagtgaattttaattgatattcgaatacaccattgttattgaacacttaattattgccgccgctcttccaatttttcaattctttttttccccaatcagtagagtaactatgggcttttaaaacccatagctccggattcccaatcatatattctatagtctatgtcatctaaaacaatatgaatttagataaacaatttatgaccttcaagccatatatttgggccggatactcaaaacatatgaaattacactcaaacactaattgagctacttaggccaaatatataaaggaaacacttactactaggcataaaaagtttggaagaaataataagagagaaaaaaatgttataatcctgacattgtttttttattgttaactcactcttggaataagttgtccaagtctcatagttgactcagtttggtggtgtcacaaattagttccatcattactaatttgctatcagtttggtgatgtatcaaatactgttgatctagtaatttcacaaaaagcgcatatcttccggctaatgatattagatttactcatatgtgtaatgtgtatgtatggttgaaagttgaagctaaattaggtttaagtcactcatatcatatgtgtgtgttatcttgtatagtgtaatacaaaattcaatacaaaattttccaataagcaaaaatagtcgtcagtgcgagttcaactttaaactgtttcaaactttatattcattacgaatgcaacagtccctctcttgtttctccacgcttcgctttctccttccattttcttccaaactctctccgcttcgtcctctctttcacaccgccgct

SEQ ID NO: 13663 - DNA, 3000 bp, Unknown; identical to SEQ ID NO: 13660
  misc_feature (1)..( 3000): cDNA_ID_2703718_gDNA_ID_2214642_Annot_ID_136277 3000 nt of promoter + ATG

SEQ ID NO: 13664 - DNA, 3000 bp, Unknown
  misc_feature (1)..( 3000): cDNA_ID_2713923_gDNA_ID_2214642_Annot_ID_136285 3000 nt of promoter + ATG
ctcttagcaacaatatttaatttgatgttcaatgacagtttataatttcttttaaatttttgtgagcttttaaaaatatgttagtaaatgtctacattcatgagcattaatgtgacatatacttactccactgatctatgaaaattatgagatgtgaatataggattattatttaagttgactataatgaactataatggtatttcatatataattaagccttcccattacgatttaggttctagttggacgatctatatttttctttttgtcaaatctaaccttttttttcttcaaaaagtcagatgatctttagtatgtcatttgcattcaatagttatactatacggtcgttaattcatttcatacacaattattttaaactacgttttaaattttaattcgaatatattatttttttaggatttacacatggtgttaacaaatattacaagagaagttgtagaagtactcaataagagtttgttttacatggatttgtgttgggccttcatgagctttgtacagcgcctttacaacactcaaataaattgtcactcaagggatataaacccaaaggccgtagctcctccaacacaaatccagaccactctttgtttccagtattactattattcctctaagtacattagaaaggtgtataaactttgttttacaacatataatagaaaaataaacattactgttaaacaatacaaaactttacagaaaacgtacagtatgtttaattattgatagattaatatttagaggccgatgaaaggtggaagtttttttatgggaacctggtagacatagaatgttgtaataatattgtccatcaatctgattttcgatttgagattacctagtgtaaaatataagtaacataagtaacaactcacttatgatcactgcactattaagtacttcttcctcaattccttattactccaaattctacaaaaaaaagtttgttgcaaaaagatacaaattttaatttttctatacaaattttaagtgtggaaattgttaatcacaaaaaataatacatttaggatcaatttttttcatgtgtgaaaaacttagaatttggattaataaggaacggaattattttgagtttatgtttgtttggaaaaaaaaaagactaggtttgcttcaaattatccattgaataaaggatgtttagatgagattttaatggatttcaaaagatattctagtagtttatagaatttcgtatttagtattttttttgaaggacagcagaagaatatatatttattagtgtaaaatcagtcaaacttaattaatttgattcttcaaggactttttttgtaaattcatatgaagcgtcgaacaatgttaaataacgaggataatgagacaacggtcaaacggtcaaacggtaaacccgttcctcttacccccaaattcaagtagcttttgtggcaagaaaccgtttactttttgtaatttttttgtttgtttattgacgtttatatatttctaaaaaaactaaaccctgatgtattccaattttagaacttacgcgtcttcataatcttcctctttttttctttgtctttgatattcaaagtttttgtttattttttctttgcttaacccggagagacaccctctccataaatttaggtttgtttataacaacttatacatatttttttctcttctaataataaaactctgtaaccattaaacatggttttgatctcatttgcagttttgatccctctgggttccttgaagaaaaaaacaccaattccattcatattcttcttcatacgttcaataattcttacgaggacgagatcttcctaacgtctttgatcttcttcattaggttcatttgcatttgttaaacgcttaaaaatggatctattcgtctgatatatatatgattgttgaatcggttttgttatgattgtaacaggagataagtctaaactggtcgaagatgttgggagatttcatcatcagactccttgtgtatgtcctaaccatatctctttttttcttttgattaattaatcatgtatattgatgtatatatataattgaaatggtgagaatggcagattgatattagggtacacatacccagcattcgaatgctttaaaacggtggagaagaacaaagttgatatcgaggaactcagattttggtgccaatactggtattgaattatttatatatgatccccttttttctatcctcgatacttttaaacattcatatataatgtgtagtgtatgtagtagatttgtagtgataggcaaatcgattttagttcgatcatagtgatatacttttctctgttatgggtttttgtttgattttaaaagagaaaaaaaatcaaaattccgttaagttgatgtcttctgctagaaaaaccatttatgaatacacctcatcttttgtacaagtctttggtttcgaacgttgattatatacctagtctggggattactgggacaattgtattaggtttattttaaagatatctcaatatatgtgatgcacgtaattctaatatgatagtttattgtcaatatgtactcgaaaatattaatttgttaaacatttgtatttgaataattaggatacttttggcgctaatttcatcattcgagagggttggcgatttttttatctcatggtaagtaagttttattattagttaattcatgccttaatccatctctgtcttaaaaaatattaacaatcatcaaataattaattgatatatgcaattattatttgcaggttaccgttatacggagagatgaaagtagtcttcttcgtatatctctggtaccctaaaacaaaggtaatataatttttccttttaaaaagtgattagttggatcataattaattagtggtttatggtgatgtacaaataataataacgaaataaataatgaatgaagggaacgagacatgtgtatgaaacattgttgaagccatacatg

SEQ ID NO: 13665 - DNA, 714 bp, Unknown; identical to SEQ ID NO: 13658
  misc_feature (1)..( 714): cDNA_ID_2713919_gDNA_ID_2214642_Annot_ID_136289 3000 nt of promoter + ATG

SEQ ID NO: 13666 - DNA, 3000 bp, Unknown
  misc_feature (1)..( 3000): cDNA_ID_2703785_gDNA_ID_2214643_Annot_ID_136290 3000 nt of promoter + ATG
atccaggttcaacggttattttaggtacaaaagatagtttttttgagaaattctaacttgcttcgaagctcaaaaacaggctggaagacagcatgtcgacgtgtaattcatttggatggaacatttctaaagggacgcatgaaaggacaattgttgactgctgtgggaagggatcctaatgatgcaatgtttatcatcgcatgggctattgtaccagtggagaacaaggtctactggcagtggtttatggagttattaggagaagacttacgtttgaagcttggtaatggttttgcattatcttcagatcagcaaaagggactgctataataaacgtcctaccttacgcagagcatagaatgtgtgctagacacatttttgctaacttacagaaaagacacaagcagatgggacctttgcataaggttttttggaagtgtgcacgcgcatataatgaaacagtcttttggaaacagctcgagaagatgaagaccataacatttgaagcttatgatgaagtgaagcgaagtgtcggttctaactggtctaggtatgaaaaaaaattgtctcttatttatctctggttttgtcttagtatttgtctctagttttggttggtttgactcttgttttgttctttgcaattgtcactctagttttagttgatctaatcggtttattattttctccttttgtagagcattttttaatgatatcacaaagtcggctgcggtagaaaataatatcggtgaatcatacaatgctgttttgaaagatactctagaaaaactagtggttgcattgctagaggatataatatcggtgaatcatacaatgctgttttgaaagacggcatattatggctagtaacctagttaagatcaaagagatgcaaaatgttacaggccttatcatacccaaggacgaggcatttatgaagtggatcatggaaaaaataagtatgtggttcatgttcgtgatcatggaaaaaatcattgatttagtatacagtaaaccgattaaacctagtgctatggggttttaaatcttgaacttacgattcatggacatgctctcgaatttttaattggtggggaaataaacatataacttctgtttcatgggcatttgggcagaggtcaaagatcgggctctatctagcaagatacgatagttctttctcggggggggggggggaggggggaatagaccctttttccttaaaaaccatatgaacaaaaaaaatttaccgatggtgacgtgatttttttaaatacacacgtcttcttcattccttataaaacttgagtttcgtgttacttttttttactgttttctccaaaactaaacaacaacgcacaaagcagagcaagatgttggattaagcttaaaggaagcttgagaaagaagtaaaccgagaaatggttaaagctcaaaccgagttatggtttagagtttgagataggttctaaagatctagagaatatttaggagatatctaaatatatattcctaataggattaggactagatcatctcttatataaggagttatcgaggtgtgataacacttgtgagttttgtgagagagatttgagagaaccaaagagagctttagtttttgagttggttttctaaagctaataaagagagtagttctttaacttgtttgtgttcttaacaaatctagcaaaacaagacaagaaacagaggaaaagaaaagctccggtaagaagcaagaaaatggcaattcgcgttgtgggacacgacttggtttgcactttctattgctttattgattcactcactacaacggaagagtcgatccggcttggtattataaatttctcggaaccgggcattgcttgctcgaagagacgacatcactttgttcgcaagcgtctactgtgaattttcgaatacaatttctgtgttcacaagaaaccatggagatcaacgtgttctaacaatcaggtattctggctttaatcttcctgaagaaatgtgttcaagattttacccgacgagcagtcgccttctctgtcatctcgcgagctctgctgctgaggttgggtatttcaaacgcaaattaacgatttgtaagtttttaggattataatatttgagataaaatttgtaaagacttgtatgttgttagtaaatagtataaggattttttggccaaaagtgtaccaaaaatgtatatgtagagttttaagcaataaaagaccttgtacatttatttgttttcattgattgagtattatatgtctgtttttaaaagtttgaatcacattatatgcagaaaaatataatattttattaactatttttattttatatataaaatcaaaataaattagatataaaaacaaatataatgataaaaaattatatatttatatttaatgtcgatatagagattttagaaaattaacttttatcgaatatagttcaataaaaaaagatttaattaaagataaaaatttaaaaaatagttaattctagtatttaatgcaaattaaagatttataagtttataggaataaaacatttggttgaaataaaattaataaaaatttatatattattaataaataatataagaatttttggctaaaaaatctatcaaaaatatatatgtaaatatttaatttggaaatatttacaaattactacatcgcatgttaaacaatcaattcttcattaatatgatattcacattcctatcaaaaaaaaaaaacaatcaattcttctgactgcactatttacgtgggccgacgacaacagagcccaaatgaaaaaataaatctattacccaaaatcgtaaaccgaaccgatcgtcaaatctcgaaccggattttagataaaccaaattggacatcaacgccgaatcattcaccttctccgattcaaaatatttctcttacttacactttcttcatcttcttcacataaaccctaaacccctttttctcgctctcttcctggtttaaaatg

SEQ ID NO: 13667 - DNA, 3000 bp, Unknown
  misc_feature (1)..( 3000): cDNA_ID_2703753_gDNA_ID_2214643_Annot_ID_136291 3000 nt of promoter + ATG
gtaggagagaaggagagttgagtttctcggaggagaaactttgagaaactattctcatccaatttggacaggtgtcatcatactattagttcaactattaaataataattaatatatttgttttgattaaattattaatatatttttttttgagaaactttctttatttttactgatggagatggtctaaacatcttgtctcaccgccatggtatgaaccatctgctgcccaatctcctccgacatgcaatcgaaagaaaagcgtcctaacaaatacaattatcaaaaactctctaaaaatctgataaatttatgcgtctgaaaacaatttaaaaaattgagagaacaatcttataatagttaccttaaaaagctgagagaaattttcctttaataatcttttcctattcgtttaaattttattttttcagacttttggaaattttatgttctgttgtttaatataataataaaatttacatataaaatgctaataataaattttttgcctttttgttttttgaaattttattttattgaaaactattattttgtatattctaataattatattatacatttttactatttccatatcttgttgaattgaagagatcacttaagactttcatcaccttctaattattattataactatttgtataataataattactatattgagtttataataattgacacgtcataatgtactggatcacgtgcatcgcatgttttagacgagagtatcatatggcaactcgtaagaagaaaagctgaaaccagatcttccttcgttaactgttttcagctccagcttctgaaacaaaatatcatcagggttttatctcaaacaacaacagattatatagtttgtagatacgaggaagatcttggactaacctgctgtttggatcataatagaaaccgcgcgctgatggatccgtcgctgcaggagaagcatacgtagtaaaatctagctattgttagtccacaatctgtgccaacatttacaaagtattgctctttccatctcttgcaccaccacaaaaattatccggagtgaattatataggatatgtaagagtaaaggatcatcgatattgatacgaaagcgagagttataccataaatatataagggtaaatgttatgacctgacactcacagaatcaagaatcgtttcccgtattagaaattcaaagggaaacaacatgaagaaaaataagtaagagtttaaggtcttacaggagtgtctgccatgggaacgtttagagcttccatggtgccacaaagacagccatgttcaaggtcaattccctgtatctggacattaactctccaagcttcctccttgtgttaattagagacattttgcgtaccagaaaatgcatgcagcataaaaacatgtgtgttcctcatctttaggttcaatatgaacaaacaatctcttggagccaatgaatgttatacaatcccaactagatataaatgcacttgaattaagcatagatgtcaacatgaaaaagatatcaagccaatcaaagcagacaaggccaacttctactattagctattcttgtgatttcaagtattcataagtcagaacttgtcaagtctgagagaaatttcaccttttacatataaaaatccctaagacaatgtctttatagatatactcagattctgcttacacataaggttatgttcataaaaagagtgtgcatacataaccacagatgcacaagcataactaataaagttctctctagtcctaaccaatattcccaagacctctatggtcagacacttataaaattcaatttgttaaaccaaataaacagaatcgaaaaccacatctcatcatacccggttcggttttcttaaccgaatcaaattatatataaaacggattaggcttctccggttttctactgcgttttgtataaaaccctcacaaaaaccctttctccaaatccttcaacctctattatcgaacttgctatataacctttggacctgactttcctacttctctctaactccaggtttgtcttcctctcaagttgaagctgcggctttattagtttcctgttgacttatgttccttgaatccattcacatgagcttcttacgccgttttcattggtttacctattgacgttgacttgggtctaccatactttttcatgttacttgattgcatatttataaaacggtgctcctttttgtatagcattctagatgttgcttctgaaacaaagctcatctgctgttcttgtcgttgggaatacaaaaactccagtccttcacacttgtcgctccacctacagagttggaaccagaacgcactcgttcaagagtttgactatggcaaatttgcacaagcacttcttcgtctgggaaactgaatacggcttcatctgtgccttgtagctctcacgaggcttctcctatcaggtacctatgccccctgtattgagtataatggtgtcaaccattcttcttaagtattttctcgattcttgttattttcttggctattgtcagtttcatggacatgagaagttgcatagctgttgtagttaagattgcatcacaccaatataataaagaaactagctgtgtgcttccctgctcgtttctctgttactagacacgaagatttgaaaatagtaagactggttaaggtatttctaatgttcattttctttcctctttgcaagtgagaataacgagaataaacatgtccatggagtttctgagacaattgtgggagttcttggggtggacaattgggtcagtttccatagcatcatttggtatctatattccattggcttttaatttctgaatgctttgaaacttatatcaccaaaatctgttgtatataacctttttatgaaacacttgaacccttcatgaatcttcaaagtatctgactgaatttgtggtgcttgttgtttaccacattgcagagacacctcgtgttggtatcatc

SEQ ID NO: 13668 - DNA, 3000 bp, Unknown
  misc_feature (1)..( 3000): cDNA_ID_2713947_gDNA_ID_2214643_Annot_ID_136293 3000 nt of promoter + ATG
tgtggaattgtcagttaatgttttcatatacataatcaatagcctagttaaaatattatcaaacaataagagaagttaatggatggctactcactaatttaggtaactcaattaaaatgactgccaaaaaaataattctacaacagttttacaaaatctaaatttataacaacagatatctaaactaacattaatcaacgtctcagagtagttttcatttcactaacctttaacattatataaggatgtgttaagttctcctaagacgaaatcaatagaagcctcctccatgggaatgttacgctgagattatgcttggcttgtatacattttacatttccaaactcaaattttgtaaaatcagttaatatacaataaaagacgtcaagcctatacctttctctcaaaataaaatgggtaaacagtagctaacatgttcttatcaaataaacaaagtgttattattaacatatcaataactattagaattgccctaggattctaaatagcttagaagatgacactgaaatcccattctttaaaagaatttaactcttaaatgaagcactactgtaaagataatctgctcattaacctgtgacatttatatttctggatagctctattgataagatttctcttccctcttcatagtatagatgttatttgcaaaggttcatcaccttaaacagagacttactactttgcttttaacatactagggcacaactatatggtacattacatatgatatgccttaacttaaacttcctaccagtaagtaaatctgatacacaatagtgttgttttctataaattgatgtctcactaatctgttaaatcgagatttcagaatagctatgatgacgaaatctcagcagctcttccaaagtctcatgttacttccaaacctcattcatctgaataaatatacattgattttcactataacataaaaggacaaatcaatgtgccatatatatgaaacaacttttttgttatatatatatatataaatatgtatatatgaagtatcttaactttaactcaataacaatatcaaaatctacaaatctataaaactaaaattcaaaaatagagataaaaaaaactaaccttaacatatatatttcggaatacctacaatgacaaaaactataaaagaataaatatgattcagtatgaagcttacctcttcatacggttcacgaattataaaaatagaagtataaagcgagttgcagtaacaatttttctatgataatcgcgcaagtgattttttcttcttctagagatattcttcattttgttcggtgaattttttctcttttttgctaataagacaacaaatttctacagatggattatggattgattctaatagcaaggcgggaatcagatggggactttttaacgctcaaggtcgttgccttctcaaaggctccacgtcaatagagccaacaaactcagctttggatatggaggccattgcactacgggaagctctactgcagatgagacgggtcagctatcagaaagtcatattttgagggaactcgcgcatgctatatggtcatttagagtaggtaattcaataacgtcaacctattggggacccttagaaaatccaagaatacattaaggatatagtcgttatgtccaaaaactcttatgcctttctacatgtaaatcgacaagagaaaacagtaacggacacactagctaaaacagttagacatcagaacttggtttgtgttgtctcttggattttttaaatgtatgtcaatgttatatctagtgaacacttcttatactgtgtttccttgattaatggaatatttggccgacaaaaaaacgaaaaacacaaacgaatttcaagacaacatatatttgtccacaaataaacactaacatcaaatggcatatgactaaatggcttcaaaatctgttactattggatctattaaaatatggaacaattcttgggttcaccctttagggggtgaatccattcattcaccgccttttagttgactaatgagaatttgacatgtcatctatttaaaaaataaataatttaatcacaaaatttaaatcttaatcactattttatcaacccaaaccaaaatataatttcgtttaatcacaaaatctaaaccctaacagctattttatcaacccaaaccgaaatataattttgttttaatcacaaaatctaaaccctaaccactattttaacaacccaaaccaaaatataatttcgttttaatcacaaaatataaactgctggaatctgtaagtttaatcacaaatataatgtgaatttaacaagatgttagtttacaattattaaattgtttagttccgtaaaaaattgaacttttaaattttcacatctacacatttaatttctgaaaattttaaaattctcttttgttaactaaataattttttatttggtatataaaaaattataacgttttaaataaaactataaatatttgtattatattacattctattctaaatactattctaaatacatgtctatattgctactataatataaatatactattataatttcataaaacagaaataaatacataatatttttcataaaacaatatataaaaatactattgtattttcactaaataagtgcggattaggatctaatatgcaataaaacctaatttttcctttatacgattaactttataaaatctcagtttataagttaaattaaattttgtaaatttaaaaattgtttataaattcctatgaattgccaaattttattttaaactaaaatttcacatgttaatatagaaaaaaacattaatttttgtatttgttttcatcaaatgcaaatacaagatttctccattgagaccttttcgaccgtaaaccgattgcgatcaaattagctgatctgatcggaaaatcacaagaaaaccctagaaaactcctccggattcgaattctcgactcgattca

SEQ ID NO: 13669 - DNA, 3000 bp, Unknown
  misc_feature (1)..( 3000): cDNA_ID_1812229_gDNA_ID_2214643_Annot_ID_188421 3000 nt of promoter + ATG
aatttatattaattcagaccaaaaacgaaaaacaggagatgtgtgggggcaaatggaaaacaatgagataacaaagcttaatggctatctctatatatgaattagattatttactatttaaattgctttttatttatttcctttgaactaattagggacatcttaaaatcttagggaaataaatctatctatatatactaatatatctctctaattagagaaaaaaaaatgacaatcaattgaagatcttcaaccaaaactacaagaattacaacaacctttcttatataaatattaataaggagaacttgcaagatcaagtctagtctcgctttcaaaagcccatgaaaacaatttcaacatagcccattttcgtaattcatttggccaactgtactaacatgttctcatcaggccgtgcaagacggcttggcgagtgcaggtgaaaaatacatcattcgtggcgccacaataccaacacaactggtgaaacactatagttagtattgggaagttgttgcacatgtaattatctgacactctgttttagtataaatcgttttcctttttgatttatcttattgtgtttaacttattgtaatcatgatgttaatatagatttctctgatttattttattcatacggtggcatgattcatcatcagactcataagtatttgaaccatctgcctaaaaagatttacattataactaacctttgattggtgtaaggagatgatacagaagtgactttaagatggagacgatacataagtgactttgagatatgttctttagcattaaacctgttattcagctatgaaataaaacaattgttagttataatatctatattaaggtgaatatatatttttgtattaaattagataatgaactcttatcttcttcttttttaaaaaaaataataatattaaattagattaaaaaaaaatagcgtttttacaacgagtgcaacgtataacagtagattgaaatcagaatgtagaatgaataagctttgtgattactttgaagccagcattggaagcaggcctcatatcaactgtccttctgtcgttgaacggtccttcttatcttctttttgttgataacagtacttcagggaatgaattcccaaagcttgaatatattcatctatgtacaatcatctaaagattagacaaattgttttgcaaaacaatcatctttgttctataaagaacaacctactacaattaaaattataagtttcttttctgtattaaaaatactggaaataaattagttttagaatcggaatggtcaatcggtttaaatatatccatggggttacgattcatatttaaaatgaaactatatttacaaacatcaacaaagaatcaaaatcacttacacatcgattgacccaaaagtatattcaacttggaccattagcggaagctattgacatgtagaaccgattataatcagatcatgttcttcaaactgaaggagaattttggtttccaatttggataggagagaattagtttccaattcatcagttagataactttttcgagtatttgttattaattaataaataaaatgatgcaaagaaatttaagaaataataatgttaatataaaacaaatctaattcaagaaaaccatataaaatacaaaataacattagaatacataatcacggaaactttacgactaattaacattagattgaaaattttaaactaactcagaatattttaaataaaaatattattaaaaataaaagaaaaaaagaaataagttttagttaccatgggacgagtttatatgtgagacagatttatatggtgagatgagtttggatgagagagattttttgtttgtcttttaaaaaacaacactatagtatatcaaaataagagttaatcttctttcacacctctaaatgttaatcttctttcacacctctaaatgttaatcttctttaacacatctaaatatataattgtaataaaaaattattaaattacctatgttctaagggtaaaattaaaaaatatagaaattttaaattatataatttaaaatacaaaaatttgtgaataaaacatagggtatacgggacatatactagaagataaaataatattagacttactaatatcataaacttatgacttaataaaaaccgtacacaactttatcaaaaattattaatcaacacaaacaacaatagacattgtacacaacaaattcttcattttgtaaaaatttaaaataaacaaaaaacttaacccttggtgtaccacgggtcacattctagatacgtataaaattaggagatacacactttgtatatagatgcgtataatatatatgcttccggaactatacaaaaccatatagaaacatactaatataatcactaagtgtaaatagatataaacaatgagttttgataaattgaatatctaagatcattatttaaatatagatgatattgaattgaaacattaaattaattcaaaacgaaaataatcaagcagcagtgtaccgcaggtcaatatctagtttgttacattagcagtaaatagtcatactttatttcattatctataaaaattgtacccaaaaacaaatttagttagagaaagcgagataaatggtaattgttggtgtgcatatcaattgaagatttcagaaattttgtgacccaatttcaattttaatccgattcgccaatggtattttggataaatactttgaaagaccaaggttttttgccaaatattccagaaaaaaaaactaatatatatttgataggtcttatccatttccaaatcttgaaaattggacgcagatgggaaatataaaaagtcatttccaaagtcttgaaaattggaagcagataggaaaagtaaaaagttattttgaccgttttcaattgtcattatcttctctatataatccaccatcctttacaacctcaaatatacgttacattattgatatg

SEQ ID NO: 13670 - DNA, 3000 bp, Unknown
  misc_feature (1)..( 3000): cDNA_ID_2703746_gDNA_ID_2214643_Annot_ID_188418 3000 nt of promoter + ATG
tcatttcctctttcttggaggttgttagtgcttcagaagatgatgatggagctgcaacgcttgtagtcttactttgcatattgcaaatgaaaaggtgagtacaattgcattaaccaccagatatatctattaacctttgtagtttatccctaggtggcgtgatttcaccggcgatcagttctctccctgaactagttgagattaacctccaaaacaactttctcacaggcgaaataccgaggcttccaaaacacgtaaaggtcatttacaaacccggaaaaaggttcctcatacacaagtcaagagataacaagtgactataggcatactcattgcaatcacaattggaggagcacttgtcttgatcaacatgggaatcatggtttacgtttatcagctcaagaaatctacaatggttgcaataaaatatataaaaaaataaacagttttcttctaataaaaatatctaaatgtcaaatatgggtttacaagttacaatcatgaaactctttggtaaggaagataatcaaaatatggatttgtacaattcaaacatgggcttctaatatgatataatctatataataataacaattttaattaatgtctttaacaattgtgttttcttttaatcgcattttttttgataaactagaaatatattttgcagttatttttttttagaaagttgcaatctggataaatgtcttctactgttacatctttttttaatcgtaaatcttcataaacggttgcaactatttagttaaagcattacaatatttaatttatttgaaaaatcattgcaatttttggtttatttatgaatcgttataatatttaataaattggattctaatgtaatgccaagttagattatcaaaagctagggtaatgatcatacatctcaagatgtcgcgaaaatgaagctagtaaggtaaaattcggcaatcgccaaaaaatcagagtctagatttgtaattttaattgcatcttcttctttttggtcaatagtaacatctggtcatggaaagtgttctgcaaaagtatgtttatgcagctcctagtagaatgagtacaagaacggaagaaacactacatgcttagacttttgatgatgataataaaagtttaccaaaaaagtgaatccaaaactgaaaaagaaagaattataacacttaatctgagattaataacttgaaaattttaaagcttaactcatattacaacataacaaataacatgcagtattctcaaaatctacatatacatttttggtagactttttggccaaaaatctctcaactatttactaataacatttagatccttacaaaatatatctcaactagatattctaatactaaaaatttacaatttgttagtttgcattaaatacttaaattaactcttttctatattacatatttagtccctacaaaatctatctaaaaaaaatatgtgtctaattaaactacattcaattaattactaatttcttaaaatttctctatctacattaaatataaatatatgctttttctttcacttttagttgttctaatatctaatttatttgattttatataaaatatatatagttaataaaatattagattttttctatatatgatgtaattcaaatttttaaaaacagacatatattactcaatcgatgaagaaaaaaaagtaagtgtaaaaagtctcacattgcttaagaaattgggcaacggttcagagtcatattataaaaagaaccaaaatgattttgaataagaatgaactggaagttgatttatcaggcatcccaaaataaaaatgttattcggtttaaagaactgaatctttaaaaatttcaaaatattataaatatttaactttcttaaaagtgaaatatcaaaaaatttataacttttaaaaagttatactttattaaaaaattaaatgcattaatacgggacaatatactacgggtgaaatcctatatataacaatcaaaatagaattataaagtttggatcgatattattattattatttttaatttcaataccataaacatttaaactttagaaaaaatgacaaaatgatgtttaattccacgtgacggggttatatggtgggacgggtttaagttgatattaatacgggatggtatatagtatgggtaaaatcctataattaacaatcaaaatataattatataattttaaaaactaagccaatgtaacaatattaatatatatatatatatatatatatataaaacttaaaattttaatttttttagttctaaaattgtctcagagtattatacgttaaaataaaataacatatgtctatatatcatcttaaagacaaaattcatttttttgataaaaatatacccatgtgatatacctcttaatatgttatatatatatatatatacatatatgtaatataatattaattaaaataaatcgttaactttctgtgtaccgcggaccaatctctagttaaatacattttgggacagttcttattacaaaataaaaaatatataaaaatgttacaagtttacagaaaattacaaaaaaccatggttacgtataaaatgtcgacccatatttagtgggctttgttggcttattgggcttttgtgtataaaaaactcatttatatacactcgtgagaactggaaggttccgtcaagtgattcctcattcccagcaactgtttcaacttccgccggcgacatcacgatctacagttccggcaagttattccattccgttcgatcaaaacaatgtagttcttcttcgtcgtcttcgtcttcttcttctcattttacacagttttgttttaggaattttcttcataagatttttgacaaaccctagcctgatcacttagtctcaataaggttttagttttagtttctcttcctcactggcgatttatgtttgcatgcatgtaccttttcttacagatttttcgtggtgcagaacaagaacacat

SEQ ID NO: 13671 - DNA, 3000 bp, Unknown
  misc_feature (1)..( 3000): cDNA_ID_3031333_gDNA_ID_2214643_Annot_ID_188415 3000 nt of promoter + ATG
ttttggattcacttttttggtaaacttttattatcatcatcaaaagtctaagcatgtagtgtttcttccgttcttgtactcattctactaggagctgcataaacatacttttgcagaacactttccatgaccagatgttactattgaccaaaaagaagaagatgcaattaaaattacaaatctagactctgattttttggcgattgccgaattttaccttactagcttcattttcgcgacatcttgagatgtatgatcattaccctagcttttgataatctaacttggcattacattagaatccaatttattaaatattataacgattcataaataaaccaaaaattgcaatgatttttcaaataaattaaatattgtaatgctttaactaaatagttgcaaccgtttatgaagatttacgattaaaaaaagatgtaacagtagaagacatttatccagattgcaactttctaaaaaaaaataactgcaaaatatatttctagtttatcaaaaaaaatgcgattaaaagaaaacacaattgttaaagacattaattaaaattgttattattatatagattatatcatattagaagcccatgtttgaattgtacaaatccatattttgattatcttccttaccaaagagtttcatgattgtaacttgtaaacccatatttgacatttagatatttttattagaagaaaactgtttatttttttatatattttattgcaaccattgtagatttcttgagctgataaacgtaaaccatgattcccatgttgatcaagacaagtgctcctccaattgtgattgcaatgagtatgcctatagtcacttgttatctcttgacttgtgtatgaggaacctttttccgggtttgtaaatgacctttacgtgttttggaagcctcggtatttcgcctgtgagaaagttgttttggaggttaatctcaactagttcagggagagaactgatcgccggtgaaatcacgccacctagggataaactacaaaggttaatagatatatctggtggttaatgcaattgtactcaccttttcatttgcaatatgcaaagtaagactacaagcgttgcagctccatcatcatcttctgaagcactaacaacctccaagaaagaggaaatgatgaagagaataaacttcattgtacatgtccaaaacaaagttcaaccgtgtcaattatgatcattttgtactatataaaagagatggaaataataaatctcctaattttattatatcatttcgtttagttaaactcttatgtacttcgtattttcattatcatgttcgttgtacatcttatatgctttaacacaagagtaaaaagtttttaaaatgagtcgaaattatccaaacatgattatattttaggtgtgataaaataatgtaataactaatttcataagttgaataatattctccactgtaatattgggattaaagttagatattaaaaaaaaaattgctaacggatttaacatatttttttttcagtttgtgtttcacaaactttgaattcttaaattcaaatttgtggatattgacattacacatgtaaacattaacaaacacacctatattttttatattttatcatattatcttatgttttgctcatatttttcttaatttttgcttaataaaacaatgcattttcttttctctcatgtcactcagtgacggagctagagcattaggaggggggtcacttgaccccataatatttccaaattttttttataacaatattatgctaaaagttaaaatattagtagacactttttaaatatggttagtaataattaatcttaatttgtacattgtgagttgtgatttttttttttgtcggccaaattccattaatatggaagcccaatgggcagtagtacaaagcccaataactaatagtacaatgatgagaatacagaagcccaaccccaacatttacaaccttaattgaaataacaactctttagtcgatttcttttagaaaagactaaggaaagaaggtgccacgtgtaacatacgtgttagcacgcaagaaggagaagatgaaacggacggtgccgaccaaactgcacgagttgacacagctccgccgccggcttcgggaaaccaccaccactccctttctacagattacgtccatgcaaagcaaattgaaacccactggatccgtctgaaaaaggccacaagaagacatcatcaagtcttcaacttcttaacccaatctactcgttggaagctccgcctaagacctaaaaaggtcctcttcaagttaagcggcgaagatattactccgacaaaggagaagagtcaagttgacggggaaacatggagatcaatagatcgcaagaggagatcaatttgaatccctgtagaaagaggataaacaaaaaacagaatccaatcttagccgaagcaaagatggagattattatatccgattaaaccggagaaagatccggtaaaacagaaaaacaaaatccgacccgttgggaccggaatatattacaaaacaaaaagccggtattataccggaatggattccgggtaaccgaaattcgccctctctctctgaaaaataagagtgagttaagagaattgtgagttgcccaagtgttttttattttatctataattgtgaaattttctattccttaaacattgtccaaataagaaaaaaaactagagaaagtgatatcttctgttctctttcatagctgatgcatcacgtgttcttgctttgccgtcaatatcaccgctgtcccaattgctttaggttctctctcaggcagttccttctgagaagagctttcaccggagatatcaccgttttctgtccggaacagagtttcgtattttgttttttttctgtctggttttcatcaagactttcctcaggtttattaaatacttaaattgacatcttaatggagtttcaattggataagtgtctgcaaaagatg

SEQ ID NO: 13672 - DNA, 3000 bp, Unknown
  misc_feature (1)..( 3000): cDNA_ID_1018763_gDNA_ID_2214643_Annot_ID_188413 3000 nt of promoter + ATG
tttcactctgagagcttcctctctgtaagcttccatgtagaaagaaaccaacacaatatatgacagctctacaaaaggaaactaacaccgttcccgcaagcattccatattcaagcaccaaaagatcatcattatctgcaaacaaacattcacaagaacaacattaattctttttgagtcactacaaatgcaaaccaatacctaaccaaccacacatactcaaacaaacccatacttactaacttacaacaaccatcctaagattcgagatctagaatctccaagttcagatttttttttgacaaaatcgctaactttatatcacaaagacatagagaattatacaaaactagatttagatagtcaaaaagtagcttaattttatctccattttgaacaaatttcaccaaaaagtcagattcaagctatcaacttcataagacaaaacccaactcaaaaggattaaactttaaatcccaactcaaagtttactaatttcttcaataaacaacaatgacaaaaaccaaaaacctaaaatttcaataaatgaaataaactgagaatcgaagttagcgatcttactgataaattggggaaaattacaaacacagcttcaaaaatagatctctgaaacttcttcttcctccagagattgagtagatcaaatcggaagtaaacaaaaagcacgaatctttaggcaaagatttggaatcaagaacacagctttaataactacagtaactttagggttttagggtttcagtgaattcaggtaatcggcgattcaggcatcgaaaatgaatcgccggaaaacaccgtcgagaatttcggggaaaaaaaaaatggaagataaaataaaaatttgtttttttttttgttaagtaaaataattttggagtgaaagtaaacggtgctaatttgttaatagtggctatctcgactctgatctatgctatcgtgcaccgtaatgaggagtgcgcatattttttttttaataaaacttttaaaattgttttaatgtgataatttataatttttaatatatgatgcaagttgcatttatcttttttttgtcatcttttgaaaattaaacttttgaaacaacctcaaccagttatttattttgaatgtggaattatcttaaatttcagtttaaagatatgaataataagactatgggttaaaaattaaaataatagtttcataaaggtatagaaaaattcaactttaataattgttaacaatataataatatttataaacagcatctagctaacctatgaaggtatgactcatgaagattcatttaagaattttcacacctattaattttttttattaatacttgttttttctattttctaataattgtacatttctcattttattcacagttccaaatagtttaaactgataactttattatgtcactaattggatgttggaaagtatgtaacaattgcatagatcgtaacaagtaatagttgggaacagatcagaaaaagatggctcgagtaaaattgtatagtatcgtttggtttagccaaaagtgttttcgcttgtcttaactctttaacgatcttgagatgagctttgtacatatttcttggattaaaattttatataccgacactcttcaccatatccttcctaataatttcagtgctttagattttttgctactcaaagtagcatttcgaactataatctattacttatgacgtgaatgcaatggtcgagacactagaaagaccggatatcaacctaaaacatccataatgaaacacaataattttgaaaaacattagtcaatgaagtaaatcaaaggttgctagagtagttgttaaacttgcttctataacattttatttcattgctcagatcacggtctttcatatctggaaacagagaaacaatgtgttttacaattcgcacttgatttgaatgcaatggtcgagacaccataaacaccataaacacaatagtttcaaaattttgaaaaacataagtccatagagtaaatcaaaagttgctagagtagtcgctaaacttgcttctataacatttatttcattatgcaagtacatcaaccatttacatttaacatctctctcatataattttaataagaaaatgtcataaaaatatatgtaatttacctattttgactaaaataactttaaccattccattagataaataaatctccaatttttatgttgattaagttattttactttcgtttttaatcaataataacgagttaaaattattgactaacaacggagataaatagtaagttcaatgtaaaattgaaaactttattcatctgataaaatagtttgaaagctttttcgttaaaaaagtttgagattatttttagaattctttattacatttatcttttttgaacaaaatctttttatttttccaaacaacccaaacaccacataaaaatgttaagcgcttgccgacaaaaaaaaaacaaagaaacgcttttacgaaacgtgtcaaatttaattagtctaaaacgccgtcgtttctgtataaccatccaacagatccttgtgcttctttttcattacaaggaagactttttcattacaaggaagatcgatcacggacaaaatttgcagagacattgtagacaaagatcattcatgtttcttcaactccggtcttaggtattaattctcttacaatatttctaccttttttactcaattccttccttcattctctaatctcgaattttccaatgcatttttctctgaatttgttcttcaatcgagtttagttagctagggtttttgcagcaatgtcttcgtgatacttcgatttcataaacaaataagatctctctataagtttttatttagatgatccaatacgttgacttttcttaaaattatctgctagatttcattgtttcaattcagattcgaaaattgaaagtttctgtgacattacagttagagaaaggagcttattgaagaatca

SEQ ID NO: 13673 - DNA, 3000 bp, Unknown
  misc_feature (1)..( 3000): cDNA_ID_3031337_gDNA_ID_2214643_Annot_ID_188411 3000 nt of promoter + ATG
acttcatatccaaagttcaactagacgttggtctgctgcatcagtattggatacacggaagcccttaattcaaaaggccagaacagatatcaagcaaagattggagatgatgagattggctttagaggcagcagcggctgcagaggatgcaacaccccttgatgaaaaaactgttctctcctgtaagttgggagatgttacagggcgcaaaactaacgggccaataacagttccagactctgatttccatgactttgataaaaacagatcggaggaatcctttgagccaaggcaaatatgggcaatttatgatgaagatgatggtatgccacgcctatattgtgtggtgagggaagtactctcagttcaaccctttaagattgacattgcctacttaagctctaaaaccgacatcgagtttgggtcaatgaaatgggtacaatatgggtttacaaagtcgtgtggacatttcaggatacgaaactctgacatagtagaccatgttaacatcttttcgcatcttttaaaaggcaagaagacagggagaggtggttgtgttcgaatcttccccacagctggggagatttgggccgtctacaagaactggtcactgaactgggacggatcaacaccggacgaagtgaggcaccaatatgaaatggtcgagattcttgatgagtatactgaacagtatggtgtgtgcgttacccctcttgttaaattagagggctacaaaaccgtgtatcacaggagcacaagggaggacagtaagaagtggataccaaggtgtgaaatgttgcggttttcacatcaagtgccgtcttggtttcttaaagatgcaaccagcggctttcccgaaaactgttgggacttagatccagctgcaatccccgaggagctgcttcacatcggagcaggaaccaattgatttcagtgaccctgtaagagaaagatggtttcacttttcagattgagaccaagtgtaagagttgttgtatcagcgaagattgtggagttttatgaaggactattaacacgcaaaaaccatactgtttggttcagtgaagctgttgtattaggcaaatgttcaacgagtaagcaaagcatagtttgacttttgtttactctgtttcttcttttctttttctttttcgattatgtattcgtttctttgttgaccttagtgatgacagaatttttacaagtagagttataaatgtagcaattatctttccatttcttgctgccttttatttagtaattgaatttacaagttagtgaaaccattttaaaactttgaacaaggtatagttgttccacaatgaaaatgtgtatattgcctactgcttctattaactctttaggtctagaggaagatatttttgtgttcagtctttggatttggttaatatcatgaagatgttcttttggttacaaggtcttcatgaactaaaacaacacaactaccatacttaagtaagccacatccaacattcttaacatgagtttcttttggttaattgtttctctgagtttaatcaatttatactttcatggtcttggtttgcttgttgattcggttgttttttatcttctgcttgatggttagatctatttgtatcgtgattatgtgtttgtaaggaagagcactttggggaaactttcttaaatttttgactttgataatctctgagttttttttggtaaggctgataatctctgttatcctttatcttataaatcacaagtcacttggccaattaaaacctgccacatagattttgtttttatattttaatttaaaaaaaaaattaaaaatagttaataacaaaatagtggtacgtaaaagaaaagagaaaaaagctaaaaaaaaaagagaaaaaaaactgcatttctaaaactccaaaaatcttacatccctaaatttgctcaaactaccacaaaccacgttcaatataaaatatgtcacgatctgaaactgtttgatctcttatttaactcccaacaatcaactcctcttatctattttctcacttttaatttccatcgttttatcatattcatctcttttcctgtttctaatctctattgccagtttgtcttctcttagtcgtttcatttccgtgtttatcgtattcactgaatttagcaaagtcactgatctagatttatgactactctgtattcaatttcattttatattgatcacatattactttttctctgattttacatgattcaagttgaacataccaatgccctactggattatactcctacctccctacaaaactcttcaaaacaaaatggaataataagagctttagcccaaagataaaagtccttgcatgcaagttattctcgaggaggaaaaggtacacaaatataaacttaaaagttaatttagggtattaattaaatgccaattagtttctggtttttaatcaatgattttgtttgtgtaaaggtgtgattcaaacttctggtttagcctgatgtcgacttggtttaatcagttagttgttggatcacggttcaatgccggtttggtattggtttaaggagaaaggagaaatcggtttgagttcagcagaagattgaagagactctcttggtattagagggtttgacttggactctgttataaatagtcttcttcttcctttgttcgttgtaacagaaaattcttatctcaattcttctcctttgtaacacgatcttgagctctgggttttgagcttgagtaaatattgattcatagtggattgctggattgaatccagccccagacgtaggatcatcacaccggtgatctgaactaggtaaacaatcgtgtgttcgtttcgttctttatttgattatgttcttgatcgatctattaagtgttccgcgaattgaagcttgatcgagttgtgttgtgattgaatcgagttgtgttgaatcgatctttgagtcatcggattgtaacagattggtatcagagcctaaggttctttaatg

SEQ ID NO: 13674 - DNA, 3000 bp, Unknown
  misc_feature (1)..( 3000): cDNA_ID_3031349_gDNA_ID_2214643_Annot_ID_188407 3000 nt of promoter + ATG
tgttctttaagaatcagatggatgaaactttgtggacaacaatcgtaccaaaagcaccacatatagcttttccaattcttaacatgtaagaccaaaagattcacaactctcatcataacaatctgcacaatccacgatgcgtcatccataatgtgccatccatataaacattccattatcgtcatccacattgttagaactaagatacaaacattccataaacaagcaaaatctaaaatctaaaaagccaacaatcatatgatcagtttaacgtcatcaaattcaagagagtggccaagtgctatgcaatgataagagtatccatatacatgtgaacaaattgtcaaaacaaattggtgattgcagctaatgtaaaaagtcatatggatatagaggtgtggataggtgtgtgatctaaacacatcatttctagatccggaagatgtatctgttgggaaacgatagctccaataaaaccaaatatcacatcttccctagcatttttgagatagaaagagattaacacaaagttattgttagccaaagtttttgaagaccaactacgtatctataggctggaaatagagcaaaaattaaacaaggaattcaaggtgttcccagagaagggtattagaattttaactggaaaactagatgcattttaacaaatcaaatttcaatgtcaattcacaacattcatatcactggatcctaacttgggattgagtcaactacttaatttaaaattcttcaagtaatttgtcaaatcgatcctaacttgggattgaatcctatcttactatttatcaatttaacattcaatcttaagaaacagataaagccaagtaaaaatccaatacgagagaggataaaatttggttaaagatgctcttacctctcccaaacaatgattcagtttttcttcttccccaattcaaacatccttagtgatctgagttgagaccaatattttctgtcttaatcttcggcgaattggatttctaatgttaataatccttcgataagaaacgatggtggtggccataagttttccagcgaatggagaaaaatatacaaaagtaaaaaaaaaaaaaaaaaattagggtaaacatagattttgattgtgaatttaggataacctcataattttcatgattttgtaaaaattatagagaacgacaatgattttgaaagagagattgaaaatgatgaaaaacaaaagaatatggaagagagagatgataaaagggggatagtttcttacccacacgatctcatcaaaaataagtttaataattattgtgtcatcattacttcaggggtaaattagtccaatttctcctcaaaaagatggcaaagtgcctaatccctgaaaagtgcctcaaaaggaataaaattctttaaaagtgtctaaacgtgtcacattcccttatcattttagtcctttaatttttatatattcaaaatatttcaacactttgactcgtaatctacagattaaaaataaagagacttatctatctcttcgtaatgcattgattgatcacatatgagagcattacgaaaataattttattgagtaatttgtaatttataagttaatttatgtatttttaatttttatttatatgtattttatttataaatgtattgttttgttaattaagattatgtgtaatattttaatgtatgttttagtgttattattaaagttatatagttttaaaataattatgaacaatataaagactataatgcaaaacacatattttagaaacttcatatttaaagtatactcttggagaagaaactactcatactttatatttgaagtttacatactctatatataaaatatcttttggatatgctctaaattatattggattatcttttagagaacctaaaactttatatttgagggatagagtatctcttggagatgctcgtggtagttcaatattgtaccttaactgtaacgtaaatgttgttatctttacttagacgtctttgatatgtaaaaattctatctctgtatcctgtttgtactggcctctccaaggttcaccattattggatgatgcactgggttgatatatataacataactttttggcaaaaaaaagaaacaagaaaaaaaaaacagtctctttggcgatagcgatttggtcggagatttctccgattacattgattgggactttagtgaatcttcacagaagcaacttcacggagaacggcgagaagaatgtggaattgagagcgtcgttagaggatcgagaagcgtcggccgtttcactggagagatctagtgttgttcgttgatgaaggggttctaatttcgatacctaacggaattgatcattgataaggtctcattccggtggcaatcgtcgtcgccggaaacaatgtgcacagatacgaccttgaggttagtttattcctttaaaatctaatcacaacaaaatatatcatttgtattcatgggattatgttcattgtaatggatttgaggatttggtagataaaagtagtaaaaattgtggattgaagaattttcttgtgagagatggttgatgtaagggaaggatcatattctggaacatttgttagctttggttacttctcaccattgtgatgaaatttgctatatccaggggatgattcaagtgagagaaagataaagtttttttgccttcagtctgattctgcattgaatacttccagtgggctgcaggttagtgcttagtgttcttttgatatccttgcattgtcattccgttgatggctattctattgcctccaatgtatactcattccacttattggctccaatgtatactcattccacttattgcctccaatgtatactcactccacttattggctatgggctgcaggttggtgcttagtgttctgttgatactcattccacatattaccactctctaattttgtgacgtcaggataatacttaaaaacgttgtagcaaagcgggag

SEQ ID NO: 13675 - DNA, 3000 bp, Unknown; identical to SEQ ID NO: 13668
  misc_feature (1)..( 3000): cDNA_ID_3031367_gDNA_ID_2214643_Annot_ID_188402 3000 nt of promoter + ATG

SEQ ID NO: 13676 - DNA, 3000 bp, Unknown
  misc_feature (1)..( 3000): cDNA_ID_3031374_gDNA_ID_2214643_Annot_ID_188399 3000 nt of promoter + ATG
gtaataatttcggcaacatcactatcaccacacaaatccttacgattttgacctacttttctagatgggaagtaagaaaacttactcatattttctgtataaccaacactcaaaatcatacttgtcaacattgctaaactcggatcttcaaaatcaagctgtaagagcatcttcattagaagtatctcaatgagatacccaacaaaaaaaaaaaaattttaaaaaaaagtatgagagaagggagaaaaagtaggagagaaggagagttgagtttctcggaggagaaactttgagaaactattctcatccaatttggacaggtgtcatcatactattagttcaactattaaataataattaatatatttgttttgattaaattattaatatatttttttttgagaaactttctttatttttactgatggagatggtctaaacatcttgtctcaccgccatggtatgaaccatctgctgcccaatctcctccgacatgcaatcgaaagaaaagcgtcctaacaaatacaattatcaaaaactctctaaaaatctgataaatttatgcgtctgaaaacaatttaaaaaattgagagaacaatcttataatagttaccttaaaaagctgagagaaattttcctttaataatcttttcctattcgtttaaattttattttttcagacttttggaaattttatgttctgttgtttaatataataataaaatttacatataaaatgctaataataaattttttgcctttttgttttttgaaattttattttattgaaaactattattttgtatattctaataattatattatacatttttactatttccatatcttgttgaattgaagagatcacttaagactttcatcaccttctaattattattataactatttgtataataataattactatattgagtttataataattgacacgtcataatgtactggatcacgtgcatcgcatgttttagacgagagtatcatatggcaactcgtaagaagaaaagctgaaaccagatcttccttcgttaactgttttcagctccagcttctgaaacaaaatatcatcagggttttatctcaaacaacaacagattatatagtttgtagatacgaggaagatcttggactaacctgctgtttggatcataatagaaaccgcgcgctgatggatccgtcgctgcaggagaagcatacgtagtaaaatctagctattgttagtccacaatctgtgccaacatttacaaagtattgctctttccatctcttgcaccaccacaaaaattatccggagtgaattatataggatatgtaagagtaaaggatcatcgatattgatacgaaagcgagagttataccataaatatataagggtaaatgttatgacctgacactcacagaatcaagaatcgtttcccgtattagaaattcaaagggaaacaacatgaagaaaaataagtaagagtttaaggtcttacaggagtgtctgccatgggaacgtttagagcttccatggtgccacaaagacagccatgttcaaggtcaattccctgtatctggacattaactctccaagcttcctccttgtgttaattagagacattttgcgtaccagaaaatgcatgcagcataaaaacatgtgtgttcctcatctttaggttcaatatgaacaaacaatctcttggagccaatgaatgttatacaatcccaactagatataaatgcacttgaattaagcatagatgtcaacatgaaaaagatatcaagccaatcaaagcagacaaggccaacttctactattagctattcttgtgatttcaagtattcataagtcagaacttgtcaagtctgagagaaatttcaccttttacatataaaaatccctaagacaatgtctttatagatatactcagattctgcttacacataaggttatgttcataaaaagagtgtgcatacataaccacagatgcacaagcataactaataaagttctctctagtcctaaccaatattcccaagacctctatggtcagacacttataaaattcaatttgttaaaccaaataaacagaatcgaaaaccacatctcatcatacccggttcggttttcttaaccgaatcaaattatatataaaacggattaggcttctccggttttctactgcgttttgtataaaaccctcacaaaaaccctttctccaaatccttcaacctctattatcgaacttgctatataacctttggacctgactttcctacttctctctaactccaggtttgtcttcctctcaagttgaagctgcggctttattagtttcctgttgacttatgttccttgaatccattcacatgagcttcttacgccgttttcattggtttacctattgacgttgacttgggtctaccatactttttcatgttacttgattgcatatttataaaacggtgctcctttttgtatagcattctagatgttgcttctgaaacaaagctcatctgctgttcttgtcgttgggaatacaaaaactccagtccttcacacttgtcgctccacctacagagttggaaccagaacgcactcgttcaagagtttgactatggcaaatttgcacaagcacttcttcgtctgggaaactgaatacggcttcatctgtgccttgtagctctcacgaggcttctcctatcaggtacctatgccccctgtattgagtataatggtgtcaaccattcttcttaagtattttctcgattcttgttattttcttggctattgtcagtttcatggacatgagaagttgcatagctgttgtagttaagattgcatcacaccaatataataaagaaactagctgtgtgcttccctgctcgtttctctgttactagacacgaagatttgaaaatagtaagactggttaaggtatttctaatgttcattttctttcctctttgcaagtgagaataacgagaataaacatgtcc

SEQ ID NO: 13677 - DNA, 3000 bp, Unknown; identical to SEQ ID NO: 13666
  misc_feature (1)..( 3000): cDNA_ID_3031386_gDNA_ID_2214643_Annot_ID_188396 3000 nt of promoter + ATG

SEQ ID NO: 13678 - DNA, 3000 bp, Unknown; identical to SEQ ID NO: 13674
  misc_feature (1)..( 3000): cDNA_ID_2703769_gDNA_ID_2214643_Annot_ID_136296 3000 nt of promoter + ATG

SEQ ID NO: 13679 - DNA, 3000 bp, Unknown
  misc_feature (1)..( 3000): cDNA_ID_2703765_gDNA_ID_2214643_Annot_ID_136297 3000 nt of promoter + ATG
aggtctagaggaagatatttttgtgttcagtctttggatttggttaatatcatgaagttgttcttttggttacaaggtcttcatgaactaaacaacacaactaccatacttaagtaagccacatccaacattcttaacatgagtttcttttggttaattgtttctctgagtttaatcaatttatactttcatggtcttggtttgcttgttgattctgttgtttttggtcttctgcttgatggttagatctatttgtatcgtgattatgtgtttgtaaggaagatcactttggggaagttttcttaaactcttgagtgcgataatctttgagttactatccaaaatttggcaaaacaaatttgttgaggcaatgtgatgacaatggctatgatatctgctttagtttctaaaatatgtgaaagttgcaattaggtttgggcgttcagatattcgggtcgggtttttcggatttagaaatctaagacccgttcgggtattttaagacttcgggttcggatcgggttttttgggttcggattcgggtttatcaggagtatccaaaactcaaaacttttatatcaaaataggttaaaattacttgaaactattcaaaaatttataaaaacttgattattttctatccgaatttatctaaaagtaggtaaaatacctaaaaatatacaaaataacttaaaatccaaatattttaggcatttaagttgttgtagacttgtagatatgattattattgataaattatttgttatatatatattttggatatgttcgggtacttgatcgggttcaggttcggatctggtttttgggttttgaagtttaggatccattcgggtattttaaaattttgggttcggattcgaatcggattttttgggtcgggtttggtttgattcttcaggttcgggtattttgcccaggcctagttgcaattgagaattcaagttctagattagtttgaggttttgtgattgttaaatacaggacatgatgtggagtatagactattgtgggatcataactttttttgaggaatgtctcatgttgtgtgcttgtcatctctcttttattaggtggtttttttttttttttccccttctctttagctctgaatctcaggctttcctgtgataaatgacaatttgaaattgttttgtatgcccttatatgcccaggttatacgtttcgacctctggctttgcaaacaattgatgtctctattataccatcgactcattacgcttgtgtggatgtttcagattataaacttgttgggtttggtttccttgttttaacatatataactggatgttttgcctatactatttatactgttggaaatgtaagtgagttcctttagcaaagaacaagatacacttattaatgtactatacaagaagtaaattagatacttgattcagtgactactctcttcagaaattttgtttactctagaatgtttagttctagatacttgattcaatactacttccttcggatatgtctcgataatgtttttaatggctttaatttcataaaatattttctctctttatatgtcattgctaaataacagaattaaaacaataaatatatgatgttctaatctttcatcaatttatagcatcatctattgagaagtggacaaaaactgaatcaaaaccctgatcgcaaataattgtcaatcgatcagtgatatggtgttgtgaagaagctgggttcagattgaatcggaatgtgattgacaaaaaaaaaaaaactgaatccaaatttgttttttttctcaacgttggtaacagtaaaaactgttaatagtgtttgggctggaaaaaattaagtgggcttcggttttagatttgggcttcaataacagtatgctttaaacaaaagaggtaaatgtaatgggctttgttaattaccaagtttctaacaaaattattaatgttacaaacatatattgtttttagaaatttgtgacaaacacatttactaatttcaatttcaattttatgatacatcattagaatttcataattgttattttaattacctgctgtccaaattaatatacattcttgagatatccacattgcattgcataaataaaataaatacaagtactaaatctaaatatcattatgaaaataaagtgtcacatacttatacccaccacagaagatatagtttttatataagaaaaaaaaacatcaacaaccattcaaaatcatatgcttacagaaatatacatattatatcgcctaattccataaatccgtagaataaccaatgttatcgttaccttaaatacgtgttctttaattatacacacaaccgaatatataattgagcagtaggaaaaaaatacaataaccatactgaacataaactatattgtcaaaacacaaaacatcaacattaaaaaaaaaaattatccagcagtataccgtggatcatatcctagtattgaatacatgagtacaactacagaaaataacttttattttgttcctatatattaattaaattaagcaaacgttttgttaattatgctcaaacgttttgacattcatttattaattatatgtaatcagattaatcaaatatgattaagtttttaataactcttttgcattttattttgttcattgataaaatagtaaaacattaagtttcaaaattaaaccctataccttaaactttcttaaaacatatttatttatttatcatttaataaaataaatcgaaaacaaataatcaaaaattgaaccatataccctaaaaatcatataggcctggatttccggttaaacccgagtaaagcaaaccggaagaaccgaatcattgcgaattgaagtagcagagaagtaaaccgttcggaaaaattaatttgggctatcggtattcggttcgggtcagttcggttatcagagtccgatcgggttaacctaaaccgagtattagaagccctatataaggttaatg

SEQ ID NO: 13680 - DNA, 3000 bp, Unknown; identical to SEQ ID NO: 13672
  misc_feature (1)..( 3000): cDNA_ID_1018763_gDNA_ID_2214643_Annot_ID_136300 3000 nt of promoter + ATG

SEQ ID NO: 13681 - DNA, 3000 bp, Unknown; identical to SEQ ID NO: 13670
  misc_feature (1)..( 3000): cDNA_ID_2703746_gDNA_ID_2214643_Annot_ID_136303 3000 nt of promoter + ATG

SEQ ID NO: 13682 - DNA, 3000 bp, Unknown
  misc_feature (1)..( 3000): cDNA_ID_2703742_gDNA_ID_2214643_Annot_ID_136305 3000 nt of promoter + ATG
tcctcgaaatcccgagatgctctaccgaatgtgaaatcgtcatcctctgatttggtaaaagagcagagagaacattgtgaggtttcgtagttttatgtaaagacgatgtgaacatgcattgtagtttcatggttggtttggctttggatttcatttgcgtcttaggagtaaaatgaatgcaactatttaggtacttggctggagatatcagttgttcttagaagcaatttgtatcttttggtgattttgtgtaaagccaatgtggatcgtcgtagcagtttcattactacttggtctaatgatattatgatagcttaattattttgctcattcgatagtgaattttctatggcacttcatggatctatctatatctgttcaattgttataaaactctaagcaatgtcaagctcttcaagggaaaaccttctagatgattccaagtctctgcttaatgtgccaactagcctctacgtcactactttgtgtcgtctccaattctcatccttcttgacaagaccaaacgtatcactaatgttggagagatgaccaatgtttgttcatacatttgtttgtaatgaagacatatagcacaacaccatataacatatgatccattctattaattttgctatttttacagccgaagaagaagagtataagaaacatgtttaagattcagccttacacaagtgtagcagaagcaaaaaagaaaggctatcaacgaatgggaactttgatccaaccattggcaaaagcaatggctaagatgacgaatggcgttgacataccgaagatgataatgtaaggaagaggcgtcttcatcggattctctccttctctttctccaacgctttgccaatacctataaagttgtaatgcaaatctcatccataaccatttcgtcagtcacaatattgcatgtttatgaaaaatgtgcatgcaagagtttaagattcttttgactaacttacaaaaaccaaatattttcgatcaaatttatggttcgtgtattgatacaatactaacacaaaccactagtctacatgtcattgtcacataccaaacaaaatctaaattctgcaaaggagactaaaattacattaccatccaatgagtttctgtttattttctacaatctcatgatggaaaaaattgagaattaagatgaactaactgttctggttcttcatctttggtaatgaacttcttcttatctttaggcttcacttctccatctcctccaccttaagcaagaaccaaggattaacagattttcatctacaaataaataaaagatctaagagagtacctaacttggcgtgaagcttgaactgtgggaatcctaatggagatggtggacagaagaattgaggcaaagcaagcaatgatgaatatgaagaagatgatgaggttatggaatcattagttctgtggctaaacgaagaagagggaatgcagagttttgctgccatttccaacaactaaacgttttgtttttgtatatgattttttttgtatatattagttggagatatatgtggcatttgtagtgacatttggcaaacttgtagactaaaaccttatcctcttcttacctctctttgtgttctgattttttgtattagacactccatttgcagtggaacatttgaactaaaccgaatcaatttaataaaagagagaatgtgtaaaccaggcctttttaaaataatattgtaattgctgcaaaaacaaaaaaagtttaagaataataattttgcaattaatttaatggactagttatacaaaaattaatcagcttttatatattttgcaattatttgaatccattacattatgtatgtcaattgggctgcttggacccaatctgaattagaatttcaaaacccacaaatctttcagtcttgcccaactcattttactatcttacaaattcttgttggcaagaaattagttttggaatgaaaattatttgtttgagctttaaaagccggtccaaagactctaactcgcttgggttagacccaataaaccttttattctgaacgaggtttgatcctacttgactgtttctgaatcttattttgcgtatatgaagttctccttgatatgcctaaaatcccttcgaggttcatgtttaaaggtaaatatgtgagttataagactcgtacttttgaacttttgatctgatttttaaaccaatgattaaataacaatttattgtaaaatatttcaaattatatgaagtataatttaagtttaaaatctaatttgcaaaggcaattaaacactattagtacaacatgtaattatataataataataataataataaaaacataaattttgattgatttttgtttgagtgattattttggttatgattggtaaaataccctcaaaccacatttaaaaccatgagatgcaaatgttttgtattgttaactaaagaaatcctctaaactgtagatttggaagtctattttaaaatcactagttcataaaacactagatttcttaagatttttttagaattcatgatggtcatttcaacacaaatcattttaaatgtttgattgaatacacttccctcatttttggaagtaatggatatgattattgccaaatagaaactattaatgatccaaaacatgatttgtaagataaggtttttcacattaaatttctgatgatacactttatgctatattatatttgaagtttagactaaatacaaacacctaaagagattgtaagtatgtgtgtaaatgaagtaacgtatgaatgattaaacctttaaatagaagtatcctcttaatcaaataaacgtcatggaggatgatgcaacattctaacgaactattcgcataaagtttgattacaaaatttgtaattaaagcaaataatatcgttttaagaaaaagaaaaaacacagcagtcaacaattggatggcagaatcgtaaattaagtaacaattgatcggtgactaaaaaaaa

SEQ ID NO: 13683 - DNA, 3000 bp, Unknown; identical to SEQ ID NO: 13669
  misc_feature (1)..( 3000): cDNA_ID_1812229_gDNA_ID_2214643_Annot_ID_136306 3000 nt of promoter + ATG

SEQ ID NO: 13684 - DNA, 3000 bp, Unknown
  misc_feature (1)..( 3000): cDNA_ID_2703848_gDNA_ID_2214644_Annot_ID_136309 3000 nt of promoter + ATG
attcagagtccaatgtcctaaccgctagaccatagaaccaattgatacgtatctaacttattatttatttatacttgttttatttcatcttctccgagccgttgctttgctctatctcttttccattttactactttctccgttcactgtaaaaccatctctctcaattctctccgacaacgttgctctaatgcttctccactgcaacgttagctactacacctcaacgttttccttcatctcctcatctctccgccgtcaagacaacgccgacgattcacaagatacagtaatccgtcgccgccacaatgctagatccatttctctatacatccgccataatcgagacctaaagctcaacaaaaaccctaacgaatctcaagaaacctttgttcctcctcctcctcctccgcggcgagatttagacggtgaaaaccgatccaagctacttgagctctctcttgtaactagaagaactccacaatttcctggttcaatctacgctcaatctgcttctgatgctgatattgcttcttctcttccttcgcttcgtaattttctcggctctgatggtgatgatgatggagagagtgagagggagatgatagttaaagcgcttgagattagaaggaaagtgacgaaagagattatcaaagagtctttggttaggaaaggtagatttgggattacgtatgcgactaatgtcactgatcgtttgggtgatttcgttgatcatgttatgattcaagctgcggcgttgaaacggttgccggaattttcagagtctagattcaatcttcgcgctaggacggttattgaagactccaatttcgttcctcttgtaaggtcaagctccatttttttgtgcttctgggtttgtgtatattagtgcacataagttgttcgataatatgtctcttagaaacaagttcaaagaagtagtagaatatttttaactatgtttctgaattgtgcaggtggttgaagcaccatgagttgtcatataatagaatagcgaagatcatatgcatgtcaaaaggaaatctcgactccataaggatcatgatcgagtggctgaagagcattcatgtgaagggtgaattcattgcagttgcgttcttgagatctggggataatatattgcaacgtaaccgtgaggaactaaacgaaattgttgagtatctagagagcaatggtgtgaggagggattggatgggttatgtggttggaagatgtcctgagttgctgtctttcagcatggaagaagtgaaaagccgtgttgatttcttcttgaaaatgggtatgaatcagaatgactttggcactatggtctatgattatccaaagataattggcttcttctcattccaagtgatggagaaaaaggtactgaaagctctttttaatactccagcgttaagattgtcgtttaagttcataattgtgttgcttgtattaaaccagatcaattacctgaaagagtttggccttagcacagaagaagttgggagactattagcctacaagccacacctaatgggatgcagtattgaagaaagatggaagcctctagtcaaatatttctactaccttggaatccccaaagaaggaatgaaaagaatccttgtcgtgaaaccaattctttactgcattgatttggagaagacgatcgccccaaaggtagttgaacttcgttataacgtatgaactccctataccatacacacagcagattccattaactcagcttctctcttgtgtttttaaaggtaagatttttgcaggagatgggtatccctaatgaagccattggaaacatgttagtaaagtttccttctttacttacaaatagcctctacaagaaaatccgacctgtggttagtaattacttcctctatgaaacaaagatgttccatcgaatgttgttatgttagtgttgttactcataacatatgatgatttcagaagctgcatctgatattgtacaagttgtggttgtacaggtgatttttctcttaaccagagccggagtaacccaaaaggatatcggtaaagttatagcaatggatccagctctccttggatgcagcatagggacgaagctagaacccaacatgagatactatatatcattgggaattcgattttatcaactaggcgaaatgattgctgatttcccgatgctgcttcggtataacgttgataatctgcgcccaaaataccgttacttgcgaagaacaatgatccgtccgcttcaagatctcatagagtttcccaggtaccagaaaaagaattgataaaaataatcccttcaaagtgtagcttttgagaaccatggcacttgtaacagattttttagctactcactagagcgtcggataatcccaaggcacaccattatggttgagaacagagttaacttcaagctcagatacatgttggcttgtacggatgaagagtttgagaggagagtgagagataaagtggagagaagagagagattcgaagctggcctcgactctgaggattctcaaccgtcggatgagaacatctccgatcaggagattgctttctcagacgaagcggaagaagaagaggatttgacagaatgaagaggatttagcataatgaatagttctgtacagtttaacacaattataaacgaacgaatgtgtgaatgagtctatatttataaatactaaaatgagaatacttgttctttcatgtcctaagaattcgaaaaagcacttttacagtttgtgaaaccaaacgctcaatcgcctcctccgccatcttttctcttccggtgctcttgattctctcaactccgccgtatatatttcaaataaagagagagtcggtttagggttaaccagaagtgagtgtataattgatagattagagagtattgggacttttttaatctatagcgataacttcgggtccttaagttgaaaataatttttcttcagctattgactgaaatgacatcgttttagt

SEQ ID NO: 13685 - DNA, 3000 bp, Unknown
  misc_feature (1)..( 3000): cDNA_ID_2703844_gDNA_ID_2214644_Annot_ID_136310 3000 nt of promoter + ATG
tgatcgaattactcgtcaacagtttatattattttcgtctcctccgggagaccgggacaaataaaaagtagtacttcatctgtttcttattaatctattttctataagaaaaaaatatttcaaacaaattctttttatcatcaattgtaaagttaaaaacaaaataattgaataataatggtttagagttacagaaaattgtaagtcacaaattaatgtatttataattaagttttaatatgtttcatgcatgaaaattctactaaacataaacatatggaattaacctaaacatatactactagaacagtatctcaacctaaaattattttgataaaagcacatttatttattttgaagtcaacatttatttatccaaaatcaaattgtatggaaacaaatttgtgttttaacttttgttatattaattgttaaatttttgacccgtcatataagacttaatttaaggagcattggagcaagtaagaagtcaagaacatcaaaaaagatttacaaccaaactgggaaaaaatatgtatatatatatattataagagaagaagtttttttaatatataagagaaaaaattagatatctacggaaaatgaaaagcgagaaatctgcagatgcttatggaacatattttcttctaatatcaaccattttcttgcttttcattgcacgtaagtcattacttggttcataaaattcaaatacaaaaactgatctttttgtgatagtgggtgatctttgaatgtattggttatgtttttgttttatatatatatatatatatatatatatatatatatatatatatatatatatatcaattacaggacaagcaagttcgtaccaaatgctcatatgtttagatctaaatatatcatgtgccgactgccaaaaacagtgcgacgagacaagttatggaggaatgtgtttaaatggaggcagaacttgttgttgcaaaaaaagtcctccgccatcatattatgatcctaggcccccttcttcataatcatatggaatgtgttcctatttggtactatcattttggatttgctcaaacatatcaaatttatactttgaaaagaaaagaatcatcaaaataaagttattttattattttttctttgtttactaatctcacaatcataacgtcaattatatagaaattttcttaacatgagtcaaaataagactaacgctaaattttacattctaattctaattttaagtgatgtttctgaaccaaataatatgtattaagtttactaatagtttaacatattaacatttaaccagcatatatgaatagcttatcgattagaaagtgatttctaacaaagccacacaatagtccagatacactcaaacccgatagtgcataattaacagaactactataatcacaaacaaagtgtatgattgagccacatattaacctagatatagaaagataatataccatgggaagttatatattattgttcaaataataaaattcgttatattttttaaccagaaaatggtgaaacaacattaattatcagtagaacacatgttccatatttcattagttttggaaaacttcttagaactaaaacgtttgagttgatacatttcaaaaaataatcccgtccatttcttatggcattcctttccagctttcactatcccccaacaacaaacccttgaaacacttttgttctgaacaatataagctatcacttcgtccgcacattgatatgggccatatggcatgtccatctttttaccgcagttcttaagataatctttttctttttctgaatatttacgtaacatattgtcgttataatcgtctgatgccggtgaccttgccatcattgcatcaaactcgtcgtctgaaatgagtagtggctcgtcattacctctttctttggccaaagttagatgagaaaacgatagcaaaaccatgatcgaagaaaatatcatgaacatggttttattctccattttaaaatattttgatcttttattcttaattagtttttttttgtttctattctaccaatgaggatttctgcatgtatttatagtatcaaatgttcatagcattattatttagtaactttttattagtaaaaataacatttttctatttataacaataatttattagttatcaacataatttacatcttttgacgttttacaacgtttataaatattgttcgtttaatgcatttcagaaagcttcattgtagtatatgcatttaaagcttcattgtagtaaatttattgttcgtattcgaatgaagtttgcaaagaaatttaagaaaaagagtataaaagtaacgaaataagttatttcaaacctgcacaatagttaacaatttgtaaatataaaaatatatgggcgtattaactatttaatactgactaaaaaaataggttaatttggctccagaaaaatataacaaaaacagctaagatgtaccaatctgatattacactaaaaccgaaccaagatttacttataaagcaattaatggtttcatactttcgttaattagaaaatcaaaaatcaaaattgaaccgaactgaaccaattttagtgtatctaaactaaacataatcatattatattttaaaatttttaatactgtatttacaataaatatattcgtgttgtagaaatgtaatataaactatgtaaagtctttatctatatttataaatttatctagtcatggtaatatgtagtgcaaatataaaaagaaatcacccagcatagaaacatttaaaatttcaacaattctttgaactacatccacaaatccttcaattcttatcttcaaatgatgtgacatatttttaccccactaaaattccactaattcatttacacttgggttagacccttcttacatgttccccaccctttcaattcaggcataaagcataaccgaatcgttcacagatagagaaagagagaaagattagaagaaacaaat

SEQ ID NO: 13686 - DNA, 3000 bp, Unknown
  misc_feature (1)..( 3000): cDNA_ID_2703825_gDNA_ID_2214644_Annot_ID_136315 3000 nt of promoter + ATG
cttgttttttcacagattccagaatccttcaacgaatgagattgtaacacgtgtaagtgagacaacttaggtgacaattccatatttggagtcggaatttggcttacgtggaacccaccgaaatcgtgtaatagaagtcaaacgcatctatatctgtgtttaagctaaaagtaaacctcattgaagaagtaacataggaaagctttcgtagccgtcagatcaaccagacaaaacgtcatatcgagacaaaaactttcgacggagcagattctacagatacaatacacacggtttcactggatttcgcccctctctctttaaacaaaattaaataatatcagaagacacgttcttcttcttacgaaaccgactttgtagtttcttctttttttccattacacaaaaacgaaaaaacgacaacacaaaaacaaataacaaaatcttttaaataaaaaataaatcgactctcgtgtttgtttaacttcttgtttatttttcttagaggttaattaatttcttctctacatgaacgatccaatgggagaaacaggattttctagagaatcggcgccggagatcgtgttctcggagacggatatggctgcggctgagcagcttatgcatctaagcgaagaagaaacggttagctgtagcagcagcaccggcggagattgcggtggcggaggcggagacaagataaagcatgaatatgttagctcgagaatcggaaacgagctaaacgacggcgtacgaggaaactctattcttggcgtggagaagaagaggaagaggacggtgatgaaggaaaagaagtttcgatctcttgagagtatttacaaagggacgaaggagattagggattaatggaggaaagggatcggagagatggttaattatatatcgtttgttaattacttttgttaatcgatgttagtaacctcttcaatggtttttttggtgtgtgtgtatatttctagtccttgcttaatttaacgttggagctgaaaatttgtgataatagtttttggagattttcagatgaaatctgtaaatattttggttctcatatatattagacgtgatgctgttttttgtttttccctagtcacttcgttgcaaaaattaacaattttactttggttttggatctgatagtacattcatttttttcgtaagatttaaaagtttatttacgtgcaaatgatttcgttttgaatttttaaattttgagttctatgatgtgccaactgccaactgagatcattttttttttaccttttcaaaaagtatatattctacacaacaaaccagacacatgcaacaccaccaaatatcttaaaattgtggtgatgatttttatacttactgcagtaaagaaaaatcataaattttatcatgttcaactaaaggcatttgaagatgcctcatgtgggtgttgagtgaactcgggtcatgggtctttttcgtgaacttctcgttgagagcttcatcttcttaattatcttggagtcatcttctgattcttgtagcttgtattagggtttttgttataccttgatgagcatgtaaagagaggtcaagagtgagtgagttcctatagtaaacattcagttgatcgattggatgtttgtgacacaaaatgtactgtaggagaactagtgactatgtatggaaattgtttatgcattgatgtttagtcatgctaaaaacagatttcaacaagtggtattagagcacaactattctcaaggatagtcaaatttgtaacagaaaagcatattaaggcatgcaagcaatgcaagttgcacaagaagattctattctagtctcgattcttgtaaaatcgagtcacaaaagatcaaggtttcctagtatatcaaggatttcatcgggatataattcctaatgtatcttttttgcaatcatggcttgaacctctagacggttttggcagtatttgtatccatcatttccataccaaatcgtgtttgcctcaacattctacatgtaaattgcactatctgctcatgccttccacaaaatacctaggcaaaagacattaatttttcaagtttacgagcacggagtttagaggagccatcacactgattttacaataaatgaagaaaaatctttttgttatcttgattgacgtctactcatcccatgttttaacttgaaactttaattggcagctaatatctatagtgttatatccacaataggtggaaataaaaccctcacgttccacatcatgttgaataaataaagctgtcatccgaaatagatttggaggtatatagaagttttgactctttgagataacactgtggaagtcaaaaaaaaaaaaaaaaaaaaaaaaaaagtcaaaacatcctcctcgtctgagatgttccatgcaatatatctcttcataattctttcttgtcttcaacaaagtccagcaaggatctgagaagtttgcgtcgattgattatgccaacttgaagttggaaatagaagaagactaggcggaacatctcatcaaaaccctatacattcaacagggaaattcttttgcacgaatgttagacttcaatattgaataaaattcatagtttcaacaatctcataaaaaaagagctgggctccattcgaagacacattaatttccatgggcctggtccacatacaaccatactaaatttgaagtaatttacccgccatttaaaaaagcccataggctccttctcctagaagctggcgggaaaatcccaaaacttttcccgggaaagtagataaaaaatttcggccattaaaggacaaaatcacaagaaagtagaaaccctagagattttgaaaccgaaaccccaaaaacccctttgacgcctccttcttcttatctctttataaaaaaccatttctttcctgcaacatcgttgcttatcatcagacgcacatcacctgttcgataaaattcctctgagagtgttttttttgttttccttctgacaaagaaat

SEQ ID NO: 13687 - DNA, 3000 bp, Unknown
  misc_feature (1)..( 3000): cDNA_ID_2713990_gDNA_ID_2214644_Annot_ID_136316 3000 nt of
gagggtccagaataatgggcagtggtcactgttttgtcctaacgaagctccaggtttggcagattgctggggagctgaatttgagacactgtacactaagtatgaaagagaggtgagtccctatttcatccatgtatatgctgcttctttagtaactcaaattcctgttatctcaatacagttatgtttgttcatatcttcagggaaaggccaaaaaggttgttcaggcgcagcagctttggtacgaaatattgacatcccaggtagaaacaggaacaccatacatgcttttcaaggtaagtaacagtcatcattctgtagctacacgttatggccttataatcattggttcttactccaaatttgaatgctcttaaactataggattcatgcaaccgaaaaagtaatcagcaaaatctgggtaccataaagtcgtccaacttatgcactgaaatcattgagtacactagtccaacagaaactgctgtgtgcaatcttgcatctattgctttacccagatttgtaagggagaaggtgagagggagactggttttttaaaatttgctttctctttattactcaatgtatagctctaacattcttcatctcacaacagggtgtcccattagactctcatccacctaagctcgctggcagtctggactcaaagaatcgttactttgattttgaaaaattagcagaggtcagatacaagcactcgccttgcttgacctgaaatctgattcttaaggaattatctgtggagatatttccgtgtctgtgatgtgatgtttgactttttaatttttctgtgtggccaggtgactgctactgttactgttaatctcaataagataatagatgtgaattactatcctgtggagactgcaaaaacttcaaacatgcgtcatagacctattggtattggtgtacaaggccttgcagatgcatttatcctccttggaatgccatttgattctccagaggtagacttgttttgaattatgatcaatcttggaaaatataattttgttatctgttcttaagcagtttaatttgttactcaggcccaacaactgaataaggatatattcgaaaccatatactaccatgcactcaaagcatctacagagcttgctgcaagacttggcccctatgaaacctatgctggaagtcccgtgagtaaggtatgcatctcagccatcaattatatcaatttggttttcccaaacttcataagctaccattgtggattgttatgctgactttatcccatgcttctctagggaatccttcaacctgacatgtggaatgtaattccatcagaccgctgggactgggctgttcttagagatatgatatcaaagaatggagtgaggaactctcttttagtagcaccaatgccaactgcttcaaccagtcaaatccttgggaacaatgaatgttttgagccctacacatcaaacatctacagccgcagagtcttgaggtatgtgaatattaaatcatttgacaagtatgtttctggttttccccatttgatgcttactcacttggttgtcttggtttgtacagtggtgaattcgtagtggttaataagcatcttctccatgacctaactgatatgggactttggactccaacgctgaaaaacaaattaattaatgagaatggttctatagttaatgttgctgagatacctgatgacttgaaggcgatttacaggtatagcttccacttattttgtgttttcactctctactgtctagataaagaaatttgacttgtttcttctgtaaaacaacacagaactgtctgggaaatcaaacagagaacagtggtggacatggctgctgatcgtggatgctacatagatcaaagccaaagcttaaacatacacatggacaaacccaacttcgcaaaactcacttcgctacacttctatacttggaaaaaggtacaaaccttaatcatctaaactcttcatatgataattgtgaaataggttagagattctatagagtatctgatccttcactcatctgacaattactcttaatctcacttatgttgttgtgaatctaccttaagggtctgaaaaccgggatgtactacctgcgatcccgtgctgcagctgatgcgataaagttcaccgttgacacagccatgctcaaggtagaaaaaacaatgcaaactctttacgctgattcttcttgtgaactcagacattttacctatgagttgttttcgttggggtgaatgtaggagaagccgagtgtagcagaaggagacaaagaagtagaagaagaggataatgaaactaagttggcgcagatggtatgttccttgacaaaccctgaagagtgtttggcctgcggaagttgaagctctaagttatagtttgggtcttaaaaagttagaaagtaaaagcatgtctcttggacggtcttttttatttacttgcttatctgggtgtattttgttaatagtttcctaatgcttaatgttgcttgagtttttgtgtaatccaatttcgtttttaccttttctcttgaaacaataaggatttgtaacgagaattatgtataaccaccaccaccttacggtagattttactatccatatataaatattttaccatccatttataaatatttgtagtttggtactactaccaatggttgtaagtaatctgtaagaatatattctgatcattgtagattagaaaatgtgttactacaggtttcactagcttatcctagaactagaaacatgaaaattatgtatcgaatggtgaaaatattaatacaaacatatttacgtttaaatgcatgtgtacacaacaaagtttctaaagcaagctctatcatatagagaataaagtaaagcatgtagccaaacactctgaaactctgacgaatcgtttatcactgatttctctatcgatagtcccgccttcattgccaaatttaaactcgaaatctctctctcactcactca

SEQ ID NO: 13688 - DNA, 3000 bp, Unknown
  misc_feature (1)..( 3000): cDNA_ID_2713978_gDNA_ID_2214644_Annot_ID_136320 3000 nt of promoter + ATG
gtagaagcttgaaatatgtaggaaattttgcaaaatctgccatattattggtccaatcttacaatttctaccatattctagttcagcttacaatatctaccacattttacttcacttggtaattcgtggacaaaaatgcccttaaagtgggtcagggactgacttagatggtgacagcttttaactgatgtgatgatacatgacaaaaaatcatggtggaaacataaaagattaggagagagaatagtggagaacagctggcttctactgttattgggtatttaaaattgacttgtttaaaaaaattggttatccaaaattctgcgggggacaacgtaatatataatacattaggagacatgattacctgctagcgggagacaacgtaatatataatgcattaggggacatgattacctgttagcggagaaattctgcgggggacaacgtaatatataatacattaggagatgtgattacctgctagcgggggacaacgtaatatataatgcattaggggacataattacctgttagcggagtacaactggtgacagacttttgttttagtctccagatcttgtccccgaatagaaatctgttgcatctacgttttgttttcgatttcatcatcttgctctattattatgaatcctacacgttatatgcaattgttctcatttaagaattttaaattttatttagatttttcgtcatctattttggtccacagattagttgagcgttattgtcttcacctacacgtttacatattttaataatatattatatcggggacaagttcatatcgaatgagtaatagaattagatcggggacaaattcagatcgaataatagacaagatgatatgtaataactggatgtttttgttattttacaatagaagaaaaaaaaatcgtgtcggtgaaaacaataatgctcaactaatctgtggaccaaaataaatggtgaaaatctaaatcaaattagaaaccttaaatgagaataattggtggataaaatgtgggattcatgataatattgaaagatggtgaaaatcggagacaagatctagacataacggaaaatttatgatgaatagaaattaggggacaaaataaattaaaagttatatgtaaagaatatgtgcacgttgtcaggagaagtgagagagacaaaaacgtttcattttgtcttcggaaagatagtgatgtgtggttaaagcgcacggatctcgagaaaggagaaacaaaatagagaagaaatggtgagggcaatatagatattttaagtggaaatgtggtatgatgtgtaagggaggaaaaattatggtaaattgcataagaaattgagaaaatatggtaaattttataatttttccaaatatttatagtttttagtttgttgggcttcgaagatatactagattttaaccgcggtacactgtgggtacaatttattttttaaagttagtatatataaaaatttacaaattttatgtatctataaaatatttttattttatagtttacagttgttattaagtaacgtcctgccaaacccgtcttgtaaaaaaaaatcatttatgatatgtttatgaatcattgtctaaatattttagtcgatgcgcgacgttgaacccacacattttttcgccaattggttaatatatgttcatttttaaaattttgaatcacaaaatatgacggaaatgttttttgagatttttaaaaactttatatattatataatgatgttaaaaaattgtgatatattaaacgtttagaatatttaaatatgtgaaatctttaaaaattaaataagaaaattttaaattaatttgaattataattgttttataaaagtattattaaaaaaaaatgtttaatttcaccgaacgggattagatggtaggacgggtttataatattattatatatatactttacaacaattaaataatcatttgaagaaagaaaacttttaaattgatttgaattatacatcttttaaactaaaatattattaaaacaaaataacaaaataatgtttaatttttctgaacggggttagatggtatgacgggtttgggtcgatagtaatacaagacggtataccacgggtgaaatccattaaatatgtttaattccactgaacgggattagatggtatgacgggtttggatcgatagtaatacgagacagtatactacagatgaaatcttagatataacaattaaaatataattatattatcttaaacactaaacaaattaaagaatattaattaaataaatataatttaaatttaaattatgtagttataaactagattttgacttaatgaactgtatgtattgtttctatagttttaaaaagtaaaaatcaaacatagtaattgtatactaaaaatctatagatataagagttgtacatttagaaaatacaaaaaaataaattatatatatttttaatctactaaacatattaaatttttattttttaaaaaataattatagtcccgcggtataccatagattataattaatatatatatatatatatatttatttatatagatatttacacaattcttttaaacaataacaaaaagaggttaaggaggaaaactagattaacatagaaaacacttattacctgaaactagtaaaaagaaagaaagtaatatcaattggcttaaaaaaatagtagaggatatggggcacaataaacaaatttatttcatgtttacgacaaattttatgtttgtttttaataaaaaacaaaaattgcggtatattacgggttaaaatctaatttacgtttaaaacgtaagtaaactcgatatccaaacccataattgacccgacccgaactcccaaaagtgaagctcgaatcaaaacatacaaataattggaaaacgtttttaaatctttaaatcaaagcggagaagtaaataaaattctgaacgttttcttggttgactttcttgctctcgatg

SEQ ID NO: 13689 - DNA, 3000 bp, Unknown
  misc_feature (1)..( 3000): cDNA_ID_2713974_gDNA_ID_2214644_Annot_ID_136321 3000 nt of promoter + ATG
atgtaaacgtgtaggtgaagacaataacgctcaactaatctgtggaccaaaatagatgacgaaaaatctaaataaaatttaaaattcttaaatgagaacaattgcatataacgtgtaggattcataataatagagcaagatgatgaaatcgaaaacaaaacgtagatgcaacagatttctattcggggacaagatctggagactaaaacaaaagtctgtcaccagttgtactccgctaacaggtaattatgtcccctaatgcattatatattacgttgtcccccgctagcaggtaatcacatctcctaatgtattatatattacgttgtcccccgcagaatttctccgctaacaggtaatcatgtcccctaatgcattatatattacgttgtctcccgctagcaggtaatcatgtctcctaatgtattatatattacgttgtcccccgcagaattttggataaccaatttttttaaacaagtcaattttaaatacccaataacagtagaagccagctgttctccactattctctctcctaatcttttatgtttccaccatgattttttgtcatgtatcatcacatcagttaaaagctgtcaccatctaagtcagtccctgacccactttaagggcatttttgtccacgaattaccaagtgaagtaaaatgtggtagatattgtaagctgaactagaatatggtagaaattgtaagattggaccaataatatggcagattttgcaaaatttcctacatatttcaagcttctacctctagttcactactttcgttattaaataagcccaattactctcacgttactattctacatgtgttatctatatttggttaggcagttatcaacgctttcacgacattgtaaaatttttagactgaatgcattccataaaatgatgtttaatttgagaccgaatgcattccataaaaattgaaacttttaaatatgtttttaattaaaaatattattaaacaaaaaataacaaaatgctgtttaattttacgggacggagttatatggtggaacaagtttggattgatactaatatgatatggtataccacaagtgaaatcctaaatttaaaacaaaaaataaaatgatataatcttaaacactaaacaacccaaataatactaacaaaacaaatacaacttaaaatttaaggtttttcattttaaaaaatcgatcattaatgtacagtggagtaatattttagatagaaaataatatcaaattattattatagtccatgattataaatatttaccaatattaacactatatcacttctacacctacaaatcttctaagtacatcaatacaattaacacatttatgtaacaaatacaaaaactcaggaaacaatctttttgcatttcaactatattaattctaatataatataattaaatgagaaatatgtttttacattatgaatttaaaaatccaataaattattaattattatctaaaatctataaaataaaaatattgtcatgcggtataccgcgaattaaatcctaatagaatactataatcaatgactaattaacacatcaaatgaatttgcttcatttacatatctttaataaacgttactataatattttatattaaaatttatatattaaatatattgtgtctaatattaaatatgattgaattttatgactacattttttaatgatatattaacgtatttgcaacttacagtatgtgtaccccgaataatagcatacgatattttccattgtagattacgaaattctcatatttaaactcttctcttgtgggtagggttgtcaaaatgggtcaaaattcatcggtcaactcaactcaattcatgaaccctaatgagttgaaaatattgactcaaatgagttgatgggtcaaatgagttcttgaatcaattagtttgatgaataaaatgagttgagttgtaatggttaatagtttcaatggtttatccaattaacccatcaaattttgtaaaattgaattaaaccaactaaaatctctaaaccaataccaatttaagtttaaccaacacatctaaactaatttaataaaatcaatattttccaaatttcttaaatatacaagctatgaaattgaaaagaagtaaactcgtaattttccaccaaaaaacataaacccgtaattttcccgccaaaaaagtaaacccgtgattttcccgccaaaaacgaaaaactcgtgattttcccgccaaaaatgtaaacccgtaattttcccgccaaaaaacgtaaacccctaattttcccgcaaaaaaagtaaacccatgattttcccgccgaaaacgtaaacccctaattttcccgctaaaaacataaacccgtgattttctcgccaaaaacgtaaatccgtaattttcccgccaaaaatgttaacccgtaatttaccggccaaaaaacttaaacccatgattttcctgctaaaaacgtaaacccgtaattttcccgccaaaaaagtaaacccgtgatttttccgacaaaaacgtaaatctgtaatttttctgccaaaaacgtaaatccatgattttcccgccaaaaacgtaaaccccgtaaaaaatggaatccgaaaatatcttaagtttgatgataataaattaataattattaataatgataattatttattattgttttataataataattaattaaattattacgtgggataatctatttaacaactcaactcatcaaatgaaatgagttatgggttgggtcaacccatttaatcatttaactctaaactgatttgataatgagttgagttgagttgggttacccatttcgacactcctacttgtgggcttagtgaaatttcgtagatgtatatgtaagcccgttaaacattgtatacgatttaataaaacagaacgacttgtttcgtgcactcctcccactatcttaaatctaaaaaaaaaaactttggatctcatctctcgttgacttcg

SEQ ID NO: 13690 - DNA, 3000 bp, Unknown
  misc_feature (1)..( 3000): cDNA_ID_2703829_gDNA_ID_2214644_Annot_ID_136323 3000 nt of promoter + ATG
ctccgtttctaagatatgggataccgctggacaagagagatttcaaagtctaggggccgcgttctatagaggtgctgattgttgcgttcttgtctacgacgtgaacaatctcaaatcttttgaaactctcaataactggcacacagagttcctcaaacaggttttgccctaatgttccatttcgtgtgcaagaagttacagttaccatccaagtctaaccgcttcgattccattttctgatatcctctaggcaaatcctatggaaccggagacatttccctttgttttgatcgggaacaagaccgatgtagatggcggaaacagccgagttgtaagccgatatgatcttcataaatctcatcttcaaacccatcaaaaaccctaatttcccgattcaacttatgcaggtttcaaataagagagccatcgagtggtgtggctcaaagggaaacataccgtaccatgaaacctctgcgaaggaagataccaatatcgatgaagcttttttgagtgttgcacacattgctctctctaatgaacgtaaacaaagcaatgacatgtgagtttctatatagatctaactctttccaatttttctctaagattcatgtttgaattgttgtttgtatttgaatttgcagatatcctagaggccagtatcatgactctgttacggatattattgatccagatcagtcaagaggttgtgcttgctgattccatgtttgacatatctgatcaaataatatcgagtcccagctctttcatttgcagtccttgtttttggtaactttttttctatttattggtttaataatatcatttatagaggtttattaacgacaaaaaacagttgatacatactactttctgagtgttttgattcatgtaaagcattaattaatttctatttaatttttgtaaaccttttcgttgagataacttatagtaccatcaccgaatcacttggatttgttctacctatatatgtctattagtagtactccatttgattattctttttgaaagcgtaacgtttaggtgtggcattaaaaaacaaacacattttggtgtagagtctttccgcctctgcgcaactacttctccttaatgctcccttttataggctcaaccaattttgtatttctccttagtgctcttttttattgactctaaccaataatatttgtattggatgtcataaaagagactcttgttatctcttgtgaacattgtttttaaaccaaaaaacaacaaccaactttgctctttcgcttttagttgcaactcattttcaaacgtaaattttgttaagcgttatgtgaatttccgactcaaaaatcaattgacattcactgaacattctcagtatgggatttctatcaagtcttttgaagatgtggtttctctgatccatttagagtaaaatcttacttttttttttttgcaacatgtatatcttatttttatccaccgataatcaattatgtacaagttgattgcataatttttggtgtagcaaaagtaggtttaaacgttggaaaccgaacttaactcatggtattgtcttgatgggcttgattcctcctatcaagttctttatacatggacaaattcttaatgaactagctagcatggtcagttttgtaccaagtccggaagcaattcccaattagacatatgatgagcttggaaagatgagtgaatgtgattcttctagagagagtacttggagatcatcaggaggcatatgtagtgggacaaatgtttatagaaaaatattcaatcgggaaagtaatacatgatttgttaaactgtaaaaatggcgaaagtacatggactgcaatggtggaacgaaatggctagtaatgtatattgcatgatcatgggaataaggagaagataagtgatggaattgggggggggggggggggggttaaaggtcgacgaccaaaatatgcgcaagcatgagtttgagggttgctatgtctgagttgtgagttatgatgactgagatatgtcaaactatgagtttgataataagactatatgtaatgagagtgttgaataaattattcaactgttgaacacatacgatgagagtgttgaaaaagtaaaaaatcatatgtggattaaacactattgaatagattcaacatattgaaaaccaaaaaatgggagaaaagatgtatgctctcaaaggataaacgttaaaagaaccaccttttcagtcgcagaaggagaggctctagtcttaaaggaagcaaccctccaactaaaatggttgcaatttgatcatcaaaaccggtccgtgactaaagtccatgaaacaaaagctttaggtaacagtaataataagagctttagataaatggtctaatggtctgtccgaaccttttcagttttcaatgatcagtcacagttttgattctaattattgttgaatctattacttataattttttttgactatttatgttaatataccaaattatttttgctttaggtatccatatagttttgaccgacctcgatgatcatgttatattctgtggagatttatcaactatttataaataccttgaaaccgctactagacattggagtaatccctcaccttgtctcatttggcaaatatttcctataggttcaacttattagtagaaatgacaatgtcttggctgacacttatcaagaactctccttgtaatcacttagttacttccattatggaaaagttgaccgatcgaaaaaaggtattaaaaaaaaaaaatagaaaaattaagattttcatagtgtaattgtaaaaaataaaatcaaattattttcagatattccgtattgggaataaatctcagccgttgattactatcaacggtgtacaattactgcctttgcctgttacttgttctgctccgtcgctcagataggatctcaacaagacaccacaaaccctaaatttcgtcaactccacagcgactcgattcgatcaaggaaatg

SEQ ID NO: 13691 - DNA, 3000 bp, Unknown
  misc_feature (1)..( 3000): cDNA_ID_2703818_gDNA_ID_2214644_Annot_ID_136325 3000 nt of promoter + ATG
tgaaccaagttaatttatgcggttttccaattgccgtaaaccaaccttcgacaaatctttggtgtacttacaacatcaccaagcttctcgagagtggataacaccagcaaaggagctactaataaagaatataatttatgtggtataccacaacaaaatattatcgaaatagagaaaatccataatattaattcaattccattgggaattcatttttgttccgaatgaaagtatataataataaattcatttccacggagaccactagtatatattactgtgtagaaaaaaaatgatagtgcatgatataacgttggtaatttaattgattgattaggttaagtttaaaatacaaagaaaattactggtaaaaaaattaattttggttggttttcaattctaatatggaaaaaatatggcttaaaagttagaatatattataaggcaattgacacaaatagcattaaaaaatattcaaaactagcaccacatataaaaaactacacaaatatcacttttcattttatttaattattaaatgtaaattattaaaagttgtcaccattaatgaacctctgagccacaagagaaggacgagccaaaggaggaggtggaaaaagagaagaaaccaaagtcacagaagaagggtaagaaggaaagtaaaagaaaggaaccagagccaaaacagaaggtggaaaccaagaagaaaccaacgccacaaaagaaagacgagaacaaaaggaaaaatgggcctaaagagaagggtaggaaagaaacacagaaatccgtaagatgggctaaatcagtaggagagctaatcaaaaagaggtgtttacactagaatgttgacagtgcaacccgctagtttgaaagatcagctaggctaagaataatgtatagaccagaatattcgtgttcaaactagaaagaaaaagcaggaagcctaaattcactatggacctccttctgacttttgatttctattgtattttatgtagccctctgtactgaacttacaccccttttttggaagtactagcttttgtgatcccttgaagaactggcaaaggcaaaagcaaacttcttgtaagcagatttgtagtcgaccaacttgtactatgccgacaaactgcttacaaatcggcataatacaagtttgtggactacaaatctctttacaagaactttgcttctgactacaaaatctacacattattcttagcctaactgatctctcaaattggcgggttgcgctgtcaacattctagtgtaaacgcctcttttttattagctctcctactggttcagcccaccttacgaatttatgtgtttccttcctacccttctctttcggcccatttttccttttgttctcgtccttcttttgtggcgttggtttcttcttcgtttccaccttctgttttggttctggttcctttctttactttccttcttgcccttcttttgtggctttggtttcttctcttttcccacctcctcctttggctcgtccttctcttgtggctcaggggttcattatgaacaaatatcactcttcactcttcaccttctcgtcgtctgatatgagtagtggctcgtcattatctccttctttggccaaagttggatgagaaaacgatagcaaaaccatgatcgaagaaaatattatgaacattgttttattctccattttaaaatattttgatcttttattcttagttagttagtttttttttattttaccaatgaggatttctgcatgtatttatagtctaaaatgttcataacattgttatttagtaactttttattagtaaaagtaacatttttctatttatctttgaccaacaataatttattagttatcaacataatttacatttttgacgttttacaacgtttataactattgttcgtttaatgcatttcggtttatgacaatatgaattaagctgaatgaaaatgcatttcagtttatgacaatatgaaaaatcttaagcgtttcatagatagaaaactgggttttgagtcccactatatatgcatttaaagcttcattgtagtaaatttattgttcgtactcgaatgaagtttgcaaaaaaatttaagaaaaaagagtataaaagtaacaaaataagttatttcaaacttgcaccatagtttacaatttgtgaatatgaaaacatatgggcgtattaactatttaatactgactaaaaaaagcggttaatttggccccaaaaaaaacataacaaaaacagctaagatgtaccaatctgatattacactaaaaccgaaccaaggtttacttatagagcaatggtttcatgctttcattaattagaaaatcaaaaatcaaaattgaaccgaactgaaccaattttagtgtatctaaactaaacataatcatattatattttaaaaacttttaatattgtatttacaataaatatattcgtattgtagaaatgtaatataaactgtggaacccccttgatccaaatgttgaccaagggttcattaatgattctaccccaagaggtctggggttcgagtcccagctattgtgatttattagcaaatttgcagattaatggaggcaagtgtacaggagatctacaacgaagtataattatagccgtttgtcaagattttacgcagagaagatattgaagatgtccattaagcgcatggagaaggataagaagattatgtaaaattttttatctatatttataaatttatctagtcatggtaatatgtagtgcaaatataaaaagaaatcacccagcatagaaacatttaaaatttcaacaattctttaaactacatccacaaatccttcaattcttatcttcaaatgatgtgacatatttttaccccactaaaattccactaattcatttacacttgggttagacccttcttacatgttccccaccctagcataaccgaatcgttcacagatagagagaaagagagagattagaagaaacaaat

SEQ ID NO: 13692 - DNA, 3000 bp, Unknown
  misc_feature (1)..( 3000): cDNA_ID_2713962_gDNA_ID_2214644_Annot_ID_136330 3000 nt of promoter + ATG
ttttgtacgcacaaagtcgggtgccaaaacaatctcccctgcatcattagtacaaaagacacaatgatgaaagtaaggattgcgaattagtgaagtagacgaaacatcataagacatcttggaccattcgtgttttgcagcatcctctataacccacaagttaattctataatcagatccaggaaacaggagtgcaggctttccctcgtagcgtgtcagctttggattcaagtccccgtctggtcctcctttaataagatcaaacttttcagatctaacatcaaagctcatgactgcatgattcgaagctgtgtcgagcatagctacataatacaaaacaccattgatacacaaatcaggagtatcttcatgacagagacagtgaggaggaaaatcttcaaccatcctccaagaattcccttttctcaaagtgaaaacctgaagctccttagctaaataccgtctctgataaacatgcatgcctttcatcatacacaacactttgtaatcaccatcaataggatcataacccatatggtggtatatacattcatgattagcatcaatcttgggcaggataatggatcgtctagtgctagggttagatactattagtctagggctagacactattagtgtagaaggaggtccatggcaaatcaaaccgtgaacagaaggagcaaaggttttaagctgtagatgagggcaattcataaggtaagttggtttagaagacgaagttgattcaccttgatcaatcaaggagaagaagcaatggattccgccgcctgcgattgtaaagatgagactttgtgggcgagtcgaagaattaatcaagtacgatttcatgaagtctctgttgcgaatgatggaagtatattcttttgatacggagaggaacctagctagggttttgacaggtaaccttttgagtatctccgggatgagatcaaacggaatctgaaccgagtttccactgcatgtaattagatcatcggatatcttcgtcttcttcgatctctgtttctccatggcggtgataagaacgaaaggcatcgatttgacttcacagtgagaaaaacttaaggaataagagaagaaatatgaaaggacggtgaaaaaacgtggtgccgttttaaacgggttggaatatgactaaacgtcgtgccgtcttattaataaggaagaaacttttgacgcatgtcacggatttaaacactacacgtttccactaatgaccattattaatccattatacacactaaattcggaatttagatgggccttgtaaaattgtttcgtaaccgaaataaatggaagattttaaatatgaccaaatgtaaggagactgtattgaaagacaaaatattaaaagttatttgagttttaataagttttggtatgattctggtcaacttggttgaattaggaaatttgttattcaaattttttcaaaattcagctaaaattatgagatttgaatttgtttttaacctaaaatttttcttgaattgtcatataaaattatttaaatcacttcaaatccactacttcatttttttacgatttgattgtatattttctaattactaatccaataatatatttagcaaaacttcttaattttgaataaactaaccaaatttggatatgtagcaaagtttgataatatcttctaaattctgttttttgacgattagattataaaagtttttggcaattttagtttttttcaagcaccaatgaggggaagttgttaggaatttgaaaatttcatattcataacatatatttcttttggttcttattaattgattttttagaaaaaaaattgttttaaaaaaattgatttttaggaaatgtaaatcataaaaactaatatatttataattagttttaatatattattttaatctatatgttttttctaaaaaatcaattaaaaaatcagagaaagtagttttttgccaaaaaaattctgatgccgaatttgagctttgtatcctcagttttcttaggtgttagtaagatattttgcttttaataaagaagataattttgtgaagaaaaaaaaagttttgaggagaaaaatagaggataattaagaaatgtttataaaatggtcaaaacaactaatgacatatttaaagggggaaaaatgtcatttaatccctcaactttcaaaaaatgatcattttatataccattttatatatgcgactgtttaatatatgaactaaacgttgactaatttttaaaacattaaattaatcaacgtttagtttatgtattaaacggccgcatatcaaattaatgtataaaatgacaattgaaagttgagagattaaacgacatttttccccgcatcactgtttcagcttcaccaaccccattattctctctattaattatcaaatgaattagttattagtcccttaattattcaaaaaaaaaaaaaaaaaaagtcgactcatcctccggcgggagtagaaaattcttcttggttctgcaggtggtaatcttgttttccttaatgaagtttcttagcgctaattttttatatgttttctcgtttaaaaagtgtcaatttttaaaaatcctttcccttttacggttcaatttgatttggataataattctctttttctctggaaagttcgaatttttttttgtttggaagcttggagaaaatattatactcttctcattgaatgatcaatttacaaatcctcatttgatcgatcttgtcaatttttgaaaaaaaaaatctgaactttgagaaaagttattgagtttcgatatctgtcggtcatggtttgattgtggctgttgggtaagacaacaaattaggtagggttttgtgatattgatgtccgtagtccttaattatggccaaattgttgtcttttaggttttgacagtagcaaagaaaagctgaatctagttagaaattgcttttgcagggtttttgaatagtttgtgtattgaagattgtctgaa

SEQ ID NO: 13693 - DNA, 2584 bp, Unknown
  misc_feature (1)..( 2584): cDNA_ID_3031419_gDNA_ID_2214644_Annot_ID_188465 3000 nt of promoter + ATG
tagtactttacttggacttcaactgtcgttacttatgctttgctttcccatagaaaaatacagcatatatatatagtagaagccaaaacagagcataaagatcaccatttaaacaaagcatattaatgataatatgatgattaaacatataaagtatcaaacatcataacatcatcattagcatcaacgtatctcttttcatctacttaactaacgctacattgaacaccaaatctctttgttttcttcccactaaaacaatgaaaatagtaccaaacattgaaaatcatctactcaaattaagaggcaaatcatatcactagcttttaatcaaaagtaaaagcataatcttaccattatcattatcatcatgattatattccatacatatttttgttaatcactacaccaaaactatgcattttagtatagttagaacagggaaatcgtccatagagctgaggtttggcacatttgaaaatctttatgttttgtagcatttttactaagttttgctacattgaatgacaagttcaaccaaaaatatttaccaaaaaaaaaaaaacaagttgctgttcaaccaaattcccaaaagtaaaagtggcaacggttgcaaaattattccatcacacggaaacgcagcgttttaatatttcccttgaagacaatataatgccgtcttaagtcactatctgaataacagagacatcagccagtgaagtggctgttgatcaacgtggaacacgtgcacgatacttcttttattagtcattagccgacagtggtctcatagctttccacgtggtgtgtttagagatcgagttgatattttcaattatttatactctcaggtcgttgacaaggtcgtgtgtctatcggaagtttgcaaaagctccggtgacttgtcaacaactgctccgtcacgttccgtcgatttcaatcgtctttacatccacttgaatagttttcgtgcatacattatagtaacactcttctttaatttgcataatgtattaagaatatacgaatggcttttgacaattgatttacaaataaagttttctaattaagtcaactccagattattattagttcttgtcaacgaatgataccagtattataattgtttgtgaaacccgttatgattatagaatctacaaataggaaacttacatctaaatttttctttaccaaggaaacctgataactagattcatatttttttttttgtcataagatattattaaggacttaaaaaaaataattccgagagaaattatttacaaaagtgatatataacttaaatttacatttctttttagattaatcataattatatcatattttagatccacttaaataaaatacagtaaatacgctattcgacaactgtaatcacattcgaaaatttcacgggtagtcgaaaccaaatcatctttgataataaacaataatattttttttttttaaactaaaaataataactatttaaaagcgataaacaaaactaattttttttaacaatgtttttagcaaaaattttacacgaaaatctcataatactaacactaaaatgaaaaaaaaaagaatattcaaacaataccatattatttttgtgattttttctttagttagtggtgatactaacattcttttaactttacctttaaattgctaagttttacagcacctttttttttgttatttttgattaatccaaataacaggaaatatcttcagtaaaacaaatctcataatgttaacactaaaaaagaaaacagaaggagaaaaattaaaaagcgttgtttactttttgtaattttgtaatttgatttaagaacacgttaacatctactacgccacgtgtcaaaataaacgtaagaccgtccgcatcgtaaactttcctccttctccttctataaaagttaccagaccagaccgtcgatataatacgtcatcagccacgtcatcgacaccgacacgtgtcggtaaaaaacccacacgccacatgatccattggctcgttcggtgttagccaccggtcttctgattcctctctctctctttcttcaattcttcttctctgttcccccaaaaatattgggcgcaaaatctctctctctctctctcttcgaggaagaagaagaaaaaaaaagaagcgaaaagtcttctcctgtttaatttatttgaaaaaccctagcacaagtccgccgtctttggtttgaagaatctgggtattgattgattttggcttctgggttaatcgcttttcatgtcaatttctccggtgagtttcgaattttccgttctgattttggtgtttttttctttctaattgattgaaattgaatagctttctctttttgttaatccctgttcatcacataaatttgaaagctttttgattcaagtattgatttttggaaacttatgctacttttttttttgttcttcttctcttcacagcttttctgaatcattttcgaattgtctctgatgaggtctcgttgaatagatacagactttggttctcttgtaattggttgtgttgaaagcgcgtttggttcacaatcaatgccatatg

SEQ ID NO: 13694 - DNA, 3000 bp, Unknown; identical to SEQ ID NO: 13692
  misc_feature (1)..( 3000): cDNA_ID_3031429_gDNA_ID_2214644_Annot_ID_188459 3000 nt of promoter + ATG

SEQ ID NO: 13695 - DNA, 3000 bp, Unknown; identical to SEQ ID NO: 13691
  misc_feature (1)..( 3000): cDNA_ID_2703818_gDNA_ID_2214644_Annot_ID_188455 3000 nt of

SEQ ID NO: 13696 - DNA, 3000 bp, Unknown; identical to SEQ ID NO: 13690
  misc_feature (1)..( 3000): cDNA_ID_2703829_gDNA_ID_2214644_Annot_ID_188452 3000 nt of promoter + ATG

SEQ ID NO: 13697 - DNA, 3000 bp, Unknown; identical to SEQ ID NO: 13688
  misc_feature (1)..( 3000): cDNA_ID_3031452_gDNA_ID_2214644_Annot_ID_188449 3000 nt of promoter + ATG

SEQ ID NO: 13698 - DNA, 3000 bp, Unknown; identical to SEQ ID NO: 13687
  misc_feature (1)..( 3000): cDNA_ID_3031460_gDNA_ID_2214644_Annot_ID_188446 3000 nt of promoter + ATG

SEQ ID NO: 13699 - DNA, 3000 bp, Unknown; identical to SEQ ID NO: 13686
  misc_feature (1)..( 3000): cDNA_ID_2703825_gDNA_ID_2214644_Annot_ID_188445 3000 nt of promoter + ATG

SEQ ID NO: 13700 - DNA, 3000 bp, Unknown; identical to SEQ ID NO: 13685
  misc_feature (1)..( 3000): cDNA_ID_2703844_gDNA_ID_2214644_Annot_ID_188440 3000 nt of promoter + ATG

SEQ ID NO: 13701 - DNA, 3000 bp, Unknown
  misc_feature (1)..( 3000): cDNA_ID_1976939_gDNA_ID_2214644_Annot_ID_136332 3000 nt of promoter + ATG
ggttatttttatgatccttcattcaagctcttcttctttgtctactctttgtttagtgtgatccattgttcatatttcaagctaggttcttttttctgtctagaccgatgcgcttaagaagctctcttcgaggtatcaagttgttgtttccacaggtggaggtgcagttataagacccattaactggtgtgttcccttcatcctgttcaaagtataatgatacaaaactcggttccttgtttaacttgtttggtaatctgatgatattatcaggaagtatatgcataaaggaatcagcatttggctagatgtgcctctagaagcattagcccatagaatcgctgctgttggaactgattcacgaccactgctacacgatgaatcaggagatgcatactcagtggtactgattctgactgttgtacaatcataagccttggatacttcaaacaaaacattcatctttttttctgtttgtgcttgtgaatgaattactcgtaggctttcaaacgtctctcggctatttgggacgagcgcggtgaagcatacacaaacgcaaatgccagagtctccttagaaagtatgtcttcttcatccatcttatctgccatagcctttgttcaatctgtgtaacttcttctggaaattttgctctccttccttgtacgcgaatcatcagatattgcagcaaagcgtggctataaaaatgtctcagatctcacaccaactgaaattgctatcgaggtaagccaggtcctttctcagttacttcatcattaatcatttcaaatcaaactcaacaaagcaaatcactcatcaccaggccttcgagcaagttctgagctttctagagaaagaagaaactatggagatcccagacggcgacctctaatttcccagccttcttttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaagaaaaagtagccgtgtttgttaacatgggccaagaacaagcaaagtgatcattcaaatataaaagtagctttctcatggaatacaacaaagaaatgcacatgcagaagaaagtagatttaactctaaaagtacagaagcaaatctatgaattttactacaccggcaagtgtttcatcttggctcagggcattaagccaagctatactctttgtcgattcactagttccggcaaagtagtctaaaccactatgctcataacaatgattgttgctcacggacatacataacacaaccaataacgatgaatcagaagcagacctgtgtggtatatcatggatgatgaagatatgatgacagtatacatgtatgcatcatcatcaaactgtagctgccaagcaattcacaatggcagattcattaggaaccgtaagcacggtaccagaccattcaatttttccccaaatctccctttctccacgccttccaacatcaatctccgcacaccaaatctccattctcctagaaccaccactaccagctttaccttcccacaaaaccgtaagctttccaccacgattagccattgtagccccacaaagaaactttggaagtgactccacacctttcagctctctccaaatcctctcttttggatcataccctctaatcttccccaagtaatcataacaatacaatatgttctcaatcacacaagctcttcctctccatcccaaatcaagcctcttctcaggcatctcccatttcttttccttgggttcgtaaacaacaccgtttcgatcagccattgcgtaaaccttcccttccataaccgcacttgcgtgcatccatttctcacgaacctccatacctggactagccactggctcccaagtttgagtctttatatcaaacatctctgcccagttaatcgatcgagcccaattatcaactacacatcctccaatcacataaatcttcccatcaattacaccagctgctgcaaattcacgacctactctcatattagagactcgtcgccaagtatgaaatctgcaatcgagaacccacacgctcgaagaaggcacgtctctaatagatccaccgatcacgtaaatctctgaatctaccacaacgtaagcggatccgactagagacggtgaaggacaagatgggattggaacaagcattttcgaattcgttgagttcgataaggttcgatggaggagagtgaaccaacacgcaccagattcaggaggtatacggattgctacgtagaggatgttttcagtggctccgacgagagctctcgtggcgtagagaagaggtgatgttgggagagatcggaaagtcttggagacgagtgagaggattggatagtgacatctagggacgcgagcaaggcaactgagagcaacgtcttctgataacaacggaatcaattgcgccggtgattttgtttccggtggttcgtcgccggagctcgttgtagccgccattgatccgttttgatcagtctttatttccttctcaatttaaaagagaaaattaattttgcaattattcggttcggttcgattcgattaagtcagacaaatccgagaagagaaagttattttagaaactaaaccgtatttaaaccgatatgattgtgccgttatctacaagtgctgacgtggcgggaagcatgatctcgtggtttgaaagaagccacgcgcttcctcgtcttcccttcgtcctccgacgtttccaattgggagaagaagaagacgacgatgaagcatttatctgattctgggtctgttgaaaatcaaaattttcttgagaactttttttgaagagtt

SEQ ID NO: 13702 - DNA, 2584 bp, Unknown; identical to SEQ ID NO: 13693
  misc_feature (1)..( 2584): cDNA_ID_2713951_gDNA_ID_2214644_Annot_ID_136338 3000 nt of promoter + ATG

SEQ ID NO: 13703 - DNA, 3000 bp, Unknown; identical to SEQ ID NO: 6141
  misc_feature (1)..( 3000): cDNA_ID_2703889_gDNA_ID_2214645_Annot_ID_136341 3000 nt of

SEQ ID NO: 13704 - DNA, 3000 bp, Unknown; identical to SEQ ID NO: 6150
  misc_feature (1)..( 3000): cDNA_ID_1840930_gDNA_ID_2214645_Annot_ID_136345 3000 nt of promoter + ATG

SEQ ID NO: 13705 - DNA, 3000 bp, Unknown; identical to SEQ ID NO: 6145
  misc_feature (1)..( 3000): cDNA_ID_1812409_gDNA_ID_2214645_Annot_ID_136346 3000 nt of promoter + ATG

SEQ ID NO: 13706 - DNA, 3000 bp, Unknown; identical to SEQ ID NO: 6144
  misc_feature (1)..( 3000): cDNA_ID_2703878_gDNA_ID_2214645_Annot_ID_136347 3000 nt of promoter + ATG

SEQ ID NO: 13707 - DNA, 3000 bp, Unknown
  misc_feature (1)..( 3000): cDNA_ID_2703872_gDNA_ID_2214645_Annot_ID_136351 3000 nt of promoter + ATG
caaaaacttgtcccatatattttaccctgttttctcccaactgtcataactgactttggtatcttttagtcaaaataaaacacatcagcccaaaagactcaaataagtatattaactagacttttttataatcttttggttacagatacgacagtagtaccaataaatgttggtgagactatactactacgagtaataaactcagcattaaaccaaccgttattcttcacggtggctaatcacaaactcacggtggtcggagctgacgcgtcatacctaaaacccttcaccactaacgtgatagttcttggcccgggacaaaccacagatgtcctcataaccggtgaccaaccaccaaatcgctactacatggccgcaagagcttaccaaagcgcccaaaacgcaccgtttggaaacacaaccacaacagcaatccttcaatacaaatccgccccttgttgcggtgtaggcggcggaagtggaaccaagaagggtaattccttcaaaccgatcatgcctatcctccctgcctacaacgacacaaacaccgtcacacgtttcagccaaagcttccggtcacttagacgagctgaggttccgacagaaatcgacgagaatctcttcgtaaccatcggactcggtctcaacaactgtcctaagaacttcagatcaagaagatgtcaaggtcctaacggcacacgtttcactgcatcgatgaacaacgtttcatttgctcttccaagtaactactcactccttcaagctcaccaccatgggatccccggagtcttcacaaccgattttccggcgaagcctccggtgaaatttgattacactggtaacaacataagccgatctctctaccaacctgatagagggactaagctatacaaactcaagtatggatcaagggttcagattgttcttcaagacacaggtatagtaactcccgaaaaccatcccattcatctacacggctacgatttctacattatcgccgagggtttcggtaacttcaatcccaagaaagataccgcgaaattcaatcttgaagacccgcctctcagaaatactgtcggtgtacctgttaatggttgggccgtcatcagattcatcgcagacaaccctggtaagctaaactattagtataaaaatactactagttatcattcattacaagtgttacttatttttatccaaatttcttcgcttttcagtttagctataaaatttacatgattcgttaatttattatatatatatcgagactagtccctaaactaaatacgtgtaaaaatgattgaaaacaggggtctggataatgcattgtcatctagatgcacacatatcgtggggactagccatggcttttttggttgagaatggaaatggagttttgcagacaatagaacagcctcctcatgatttgcccgtttgttaggagttcaagaactttgtaacataaaaccacattatagtttttcatgttcttctattcaattgttttttgttggttatagacgtaaaccgggtcatactcctgagttggcccggacccttcagattaagttttctcgattattgatgtattcttttgacattatagtaccaaatcaagtgctaagagcctaagcatacgtatcatgaaagtttatttttttcgtttttctttatgcttaattgacccattacttcgatttctttttttttgttaaaaggtttcattcactcgatttgtgtatgactaagagcatgaatttgatatgttagaattagaatgaatggttgttgagctaaattcctacttatttccataatcagcttagaacttttgcgatcataataaacaacataatttgttggcgtaatatttgctgagtcaatattgaatgttgaagttataaagaaagaaacttatcctaattccattttgttttaaaacgcattgctatgaattgatgagtattattcttttacgtaacattattgaatttgaacttgagaagatgataacgaaattaattgaaaaagaataagtgaatatgacatcaagaaaaagtggcctgaaattccaaattagttgagcagaaaagtttggggcaaagtgatttccgacgcggattaatcataacatcgacattactagaagaaacaaaagttgtcatgactttgttatatttttgagtactcagagggctaattttataacaaatgtaacaaatgataataataatataattcttacacatgcatgttgccactaatctaccgaaatattagagtagacaagaaattaacgtgtaataatttgtaagaactccgattgtcatatttgatttaatccatacaaaaaggtgaaaatccaaactaaatcttaccgtagaaaataaaacttaggtcgcgagtgtgagcttagctataaacacgcaaaatatataaaagaataattgatcttttacatgatagatattcataaatttttaaggcatttgcaaaccaattaaatactaaaataaatagcaaactaaactcatttgtcatcttaaaacctaacatatatattttaaaattcactaaccagataatatctattatacaaattttaataattgttaatttatattggcgaaaatcatgatatataactattatcagacactttagaattggatcaaccaagaagaataaaaaagttttaatcacaaccaaaaagtctatttgtcgttttcacttttcaccattcatcaaacaccaccacaaaggttttaaattttttcttttatcgtcttcacgaaaggcccattagtatataggtccattatctaaaaccctaaatctcttgttacgcattcccatgccttgttcaataaaaaattattctcaggcccattagagagttacgacttcaacctaaaaccctaaatctcttgttacgcatccccttgccttcttaaaacaaatttcttctcaggccaaaactcgcctctggaagctccgatg

SEQ ID NO: 13708 - DNA, 3000 bp, Unknown
  misc_feature (1)..( 3000): cDNA_ID_3031484_gDNA_ID_2214645_Annot_ID_188492 3000 nt of promoter + ATG
ccgagttcttatttgtcggcacaagctagagttgttgaagaccatacaatgtctcaagttattgtacaagcagttgcagatggaggtggaactggtatgctggtagtggtgacaggggcaaaccatgttgagtatgggtcaaggggaacaggattgccggcaaggatctctaggaagattccgaagaaaagtcaacttgttgtgttacttgatcctgaaagacagtttttgcggaaagagggtgaatctccagttgctgatttcttgtggtattctgcggccagaccctgcagcagaaactgctttgaccgagcagaaatcgctcgggtaatgaatgcggctggtaggagacgagatgcccttccccaagtatgttttctatgatttcgtttatgagactgactctctgtttgattgttacttactgtatctggcgttcttatgcttacagtaaaaatgaactctaaacctgatctccattattagtattagtacagttgtactttattcagcactcagtttattctgccctattttttttgctgtttagagttgactgtggagttgagttttactttcttttgctcactttgcttttatgtcttagtatgctgatagatttttttccattgttccaggacattcaaaaaggattagaccttggtctggtgtcacctgagattctgcagaatttctttgatttggagcaatatcctcttatttcagagcttacacaacggttccaggtatatccattccggaagatattcctctagtgaatctttttcttcgaatatgcttttcactaaataatgtgttatagccttcatatccttccactgtacattaacttttcctgtatttatcttctctagccagagttaatgatagcttcaactagtaagtaaaccatacttatgatgatcttttgtgttacagggattccgagaaaggttgttggcagatcccaaattcttgaatagattagctattgaagaagctatatcaataacaacaacacttgtagctcaatatgagaagcggaaagaaaatttctttgaagaactcgactatgtgatcactgatagcgtaagagcatcagttgttgattttttcacagtttggctccctgcaccaaccttgtcttttatctcatatgctgatgagacaattgggccaaacagcatagatgccttaagaggcctcctagggtccatacctgacaatgcatttcaaaaaagtctaggtggacaagagtggactctgagtcttaggattgcttcagttattatcggtggcttgaagcttgctggtgttggagttgtttccagttttgcagctgtgggatcttcaaatgctttgtatgcaatacgaaaattcattaaaccagagttgggtgttggtgagcaagcaaagaggtctcctatgctgaagacggcccttgtgtatggaggttatctgggaacatcttcgaatatccgttatcaggtatggtgatgcgcggtgctttacatgttgactcaatgaatgagggatattaatgaaaagtagttaaagttgcttaatgaccacagcaatatattatgcttttgcatcttagccaaggaaggccttttgatgaagaacagtatgctttgaatttatgcctctaaaatcatattactttcaattgcagataattgctgggttaatagagcatcgcatttctgacgagctttcttctcaacctctacttgtaaacatgatttcatttgttgttcgagtagctaactcctactttggaactcaggtcagaattaggcctgtactatgatctcttcttgaattctttgtctcctttttccttattattatttttggttaattcttgatataccgtttaacttcattccaacttttttcataaaaacgcagcaatggattgatcttgcgcgctctacgggtctgcaaactcagaaaagtgtcacaacttccaaccaaatccccgaggttgcgagccaatccacagtggaatacagtacaactgaagaggcaagtatggatgatcttaagaatcaatgagatttatgcggctatgtgactaggtaccaattgtatatgtttataaaagcttttgatcgtattggagggaaagatatattcatttgagttgtatttttgtatcttagcttacgggaaacaatgattcgtgaataaaatttcttcaattagtcatgttggtttgccatatttgcacatggtggtggatgcacgagttttttttttctcttattgcccttcccaaatatgacatcatttatcatgtactgtacagtcatgaattgcttatagttgtagcttatcaattcgaaaattgttgagaataatgggaaatggtttcagatggcatacataagggtttttttgtttttgttttaacaagatcgtttttaatgacaactaacgatattttgtcttcatcgtatcaaactgtgctcaggcatcaaataaattccatgcatgggtgtgattcgctaccatcacttttcactttctctgccagactgacacaacaatctttttgtcatataaaacacaagcttgtcaaagccacagcgagaaccaaaaaactgttgagtaactgagtattgcgcggccatacaaacacccaaggaggaacttcttatgttatcctaattggttatttgtgctccaacaatggatagtttccttacttttggacttcggtgtttgtatggaccacctacaattgtgatttatttaacaaagagaattgtaaaaaaaaaattgttgccttattcttaattattctcccaacttattttttcttctccttttaaattaaatcatttttatttatttattgaaaagttaattacagataagagtaagtgtttgagagttgactcctttgtccttcctctttaggattctcctctgggctctggtaaggtattagaaagatcaaaactttttggattccctgaaattgggtgaaag

SEQ ID NO: 13709 - DNA, 3000 bp, Unknown
  misc_feature (1)..( 3000): cDNA_ID_2703856_gDNA_ID_2214645_Annot_ID_188491 3000 nt of promoter + ATG
aatctacactatcaataatgtgttcttgttttgcttcgtctagccaatttatttggcataaacacttggtgttttaatttggtttttctaaaattctactgttgctttatctaaaactctacttgagttttgttttgtttggtgtttgcgtttgctttttggagtgttttcttttgaacttttgctcaagtgattgattgctttttggagtgtttatcatcgagtcgttagttatgtagccactattaattagtcgtttgaaaagtagatgaaaattaagacttgaggaaatcaaacacaatccataatttgaattcaccccgaagataatgatcagctgctattgtaatcgtcaggcttcaagtgtatataatttatatttgtatataattcataattcgtatttatttatttatgtataattatttgaacacactccataattcgtattcgtatttatgtatatacaaacacactccataattcgtatttatttatgtatcaaacatataattagtaaactaaataaagacgaagaaacattattgagtagaatagaggcatcgaataacaatattcgtcggcctaatcaagaatatttcttggaaattcgggttgaaatccacatatggaagaatcttgaatagcacgtactttatcaatttaattacatccctcttaacggtctagctactctaattatcatctaaacctttttccttgtacgttatctcataatttgcaggactcttaatcattatcacatttcaaattttcaatattttactaaagagacgtctcgtgttcgtgcgtagctctatattttctggtttacgtaaaatagttcatgattttgtttagcttaccttttgaaaaaaataagcgaatctttcttcctttacttttcttccactcattaaaatgttctctctatatataaatgataaatctagtcttctaatcatatactctctataccacacatatctagaacaacaactagatattcaatattagctctaatggcttcttgtgacacacctgatgcgtttgcttggcttcaaactcttcctcctctttctctatggaaaggaaatttaatgtccatgtgtatttgctctccaaattcatcacacccatctttgaacttcactcttactcgtacccctcaatctccaaactttttcaccttctcgatagtagccaatttcaagactcctattactctctttatttcaaaaactttcagaaccattagcactaattcaactactttcctcaatgaaaacgtcatatctactctattgatgggttttgtcgacgttgttctcaactataacgtcaagagaaccacttgttcaatccaactccaaaacctaggctccacttctaacctcaaagacgttttcaacctcgctttcttcactttcgtgttcctcatctgcatctacgaggcgccaacgagcctgagaacaacttgtctcaaaacggtgaaagatcagctggtaacttgtaggtcaaggcagggctctaagttgctcatggtgcaactaggctctaaccttgaagaacaatggatgagatcgctgaaccttgcaataaccaactggatcatcgagatcaaagcgtttcagcatctcaagtctccttctcctttgttttcatatgctttctcgactcaaggtctatggaaagttcatatgtattgtcctgtggtagcaatggaaatggagagcgtaaatagttctctaaacgacgagagattgttcttctcgctaaactatcatcaacttgaaggtgtaatccaattgaaccacaggatttacgttcgtgaaaagtggtttaacgtcgcagtaaatattgacaacgtcaggtatcgtaaaattgtgtgtaatcaagcatacataagtaatttgttcatattaatttctcttaactatagatattgtttataactaggtgcgacataataaggcttgtgaacgagaaactattatcggaacgtggcatgggaacagaggaaaaacatttcccctcaagaatatcattgcaactaacaccaacgaatcaatcaaacatcttaatggtatccgtacaaaaatcttcagaaaacccattgacagaattcgaagtagagaaaggcatagaagcaacaatagatccaccaaacacattctttggactaaaagtctcagccaacgagaccacaacaaaaagcatgaagccatggaagttcgaggaatgggttcatggttatagcgccaatctcacttggtttctccatgatcttgacgatggaagagaagtttcgtcctctaaaccatcgaaagtctcgatgatgaaccctcgagcttggttcaagaaccggtactcgagcgcgtttagaccgttcacgaagcaaggaggagttgtgtttgcaggagatagttatgggcaaagcgttttgtggaaagttgataaaacggctattgggaaagtaatggagtttgaggttaaaggttgcgtttggttgacttattggcctaacaagcatcatactttttatagtgatactagaaagttggaatttaaggagatgctttacctcaatcttccttagatatttcttttcttactttcaccctaagcaaaatattcccctagtttgttgcttttttcagtaaagtttgtaaaataatacttatgatggaattattgaatttagaaaatacagtattgtgcttttctaatgacttcaccgacataaagaaaaaaagttttgtatatatgaatatcaaagtcgtatatagtccatagtttttttccgttgttgttatccataaatttatttttcaacattattatacgtataatttggtggatctaacataaataaaatcatgtagtagaagtttttttttatttttgaaaattggagaaccacacaagagatggcaataaaataaaatgaaaagtctctatttgtagatctagagcaatgcaaaaagctgacgtgtacca

SEQ ID NO: 13710 - DNA, 3000 bp, Unknown
  misc_feature (1)..( 3000): cDNA_ID_3031486_gDNA_ID_2214645_Annot_ID_188490 3000 nt of promoter + ATG
atttacatctaccacgtatgttgttaaactacatgttgtttgtttaatccttaatactttggtcaaactataatcttcactggtttagtctaaatctaactcaaacatatggtgatgaaggcaaagagtatcaaattgatttaaggtaaatgagatcttacaatacttgagaaggatcagctccaaattttctaaattgtgacgaaattgaagaatacaacacaacaatgcatctttagatctaacacttacagatcttcatcgaatctatactcaaaacataactaaaaaccctgagaatccaggtttcgtttgttctctaggatcagaatcatcaaattcgagcttctcaaactcgtcctgcaacaacagaagcagcagcagaagtagcagcagaattaccaatgaacgagagtaaaccagcattagcaggctcttgttcatccaagaacaaatcatcaggaaccctaaacgcaccatgtaagcaaacaatcgcgattccaatcgttaacgccgatgttaacaaagatccaacactcgtcataaacacaaccacaatcgtagtcaaaacaagaccaagcaaagtctcacgatctgagaaactacgaccaaagagaaccaaaggctgatctgaagatcggaagaggtagagaaacatccaggagcctaagagagagaggaggacgagaagcgagaatggatgcgagaggagggagaaagcaaggactaacgagacaattgcggagtaattgactttgaagtaagcgagattcttacggatccgggagaaggaatcggtgagagagtcaggtctagcgaaggagctccgatctacgagttctagccatggacggcgttgagagaggctttcgcggagagaggacgagaggcgtgagaggaaagtacggaaggcgtgagaattgattggaggttgagattgagtggctgcttgctggttggtgacgggaagaatcgccggagaagaagacattattggtggtgtcggtgagtctgtgcgcggcggagagagtgtgaatttgttgttccgattttagtggaaactgaagttgcggcaaaaccgtgttagatattctaaaggcctaaattttatgggcctataatgttttggaataggcccaatatattaagttggagttaatagcaatttttagatgggtctataatgttggaagaggcccaatatattccactattggttcataaaaccattttttttttttcaacaaacaaacaatcttactggttcagtggtttgtatctatatgatgttacaaggataacacaacacaaactagtaaattagtgtagttaataatattctaattttatttgcagataaattacgacttcctacaattgtttatatgatcatttcaataattatcatctcatttcccaccctatgagtgttctcgttgaacaaatgaaacaatcatatgatcaattgatcatgaatgataaaggtttactaaatatatctataaactgtgaaattaaattatatacaaattatgtacacttgaagctaaacaaattatgaattatatacaaatacaaattatatacataaataaatatgaattatgagttatatatgaattatggtgtcttgagacaccaggaacttggggcaaagacaactggagggaactcgagagcatttttaaagacgcctatgcaaccggtggtggagactacatgaagaagggggtgcaagcgataaaagatgagtttgacatgattgggacaatcaaaatgagataatgaaaacaaatggaggtttgcggaacttgttcatgttgagatgaccgagataaatgaggttgacgagaataacaagaaggtaaaggtaacatgtagttactttctcaaattcgtggatggaaacaataagatattctcactcagcctaggcaatgttgaactcaaacgttgcactatcaattagtgaactccaaatctacactatcaataatgtgttcttgttttgcttcgtctagccaatttatttggcataaacacttggtgttttaatttggtttttctaaaattctactgttgctttatctaaaactctacttgagttttgttttgtttggtgtttgcgtttgctttttggagtgttttcttttgaacttttgctcaagtgattgattgctttttggagtgtttatcatcgagtcgttagttatgtagccactattaattagtcgtttgaaaagtagatgaaaattaagacttgaggaaatcaaacacaatccataatttgaattcaccccgaagataatgatcagctgctattgtaatcgtcaggcttcaagtgtatataatttatatttgtatataattcataattcgtatttatttatttatgtataattatttgaacacactccataattcgtattcgtatttatgtatatacaaacacactccataattcgtatttatttatgtatcaaacatataattagtaaactaaataaagacgaagaaacattattgagtagaatagaggcatcgaataacaatattcgtcggcctaatcaagaatatttcttggaaattcgggttgaaatccacatatggaagaatcttgaatagcacgtactttatcaatttaattacatccctcttaacggtctagctactctaattatcatctaaacctttttccttgtacgttatctcataatttgcaggactcttaatcattatcacatttcaaattttcaatattttactaaagagacgtctcgtgttcgtgcgtagctctatattttctggtttacgtaaaatagttcatgattttgtttagcttaccttttgaaaaaaataagcgaatctttcttcctttacttttcttccactcattaaaatgttctctctatatataaatgataaatctagtcttctaatcatatactctctataccacacatatctagaacaacaactagatattcaatattagctcta

SEQ ID NO: 13711 - DNA, 3000 bp, Unknown
  misc_feature (1)..( 3000): cDNA_ID_2713996_gDNA_ID_2214645_Annot_ID_188488 3000 nt of promoter + ATG
agtgaagatattttgtgaggaaaaatatatatcttatgtactgaaaatatatatattaccagaaggtctcatgtgaaaacatctatacttctaattgtaaaactgaatgactagattataattttccagttgaaataatagaaattatttttaaagttaataggaaagtggtataattagagaacaacacacaaaatctagacaagtaaagcatgttgttgactatgaacataattgtagatgcggggtcaatgtcactttgctatatacaaaaaggtacggctaatttctaaacatgagattgtcattatcagagatttagcacatagagaggttaaagataccaaagaagaagacactaactaattccaccaaacataattactaatttcttgttcaccaatccatgtccccaatattcttctcatgtacttcttctttcttaacaacatgatgttaacattttttcccaactttattacctttcggatggttattgttaaagatatttacgtaacggattacatggtctctcctttccaaaagtattaacttaatcttttaggaaaaaaagttttagttaaaaaaagttcttccgtatatttacgtaaggggtacacagttttgacgtttcaatacatattggcaaaaaccaaaacataaaggaaacaatttacgacatataggtgtagaggtagctagattcggttaaagaaaattaaaggtgttattgttaagacaagaatataggggttgaaaaaagttgtgatttaggcggttagacgaatcatcttgtttacctcaactcatttttacttttttcaacactaacaaaacaatgatcatttttacttaagcttgaagccaatcttattgtaccaattttaaaccacagagttttcgttatgatgataataatattaatctttctacgcaatgatgttacagttgattcataagtttctttcatatacgggtttgtatgaagcatatggtatggaaagttgaccttacggtttttttttccttatattaaaagttgaccttatgttatgtctcatatttttatttgtattaagtatgaaaacaacattgagattttgcaaattcagatgggaggtggtcaaaagtgttacggacaagccacataaaccctaaaatggaccattcttcctcgtaaattagtgttacggacaagccacataaaccctaaaatggaccattcttcctcgtaaattggtttccttttctaagaaaaataatactagtaataattaaacataaagagaataatcgtttctggcttctttttttcgttcaatcaacatattatgcaagtttgtatttggacgatcacaaacacaagttgtcgttaacagactgcgaaatatattttttaagtctaacttatatattccaaaagtttctaaagatgaggaatctatttgcaaaaagaaaaaatcgttcacctgctattaacgccaaactcactgcagaacagtatatagtgttgatgtataggttttgacattttaattttgtgtaattcaaaacttaaaacaaaaaagttgattcagttactagaatatccactaaacttagacttatcatgaattgatcatgcattttgaggatagccatagcaaattgtttttttttgttagttaaccaaattgataaagacaagaagaaagaaaacatccaattctatatttttcatttcgtgacttgaagtttcagattttatttgatatgttggactttatctataaacttctcaacaaacataaccttaaactcgaccttaaatctaatatagtaaaatatttcatcgatttaatcagctggcagttatattaaatctatttaaataagtttttttaataaaacgaatgataaacattttgaaatgacaaaaaagagtaaaatacagttatgacttagacatgcgctcaattcgtctttctttaggtattatactgttgaatgtaggtgaccacatataaataaagaaatactactacgaaaattatattatacacgttttccttctttggtttttacgcataccaatgttttttaggggcatatgtctccagcccgactaaagttaacaacaaaataacaacggttgcatgcaaatgttacaaattcagcatcggtaaaattaggagggctaaagaccgtagaaaaacacagttcttataccaagaccgaacagtccaagcaggatcaagatccaattaataacgaaagcgactagcataattattgattagccattatcaaaacgatcttatctcaagccttatgtattaaatgtcaattaaagctgtccaatcttagagaattatagtgtccaatcttggggaatatttacatgttgtgcatccgtgcatgcaggtcaattacatgagcatttgatatttatttagatagagatcacacaacattgcgtacttaaattttgttggcaacccagtgtacacatctccagatactattttgatccatttaatggagggtccaaaacaaaatcttatattagtgtataatttatatgtactatgtttatggcaattatggaatattacatcaaaagtcaatagaaaaagcgtgttaaccaagaattcaagagacgtaatcacctttccaattttatttgttaactcggtgattttttttgtttttcttataggccccagtgggtgcaactactcttctagtgttgaaccaagttttggccttcaattaaatcaaaacctaatcctccaaccgcataattaaacaacattcatgaaaataacatatgcaaaacaaaacaataaaaataaactacacaaatatattcaccaagtttttgaaaatgtattgtatgtctctctatataaactccatctcttttcttgaaacttcccaacaaaacatttttctctctttttccacacttcatctaaaaccctccggctcgaacagaagcttacagaaatcacatcaatg

SEQ ID NO: 13712 - DNA, 3000 bp, Unknown; identical to SEQ ID NO: 13707
  misc_feature (1)..( 3000): cDNA_ID_3031490_gDNA_ID_2214645_Annot_ID_188487 3000 nt of promoter + ATG

SEQ ID NO: 13713 - DNA, 3000 bp, Unknown; identical to SEQ ID NO: 6144
  misc_feature (1)..( 3000): cDNA_ID_3079655_gDNA_ID_2214645_Annot_ID_188484 3000 nt of promoter + ATG

SEQ ID NO: 13714 - DNA, 3000 bp, Unknown; identical to SEQ ID NO: 6145
  misc_feature (1)..( 3000): cDNA_ID_1812409_gDNA_ID_2214645_Annot_ID_188482 3000 nt of promoter + ATG

SEQ ID NO: 13715 - DNA, 3000 bp, Unknown; identical to SEQ ID NO: 6143
  misc_feature (1)..( 3000): cDNA_ID_3031495_gDNA_ID_2214645_Annot_ID_188480 3000 nt of promoter + ATG

SEQ ID NO: 13716 - DNA, 3000 bp, Unknown; identical to SEQ ID NO: 13711
  misc_feature (1)..( 3000): cDNA_ID_2713996_gDNA_ID_2214645_Annot_ID_136352 3000 nt of promoter + ATG

SEQ ID NO: 13717 - DNA, 3000 bp, Unknown
  misc_feature (1)..( 3000): cDNA_ID_3031486_gDNA_ID_2214645_Annot_ID_136354 3000 nt of promoter + ATG
taaaaaccctgagaatccaggtttcgtttgttctctaggatcagaatcatcaaattcgagcttctcaaactcgtcctgcaacaacagaagcagcagcagaagtagcagcagaattaccaatgaacgagagtaaaccagcattagcaggctcttgttcatccaagaacaaatcatcaggaaccctaaacgcaccatgtaagcaaacaatcgcgattccaatcgttaacgccgatgttaacaaagatccaacactcgtcataaacacaaccacaatcgtagtcaaaacaagaccaagcaaagtctcacgatctgagaaactacgaccaaagagaaccaaaggctgatctgaagatcggaagaggtagagaaacatccaggagcctaagagagagaggaggacgagaagcgagaatggatgcgagaggagggagaaagcaaggactaacgagacaattgcggagtaattgactttgaagtaagcgagattcttacggatccgggagaaggaatcggtgagagagtcaggtctagcgaaggagctccgatctacgagttctagccatggacggcgttgagagaggctttcgcggagagaggacgagaggcgtgagaggaaagtacggaaggcgtgagaattgattggaggttgagattgagtggctgcttgctggttggtgacgggaagaatcgccggagaagaagacattattggtggtgtcggtgagtctgtgcgcggcggagagagtgtgaatttgttgttccgattttagtggaaactgaagttgcggcaaaaccgtgttagatattctaaaggcctaaattttatgggcctataatgttttggaataggcccaatatattaagttggagttaatagcaatttttagatgggtctataatgttggaagaggcccaatatattccactattggttcataaaaccattttttttttttcaacaaacaaacaatcttactggttcagtggtttgtatctatatgatgttacaaggataacacaacacaaactagtaaattagtgtagttaataatattctaattttatttgcagataaattacgacttcctacaattgtttatatgatcatttcaataattatcatctcatttcccaccctatgagtgttctcgttgaacaaatgaaacaatcatatgatcaattgatcatgaatgataaaggtttactaaatatatctataaactgtgaaattaaattatatacaaattatgtacacttgaagctaaacaaattatgaattatatacaaatacaaattatatacataaataaatatgaattatgagttatatatgaattatggtgtcttgagacaccaggaacttggggcaaagacaactggagggaactcgagagcatttttaaagacgcctatgcaaccggtggtggagactacatgaagaagggggtgcaagcgataaaagatgagtttgacatgattgggacaatcaaaatgagataatgaaaacaaatggaggtttgcggaacttgttcatgttgagatgaccgagataaatgaggttgacgagaataacaagaaggtaaaggtaacatgtagttactttctcaaattcgtggatggaaacaataagatattctcactcagcctaggcaatgttgaactcaaacgttgcactatcaattagtgaactccaaatctacactatcaataatgtgttcttgttttgcttcgtctagccaatttatttggcataaacacttggtgttttaatttggtttttctaaaattctactgttgctttatctaaaactctacttgagttttgttttgtttggtgtttgcgtttgctttttggagtgttttcttttgaacttttgctcaagtgattgattgctttttggagtgtttatcatcgagtcgttagttatgtagccactattaattagtcgtttgaaaagtagatgaaaattaagacttgaggaaatcaaacacaatccataatttgaattcaccccgaagataatgatcagctgctattgtaatcgtcaggcttcaagtgtatataatttatatttgtatataattcataattcgtatttatttatttatgtataattatttgaacacactccataattcgtattcgtatttatgtatatacaaacacactccataattcgtatttatttatgtatcaaacatataattagtaaactaaataaagacgaagaaacattattgagtagaatagaggcatcgaataacaatattcgtcggcctaatcaagaatatttcttggaaattcgggttgaaatccacatatggaagaatcttgaatagcacgtactttatcaatttaattacatccctcttaacggtctagctactctaattatcatctaaacctttttccttgtacgttatctcataatttgcaggactcttaatcattatcacatttcaaattttcaatattttactaaagagacgtctcgtgttcgtgcgtagctctatattttctggtttacgtaaaatagttcatgattttgtttagcttaccttttgaaaaaaataagcgaatctttcttcctttacttttcttccactcattaaaatgttctctctatatataaatgataaatctagtcttctaatcatatactctctataccacacatatctagaacaacaactagatattcaatattagctctaatggcttcttgtgacacacctgatgcgtttgcttggcttcaaactcttcctcctctttctctatggaaaggaaatttaatgtccatgtgtatttgctctccaaattcatcacacccatctttgaacttcactcttactcgtacccctcaatctccaaactttttcaccttctcgatagtagccaatttcaagactcctattactctctttatttcaaaaactttcagaaccattagcactaattcaactactttcctcaatgaaaacgtcatatctactctattg

SEQ ID NO: 13718 - DNA, 3000 bp, Unknown; identical to SEQ ID NO: 13709
  misc_feature (1)..( 3000): cDNA_ID_2703856_gDNA_ID_2214645_Annot_ID_136355 3000 nt of promoter + ATG

SEQ ID NO: 13719 - DNA, 3000 bp, Unknown
  misc_feature (1)..( 3000): cDNA_ID_2703905_gDNA_ID_2214646_Annot_ID_136361 3000 nt of promoter + ATG
tatactcccaaaaaccttcaagtgttcaactgttggtttatgaccactccacttttcgatcggtgtgacatcatcttctattgcctttgtagggaaaggattttgcagataatttgacatatataatgcctctatccatagcttgtgaggaagaccttggtcaacaagcaaggttcgtgccatctccatcaaggatcagttcatacgttttgtaacaccattttgctgcggtgagtatatggcacagttacttgtctctcgatcccttcttgatcacaaaactcattgaatccgcttgaagtaaattcaccaccaccatcagatcgaagccttttgatctttttacccgactgcgtctccaccaaggccttggacttcttaaacactgaaaaaacttcagacttttgtttaagaaagtatatccacgccatatgagtatagtcatctactaacaacaagaagtatatgcttccattaagagactctgtttgcattgggccacaaacattggtatgaacaatttcaagtttctcctttgtctttgtttgagactccgttggaaacgcttctcgtacttgctttccaagtttgcatactccacatatttctttgtttacatggaaatttggaaaaccatctaccatcttcttgttgtgcatttgttccatccttgaattccccacatggcctagtcttcgatgccataactccattccttcctcttcactagtcaccaactcactttcttgtgaagaattccatctgattggaaaacttttatttaccctctgtatttccatgatcttctttcccgtacgatccaagttggtgcaacacttgttctcaaacaaaacactatatccgacagatataatttgcggaacactgagcagattcttctctagtcccgacaccaaaaatacattccttatcactttctttctgaagcttgtgcagaccgtaatgtctcctttaccggcaatcataacgacttctctgtttccaactttgattggaaccttgatgcttttatcaagttttgagaagtatctctcttctctcgtcaatatgatttgtgcaaccactgaccacacatcttctttggtgattgtcgatgcatcttctgttgcactaaatagcatatgatcttcaatttcttcatcttcaacgctcatatgtgcccgttcatacttctttgaacgactctctcttgaaaatgtccaacctggccacagttttaactttcctttgaatctttgctgggatccgtctttggctttctccagcaattcgattccatgtggttttccttcttacaaaatccacaccattttttgcctttgttgtcacgccaattactcttcatttctcctcgtcgtacaacgacttttccttctcgtgataaaacatgcaatgctccttcggtcatgctttcattacgagacgacacacacttttcatgtgccttcagagttcctatcaactctgttaccggcaacgatgtcagatccttcgtttgctccattacagcactatgctgtcaaatctttcgggaagagaaataaggaccttctgaacaatttgataacctgtcttctcttctccatgaactcttaactgatttgccaaatcaattaacttgttagtgaaaaacttgatgatgtctccttcattcatctttaagttttcataatccctcctaaacgactgcaagttgatcaagcgtacttctggagaaccttcaaattatgactccaatgcattccaaacatcctttgatgtggctgctggtgctatccgaggaaaaatctgatccgtgacggcagtttgcaagagttgcagcgccatcaaatcctttgatgatgaatcctcccatttggttttcaattgaacggcttatgtactgtgatatcgttgcatcagcatacttcgaacactagactccaccactttccacaacttctgtgttcttaagatggtcttcatcttaatccgccagaaagaataattatccccatcgaatatgggaatcacttgatttattgttgcatccatgatctcaggtttttaatagaacttttgtctgaatttttcttgtctttgtactcggattggcccttgaatcaatagagctctgataccatgttagaaacttaagtctcaaaacagaaacaaagtaaaacagagagaaaatcaatcaataagtaacttgaatcaaaagaaacttctattttattcaatagaaaagacaaactgaacaacttgtgtttcagtaatacaacttatgtttaaatagacttcaatcgggtttgaaagttaagagatgcaactcttttttcttgtgtcccttaagacataactgcctaaacataacagacacgactctttaaccaaacacacactttgacttaacatacataattactagacatcctaaactcaattatcgatcaacaattatatcctaatagtgactgtggatgtcagatctcgtctgtttgccccgacccgagatccatcatcatcaatcaatgggctcgaagttctagacctggaaatgggcctgagtctgtcaatagcgaagtggggttcgagggcccattcgaggcccggcctgtgtgaaagtattttgagcgttacgtaacggagaatcaaggaaataaatgaggcgacgtgaatgcgcgaagtattgatacgaaacgtaagcattgatgaggcatgattcgcggcgtgattattgtattcatttacttcgcaattattaggtcttgttgtataaatagagcgagatcgaaatttgtaaaggggacagaaaaattaatatacaaaagaattccgattaactgaaatattatccgatttagtcttagctcgactaacaaggtttaaggtcctcgcaacatccacaaattcctaattgcggattccgacatccacaatttagcactagaaggagggcatttaaatcttttacttcagagcttcggttaaatcatcatg

SEQ ID NO: 13720 - DNA, 3000 bp, Unknown
  misc_feature (1)..( 3000): cDNA_ID_3031565_gDNA_ID_2214646_Annot_ID_188513 3000 nt of promoter + ATG
gcctgctcgattgttgtgacatcaacttcgtgaatttcccccgatgcgtacttggcagccaaaagtcttcccagagctttgcatgccttggtggcgtgaccattcattttgtgaatatcacaataagcgtttgggtctctgatccatttcttactcggaaatgccccgttgttgcccttcggagagaaaggcggtttagatggagaagcttttggagaggcctttggcgactcttttttaccgagaaagttccttctgcgggtttttggagttcggccgttttttttgaaatagggggaggagaagactttggtgtagcattaaaatttttagctagaagagctcgctcctctttagcagttatccagttcgttgctcgatggagagcatcttgaattgtttcgggtcagtttactgttaacgccttgcggaaacgcgattcatgccccaatccattttttaaggcggactgagcggctgagtcggatagattaggcacttggaccataatttccttgaacgcagtgatgtatgtctgaagtggctcgtcagactgagagaggttccaaagctgggcctcactgacgtcatttttgatgaagtatccatattgtttaatgaaagtggtggagagctgtttgaagtagtcgattgaaccttcttctacctaggtaaaccaggtgagagctggtcctgacaagttttctgaaaagagcttgcacagtccagcgtcttcttcatgcggctcgagaggtacccgtccggcaataacctgaaaagaggtcaagtgctccttaggatctcccttgtcgttgtagctcgggagcttaaaatctcggaagtcacgaatgcgaagtctcgagatccttggagtgaacagagtcctgcgggttgtttcgattactctatcaacctcgggggccgcggtggtaggtcgataaacctttgtattcatggcccaaatttggtctttgagaatctgaagctcattgctgacaacatcaggctcctaggggattctgaggtcgggtgcttgagagagggctcccctcgaaacaatgatggagtccgggcggcaactccatccacatgaatgtcgggatttgtcggggtagtcagaacaacctggttttggttcgaggtggttccaatttcgattggagagacgcgaggcaactgaggtggcggagtctgctgatttgcccccgcctgcgaagtttggatgcttggactaatgcctccttgaaaatcgaggcgtgctcgaactcagcggtgcgcgatactccggcggacagaaagtcaactcgatccgtgtatgcgttgtgagctgtcatgatttaagaatgactgtcggtgagcgctgcgagctgccgccgcactgctcctgaaaagaaacgaacttatcagataaagaagttattgcggtctgctgtcgctccgtcttgtcggagagctcctgaagcagcttcttgatatcgtcaagggtggaggcttggtcgtcggaactttggttgtcgtcagtgctcatgatgatttaaccgaagctctgaagtaaaagatttaaatgccctccttctagtgctaaattgtggatgtcggaatccgcaattaggaatttgtggatgttgcgaggaccttaaaccttgttagtcgagctaagactaaatcggataatatttcagttaatcggaattcttttgtatattaatttttctgtcccctttacaaatttcgatctcgctctatttatacaacaagacctaataattgcgaagtaaatgaatacaataatcacgccgcgaatcatgcctcatcaatgcttacgtttcgtatcaatacttcgcgcattcacgtcgcctcatttatttccttgattctccgttacgtaacgctcaaaatactttcacacaggccgggcctcgaatgggccctcgaaccccacttcgctattgacagactcaggcccatttccaggtctagaacttcgagcccattgattgatgatgatggatctcgggtcggggcaaacagacgagatctgacatccacagtcactattaggatataattgttgatcgataattgagtttaggatgtctagtaattatgtatgttaagtcaaagtgtgtgtttggttaaagagtcgtgtctgttatgtttaggcagttatgtcttaagggacacaagaaaaaagagttgcatctcttaactttcaaacccgattgaagtctatttaaacataagttgtattactgaaacacaagttgttcagtttgtcttttctattgaataaaatagaagtttcttttgattcaagttacttattgattgattttctctctgttttactttgtttctgttttgagacttaagtttctaacatggtatcagagctctattgattcaagggccaatccgagtacaaagacaagaaaaattcagacaaaagttctattaaaaacctgagatcatggatgcaacaataaatcaagtgattcccatattcgatggggataattattctttctggcggattaagatgaagaccatcttaagaacacagaagttgtggaaagtggtggagtctagtgttcgaagtatgctgatgcaacgatatcacagtacataagccgttcaattgaaaaccaaatgggaggattcatcatcaaaggatttgatggcgctgcaactcttgcaaactgccgtcacggatcagatttttcctcggatagcaccagcagccacatcaaaggatgtttggaatgcattggagtcataatttgaaggttctccagaagtacgcttgatcaacttgcagtcgtttaggagggattatgaaaacttaaagatgaatgaaggagacatcatcaagtttttcactaacaagttaattgatttggcaaatcagttaagagttcatggagaagagaagacaggttatcaaattgttcagaaggtccttatttctcttcccgaaagatttgacagcatagtgctgta

SEQ ID NO: 13721 - DNA, 3000 bp, Unknown
  misc_feature (1)..( 3000): cDNA_ID_3031520_gDNA_ID_2214646_Annot_ID_188505 3000 nt of promoter + ATG
aaaatttagatataaaaaatcgacctacggtatactgcggataaaatattcaaaattttaaaatccacaatacatcgttacttaaaaaaatatatgttttcgtatctatacttcaaaaattgaaacctaaacaatagtaatcatgtactaaataatacagagattgatatctacatttaaaaatacaaattaatatgatatatcttcaattactctttaaaaaaataacattatatttttgtaaaaaatatagccatgcggtacaccgcgggttaaattctagtatagaacaaaaaaaaattcatagaaattcaaacgaagagtttattgacgtgacttagctacctctcgacgaggttgaaaaacatttactaataaggaaatgaatggacttttgaagaagaaatatgaagcatgtgaaaattttagaaggtagggcacatattgcatagacaaaatcataagagtatggaaagagacaccctatgaaagaacaaaacaaataaaacgagtgtttgcaaaaagatagaaagagtgatagctctctggaaaaagttgtgaagacaaaattttttatacaattgaaaagaatgtgagaaaaatatgagttgttaaaaagaaagtgtaacacccaaaattaaaagaaaatataggatcagattttgggataaattgatcattttgaaactgtctgatttcaggaagatttcttagaaactcgaaagtctggacaaaatctgtaaacaaagaaaaatcagaggactaaagtgcaaaaacgtgaaaaaggagagaaattcgagtttatcttttccgaaactgaagggaagtttttggcaattcaaaaattgaattatcttttaagaccagtatcaacatgcgactctgatttagctagctctattgagcaatctgtggcggccggcatcgccaacagatgtattctgtattctgttagtctgttagtggtattgaggtcggttaatgccgtggattgtacttccttatcaccttgataggggccagcattcctatagagtatattatgtaaatattctgttagtatatggtttgggtcaaccaatgctggggttgtaccattccgacatgcattgctggaaatctggtcgttctgttctgatgttaatattctgttctgctgatattattctgttatgctgatttgataatataatttggatagtataagctctgatgtgtttactttatttcaaattaattaaattgaaatttatgtctattagtacatacacgtgaatattattctgtacgggatcagaccgtgttggtacttgttcgtcgggtttgtagtctcactgggcaattttttgctcatataagttgtgattccgtgcagaggacattgaggaggtggagcgtgcaactgaggtttaaagtttttagttcaatcgtaaagcgagacttgatagaattttcttgatttaaataattttgttttcgacatttggagtttttatgaatttttaaacattaaacattattgaattttagtatttttattacattagttttagtaatactttcaaaattctaccgaattttggggtgttacagaaagtatagataagcttatgaatttatttgtgtatagtatcttattttaagaaaagatatactaactaatccagtgaatataaacgaaaatcaatagtgaatttgttgataccaaaatgagagagtcgtcaaaattcttcctcgtacaataatttatttcatgagatccaatcaaaatatcttacgtaaaaagacgtgatcatccaaactatcaaaacgtttacaacatttatcataatataagcaaaaaaaaatgttcttttgatgttgtaaaacctaaaagttgtattagagttatttgtagttatttattaaaattgaattatctgctacggtaattttataactcaagaaatttaaattattaacaataagtagacatattaaaacttctatctcaaaatattcagtaaatatttttaatcacactaaagtttattaaaagttctaaaaatagacccacgcgtagcgtgagttcatgacctattataggaaaaacttatacattaaaaacaaataaaaaaaaaagaaaacatgtatttattactcattagtgtttttatactataccgcaggtaaaagcatgagtatcatttcgaaacgcggttcactatatttatctatctaaaaatttgcttttttctttttcttttttttcaaaaaacgcaaagtactgttatttatcttgattagtgataaagtgccgtttttcaataaaaaaatttaaattccaccaattaaatgctaccaatcaatacattaatcattccttgttccaaggtatttatgaattatttgagactactaatttaaagtttcactctcgtaattgtaacaaattctagggaaaaaaaccccattcaagattcactagaaaatttcatcaatcttttcaaacacgacaatgtaattaggcttaattaccaatcaactcatcaaatatgaagggaatttaagactaattactaatcaatcatcaatttttagttttctgatataggaaaggagggctaagaagagtagacacgtggacagtggtgattataagaatgaatcaacggctgagatgaagttatcaaagatggttgggtttaaaggaagctgaagatcagaattggatttttttatttttttttattttagtcgtgaataattgttgaagttagttgttcttccctctttgaggtttctaggttttgagtaatatgattcatcctctgtgaagaacattgctcttgcaaggtggatctagtgattcccctgttttatgaacattggatcacattgttatctttttcatattaatcggaagtgtttttgggttgtttgatcgattgttgtggttgattaacagatcgtgatttgtctttatcaaaggtatcagagcttcgtttttcctcggaatca

SEQ ID NO: 13722 - DNA, 3000 bp, Unknown; identical to SEQ ID NO: 13720
  misc_feature (1)..( 3000): cDNA_ID_2703901_gDNA_ID_2214646_Annot_ID_136362 3000 nt of promoter + ATG

SEQ ID NO: 13723 - DNA, 3000 bp, Unknown
  misc_feature (1)..( 3000): cDNA_ID_2703949_gDNA_ID_2214647_Annot_ID_136365 3000 nt of promoter + ATG
ttcggggaatctgtttcgtggtttcttggaaaatggtatacccgttgttataaaaaagatcgatgtgcgggaaggtaaaagtgaaggctatatatcagaactggagttgtttagtaaggctggacaccagaggctggttccctttttgggacactgcttggagaatgagagccaaaagttcttggtatacaagtttatgagacacggtgatttggctagctctttgttcaggaaatccgaaaacgaaggtgatggattgaagtctttggattggataacaaggttgaaaattgctcttggtgcagctgagggactctcttatttgcatcatgagtgttcaccgcctctagttcataggtactactctcctgctcagcttctcgtaatataatcttgatattttttaaagcattgacatagcaagactattggaagttgttttgttgattctgtttttagtatcatataacctttcatgttcataattagtaagatctattcaagaattgttagtgtatagtttcatagatggagaagcccaatgacatcacctgctcctaaattacttcttgttgatctatgctctattgcctgataagaagaaaagcgagagaactcatgtgtgtgtttgtgttcaatgttaaatagggatgtacaagcaagtagcatacttcttgatgataaatttgaggtacgtcttggaagcctaagcgaggcatatgctcaaggtgatgcttatcaaagcagaatttctcgtttacttcgattaccgcagtaagtgcttattacattaacaaactctctggtccttttctgttttactttgattccctaacatgactctgtatgttgtcttggcacctactaatgcttcgctgtctcttcttttcctattcttgcagatcgagtgaaccatcttcttcaggtatacacttaggagaataaaaatttcatcaggatataccatctccgattaaccgatagacatctgattggtttattcttttcaggtgtaacaaatgcaatatgttcgtatgatgtctactgctttggcaaagtgttacttgagctagtaacggggaagctcgggattagctcgccagacaacgcacttgcaaaagagtacatggaagaagctttgccatacatcagcacaaacgagaaagaactagtaaccaagatcttagacccgtcattaatggtggacgaagaccttctagaagaagtatgggcaatggctatcattgcaaagtcatgcctaaacccaaaaccaacaagaagaccattaatgagacacattgtgaacgcacttgagaacccactgaaagtagtaagagaagataccaactcgggttcaggctcttcccggttaagaacaaactcgtcgagagggtcttggaacgctgctatatttgggagctggaggcagagtgcgtcggatgtaacagctgttcaagcgggagcaacaacaagcggtggtggtggtggtggtggtggtaatggtttgagaaactcggggtcgcaaggaagtagcggaaggaacaataacaacaacgggaattcatcgtcgtcgagaagacggcaatctagtgagattgtaccggaacctgctgcttatggagtagtagaggataatttatgattcgtttcatcgattcttttgtgtcgataataacagaggcaaagagagtcctcaaaggtagcataatgttagatgggaggaggatttgttttttctttcttttgttttgtttttgggtttaggattggtgggagttagaaatgttagttcactctttgtttttgttttttggttcaaacgtggattttgtaaattgtaaaattcttggagattgggttttgttttcggtttctttcttattgaaagaccagaaaacaaaacaaaacaaaaaagttgggttacatttgtttcagttccaccattacttattattcttgtatctgatttcgtacgtgtgaattttgttgactatttcatttgcacgtggcaagcttttgatatgtatttggacaaaaagtgaaaggaaagatacttcttccttttgttggatctgatttcgtacgtgtgaatattgttgactagttcattcgcacgtgggaagcttttgattcatattgggacaaaaagtaaaaataaaggttctaccgagaattgaactcgggttactggattcagagtccaatgtcctaaccgctagaccatagaaccattatgtttagagacgtaaacttataatatatatacgtatgaaccaaaatgttgaagttgtaggatttttggtctgagttacctgtaattatatttaattatttcatacactgaacttaatttgaaaattacaacattacaaacaaaaattgaaattctaatgagttacttttgccaaatctatcatggttagaaacttagaatgattaaatagctaaactatatcccaatatataagatgttcttatgtattttatttttgtccattatattaaaacttaaaataaattttcatattttctaatcatttctgttatatgcaatatttgccacgattggttgaattgttttaaataaataaataatattttgtaaagaacataagtttcttaatatatgtgatttaactaaaacatcttataagaaattggacagcggaatattattttcttgggttatttttgccaattctcattgatttaataagttggttgttaattggctatttgacagattattccataccaaacaaaatttgaaagaaatctccaaaaatatgattaatactgtaaacaatggggaaacccatgcaaagaagtcagcaagtgggttgtagtaaaatcagcacatgtgattatgagctttgggattctgcataaacttctgttcactaaccaattaattatactatattactcccaacccttacactaacttattactcttttacatttcaaatctcacttcctccacattcctctgtcttcatg

SEQ ID NO: 13724 - DNA, 3000 bp, Unknown
  misc_feature (1)..( 3000): cDNA_ID_2703965_gDNA_ID_2214647_Annot_ID_136374 3000 nt of promoter + ATG
atatagtattatttatacataatgtaatactctaataatcgataagtttaatatcatgatttgttttccttattactaaagtatgattgcttatcttgcctagttgataactaatgtgatataacatcaatataattattcgtatatttttaaacattaaattaagtttagaaatgtatttcctgataaattattgtttaccgaaatactcttaatactttaaacttctctaactctatcatactcaacataagtaaatggaaaatcatgctggataataggtttagatcgtgctacaaaagtatatttttaaacattaagtgaaaaagaagtttaaatgaattggttttactttgccagattaatctgctaacttgctgtccgcaataagtcaatcacttcagtttgcaatccgtgatgggccaacctgcttggcctgctatttcgtggacataaatattaatgtctaaacccaccccactacagtactatttggactaagcccgtttgacacctttactaattataaccactagtgagtagttatataagattatcttcaatagtagtttcttagaatagttataagagaaataggtataaaatttaatgtttaattcatataattggtaagagatgactcttatataagagtctaaatacatcttaagagccagacacgtgttgtgatataagtgggagaatgagaaatatttgcaaaattctgtaattatgtactactaatcgttttatgtatgtttatgtcatgtatgtttaaactttgatatcatgtatgtttcaaattttatgaattgcaataattattaaaatttttaaaaatcaaatgtttatatattttttaaaaacctcaacttaagagcttacgattggacattgccaaacatttaaacttttatccaaacttttaacttcaaaactttcaaatcaattataaaaatattgctaagaatctttgctaagaattcaccattatagattctctaacaaatcttggcataatcattattattaaaaaaaactttttgtagagttcttgttttttcctttataatttacttttctttctctttttctttttttttggcagaatttaacaattttttaataaaaatttaaaaatatagcactatatatgtatcagttaactaacataaaagataaattaaatgaccaatggaggaggtgacggctccgacgatggtggctccaacgatggtggtaagttcggcaacagtgtgaatctagtgaggacatgcggtggatccggcgagtggttctcgcgaggatggtggcttggaggacggcgatggtggtgaggacactggtagctccggcgagggcagtggttccaatgaagatggtggcttggagttggaggactgcggtagtggtgatgaagatgacggcggtagtggtggttccgccgatagcgaaactgtggtggtgatggttgttgtggtggtggttaatggtgatagtagggaggataaaattgtcatattatatattatacatcaactctaatataaactttattgtataggttagtttcctcatcatttgctattgcaagttatttctctctctaaagatttgatgtaatttaatgcttacttagccattttgcacgacgcaaataaactaataccgcaaaattcgtgattacgcaaataacattatctaaatggccaaaaataactcatcccatctcttcttttttttttttttttggtctaaaactcattcaatctcttctacacttgcattttctaattactgaacaataaactgcttcatacaacataattttaaatatgtttcgtttgagataaattgttcgacattactaaagattttggctgatcaaaaaatttatcaacctttaccacgattcaattgcctagtcataggcacgaagactcttgttttcgtttacaagcatttgaatgctaaaagtacatagccgtctttggagacatgatctaataaaaaaagatctacgttgacgtatagaaaacacattgattaaagaaagatatctcttaaactttatgggcaagaagaagatatttttataacctgatagacacacatggcaaaattaaaaatatctagatatatgtacagttaatgttcttgatattattgtgcccatttgcattagacatggcacaaaaatgaacacgtcatttttcaactaaaataacttttcaacttattaaaaaattcgaagataactataattcgtcgatgcctatacgaaatacgaggttctttttaacaccttctttggacaatagatattgagatttacatcttctgctctttccgacaaaagcccatctcttctgtcttattttcttctgaaggttctgttttttttttttttttttttttttttctcatccaaataagtacttgagagaattataagaaaattcgtacttcgtttctttggacagtgtacctccacgtattcgtctctggtaataatctccatcacaaatctcttttttttttcttttgtgtgactcttgtttctggtggtacagtttgctcatcgattgaatcgatttgtatttcttccacacaagaaaaatggatttgtacttgtttctggattttatatatctggtgtaattgtaagtataaatttgtggaattagcttcttttttttttttttttttttggagaatttactgaaaaagaatgtgatcctagtttatcaaaaaaagaataagaatgtgatcctcctcacatttgtttgatgaaactttttgtgttctttaggtttaattctgaggttgtgtgaaatttggtgaagagaattttgagatcatagtaattatccacttgcttgatgctcatgagctctagtttagtattgtgtttgttttgaattatgattgagataaaggatatttacttctcaggtgatttaatcaaagcctctggagaagatctgtaggtacgtacaa

SEQ ID NO: 13725 - DNA, 3000 bp, Unknown
  misc_feature (1)..( 3000): cDNA_ID_2703938_gDNA_ID_2214647_Annot_ID_136376 3000 nt of promoter + ATG
cagggtaattgtcattatcgatcttgagaaggcgctgaagcagctctctcgcggatttgttgaagttcttaagcccctagtaattgaaaaatgacacatcgttttaaacattttttcatatttatacattttcgaaagaagaattgaggtagaaaaatgtgacaaaccactccttggacatcaaaaatggttgtgctttggtcaatgtgcttcttggctgcggcagagcaagaagggaacttgatcttaaacatcttctcgaactctttcacatggtatttctcataccggtccattgtagtcgcttgtaacagcttgtttgcatcgatttgacctaatctctcaatgtaaaccggcctgccttctttgtccactccatggtaaccttgcggataatgtttgagtacttgatcgatctcttcaaactcgaaatccttcattattaaaaaaattataaaccaaacaaatcactcgtcaaagattgtgtatatataaatgatcagtctaagatgttccaagattcttggacaaaaagttaacctcaatgattgtatcgactccgaaatccatcctccattgaagcatgtcactccacatttgctttgctttctctttgtcaaattttctcgcccttaagaatctatgtagagattaaacataataaatcataatattacaatcgcaataatcatctacaacaagtaacatttagctgtaaactcatcatgaattatggatttatatgaaagtgtaaaacatttattgattcgcttgtaagagatgaacaatttttttttttaagatatgaagatttaatgaaatgttataatgttaagacaaccaaatttttggtcatctattaaaccagctcctcatcaaataaaatattcgtttggattggtataatttttccattagttgacttcatgatattttatttcataccacaacacatcatttgacctagtagggatcttaaagaaaaatataaaaacctgagcatcatgtgaagatcatcgtgtttggggggcaaaaggtcgtcaaggacgaggacttgacggaacgcttccacggacagataatcgtccccgttgatgtcgtctgtattggctacggacacaattttgctgctggtcctccgagtcttcttcttgaaagagttcttgaatctatttgatgcgcttatcgctttctgtttaagcgagctcatcttcactagcttccttccatcctctgaattctccatatctaaaccacacatgattggtttacattaacattttaggcaagaggaaaaattgtatcaatggctagttaaggtaaatgcattgacttataaccttgtttggtgtcagccatggtttagacttttgatgaaacacctaaaagatgattaagattgtttaagaaataagattgaggaaaagagaagcaaaaccagtgtttttttttccttaccttattggagatgagttcttgagaggaaggaagggtgaaagatggtaatggtgaggatcatctgaaactaattaagacatgtagaaaagtacttgaatgtcattttaacaagctattgataaggtccaaaggtggttttgttcttttttttgttttttacaattggtttgttcttaatatatggaaatggacatgtgtgtgatataatattgaaatatatcaaaatcgattcgtatctgtaccaataaatgctataattaatagaaaagagtatgacgccaatttggactaagtgcagcccaccactttacagatgaaaacatagtttacatgaccaaattatcatcttaatcactttacagatgaaaacatattttacatgaccaaattatcatcataagaaaacatattacacaatggttttacatgacgaaattatcatcagttcggtttggatcgatttcttttgattctggataattagtttaaaagattgaggatcaatggttttacatgaccaaattatcatcagttcggtttggatcggtttcttttgattctggataattagttcaaaagattgaagatctatttaggtattttagaattttggtttatattatgttcggtgccttttcggttcgtgtcaatttagatttgaactagacttcccaatttaactaaattttaatataataaccaaatatttcgattttaaaattaataaccgaattaaccaaaaactacaccgataatttaatcggttattttttgtaaaaatttcagtttctgaaatacttgagaaaccaaacttacctatcccgaaaaagcggaataccccataatcacatgcctagtctgtaatttctctccgaaaacttgtcatttacttaaatcattcaaaaatctactattattttgaaaagagggaatagtaacatataaatatgagaaagtccatattaattagtaagttcaacatacataattaaagaaatctatgttcaaaacaaaaaagattgaaataactattggtctatctaaaaccatggttcgcacttcgcagtagtggatagtgtccggatagtggtcttacctttaaaacccgacccttactttcgatcttctattttagtttgatagagacacgtccgtctactttaagcgttttacgaatcggcgtttccctcttttctcccccgcttatcttctcttcctgtccttttcaactccgtgactaaaaaaaaaaaaaaagtaacctttacctacttttcttctgggttttcgataatctcttttgggtatttgcaaacccctcaaagattcttcctttctcctttaaatcggtcagtactgatctcttctccatacccttttgctatttgtttcaaatttcgattctttgattgttttggatagtttaattcatatgaatctgactcttgtgtttgattttcacagtctctgctttggctttgtactagccatcgcaattcatcatcatctattgcaagtatctccaaggttttgatttccacaatg

SEQ ID NO: 13726 - DNA, 1 bp, Unknown
  misc_feature (1)..( 1): cDNA_ID_3031588_gDNA_ID_2214647_Annot_ID_188558 3000 nt of promoter + ATG
g

SEQ ID NO: 13727 - DNA, 3000 bp, Unknown
  misc_feature (1)..( 3000): cDNA_ID_3031611_gDNA_ID_2214647_Annot_ID_188550 3000 nt of promoter + ATG
ttatacccattaaattttttatgagttaatgggtataagttgacttaataaaaatgagtcagttaatgcaaagtttggtacccctctgttttatattagtttttgtttaagaagttaaattatgttttatattagttgtcgtttttggtttccaacacaaatgtttgacatatttttctaattttatccctatttttaaccttatttactgatgatatcaagtaaaacaatacatttattaggggtaaaacaaaaaaaaattgaataattttttaatactcgtgaaaaaccttaaacgacaattaattttaaatggagggatataattaccaatctaaatgacttaattgtgttttaaatgcagttaattttgtttcaatgtaagaatttttttagaaaggttaaaggttccataaatgtgtgaaacgttttgattgtatgagtgagttgaatgagttcattgtatagttaagatgattaaaattaaaaagattttcttaaaaaataaataaaacattctacatcattctaattatttagaggtgtttgcttgttggaagaaactctatatagcagtaacaaactatacttcagttagtttcttataatcatcaaagttacagaacatcaacatcagacatgttaccattgttctgccaagaaagtcaagtccctatggtttcaaaatgcatctagagaatttgttcggaatgcctttacaaaggtaatcttttttgattctaccttttaaatttgtaatgactattttactcttatttgaaaaaaaaataaggttatcaaaataaaataatgattattcccgccaaaaatattccaacgataattttttggccaaaaaatccgacaaaaaatttctcgccaaattgtttttttcaaaatatcattttccccaaaaaaaatagttttggtgggaaatagatttacaaggattttaaaaagagttttaagggacttacaagggtttcaaaggattttaaaacatttgtaattccttttcaaactcttttaaaactcattaagaactcttgtaaatctttaaaaaaaccttttataagtcttcacaagagttttaaaatggttcaaaaagatttataaatattttaatatttacaaatatattttttaagagttgaaaaataatttacaaatggttttaaagactttataatagttttagaaggatttacaactattaaaaaacttttgtaaatcattttaaaaccttttacaatggtttttaaaaggatttacaactatttaaaaacttttgtaaatcatttttaaaccttttacaaagatttttaaatatgtacaaggatttgaaaataatgacaaagactttataaggattttaagaggttttaaaataatttacaagtattttaaaaaaatttaaaaagactttgaaaggctttaaaaaatttacaaagatttttaagagtttaaaaaggatttataaggatttttagatacaaaagtttggtggaaaatcttttgacggatgaccatgcgagaaaatttcagtttcttattacatgttatcattagataaataataatttaatcatcttgttcataaaaagaggtttaaaaataggttatggaaaaagatatttttggaaaaaggtattaaaaagggtatttttacaaatacccatgcatctatctatatttacatttttgaagtacaaatatgaaataaatcattgaaatgagacttatttacaagggaatggcattttcataaatatttctatattaactaatatttaaaattattttcgaaaaaatattttataaaccatgacttccaaagatagtaacaaattgattgtttctaaatttgattaattactaattttctaaaacctttttatctaatttaaacattaatttatgattcttttttcacttatacattctcttatatttaatttattttgaatataagtaaaatatatataattaagaaaataatagatttttttcctccttatgacgtggttcagttttttttaaaaacaaacatagattactcaattgatgataaaaaatatgtgtacaatgtcccacattgctttaacaattagacaatgattgtcatttaccgagattgattgaccgagacaataattagacaattagacaatgtgtacaatgtcccacattgcttgaccgagcagagcgcggactatttacacttttataataatcaaactcaaattaaattataaatttatcgaatgataatttttacacgttttaggttccagtgtaacagtataagagcatctcaaactcacttctatttttgcttctatactatattttagagtaaattttactccaacgcacttctattctcacctctaaatagagatctctatttttatctctatatatagaagatctatattttttttactatatctagagtcaaactttattatttgtaaaatggtcctttaactttatttttcttttatatctgatttaaataaataaactaataatttggactgattttagaggttttagtttaaatatctattctaatatttgaggccattattattattatttttatttttgtttatatgtgtaattcaaaaagataaataactaatatataaatgtgtaatagactaatgcatttacttataatcaaatggatggcaaaaagatgacatcctaaaaagagaatttacataaaatagagggttttattgtaagtaactcgctatctttcggttatcttcggtttgtaatttttcatgatcttcttcgacttgtagatttaagttttgaattcgttcaccagaattcagaacttgatactgatcaattgaattttcactcatcaatttgcaacgatttgatctacggaggcttgacgaggtggattggagccagaggaagggcggatcatctcgaagtagaagatctcgattttggatcgctcggaaaactgatcaaatg

SEQ ID NO: 13728 - DNA, 3000 bp, Unknown
  misc_feature (1)..( 3000): cDNA_ID_1381022_gDNA_ID_2214647_Annot_ID_188548 3000 nt of promoter + ATG
gaatctcaacttcaacgtaagtagggcactaataaaaacttaacatttacaattctcttatttcccaagcaaatatcttcggcgtcatgttcatattggattaataataataagaagaagggttggttggtcgtcgtatattatgaagacactcttccctatccactgactctatctgtccattgtccaggtctctctctctctttctccttctgccatctctgtcccaattcagacttctttctcttcgctacccatcatttcacgttcttcacttatccaccccaatttactatttttattttcttttcaagtttttattctcatattttgaagtgtaaatttaaataaaatgcttacctatgttttcccacaaaattaactcttgtgtatttcgtaattttttttttcatagaaaataactaaatcacttaattcacaaaaagtctattttggtctctccatgcaaaaactataacctttcagtgtgttggtaagaaaaggtggtaccaccattttctatcacactaagatatctcaccacacattttaatttgacttacctcttaccaccatttcgtaccaccttatactacaaatcagacttattataaaatgtcttggagttgggattttctcaatttgtttctgattcgtaatcgtaaagtcctccatgacaagatatggacctacacttagtgaaaagaaagtaaaagttagaaaatttgtagaaatacctaaaatctgtgggcacaaaaagacaaagctaagtggggaaaaaggccacttattcattatttatgagaaagagataagaatatgaagtgttttttttttgtttattccttgcaaaaatagttgtatgcaaatgcaactatatagtaaatagcatgtggaccatcacagatattattcgaaagaacaaaaaaaaatcaaatgttgaaacttgaaagtgaaatttaaagacaaagaagaagaaactgtaaaaagcttaccaaaaaagtgaaattattttattgaaaagaagttgaaaaaaaacatccgtgtgtaaactttgacacgtcgttacccaaattattccccactctaataaagatggactagtctacacaaaaattaatattatctttgattacaaatcggacatgaaatatttaaaaaattgcatagcaccaaaattagatatgaaaaacgttcattatatatttgtcttattctccaaatatgcttgataaacacattattatagaagaattacgaaaatatcttttactattgacaccaatcaggaatatatcaaatatttttagataagaatataaaaaacacagaaaatgattgtatggtggttatagcttcattcaattttattgcagcaaacaaacagaaaggccagagagacgaaagagagaggcattagggtttaggattaggttttagaaaagggtttagatctctaccaactggtttgttaagaacataatctccttaccacatttttactcttgaaaacattttgatctgtttttgttatcttcaccaaaagacttgactccaagaaacaagaagaagaatcaagaagcaagttcaagaaccagcttttaatgaaatctctacttcaaaaaggaaacttgctttaaggaggatggatcttttgttttcttgaatcttttgtgtgggtaaaacattttgtattatcaagattttgatttgaggagataaagagtttgttgttaagtttgtgttcttgggatcatcaagagttaaaacaaaaaaaaaaaaacatttcttttttccttcttcaatttgagatttagtgtctcctttaacacccacaaagccagcagatgctttcctggtaattctttaatctatcctttcttcttctttttaaattcttaaattcatgcagagagataattctcataattttcattggttcaatttcttaaaatttgcttaattaagattttattacataatgtgaagtataaaaagggtttagtgttgtttgtgtttgattctgaaacagatgactccttgtttgatctgatcataagaagaagaagactatggccacttattacaaaactggctcaagtgagatttattccagaccagaatttgtccctggaaacgcaatgaactacacaaattctttcacagagacatttcctagagattcaactaataatgtgtcaccttcaaaagagattcaagtgttgtcaagccttggtggagtttcacaaatggttgagattcaagattctggttcttggagagatcaagaagacaatgacaggaatcgcttcccggtgatgaggcgtcttggcctcagctcgcagattgagacatcgagaggcaataataacaatgagtatgcaacacaggttgtttcgggatttactcgaaccattcacaactcaaagtatctcaaagctgctcaagagcttcttgatgaaactgttaatgttaagaaagctctaaagcagtttcagccagagggagataagattaatgaagtgaaagagaagaatcttcagacgaatactgctgaaatccctcaagcagagaggcaagaattgcagagcaagttgtcgaaacttttatcgatattagacgaggtaatccgccttacaacatatcttctacacttgttaatgattctcgtggtaacataaatgttgtttgtttctttgttgtttgaaggtggatagaaattacaagcagtattaccatcagatgcagatagtcgtgtcgtctttcgatgtaatagccggatgtggagcagccaaaccatacacagcccttgcgcttcagaccatctcgaggcatttccgttgcttaagggatgcgatatccggacaaatcttggtgataaggaaaagtttaggaggggaacaggatggatcagatgggagaggagtggggataagcaggttaaggaatgttgatcaacaggtaaggcaacaaagagcgttgcagcggttaggtgtgatg

SEQ ID NO: 13729 - DNA, 3000 bp, Unknown
  misc_feature (1)..( 3000): cDNA_ID_3031619_gDNA_ID_2214647_Annot_ID_188547 3000 nt of promoter + ATG
gttttaaaaaatctcaaaacaaatttcgtcatattttatgattcgaaattttaagaatgaacatatattaaccaattggcaaaaaatgtgtgggttcaacgtcccgcaacgactaaaatattttgacaatgattcataaacatattataaataacatcaatattaataaaataaacagtttttttttgtggacgggtttggcaggacgttacttagtaacaatggtaaactataaaataatttatatatttttatatatattaattttagaaaatgaattgtcttcgcggtgtaccaatggttaaaatctagtggagtattaaaatcaaaacaactaacttctttagacttatggtggccaacaaagcaacaacgggaaagtggtctcctttcaactttttctttctcccccattttcatgaaatattaaaaatatctcaaaagagcataatacgacattaatttgcattaatcgtcaagttgcaattatgtgtctaatcatatttacaatgctacacaaataaatatattatagttatcaataaactctctaatttggcgtcttgtttctcccttaccatttgagaactcaatttttctccaagagaaaaacaagaattccaaggagagataattaagttatgggtatgtcaccattaacggtgaagaaacttggtttcatcttcatgattgtttcagcttctgctctttctgtctcctttgcaggtttcacttctctcacccactctcttctgttttgttgcagcttttctctatacttcatgtgcgcaagaaattctttagtccttgttagaaagaaatgatcacaattgtataatctttagtccttgttagaaagaaatgatcaatattgtagtttgtcgttgtgtaaagaaactactaaacaatgatgatcatgatttagttatactgtatgtacaattaagtaacctatttttcttatagatgtaacaaataaacttcttttgttatgcaggccgaccatcgatttttgttcataaaaaaataaatcttcgcgaagaggttagtctaactaacatatgaaggggaatgtgtttcatgtaactttgtgcataaataagcatacattttctaaatttgaatacataataaatcttttttgctttcaataaataattttggagctgaatttggttaaatgataatgtgactcagatggtggaaagaagcatgcatgagcatgagaggcttctaagaatgaacacaaaggattatgggaacaacagtccgtcacctagacttgagagacctcctttcaagcttatacccaattgatgacattagaattggttctaatccatccttaaataatatatacatatataggtagaattagtttcagtgactatatagttccatcgaaatttggagatgtaatataaataaaggtaagaagctagcttgagctatgctatactcttatatttggtgtgctgcatagattttggcattttgccatacatccatggcatcacaatcatgtgtctttgtttttggttttcaaatatatatttatgttgcatgcaatattatttatatgtatatatatatatatatatatatatatgagaatttgaattcttactattagacagagatagtctaacagtaaaaaatttgtgatttgagttctataacggttcgctaataatttctaatcaacctctagatctattattatgatattttctgagaaattccttaggcatgacgatttttaatctatatgaatttacatcgaattttattgtttttcttgttttagttaacaatttttctgtttagtttgatttcaacactaagaactttccgtgtgaacaaaagaactttgtgaatctgatccttaagtattataatgaactcttaatttgagggacttacttgaagtctaatttgatatatgtcaattaccaattaagaaagccttcccatttgtttgatacaacacaatcgaggtgacactagtatggccaaagagatagttcacgatagaaaatcaaaaatcaaactttgcctcaccaaagattgatgtagtagaaactaaaaacaccatgagaaactctcatgttagaaaatcaaaattcaaataataatcaaaataaatttatattcaagagttgtatatatatatatatatatactagagtcgtcggatgcatctaaaccatagtccttgattcatatatgtgacgttttcatctccacaaatgggtaattgtgttattacatagtttaaccaagacgacatcgtctatatacaaccatttagggcatgtgttgtccaaattatttttgctatgaatcatagcgtataacaatgtttgtaccaattttgtattattattcaagtcaaaacataaaaaaaatgtttgtttttggtcaatgacctttacgtaagtcacatacaaaataaaattgtaagaaagatgcatatagaatctttaaagcattctgaaatttgataaaagtagacattaataatgagagtggaataatataattatatgcttatatacatctttcttacaaattcattttgtctatgaccctttactaatttagataattacatactcttatcacctctctcttagttacagttaatgaattatgaacaaaaatatggtaatatgacattaatgtgtttaaccttcgaaagatatatcgatggcgcaagtaaaaaaaagagttgaaacgagtttttaaaagagagacaatttacatgagatatttttcgttttaattcttagaattgaaactgttagttactctcaattttgttcattaaacactctcattattgatttctcttatcagcactgatggtattagacctgtggcaccaatagcacctcttgaggggttttatgcaaatccaaaagttaaagatgtcaattggaattggaagtaattcaaagggcttttatgcaaaagtttgtttttctcataaaagtttaa

SEQ ID NO: 13730 - DNA, 3000 bp, Unknown; identical to SEQ ID NO: 13725
  misc_feature (1)..( 3000): cDNA_ID_2703938_gDNA_ID_2214647_Annot_ID_188543 3000 nt of promoter + ATG

SEQ ID NO: 13731 - DNA, 3000 bp, Unknown
  misc_feature (1)..( 3000): cDNA_ID_3031633_gDNA_ID_2214647_Annot_ID_188542 3000 nt of promoter + ATG
ttgttttgaattatgattgagataaaggatatttacttctcaggtgatttaatcaaagcctctggagaagatctgtaggtacgtacaaatgtctgaacatgttatggttttgggtaaaggtaacaaaggaatcagcaagaattcttcagtcaatccatatgaatcagcttggttaggtcgttggactcagtcaggtagtgaagtgaagtttcatgatggtgagaccaattgctctaagcagttgataagacctgaagatgagaatcatggagtcgaggtcttgccgtttcctatgttcaaggtttctcaaaagagagagactactactactactactactaaaccgtctttccatgaagatgttggttcaagctcgagagctatggttaatagaatgccctggatgtatccgcaaggagagaacttcagttctagtaaccgtcttgacttcccaattcaagaaaagactactcaaaacttgctagagttgataagaccggtgaggatttacgcaacggttgattctgttaacttgcctaaagaagatagtcatcagttattgaaggggtctacagtttccatgaaactgaaagggaagatttttggtggatatcttgatctgtttcctaatcaagatcactcccacaatagaggaggagtaaggctgcagtctctagaaagctcaaaggatactcaagaagatggaccgagaaaaaatgaatcatcggcagagactaataccttagaaatggatagacttcagactatacatctttccggctccatttcttcgtcatcaactaaggtattgttcaatcgacatatctacatatctttactcaaaatgttgaaagttgtgattgtgaaagatgttgaaaattccgcagggaaaaggaataaaaggctactcagccattccaaggaccgaaatacctgacatgaatgaagaaccacctcttgttccggatagagagaattcagtagatggacatcagggagaaacaagcaactcggctactcaaagtatgaatgtggaacactttctgtccagagattgcaaacgtgtgcggttggaaccagaagtagaagccagcagtagatgggtcaagcgtctgaagacaagcccctcagattccagtgaaaccaagagcatgatgaagatgaaagaagcatcactgggagaaaaagagaacaataatctattccttgagatcttgaagtccggaatcaacaatctccaaccgagaaatcaagaacccgtcgtttcacagagcaatgatctgagacaaggaggagatgacattacacttctgcatccatggatccagaggtggtgcaagaagaaaactacatcaacagatcaaccaacagggcaagaagctagctttgagccagagagtcacaaggagttcgagaagaaacagtatccgagtattgcagccatggcattgatggggaaggctctgagcggtttaaacccatatggtcttagaaagaccaactctctcatggtttggaatgcaagggatttgaggtaggaaaacaaaaccatcatcctcatcttcccttgtttatcattacaacgtaaagtcaagaacatcaaacagaactagctagcaggcttgctacgatcaaatattttgacaggttctaccttatatgtcagtctgactattcttataatagtttcagtttatgtatgaataccttgtttgcatcataaatattcccttttaatcgttaccgcatcagtattttgatttgttactggccttacaaaaatgatagcataattcaaagtggtaagtaaatctgttctctcgaaaatcttgattcaagggaaaaagagtaacatttaacattaagtcaagcaagtagccctagtgttaatctgctgacttgagtgagtagaaaccatccttatcgtgcctttcaccatcaaatctcttatcgcctttctagcaagcgacccattgatctacgacagaaaccaatacaacattttacacatgatcaaattcttgagcacaataaaatttctctttcaataactcgataatcttgaacctatcccaacacattataaagagctaattcagtgaaaagagtggaggtagagagttagttagtttacccgaagacggtcagagagaatcgaaggagtgatcaatttgaacttaggagcttcagacataagcttgtcgtaagttgcttgatcgaacagaaccatgttgttcaccttctccttttgctttcctttgctccacttctgttgaaatcaagaaatgagaaacgtaaataaaacaaaacccaccagaaaccaaatcaaagaaacttactgatcaagtaaaaaaaaaagtgattgtgatttggtaaaggaccttctttttctgctttccgccaccggatttggcgggtttagaggatggtggtgggactttgtccttctttggtgcctggaatcagtcagagaaaccacacacgaaatctgtatgcgacgaataaaatcaaccatccgaaatacctaaaacctatataagccaaatatttttatttttattttggtaaggtttgttcgatttttttttggtagggtcttgttcaattttatgtagtaaaatatatttttaaattgtatattaactttatgttttattatattccaaactgggttataacttataattaaatgtaaaaatttaaatatttgtgaaatggagaaaagtaaaaatttatcatgacagacgtcttcatttcccttaatcttaatcttaacatagtaaaaatctctttcttcaatttatctatatataagattttactttagttatgttttaaaataataatatactcttaattgggttataaatgtgaaatctatatatttttaaaagggagcaaaatcaaatcttattgtgataaatatatatttcttcattatatatccttaacttttaattcttcagttttacatacagatctttacggtggaatttaacg

SEQ ID NO: 13732 - DNA, 3000 bp, Unknown; identical to SEQ ID NO: 13724
  misc_feature (1)..( 3000): cDNA_ID_3031637_gDNA_ID_2214647_Annot_ID_188540 3000 nt of promoter + ATG

SEQ ID NO: 13733 - DNA, 3000 bp, Unknown
  misc_feature (1)..( 3000): cDNA_ID_3031658_gDNA_ID_2214647_Annot_ID_188527 3000 nt of promoter + ATG
tacgagaagatacccatcaaaagtgtgagtaccatcaatcaatgatcacgtaaagtacacgttttgcatcgttttagtactaacccattttatatattcacagggtagagaagaagaggagatgattacaccagtgagacgttcaagccggattaagaacaacaaaccttctggttctggtctatgataaagagatagacatttcatttcaatcattgcatcactatgcaatctttttagtttcctaagaattagaattagctttatgactccttaaaatcttctgatttgtaccaaactagttgtgattcaatccaaagtttgtttctttgtgtcagtctcagtcgtttaaagtaaaagaagaaacaaaagcatgagactttttttttttttttggtaacaaagcatgagactaaacatcacaagactcaatttctccagcttcctccttcagatcgcccctgaccaccgtaacctccgtctccataaccaccttcacgacgatcacctccataaccaccaccgtatccacctccaccgccacggttgtaaccaccttgatcacgtctacctctgtaaccaccacttccgtaaccaccaaccataccaccgcgagtaccactaccacgagcctgagcctagttaacagtaatgttacgaccatcaagttcttgaccattcattctatcgatcgcagtcctcatggaatcctcatctttaaaagtcacaaatctaaaccccttagacctcccggtctcacgatcaatgatgatctgatccaatccataaaccatataaagtcgagatttttatgatacaaagagagaaacagagcaacacaaaaacagagtcacactttaacggaccttggagtcgaaaacttcaccaaactcgttgaaacacctctctatagactgttcatcggtggcccaagctaaacctccgacgaagcatcgatactcgttgtctgcataagccacgtccaaagatttgaggaagatgatgacgacgacggttctatatagaagcgcgaaaccatggttacgttgattcggtgcttaacatgcattcagaaatatgattagaactgtgaccaaaacactctcttggacgcatgatttgtgccacgtcaccagaatcgaaataatcttgctctgatccgatggtttagatttgacggcttattttgtatgtgtggggtctcacgaagaggacatgtgttagttatatgatcttgaactggaaaacacagatacaaacaacatttgtactttcggacacgttggatttatttaatagcgatgcgggatatgtaacaaaaattaggtagtgatgtaaatttgttatccgacgaaagatgaatagttcattgctttttcttcccgaacaaatatcctcaattatgacttaactagctcgaggttagagaaaacttttctatggaaataacagtaattggaacgattaataaaatcatatacgcaactgtagcatatgaaaattaataaacagtttaagaaaatttcacatcacttgttcatatattttgagaaaacttttgagaaatttttagctcaagaaaaattcatctctattaatgtctacttaatcactattttctaaataaaccatagtgagactttgaactaacataatcattcatttttcaagtaaaattaaataaaaaaactaaatattttcattcgattggcattgtttaaattgaacattctacaatagagaatttgtttctatcaattttaaactaaacatatatcaaatttttggatcatatcaaaaaagctagaaaattcaatatcattgttttttaaaaagaatacttcaacatctttacaaaatcctataaccgataaatatttcatccaatattttgaaagaaagttgccaacatttcacatgtttttctagttgataattttctattgtactgtatatgattatatgttgtaataaattgtttaaaatgcaaatgattacagcggttgagacggacaaatactatgcagattaaaccgcttttaatttaccaatcataaattagaatctataataatatatactaagaaaactgccgtaaaccaatcataaaccatttttacatacaaataagattgatccacaacgatttattatctacttgaaaataaaacacacttatattatcgatgaatttatctattctgattgccgttaccattcgaaccaaaaaattcagagtatttagaaaattttagcaagaaaagaaaaagattcctttattcggccaagaatggtgaatataggacgtgagatatattactccttatatatccgaacattaaatttacaacaataataaaacaggaaagaaggaaagaaaaaatcccaaatagtaattgcggcaacagcttagctggcttatggcgggattaccgggaaagtcaaaccaaacattaaaacgacgtcactttaccccacactaggttttaatttaatctaatttcaaaattattaattaatcagatttgtaattaataataaattaatttcgaagtttcttgcaaagacgagagagagaggagtgtcacagtctacagttgttatctcaacaatctcgatcttcttcttcttcttctttctttctctctctaaagatttttttcactcaacaaatcactttttgttttgtctgattttaaggattagtgaaaaatttctactttttcttctcataaattaggatttagagagagagagagaaagagaaagagaggtgctttaatgtctgtgaaggtaggagctgtaattggatccagtaacagagcaaacccagttcgatatctgtctctttcttcctctctaaagatcgaaagacgttatttttattagggttgttgaattgggtattttgcttaaatcctgaaaaaaatagtctctgtctctctctgggtttgggtgatgagtgttgatgggtcattggattgagtttgataagcaatg

SEQ ID NO: 13734 - DNA, 3000 bp, Unknown
  misc_feature (1)..( 3000): cDNA_ID_2714026_gDNA_ID_2214647_Annot_ID_136377 3000 nt of promoter + ATG
agttttagagcatagcagagacactctggcttaatttacttttgcattggttgaaccgcttatgaaccatagaagttcctcaacaacacctctccagaaaactcgctaccaaaaaaaagcaaacagattgcgtgagtttgaatatgagctagtgtagatatgcaactgccactaaatacaacagaagacaaagcattctccttttgcgagtaaacgtggaaagttaaggaaaaagtgagcatacctttgttgtcagaagtggaaaacttctgcgtaaattgaatttcatctgtgttccaaggaaatgtgagatcatttaaccaactagagataaacagaatacataaagaaacggatttatatcacctggcaaccaaattttgataatgtaccagtcccggtcctatcattcttcacattgccattagagataatatcttcaaccatattcaaatacagaaactcctcatgctgatcaaaaaccatcttaggaagaaacaaaaacttcttcccatcaaattgaagagactgtgacccattgctttcatcagaagattcatcagcagaactctttacacggacaaaagtcgtgaagcaaaaccgaagtccattttcagttactggaaacgatgaagaccaaggctgataaacagaagtatcaatcgcaggtataaacgtatcacagtcaacacttgtatcaatctcagttaaatggatagcatcacaactaggcctattcaatgcttccctacacaaatacaaccaaccaacacttagttccaaccaacaacaagattccgaatcaccaaaagggataataaatgaaaatcaacaaccattacctcaatatgtcaccacctcctataacaaaaaccctctcaatagataaacaatacggcggcgcagctaacaaatcaagagcagaatctacactactacaagtgacaacattctcagtgttggctatatcaaacccaccagaacgagttagaacaacgttaagccgacccgaaagcggcctatacttaatgggaatagactcccaagtctttctacccatcacaacagcatttttcttagaggaatctgaagtggtcaaagtaatgtctttaaagaacttgagatctgttggcaaattccatggcaatttcccatctttaccaatacccatttctttagttgcagcaacaacaacttggtaagtcctttgaggctctgaagcaagtgtagtggtgacactgtcattgagagtagttgttgccattgtggaaatcaaaaccttggagatacttgcaatagatgatgatgaattgcgatggctagtacaaagccaaagcagagactgtgaaaatcaaacacaagagtcagattcatatgaattaaactatccaaaacaatcaaagaatcgaaatttgaaacaaatagcaaaagggtatggagaagagatcagtactgaccgatttaaaggagaaaggaagaatctttgaggggtttgcaaatacccaaaagagattatcgaaaacccagaagaaaagtaggtaaaggttactttttttttttttttagtcacggagttgaaaaggacaggaagagaagataagcgggggagaaaagagggaaacgccgattcgtaaaacgcttaaagtagacggacgtgtctctatcaaactaaaatagaagatcgaaagtaagggtcgggttttaaaggtaagaccactatccggacactatccactactgcgaagtgcgaaccatggttttagatagaccaatagttatttcaatcttttttgttttgaacatagatttctttaattatgtatgttgaacttactaattaatatggactttctcatatttatatgttactattccctcttttcaaaataatagtagatttttgaatgatttaagtaaatgacaagttttcggagagaaattacagactaggcatgtgattatggggtattccgctttttcgggataggtaagtttggtttctcaagtatttcagaaactgaaatttttacaaaaaataaccgattaaattatcggtgtagtttttggttaattcggttattaattttaaaatcgaaatatttggttattatattaaaatttagttaaattgggaagtctagttcaaatctaaattgacacgaaccgaaaaggcaccgaacataatataaaccaaaattctaaaatacctaaatagatcttcaatcttttgaactaattatccagaatcaaaagaaaccgatccaaaccgaactgatgataatttggtcatgtaaaaccattgatcctcaatcttttaaactaattatccagaatcaaaagaaatcgatccaaaccgaactgatgataatttcgtcatgtaaaaccattgtgtaatatgttttcttatgatgataatttggtcatgtaaaatatgttttcatctgtaaagtgattaagatgataatttggtcatgtaaactatgttttcatctgtaaagtggtgggctgcacttagtccaaattggcgtcatactcttttctattaattatagcatttattggtacagatacgaatcgattttgatatatttcaatattatatcacacacatgtccatttccatatattaagaacaaaccaattgtaaaaaacaaaaaaaagaacaaaaccacctttggaccttatcaatagcttgttaaaatgacattcaagtacttttctacatgtcttaattagtttcagatgatcctcaccattaccatctttcacccttccttcctctcaagaactcatctccaataaggtaaggaaaaaaaaacactggttttgcttctcttttcctcaatcttatttcttaaacaatcttaatcatcttttaggtgtttcatcaaaagtctaaaccatggctgacaccaaacaaggttataagtcaatgcatttaccttaactagccattgatacaatttttcctcttgcctaaaatgttaatgtaaaccaatc

SEQ ID NO: 13735 - DNA, 3000 bp, Unknown
  misc_feature (1)..( 3000): cDNA_ID_2714022_gDNA_ID_2214647_Annot_ID_136378 3000 nt of promoter + ATG
ttttctttctcccccattttcatgaaatattaaaaatatctcaaaagagcataatacgacattaatttgcattaatcgtcaagttgcaattatgtgtctaatcatatttacaatgctacacaaataaatatattatagttatcaataaactctctaatttggcgtcttgtttctcccttaccatttgagaactcaatttttctccaagagaaaaacaagaattccaaggagagataattaagttatgggtatgtcaccattaacggtgaagaaacttggtttcatcttcatgattgtttcagcttctgctctttctgtctcctttgcaggtttcacttctctcacccactctcttctgttttgttgcagcttttctctatacttcatgtgcgcaagaaattctttagtccttgttagaaagaaatgatcacaattgtataatctttagtccttgttagaaagaaatgatcaatattgtagtttgtcgttgtgtaaagaaactactaaacaatgatgatcatgatttagttatactgtatgtacaattaagtaacctatttttcttatagatgtaacaaataaacttcttttgttatgcaggccgaccatcgatttttgttcataaaaaaataaatcttcgcgaagaggttagtctaactaacatatgaaggggaatgtgtttcatgtaactttgtgcataaataagcatacattttctaaatttgaatacataataaatcttttttgctttcaataaataattttggagctgaatttggttaaatgataatgtgactcagatggtggaaagaagcatgcatgagcatgagaggcttctaagaatgaacacaaaggattatgggaacaacagtccgtcacctagacttgagagacctcctttcaagcttatacccaattgatgacattagaattggttctaatccatccttaaataatatatacatatataggtagaattagtttcagtgactatatagttccatcgaaatttggagatgtaatataaataaaggtaagaagctagcttgagctatgctatactcttatatttggtgtgctgcatagattttggcattttgccatacatccatggcatcacaatcatgtgtctttgtttttggttttcaaatatatatttatgttgcatgcaatattatttatatgtatatatatatatatatatatatatatgagaatttgaattcttactattagacagagatagtctaacagtaaaaaatttgtgatttgagttctataacggttcgctaataatttctaatcaacctctagatctattattatgatattttctgagaaattccttaggcatgacgatttttaatctatatgaatttacatcgaattttattgtttttcttgttttagttaacaatttttctgtttagtttgatttcaacactaagaactttccgtgtgaacaaaagaactttgtgaatctgatccttaagtattataatgaactcttaatttgagggacttacttgaagtctaatttgatatatgtcaattaccaattaagaaagccttcccatttgtttgatacaacacaatcgaggtgacactagtatggccaaagagatagttcacgatagaaaatcaaaaatcaaactttgcctcaccaaagattgatgtagtagaaactaaaaacaccatgagaaactctcatgttagaaaatcaaaattcaaataataatcaaaataaatttatattcaagagttgtatatatatatatatatatactagagtcgtcggatgcatctaaaccatagtccttgattcatatatgtgacgttttcatctccacaaatgggtaattgtgttattacatagtttaaccaagacgacatcgtctatatacaaccatttagggcatgtgttgtccaaattatttttgctatgaatcatagcgtataacaatgtttgtaccaattttgtattattattcaagtcaaaacataaaaaaaatgtttgtttttggtcaatgacctttacgtaagtcacatacaaaataaaattgtaagaaagatgcatatagaatctttaaagcattctgaaatttgataaaagtagacattaataatgagagtggaataatataattatatgcttatatacatctttcttacaaattcattttgtctatgaccctttactaatttagataattacatactcttatcacctctctcttagttacagttaatgaattatgaacaaaaatatggtaatatgacattaatgtgtttaaccttcgaaagatatatcgatggcgcaagtaaaaaaaagagttgaaacgagtttttaaaagagagacaatttacatgagatatttttcgttttaattcttagaattgaaactgttagttactctcaattttgttcattaaacactctcattattgatttctcttatcagcactgatggtattagacctgtggcaccaatagcacctcttgaggggttttatgcaaatccaaaagttaaagatgtcaattggaattggaagtaattcaaagggcttttatgcaaaagtttgtttttctcataaaagtttaaatggaccggactatagtctgggtcgcaattaaaatcgcttcaaattcccgagtcagagtctctcagcttcgaagcacgagcgagcgaggcaaaccaaaaagaatccaatttacatcatcttctccaaaattcagctcgaaattttcaacctttactggtttaatggacattctccagaccgatcaagcttcctcaaacggtatacgaatctctctgtgaaaaaaattaggtctttcttctgattttagtgtcactacattatatgcatgtcgttcccaaacccgattttgtgttagttgatccaaatatttgaagaaattatgagtaattttgcaatgttctgaagccaaagttgttgtctttcttgtttttgtttatttggagagtaatgtgacag

SEQ ID NO: 13736 - DNA, 3000 bp, Unknown
  misc_feature (1)..( 3000): cDNA_ID_1807870_gDNA_ID_2214647_Annot_ID_136381 3000 nt of promoter + ATG
catggttaggcaaatgcttcgatttgttttccgatattgatatctgattaatccggaaacacatatagatcagaatttttgttgatctaaataaaacggagcggatcacaaataatacaaaaaatttagaatatatactctgatttattttttgaatcaccttttagaaaattgtcatcataagagttaatggtttttcaaaatgactatcatattaagaaaataaattaacctcgcaaataattggtcaaaatattattttcttttaggctactgcttctcaggggattaattatatcaggaatttgagacagactgtacaaaattgatcaagatacatagttgtctgacgagtgatccattttgccaaccttttaaatgatttttttttatagttatttttctcttatttaaatcaatatatatatatatatatatttatatttagcccgtttgtatcaaagaatgtctttttttttttttaagtctattttggctttttttttaagtctattttattaaatactaatatttcttttgtttttgcgaattttctggaccaatcatactgcacggtctatgtgggaatggaataaatcctttatcattgtaccaccataagcatatgcattggttgacgacctaagtctactgaggcatatcatcaattatctttacataaatatattgtgattggattattttaggtttttgtgaaaaaaaactatgaagtcactaagttttgttattttatctttcatctaaaaaaaatgcagaataatcctatgaaatctctaattatacataatataattcttagatatatactgtaaacgttttcatatcacatacatttgacttttaaaattttataggtaaatttgaactatttatcttgaaggtttcgatttgatattatatataaaatttttaaaaacttgacaatcgtgaaaaatggtaaattgcatataatttaggatttcataaaattatctgcatttttttggaagtgaaaggtaaagttgcaaaaaaatatcggtttcgaggtttttttttacacaaaaccctttattttaaaacatagaaaaaactgaaatgtactaagaaaaatagctatttataatttttggtcaataatcgtataaatttacaataatccatcgagtaaacatgatatatttagggtcctgctgcatatgattaaccaaagaataccaaaaataatcttctacgatctttaacatttccttttattttccatgcataagaactttttgtacctcttctcatcttttattttatgcttatgcaaattgagttaattttgcaaacgtatttttttgttccaaatattaccataatttgaatttttaaaacaaacacacaacaacaaaaaaaaaattgaaattccaagtgagaacatgtcatgccattgtcaaacatatcatataatgttttgttttttcttcttttttatttattatagttattattaaaatcccaatgttagtttttttttcggtcaaaaatcccatgttagtttgttattattaatatcatatattgttagtttgttctctttaccaatctaacatgttattatgtttaacaaacatagaaaatgatgttttgttatatattttcctatatacgtaacttctattaaaatcaaatggaattgaaagttattttgcattagattagttaattgaataaaaatagcatttatgcgtttaaaatagcatgacgtgttttcacttagaatcacatatctattttttttttttttttgcctacatatatatatcatggcattttattttaaacatatgaaatcaagtaatatttttagtacattggtaaataaaatataatagcatttattatatgttttatatagtagaatttcatctgatttaggctcacatatccattttaaaaatgttttgtaatcatctaaaaaattcaaactatggcatatgaagagtagactaatatagcaagttgaatcaatttctacgaagagatagaaaataaaatgagaaaagacacataaaatattaactgcatacacaattaaaacaaaaaaaaaaaacaagaaagagaggttaaagatggtagaaaattatttttgttcatgttgtttataaaatgatcattcacttcatatattccacataggtactatacattacattttcaactaattcacatattcattcataataatattatattaagagactaaatccaaagaaacttggtgggctattaattgactttaattttcttggcactccacaaaaccagaaaatgaaaataatccatggatcaaatgtttttgatttgattctttatttagagtgttcaaactggatctgttttctttatttcatgatttggttctttatttcatgagttagagtgctgttttctttatttggttctttatttagagtgttcaaggtggatctgttatttatttggtcttaatgttttttttctttctaaaacttaaaattgactgtgcaccactgattagtctgaatattacgccaccttaggtttttttttctcgatcataacaaaatgccaaaatcatgaagaaaaaaacaatttacagttgacaaaaaaaaagattaaaaatcaaaacagaagacaacaaaagaggaagcatagattcgtgtgtcctctggaccagataattaaaaataaatatccaaccgttcgttaacatattccatatcgacatttggccatttgggtcaaacaatacaaaaaccaaagttaaagaaatagaatttaatacctttccttttaaaattcccaaataaaaacttgattgaaacagtgttgacgacacggctccattaacgaatattccgtacatcaagcctcatacatttcccctgtctcttctcttataaggttttttctccctttgtttatcggaaaaaatctctctttcgaataaaaaaaaaatctcagaatccaaaaatg

SEQ ID NO: 13737 - DNA, 3000 bp, Unknown
  misc_feature (1)..( 3000): cDNA_ID_2714010_gDNA_ID_2214647_Annot_ID_136382 3000 nt of promoter + ATG
caaatgagcttatgattataaaaactcaagattaggataattttctcaaaaaaatgcgtgtatatatatcattcttaagatacaagaaacattagttttgttaacagttaagatatagagtcggatttgattcttctaattgagtgttaacatgaagcctaagttgccattgaataaaatcacacatttccttcttcaacgccaagactctttcttttattttcttccaaatgaatcatcttcttgcagtgtatataatttgtgggatcaatgggtttcttaaaacccccttcccaagaaaagattactgaagattgaagaagatccaatagctggtggcccacttggacgtgaagattagcccaattttatttgtattaaccgactaatggtctttagtatacagtatatagctacgtttctcttaggtcttttgtgaattggttttgtctaggtcttacttaatctacaagttctgtttcttcgtctgatcggcaatcatgaatccaagtccaataacgattgatctcatcttggagatattgtcgagattgcctgcaaaatcagtccggaggtttcattgcgtgtcgaagcgatgggcatcaatttttggtagtccatatttcaaggagttgttcctgaccaggtcctcgactaagccgcgcctcttattcgccatcgcagagaaaggcaacaaagagaaagactgtgtgtggaggttcttctcgtcgccacagcttgagaatccatatgagaaatcctcatcgactcttgtagcaaccgctgaatttcatgtgagattctctccagacaatctactgatctgtcattattatgacctaaaatatttttcaattggttatgcctttggcttgatctatatctatggtaatcgaggccgggctagacctctaatatgtaaccccactacaggacggtatgccatcttacctaatcggtatacttacagaaaggcgtttagctttttcgggtttgacccaattgacaagcaatacaaggcattgtccatggtttatccatctggtcctggtcatagtagagttattacatttggagctggagatctgaagtggagaaggataaaatgttcattgcgacatgatattaagagtgaaggggtatgtatcaatggggttttgtattacttaggtgacacgtcggattggagtcgcgttaatggtaatcacgtaacgtctggttatatgatagtttgctttgatgttaggtctgaaaaattcacctttattgacgtaaaaaggttttgtcgattgataaactacaagggcaaattagctgtgatttattgggaggatgatgtcgacattcaagagctttattacaaaaagggtatagatgtcgaggaatatgtggagaataatgtcaacgctgatgccactaatgagttgtgtgtgtggattctagcggatgttgagaaacaggaatggtcgaaacatgcctacacttggaccgatgaaaagttcttccgtcgtttggtatccatcgctggagtgactgcttcgggtgaaatagtgttttcgatgcgcaagtgtaatcctaaacaaccgttttatgtgttttacttcaatcccgaaaggaacagtctccaacgtgttgaaattcaaggttttggtgaagccgttacgaaatcttgtgacgtttgcacctttgtaaaccacgtagaggatctcaatgtttacgatttaaaacaactcaagtcagtccatcctccattggtcgagccagaatattatgattcagattaagagtcagactgagaagggacaaggagaagaagactgacaagtgacaaggataaggagatagagacgagccaggtgaaagcaatgggcatgccattttatgctcttacttatgcgttttttttttaaatcaacattatctatgtttactgttttttttttctcttttgaacgagctttatatgtatccttcattttgtttggtctcaagaacaaggtgttgcagtttctcttagttctctgtcttaatctgagtatctattctttgaatttcagcatggtttcttctggatgagatctgtcctctgttctgtttcaatatcttgttgtgtttgtcggttgtgtgtgatgggactaattttcatgatgacactttggactaaatacttaaatgggatttgtacaaaatcgttcactcacttgaagaaaacattccttgaattctaccattcctggtttctattagtctcagtcttcatgtttaaagtatgcaacttcttgttagcttagttttgaaacttttggttctctgtaacaaagggtcttgtaagctgtctttgaaagagggaacattctcgttaacagtctttatgggtcttatgctttgttgcttctctaagttttttgtttgaacttgtgaatggcgaatagatgagatctgtcctctgttcttaacatcttattgattttgtcatttggtttaagaaatgggaccaataggcccaggaattaggtccattaaaagcccagtaataatggcgccaaaatcaagtgaagtccccgcctaattcatctcttctcactaaaaaagcgtcgaaacctctcactccgtctctcaatcaattctccgatcagccatggcttctgattcttctctcggcaacaccaacgacggtactatctctctccctctctctaaatctgaaactgcttcataattttgacgaatctcactacctcaggtcctccttctcccggagaaaacgtttcaagccctatcgaaaacacatactcttcccccgccgcacttcaccgtcgccggcgaggaagatcctctactcccacgcaattcgcaactcctccaccaccgccttcacgtctcgcatcatccaattccactcctccaacatctcgtccttccgccgccagatctaaaggaagaaatggacacggaggtggcggtggtggcggtggtggcggagacccagggacgccaatg

SEQ ID NO: 13738 - DNA, 3000 bp, Unknown
  misc_feature (1)..( 3000): cDNA_ID_2714004_gDNA_ID_2214647_Annot_ID_136385 3000 nt of promoter + ATG
gagaaagattaatttttcacgatcttctaggcaccaattaatggttatctctaagctattttcatgctgcaccgaattgtaaatgattcttgcatttatagcaaatggatcagattttttttggtacagatgttgttcaattccacaaactattgagatgcaggagcccaaaaaacactgtacagtctcttagtatagtactgtccctcatattttagaatacatgttttaaacttttaaaatagtacactgtttgagggattatttcccctaatttctttaaactagaattaattggcattctgcttcggttatgctgtatttttaagtttctctctgtgcatggtcatacttttgtttggttacctctctctgtgtatgtatgtattccgtgagctttcatcatttccatgtctttctaatagaacctaacataatgcttcatttttatgagtaggatggcacctatgtagcaaatgtgagaaaactgcaacgtacttgtgttatacatgtatgttttcattatgcaagggatgtgccaaggatgctgtcttcttttgcatcagaggtaataagggtttgtgtgagacatgcatggagacagtcaagttgatagaaagaaaacagcaggaaaaggagccggtatgcctgacatactcttgtagtttttttttgcttaccgaaatgttttcttttcttgtaacaatgagctgataaactgctcatgttgcagtagctcatgatcttatatttcctgtttctctcattaaacatgttgtgataagtctgatgatcaatcttctgttgattctctttcaacctagttgatgcatgataaccttacatttctttcttttactatgtaatgtcactaataaattatgagtttattttcacttctgccttagtttccactttgttatttgaatgacagttttttatttttctgatctctttcttacgtcgttttgtcttttacaggcgcagttggattttaatgacaagaccagctgggaatatctctttaaggattactggattgatttgaaaacccagctatctttaagtccagaggaacttgatcaggctaagaggccactgaaaggacatgagaccaatgctagcaaacagggaacagccagtgagactgactatgttactgatggaggatcagattcagatagttctccaaaaaagaggaagaccaggagtcgatcaaagtctggttctgctgagaaaatcctatcatcaggcgataagaatttgtcagatgaaactatggagtgggcttccaaggaacttttggatctggtcgtgcacatgagacgtggtgacagatctttcttacctatgttagaagtacagactctcctactggcttatataaaaagatacaatcttcgtgatccccgtcgtaaaagccaggttatctgcgactccaggcttcagaatttgttcggcaaatcacatgttggacactttgagatgttaaatcttcttgactctcattttctgaaaaaagagcaaaatcaggcagatgatattcaaggtgacatagttgatacagaagaacctaatcatgtggatgttgatgaaaacttggaccatccagtcaaaagtgggaaggataagaaacgtaaaacacgcaaaaaaaatgtcaggaaaggacgtcaatctaatcttgatgattttgctgctgttgatatgcacaacattaatttgatatacttaaggcggagcttggtggaagatctacttgaagattctacagcattcgaagaaaaagttgctagtgcatttgttaggttaaggatatctggaaatcaaaagcaagatttatatcgactggttcaagttgttggtatgtttagttttctattttacagactaagtcaatatggttgatacaatgggtgactaagatctctttttgtttgaaacacaggcacaagcaaagctcctgaaccttataaagttggcaaaaaaacaacagactatgtacttgagatattgaacttggacaaaacggaagtgatatccattgacattatatcaaatcaagatttcactgaggtgacgtactgctgatatccaatgtccttttttgtcactggaaatgagaaaacatgttctctttttttggtcctaacatagtattttctattgcacttgcatatattgacaagccatggaggctgtggttagtacgaagtaattgttcaagggtgctatatgtttaacctataactttatgcaataatttcaggatgaatgcaagcgtcttaagcagagcataaaatgtggattaataaacaggctgacagtggtatgcttcatataacttgaactcttgcatttgattatgtctaaaaatctgtggaccatggtgttttgcatttctggtattctaatgtcaatgtttttttagggtgatatacaagaaaaggccattgcactgcaggaagtgagagtcaaaaacgtaagttgcgttttttcctgctgacgcattttcctgtctctaattttttcattattatatgtatggtaattgagcttgctggtctgggagacggaaaataactgtattatctgtctagggaatgtgcatgattctagttttatcgtctctattaggttttgggttctcaggtttcttaatattgcaaagctatcatgatagtatttaagaaatgtataaaaaaaaaatgtatgtctgcttcagtactgaagttattacttaaatgaatgcagttgctggaagcagagatcctacgtttcagtcatttgcgtgatcgtgctagtgacatgggccgcagaaaagaatatccttatctgttgaaactttcaagttcttgtcaaaaataatgatttcccatgctttggaaatgctcctctctgtgcatgtttttgtacttcagggaaagagcattgaatctatttgtagtggcagaaagcatatagtttccttctttttattcacttcgttattccttaactatg

SEQ ID NO: 13739 - DNA, 3000 bp, Unknown
  misc_feature (1)..( 3000): cDNA_ID_2714000_gDNA_ID_2214647_Annot_ID_136386 3000 nt of promoter + ATG
aggaagctggggcttcaatcgtcaaagaagaggattttgtagctgaagctaatttgtcaggagataggcttgaggaaaacaaagaagtttccatggaagaagaaccttcatcacatgagctctcggtttgtgaggtaaacggagttgattctttgaatgatgaggaaaatagagaggtaggtgaacagatagtttgtggaagtatgggtggtgaggagatagagagtgatttagagtctaaaaaggaaaaggtagatgtgatagaggaggaaaccacagcgcaagctgcttccttggttaatgcaattgaaattcctgatgataaagaggtagcttgcgtggctgggtttacggaaatttcctctcaagataaagggttagacgaatcaggaaatggatttttagatgaagagccagtgaaagagttgcaaataggtgaaggagctaaagatctgacagatggagatgcaaaagaaggtgtggatgttacagaagatgaaatggatatacaggtattgaagaaatctaaggaggaagaaaaggttgatagtactactgaattagagatagaaactatgcgcctagaggtgcatgacgtggctactgagatgtccgacaaaactgttatatcatcagctgttgttactcagtttactggggaaacaagtaatgataaggaaactgttatggatgatgtcaaagaagatgttgacaaggattcagaagctggtaaatcactggacatacatgtaccagaggctacagaagaagtagacacagatgttaattacggtgttgggatagagaaagaaggcgatggggtgggtggtgcggaagaagcagggcagacagttgatttggaggaaattcgagaagaaaaccaagaactgtctaaggaactggctcaagtagatgaaaccaagatttctgaaatgtcggaagtaacggagacaatgatcaaagatgaggatcaggagaaagatgacaatatgactgatttggcggaggatgtggaaaaccatagagattcctcagtagctgatattgaggagggaagggaagatcatgaagatatgggagtgacagagacacagaaggagactgttttgggtaaagtagacagaacaaaaattgctgaagtgtcagaagaaacagacacaaggattgaagatgaggatcaggagaaagatgatgagatgactgatgttgcggaagatgtgaaaacgcatggagactcctcagtagctgatattgaagagggaagggaaagtcaagaagagatgacagagacacaggaggacagtgttatggctgatgaagagcctgaggaagttgaggaagaaaataagagtgctggaggaaagaggaaacgggggagaaatacaaagacagtcaaagggacaggaaagaagaaagaggaagatgtttgttttatgtgctttgatgggggtgatcttgtcctttgtgaccgcaggtgaactttcatttgtagtttctgtgactttgctgttggtccttctccttcttgcttatggtcccttccctttaacatatgataaattttattaatgtatgatcctgttggcttgcaggggatgcacaaaagcgtaccacccttcctgtgtagatcgagatgaggctttcttccagacaaagggtaaatggaactgtggtaagttttttctgttattctctcagtaggtgtctgcttaaattaaatcagtgaactatagtttggaaaaacatgatacatcatctgctaagcacatattttctttcactagtgtatgtagtggtgaatattgtttactataggtatttagagtgtcttttaactgtacttccctagaaaatcatgacagcatatgtttttttatctgacttccggattatgacatttataacaattctttgtaatttaagcttcttctttcttcttttgtttgagttcctggcttgcagtttgtctttttaagtatttgctctcaaattattagtttgaacctttagttgaaagttatgtcaaaggcatttttctattgcttttcacatcatctttgattttcgtgttgttccttattgattcttactttagtctcaggcctgttgtaccactgtccaatgctacacaggcagtgacagatgttggattgtttgtgaaatggataagtctgattatcatcaaggctatgctcacccttttttgtgtacagtcatgactctttgagattccacaagaacttgtcaatggtagcttttagttgattctccgttgttcagtgtaaataccaaatagcagcagtgggatctgctatgtcgtttatttaaataaactataaaagtaaatacactggcattgatacttttaaatactttggtagttttctttccttgactatgggttggcgtggtgacatcatccagttttatcataccagaaatctacaccatttaaacttggtaacataacatattgatattaatgagaaagattaatttttcacgatcttctaggcaccaattaatggttatctctaagctattttcatgctgcaccgaattgtaaatgattcttgcatttatagcaaatggatcagattttttttggtacagatgttgttcaattccacaaactattgagatgcaggagcccaaaaaacactgtacagtctcttagtatagtactgtccctcatattttagaatacatgttttaaacttttaaaatagtacactgtttgagggattatttcccctaatttctttaaactagaattaattggcattctgcttcggttatgctgtatttttaagtttctctctgtgcatggtcatacttttgtttggttacctctctctgtgtatgtatgtattccgtgagctttcatcatttccatgtctttctaatagaacctaacataatgcttcatttttatgagtaggatggcacctatgtagcaaatgtgagaaaactgcaacgtacttgtgttatacatgtatg

SEQ ID NO: 13740 - DNA, 1682 bp, Unknown
  misc_feature (1)..( 1682): cDNA_ID_2704218_gDNA_ID_2214648_Annot_ID_136387 3000 nt of promoter + ATG
gaattcgattcaaaaaatgtgatgtggaaacgagcaacaacaattattgtagctcttgaggacccataggacgtgcatgtccacttatacctaatgagacaattctgtccttttttataagagcatcttccacagcttaatttgcgagcctcattcacgtcaatatataaggggtatgtgatacggtagatggattgattatttacatccatctacatgtaagttgaccagcatagaccttttacatagtgacatagaaccgttgaaatgccatccgattgatcaataatgttgggacagaccaaaaccaagataccaaaacggtaaagggacaaatgcgacaatcagatattgaactttaaagttgtggctctgatccagtttggcaacaacttcacttaaatttttgtgttaccaacaaaacagggaaaaagattcgctaaaagagttgcctaaatatatgtttgagcttgttgtcgatattttatgtttatctaaacagtaaaaaaaaaaaaatttatgttttatttaccacatttagaactaggcatatatatatatatatatcttattatataaagtatggtttttaaagttgctaactcataagattgtgtcacgtgtcaagtcaaacgatcagatgtttacatgtatcattcaaaatttaacttttttattctctaaaattaaatagaaaatcttaaaaagtaaacaaatttacatatactaatttatatgtctatatatttataaacaattaacatttattcaacaaaaggaaaattaacaaatttgtctttaactcatgtaatcataagtgaaaatagaacattttgagaaaaatagcttatcttataggatttaacttttcaattattttcatttattaattttaactcatttaatattaatttgcatgatgtaaaattaacttacgagattacggcatatatagaaaatatattttcaacaatgtttggtttctaaatattttgtggatttcttttttttattaattattagccctaggcgtttgggtattcgggtcgggtattttgggttcgggttttcgggtttagaagtttaggacccgttcgggtaatttaagatttcgggtcgggttcggtttgggtgggtttgagtttatttatatattgaaatatcaaattttgtgtgcaaatctattaaattacttgaaaatttcaaaaattcccaaaacaacacgagtagttttgcttgaatatatctaaaaatacacaaaataattaaaatatccaaaaaatcctaatattttctatatataagtataaatataactaatatatatttatatttgaaatatgtttggatacgtattcgggttcaggttcgagttttttgggttttgaagtttagatctgttcgagtatttgaaaatttcgggtacacccgcctcaataggcgggccttatctagtatatatatatatatatatttttgtgatggatttctttctgtctctctctatatatagcatataaatgaaaatgaattatatttgcctttaagggagaagaaagagacttactttggatatcaaaacatgtcttgctctctattctaattaagtctagcctatctacaacatacataaacctctatctacgattatatttggatctacaagtgaagattgatcgatg

SEQ ID NO: 13741 - DNA, 1919 bp, Unknown
  misc_feature (1)..( 1919): cDNA_ID_3031681_gDNA_ID_2214648_Annot_ID_188582 3000 nt of promoter + ATG
tgtagtagtactactacttggtttgcataatctgaatcaaagttttacaccaaaaaaaagaaaaaaatctggattaaagtaaaccccaattaattaatcatgcgtgggattgactcattttgacatcatagtatgtgtttagaaacattttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaatttaaaacmaataaatagctaaatagttacatgtagtygmactactacttggtttgcataatctgaatcaaagttttacaccaaaaaaaagaaaaaaatctggattaaagtaaaccccaattaattaatcatgcgtgggattgactcattttgacatcatagtatgtgtttagaaacgttttttttagcaaatttctagtcatcaagagtaagtaacattagatggagcgtaaggaaaaaaaaaatacattaggattattatgattatggcattcggcccaaaatctcttagtattcaaaaaaaaaaaaaaaaaaatttaaaacgaataaatagctaaatagttacatgtagtagtactactacttggtttgcataatctgaatcaaagttttacaccaaaaaaaagaaaaacatctggattaaagtaaaccccaattaattaatcatgcgtgggattgactcattttgacatcatagtatgtgtttagaaacgttttttagcaaatttctaatcatcaagagtaagtaacattagatggagcgtaaggaaaaaaaaatacattaggattattatgattatggcattcggcccaaaatctcttagtattcaaaaaaaaaaaaaaaaaatttaaaacgaataaatagctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtgtttagaaacgttttttttagcaaatttctagtcatcaagagtaagtaacattagatggagcataaagaaaaaaaaaatacattaggattattatgattatggcattcggcccaaaatctcttagtattcaaaaaaaaaaaaaaaaattttaaacgaataaatggctaaatagttacatgtagtagtactactacttggtttgcataatctgaatcaaagttttacaccaaaaaaaaaaaaaacatctggattaaagtaaaccccaattaattaatcatgcgtgggattgactcattttgacatcatagtatgtatttagaaactttttttttaacaaatttctagtcataagagtaaggaacattagatgagcataaggaaaaaaaaaatacattaggacaaatgttaatttggaatctcttaaatttagatttttttaaaaatgtctatctgtttttcttctagataaaagtgtttcatattatccatatatattacttttaaagaaatctttttataaatagaatagtatttttgtagagtatatccggatatgttctgcgaaagaagaagaagctcacgagattagtcatgctgacatgggaactagctgtcttgagcaatcattcatctctcagatcttacacgtcctccaatcacagtttcacacgtcaccattcgcggcgccatgtatctgcttctctgatttctgataggtcccattttattctctcccacctactatataaactcccatttttcctttgtttttcttcaacccaaacaaaaaaacattttttctctataaatcctttattattgttataaaaactccgatg

SEQ ID NO: 13742 - DNA, 3000 bp, Unknown
  misc_feature (1)..( 3000): cDNA_ID_3031704_gDNA_ID_2214648_Annot_ID_188579 3000 nt of promoter + ATG
atgaaacttaataacttaacccagtcaactagaatcagctgagttgatgtcatacattcataactggctagagaatatatatatcagaccaacacagtaaacaacagagattcaagttctgcagtgttgcagtgttgataggcctataggcccaagtgagccaacttatgtcttttgacttgtcgtctgtctgaggaaatctctctctattctagctttgtagataaaagaaaccatttagagtattggatcaacaaccatggattttacattgtggccagaacatttattgtcaatggaattgtttaagcaagacatgactttgatcacacagcttaggcgttttatacgtcttttgtttctccctctcacacacaccggaatggtaaagtttatagacaacaaaagtttatctatcactggaaccttacaactatacaagaaatgtcgtctgtgctttgcttagagactgcttcttctatcaactccttggctgccgcttgtggatcttttatgcttttgatcaaatccaccgcttcttggttcgacatcacctgataattaatgcaacactcgtcaagacattgttaaagatttcatcactctgatgataacatgggacgagatctcaaataccttccaaactccatcacttgcgaaaaggataaactcagtctcatgatcgatattctcgtctcttatgtctggatctgagctcagatgtatctttaagctcttatctccaaacgccctagcaaccgctagttgtccatcaactcttggaacatcccctgaaaccattcaagaatcgtctataaattcctcttctcatgttttatatgtgatgagcaagtaagtgtctccatctacaaaacttacctggaatatttgatacaaagccaccacggctttctatttccttttgttccttgcttggttcatgatcaacagagagttgagaagcaacaccgttctttgacatcactgcacgtgagtctccaacgttagcaatcactagcgttttcccatctatcagaatgcctgttacagccgttgatccacctttgccaagtttaagtgactgctctaatatcacagcatcggttgatatgtatgcattccttatagcgtttttcgtatcagtccaaaaatccttctgaaataagtgaaacaacaaaaacattttaagtcttatcagagacattatagaaatccataaaaacagattcatgcatgctttaaacatgagttacctctttgagtatgttatcaaagagattggtttgcaagtacttggctacatcatgccctaagtgaccatcaaagatagcaaacaaacccaaatcatggccgtctactttcttgaactcagacacaacatagtcctccatcggatggcccgctttgcctttcacaaagtcataaccgtgtgcgatgttcttccacaccttggttttacctctgcctgtgtcagatccgcataatccaaccttcaaatattcacacccaaacaacaagaaattatactattagtttcatttttaaaaaaaacttttttactactcaatacattataatcattttattcttaagctaaaaacataagttgacaaataacagcaaaatataagaagaaaaaaaaaagcaaatatgaaaataaatgagaaagataaattataaaatcaagtttggtttgataaacaaaaagaaattcaaagtttagacatttaaagaaaaacaaatgattattagatccacataaccctttgtaaagactcaatttcatgaataaaattcagcttgcagaacaaaacaaacaaaaaagatctacataatccaacctttaccaattcacaccaaaacacaatcacattaatccaagttctgtaatttcttcatcaagagcaacatacatacatttcattatcaccaaatctctaaccaaaaagagaatatagaaaatgcacaaattactgaaacaaattcagtaacacaagctctagaagaatcaatatcatcgtttaacatgcgagatgctaacttccttaaaacggctctacgtacaagttatcacaaagaaacaaatatagcttaatgagaaacagaacaagacatacaaggatcagatcacaaaatcaagattctttagagcccttgaaacgctactaaagaaaaaagaaaaagactagcgttgagctaagcataccttcatcttatggagaatctctctgcctgccattgttacaagaatttgtttctctgcctttgtgtctgaaatatgaatgattctaagaaagaaaaacagagagatgagtttatgtaataaatatgaatgtgaggtaatcaatccacatgtgaacagccggtgattcttatcattattggctactgacttcctccgccgacgacttttcttctttatatttttctcaaggcaaaagtattccctaaacaaattctctctattattatttgctacattctttcacattgccgacaaaataaaacattacttttaaaataaaaaactgttatttcgtgcacatcatctcattcattacattattgatcggaaaaatatttttttgttattacttaaaataacaagacattattttatcagtttttctagttactctgtcatgacaacatgtgcaacaaagaaaggaaactttatcttaaaaatattttcaaacaaattcgaacaaaatgacgtcgacaaaaagaaatacgcgtgtaaaagacaaaccacacgcaacaaaggcgcgtttagcgcgtaagactagaatccgtggacctgaagcgcgtgggccgggattttcatttgtcttaactgaaacaatgggccacataattaacaaaataggcccatttacacttttgggttatatagaatatttgctctggtccaacaaattttgaatttcgaaagttaattttttttgaaaagcttcacttcccactctctctctctctctctctcttcctacggctgcgaaa

SEQ ID NO: 13743 - DNA, 3000 bp, Unknown
  misc_feature (1)..( 3000): cDNA_ID_3031708_gDNA_ID_2214648_Annot_ID_188578 3000 nt of promoter + ATG
ttctcatgaaagcctgtctcagttaggttttctctgcaagtaatccgtgaggtatgtcagtctctgccacgatcgttaacatacaagtacatggcttcatgaccaaaaagtctttatctacaatctaatcagcaatattggagcggaataaacttacggagggtatcggatcagcagattgtctggcttgaaatcaccatgaatgattccaacactgtgcaaagtctccagcatgttcagcatttctattgtgtaatacatgcacaaaacttcttccatggactttccaacaacgacatacgagtttatgacgtccttaaatcacaaaaagaaggcaaatgaagcaaagaactatgtttgcattttgtatattcagtccgtgagagtcctaagataccacctacctggagtgtcccgtgtgataaataatcgcagacaagtatactgtagtctgaatacacgtgcactctctgagccaatccaaaacttgatctctaacatagcatgagagtaattagtacggtgtgaaacacctgtgaactggtaatattaatggaaaagggcatacttggctatctgggatcctgcaatcaagttggcgatacatgtggaattcccaaggaaaaggtggtttttgtacctgtgaagagatttgtatatgcaatatgagcatttagcatcatactgtatttgaaaaaactttaagggtctatctacctttagagcaactacttcatcaggattgctgtcaatgaatgctttgaacacttgagcaaaaccaccttggccagcacagcccttcatctggtactttcttccacctagcaaatagacagagccaatggatccaggtcactttttttattttagtctcagagaagacatattgtcccaggtgagaacaaagcgggaatcaatttcttttacacaaatgaatacatgcccagccacttttaatttgaaaaatgcatcttataataaaaagaaggattctttatcctgtagcggtgacagactagattggtatgaaaaaagtatacctatctcaatgatcttatttctggaataattctgcaaagatgacaggttggcctttccagggaaaactttgttgcttacatggtacccctgatgcaaacataaagaaagaaactcagtggacaagcctccctatataagttaaatcatgtaaaatatcatgattttccatcagccttacatcatatttcacaagctgtggttttatcttgtgaattaagccgttcacagtggatgtttcccatggattcacaaaacccgtctccaagtcagtggcctgagcatcatcaccaacctgccagaaagaaaacgttcaatcctcaactaaagctatcaaagtgcattagaataaccatatgctactcattaaaattaaaaaataaaccttttcaagggaagatgctttggtcctcttagagattctttgtaagaacaatgagtgagcctcttttaacctgtcaaatggttcagctttcctacaattctccaatgagaaacaaataagaaatgaaaccacaaactagaggaaaaagataaggaaggagccacagaacaaggagaaagataagagaccttgaaagaccagtctgataaacagaatttgctcttcgccacaatcctttgacctcaagaaaaatagcataccattcatagagcaacgaatgccctttacatatctcagtctcttcaatttctctataaaccctctcaaaatcttccctgccttcaagctaagaagagattcaacaatttaacccccaaactgtaacatctacatcagttgattcgcaatataacaatcccaaaccctaagaatgctaatcaaacaaacaatcgaggaaagaaaagcacaatttaagctcaaacaagttgggagagagggttttagtaaagttacatagagaaaccagatcttgaggaatctgaggtcatttcggtaccgagaatctttcttataagttgagatacaatcaaatagaagcttatcgagatcgtatccggaatttttaccagcgtatagatcctccatcgaatttttaatctccctgtgaaaaccccaaaatacaacatcggaaaattagaatccattttgacacatatagcacaattagttagatgagaaggaaggataaagcatgagttacataagccacgggaagagcgggtctccggcggcgtctctgtaaccgattgtcattttcgcagccgtaggaagagagagagagagagagagagtgggaagtgaagcttttcaaaaaaaattaactttcgaaattcaaaatttgttggaccagagcaaatattctatataacccaaaagtgtaaatgggcctattttgttaattatgtggcccattgtttcagttaagacaaatgaaaatcccggcccacgcgcttcaggtccacggattctagtcttacgcgctaaacgcgcctttgttgcgtgtggtttgtcttttacacgcgtatttctttttgtcgacgtcattttgttcgaatttgtttgaaaatatttttaagataaagtttcctttctttgttgcacatgttgtcatgacagagtaactagaaaaactgataaaataatgtcttgttattttaagtaataacaaaaaaatatttttccgatcaataatgtaatgaatgagatgatgtgcacgaaataacagttttttattttaaaagtaatgttttattttgtcggcaatgtgaaagaatgtagcaaataataatagagagaatttgtttagggaatacttttgccttgagaaaaatataaagaagaaaagtcgtcggcggaggaagtcagtagccaataatgataagaatcaccggctgttcacatgtggattgattacctcacattcatatttattacataaactcatctctctgtttttctttcttagaatcattcatatttcagacacaaaggcagagaaacaaattcttgtaacaatg

SEQ ID NO: 13744 - DNA, 3000 bp, Unknown
  misc_feature (1)..( 3000): cDNA_ID_2703977_gDNA_ID_2214648_Annot_ID_188577 3000 nt of promoter + ATG
cagcaatgcaatcttctacatgaatttcaaggcatatggaggtccacaatgcagaggaatagtaaggaaacaagtgattgaagactaggacatatgtgatcgatcgatagatagagagctgatggtttttgtgtctggataatactttttgcatgtaaaaaaccattgagacaagtcaatcttttacattgtaattgatttaacacaatatacttactacatcttaattagtattaatgagagttttagtactagatataagtcgaccaaattaaaggaagccaaatgttggcgttagaagcatattgtggtttaaaagaaaaaataaaaaataaaaaagaaaaaagaaacttgtgagtcaagtaaagaaaaacaaaaccccaatttcagatttatgtttggttccgatttaaaagggtcttttttttttcttactttgaatattttacaacattgacaaggttactctctctcccgtacgccactactctgaattgtgtttgttttggtactttgaatttgtccgtccgtatgatgaatattattctctcctttctatgcagggaagctgtggatccggtcgacaaggaaatgaggaaattggtctattctatttacggagaggtaaaaccgaaaagtagaaaaaaatagaaagggaaaaaaatgtagagttgcgattacaaaacttttaaaatatatagaaagtagataaaattaaagattttaaattattacattagagagttttgtatattttgatttataatttttccaaaatgataacatatctccaaaatattgtgtaatatattcccctcttctataaaaatcatctctaccaaagtgaaaatcacacgtataaacacaataattatggtatttgtgaagtaagctatgaacatggaaccatccatgaaaaacttgaagtttggttggatatttacttttcatgtgttggattaatgctttgttttaaaaattgtttgtgtggtgaattttcacagaaattagaaattatagagaagcaaagagtataatttgtgaagaaaaaaatataaaatcataatccaataacatctaattatactaaatcagcagtcacttttccaataactgatgcattcagtgattgacacatcaccttagtactatttttttattctttcattttcacgcaggatttttatgtgtcgtttttatttaactttgtttctttctcaaacgattttctctttcatccccacgatctccacatctccactttctctcttccaaaaactccatgactactgtgtaaaatctcaaagatgggtttctcaacatcattaatcgattactcagaaatcaggtactttgttcatctcaatgaaccaatttaccattttctatttctgtttgtaattttgttttatatatatagaattctccatagatccgaaaatcatatatccttcttctagatttctatggctttttttttttttttttttttgctttgtttctgctttatttgactgaattcgatttctctttttccataggattattctttaatacaatcaatgcatatgattctcctgtctcacaaacactcaaggaacagcgacaaattttggcttctcatcggaacagttgccttaaaacaagggtgaatttaatatcttaatggaagctcaagtgtttttttaatggtaaattaattctcatactttttactaatcttctttcatctcttattttactctgcaatttcgtttttgtattatctcatgctacaaaacaaaacaatgtcttctgtagcaatatctcactcgcttgctttctctttatctcagtttggtcttcttttgaaacttctgtagagaacgtaacatccaagcatgggacgaccattagttgacaagttctttgtaagtttcttttcagcatcctctttctccaggtgtatttactgtcaagtttgttacattcatgtttgatactttgatgcataagtcatcataattatagagaaaacgtaatgtctttaatttacagattggattacaattgggcaattcacttacttcaaaagctaaatgcaattcacaactaaattattattttgtatgttgagcaaacttagaatttcttagttagaaacttgcattcaatgacgtaatggtttaatggtttaattggtctgtttgacaagattttaggacaaaattgcattttttttttgtattcatctatggtcattatcttttgacatgcaaacgtttcaaaggcagcgtgtacgtcatgtagttacttacttacttgtgcacattttacattttttctgagacttccaagctttgggtgtcaacgaatgtttgtaaactgaattactgatgatgagaagaagaacacattacaattggttggagctaatgatgaaataagcggacatgtatatacccagcataattttcgtacctatactctcttatatttctaaactcttgatttgttagttactgtctatcccaattgattcattgggtagaaaagttgtaccttttttatatctttttcttaatctttgtatattcttcggtcaatgataataaatttgttgtatatttatgttgtctgctttattttaaaaatcttagttaagagttatagcagatataatttaaaacaatgttgtccctgcatagcaggggccaaatgctagtaatattttaattgactaacaataatggaaagtgttgtttattttgaataacacaaaaattttaatgactttattaaagtatgaatctaataactccagatttataaacactttaaattactttttataaatcaaaatttaataataccaaagttttataaacctttaattaaataacaaaaaaatttcataacatttcaagtaattaaaaattcatataaatcacaaattaataacacccctataagttaagtagccagcgtcgaaagtttgtttggtgcgaaatcagaaagatg

SEQ ID NO: 13745 - DNA, 3000 bp, Unknown
  misc_feature (1)..( 3000): cDNA_ID_2703973_gDNA_ID_2214648_Annot_ID_188572 3000 nt of promoter + ATG
aaaaaaaaatcaaaacacaagacttacttaaaattttatccaagaagcaaatgctaatgattttagctgctcactgactttggataaacactcatagattgcattcttagaagatattagatcattaaaaactctttgcaaaacagtaagaacatgttgttgaacatcacttttttaaccgatttgataagatcttgtatatctttcactcgctaaagtgtttgttctataactttttcatggtttgacattgtaaaacctaaaacattcaaaacactgagttttcagagtgagatgtagataattaatgattagtcattcataattataagctttagattacatagaattatatagtaaaagaattttctatctataatggatagaaatatataaataataaatataaaatattcttaacaaaatctttcaagatatttcttgtcaaaatctatcaagatttataaataataaatatagattacatggaattatataattaatgattttccaagatctttctttatttttattttttaataacttctagcaaaatcttgactcttaaatgaccaaggaaatttgttatataaaaaaaaaagttaccaatgaactttactttttacacaaagcttgcacctctcacacaaacttccacctttctcaatgtcaaacacaagataagatctaacttgatagaatgcttagaagatgcaaataattatgcaagagatgaatgaaagagaaagctaaaatgtaatccttgatgtacacatatctccatgtcttttaagaacttcaaacatttcctccatcaaaggcatgatgaaataatctttgatgtacacacatctcgatggatcacgataagggttaggcgcatcacgagaacaccctatgaacggcctatcttctttaagttgtagttcactatccatgacatatattgcattgctactttgtggtttagaccatatcagtaatggtcttccttatcaagagtgtttctcttatctagacttgcaaaatcaatcaaatcttgaggagaacagagtgtatcatcacgtccatcaagaagccttataactcgtatgagttcactcacaacaatggccaccacacatcttacaaaacacacataagaaaaaacaaaaggagttaaaaaagtgaagaaaatatttcaatatcatatcttatctatattacaattagagtagttgtattgtaaacttttcaatattgttttaaagattctcatatgtacttcatatatatgtctctttatattgcagcatataataatcttttctctacaaaatattcattcatatgtccattcctttttctcttgcaacttaactgtgttctttctgatctcttaaagctttcattattatccttcaatcagctttcagtaaatctgggattttgaaataaaactacaagaacaataataaattgttagaccaaacttgtttcatagagaaaaaaaaaagaatctgatacacttacctaacatgttgaccaagatgcaaatgtagattatttaatcgtcctcccagctctcaaaaaaaaacccatatctttagcaatttctttcaaaacatggagaatattttttcgagcatcacttataccaaccagtgattcaagaagctggtgtagttcaaaaagtatagccctcactcgtcgacgaactttaaatgaaagtaatgaaaatctggtattaacttgaaactttcacacttctcttccacttttatcctttcacactagaaaattacaatgtgcacaattatagccgtttcacacttctcttctacaattttttttttcacatcaaaaaattatttcaggtttttgacacatattcccaacaatttatttttcttaataattaatataatttttaaaatatatcaatgtacaaaacataggctccaaatggatgacaaataattgaatatttgggtgcaaatggttgcacaatttaaaaggttgaagaggttaaaaacattattcaattaatcttcagcattttagttgaaaaagttgaaaaaattattcaattcattcaacttaaaaagttgaaaaatgaacaaattataaaggaaaagtgttcaacttcttgatccacatttttggagatgatcattcaaccccaattttgttcaacctaataatttcaactcattcaattttgaaaaaccatttgtacaagttgaagatctttcaacttattcctctacaaaaaggttaaacaatttttctttataacttttttggttgaatggatgaaattagttcttagttatttatctcaaatagtaaaaacataagatgaatgatcatttaactttttataacctcttattttcaaacaacatttgcacccatagtctaaaaatagaaatttgttgaccaagaagaatttggtatcaaatgaatattttttgtggctcaaacttttattctctctttaagtagctgaaaaattaacgttggaaagtggggtctacagacctttacgcccatttatttacgctacaatggttttctaatcacatccttaatcttacaatttgtttgataataaatctactaattaaatttgacgtcacaaatcacaatgcactgacgcccattagcatgttagtgacaatgtaaccaaactgattcatcacatttcaaactgaactcattccggttgactaatcggttgggttttaactcgccaactattcttatcaggccaggcccaaacattccttcacaaagccctgccaatttgattaatttttgtggcacgtgattttagttttgtgttaggtctcaccaagattattgatcacgttccataattcaaaactttgcattatataccaaaaatccaatccgtattgaaacttcatttgtaaagtttttttttttcccaaatagtactttttttttgtttggccttcttatagaaagaagaactcaaagcacagagagaagatg

SEQ ID NO: 13746 - DNA, 3000 bp, Unknown
  misc_feature (1)..( 3000): cDNA_ID_3031736_gDNA_ID_2214648_Annot_ID_188568 3000 nt of promoter + ATG
atacaaattcggtaaaaaatcaactgaaagttaaacaaaaaaaaagatgaatgtatcgaatcacacttagttaaatagaggttggtttcacgaaaaattaatataacaatatcaaaagataaaaacagagtttgcttttataagatcaaagaaggtaaaaaaagaaatggcaaaatggagtgcgatcgtattgataatgatggtgatgattgttgcggtcacaatagaagcacaagaagaaagtggtgggactatttgttttcgccaatgttctcagccttgtcgcagtgacgacggtagttgctatgaaaactgtaaaatcgaatgcggtggtcccaagcctcccttatctcgtctacggtaatgtataaataattatttgcctttaatttatatatatgtgtgtgtttttttttcctaattacttatatatatatatatgcatgaatagaagctcacatgcatgagatggcatcatcaatggaagttcgcggaaggataggatgataaaaagagatttgtagcggatttttgatcatctctactgtttttaacttcacgttttatattataagagtttcattaaaaagatcaataaaacgagaaaatgtggaaacaaaccttgagttaatttttctatcaaaaagaaaccatgagttttgtcataaaacatgttaaaaacctgagttttgttttaagtatttaaaccctgagcgtttaataaaagtgtaaaaaaaaacctcaaaactcaactagatctaaaacgaacaaaagaaaatagtttcaatctactctatcgcccttttccgccacaccatcctgatcccctttgctgactcctctctgagttatgtctttgcttaatttgttcaggacataaagttattttccatagttcaagagcaagtaaagtataaccgtttcagtgtcaccaagataagcaaaaaaggaagagaaagttacggtgtttgaagatcttacaacaagttaaatatcacttgcaattgataagaactggaggccttggacatgaacaagaagcatatacatgtgatagaagccatctttaacttatgtggaataatcataacatacaaaattttacaaattgatagagttatctatgacctatgatgagagatcatgtttgaagtcacaattggctctattttgaccaattttctttgtagctagctatcacataacaaagttcagtattttacacacaattgtttgttttttaatctaatattaaattatattcaaagactaataaacatctatacaaattaatgcaaactttttaagaaaaataataaacaaaagaaattatctttcattgtgtgcctttgatgcaaaccaatctcgtaaacctacttcatacttccgctcatctccattttgtattgtacttaattaattattaatgttcttatcgatgattcttatcaccctctcgcttggtgatggctcgtctctatgccttctattgttcctctctttcaaaatcgagtggatcgtgttttgaaacacataacatagagtgaatgtttttgttatgtcaagattgtttccatttaataattatttataaataattaagttaaacaattgcaaaataaaaaaaattatcaaaataaaatgacattatctgtaagcaatattccttagttctacttttttgaactctaattaaaatcggatgataaaaaaaaaaacatactagtatattgcttgaaattggcaaaaataaacactcccatagaattatgcttcgttggcgattggacaagcgaaccagtaaccgtttctcttctttggcctccatcttttccgattggtttagggccgccggcacttgtcggcggttccatttcttctctttagtttgattttgctttttgttttaatctaaataaagtatttgctctcaattctggatttctaaatccaaacttcttcttcttatttgtagttttaattcacttttagatctgtaagaaaaatcagttatgtatagattccaagtgtttctgttcaacatacatggtggaagatctatggatgtgaacatgagcctttggatgtgttgggtttcttaccgaaatgcaatttccgacggctacgccgtatttgttccgacataatttgtcgattatatgtcaactctaacatgtattgttagttttgtgttagtttccggtggtcatcgcgatcgtttggtggctttccgatgtttgaaacaaatcttcatagatttgttgtggaaacggcgaccaccttggaaaccaccatggaatcaaatcataagaaccttgtatttctggtctttgaagaacgtcaacaagagaatcgagatcatggatttatcatgggcaacatttacaaccaaaacaatgtcattgtctcacgcgggtgatggaaataattatatggttagcgatgtaactgatggatcgcaaccttttgattttcgaaaagtgtgttggagtttcattaaagagatgatagccaaacaagaagatcaaattagaccgaagacgaagacgatcaaggaaaataacagattgataaccctgttagcgtgtaaggcttacctacgaaaggaagcaatgtgtaatttcactttttcgattatttcgttcaacttaagtattggttgtatggattgtagagctctcacttatatgcttattggtatatttgtaatctctttttaagtttaataaataagacgttaaaaaaaaaaaaaaaaactcccataagttttacgccgttaaagagagacggagcgacgtttgctacgaccgtcaagattcaaatggaatcttttttaaggaaaaacaaaaattcctccaacggctatatctgatcagacatctctgtcttcttcttggatgcggaaaaggaaaaaccttattacttgtttgagattctcaattcaattctctgagattcttaaattcaattctctgagattttgcccttttcataataatg

SEQ ID NO: 13747 - DNA, 1682 bp, Unknown; identical to SEQ ID NO: 13740
  misc_feature (1)..( 1682): cDNA_ID_2704218_gDNA_ID_2214648_Annot_ID_188565 3000 nt of promoter + ATG

SEQ ID NO: 13748 - DNA, 3000 bp, Unknown; identical to SEQ ID NO: 13746
  misc_feature (1)..( 3000): cDNA_ID_2703969_gDNA_ID_2214648_Annot_ID_136389 3000 nt of promoter + ATG

SEQ ID NO: 13749 - DNA, 3000 bp, Unknown; identical to SEQ ID NO: 13745
  misc_feature (1)..( 3000): cDNA_ID_2703973_gDNA_ID_2214648_Annot_ID_136390 3000 nt of promoter + ATG

SEQ ID NO: 13750 - DNA, 3000 bp, Unknown; identical to SEQ ID NO: 13744
  misc_feature (1)..( 3000): cDNA_ID_2703977_gDNA_ID_2214648_Annot_ID_136391 3000 nt of promoter + ATG

SEQ ID NO: 13751 - DNA, 3000 bp, Unknown; identical to SEQ ID NO: 13743
  misc_feature (1)..( 3000): cDNA_ID_2703981_gDNA_ID_2214648_Annot_ID_136392 3000 nt of promoter + ATG

SEQ ID NO: 13752 - DNA, 3000 bp, Unknown
  misc_feature (1)..( 3000): cDNA_ID_2714034_gDNA_ID_2214648_Annot_ID_136393 3000 nt of promoter + ATG
aataaaaaaaatataataaaaaaagaaaaagtaaaagagaaggaagaaaaagtaggagaaaaagagaattaagtttctcccaggaaaaaatttgagaaactattctcattcaatttggacagatattatcctactataagtttaactattaaactagattttaacccgcggtataccgcggggacaacttattttttaaattagtatatataaaagtttgcaaattaaatctatttatttttattttatagtttacaattgttattaagtaacgtcctaccaaacccgtctcgccaaatccgtcccgtaaaaaaaacccgcggtacaccgctaatttaaatatataattaaaataaatattttacggaattgcaattgtattttggtttgtcaaacaaatatttgtttaaaatagttaccaaaatctagttcaaattttggagaaaaaagatttattggatagataaagaatgtatctaggtgggttttgctcattttaagggattgcaattatatttttgtttgtcaaacattttttgttttaaatagttgctgaatatatttagaatatttttagtttgttaatcaatttatcgctggaaaaaaatcaataattaatagttaatggcaaccattgtaaataactcccaactctaggatttattttacaaaatgactgcaaaaatgtatatatagataacaattaatatatctgtcttaattaaaatattaatattttttttttttgagaaactttactcacttatactgatgatggagatggtcttacaaaaagtaaaactccgacattccaagtttccacctttgttctctccaaacatatattatactaatagattagagaagaactctataaagtttttaactttctccccaaacgaggaatctcaaagtcaattgctgttctgtgattccagagtgtttgtttctctgtcataatctcttctagttgcggtttgttgggctctcactttctctttcagccgatttgatctttcgtttcttgtggtttgacttcacttgaagcaagctcttttattgatcttattgtctcctttatgttctgatgattccgcattgtgaaatcactagagattttggggttgtgatatgaataatctggggaattttggggtttggggattcgggttcttctccttatctatttggtttgcggttctgcaacaagctaatggactcagacccataagggagactgctcggtcctggggcgatgaggtttgtgttgttttgatatgatcgtttcaaattgttttcaatgttccttgattttgtgtatcagctaagtctttgattagtttgctgttcatgtgttcgttgacttgattaagttgcaatagtagaatttctgatagctcagaatctaggatgggaattagattatgcagttttcgtctctctatttgccgccgagttttcgatagaatgggaaggctgagactgttttgtgatcttgcagtggctctttggcaaaaaagaaaaaggtggagcaggaccgttttctgcgtggaatataacaggaacatatagaggtttcgtggcattgtattgttgattttctttctgcttcaatatcataaccttgaagctcatttccgtgatgtatttatgttacaggcacatggaagtttctagatactgtaaatagctcttcaaagtttccagatttcagaaaagaaagtggtaactctgtcattgagttagtgacaagtccaacaaaaattactggtgtgcattatgttcaggtgaatagtcgctcttcatagtcttttgcatcatggagatcgtgctttttgatcttagtaaaaactttgcaaaatcagaacttgtgttaactttgaatgtgaacagggtgcagttgttttccatgacgtatttgacaatgaacacaatgtgggtggtgcccaaattaaagttgaaggtgtatatatttggccctttagacagctccgtcttgttgctaacaggtataactacatttttttttaaaatctatttaactgctttcaagatccagtattggtagtgttctctaatgtctgtacgtttaatgattgatcagcggaaagaagagtgattcaggactagaagacgattatcttctctccaacccctatcatctggtaatgcctgatgtgatccactttgccacaagatgatggatcatatttctgattcttcgttatctttatttgatgcgttaaaatgtttggagagctgataagtgtcaacttttctgctgttggacagctcggtattttttcctcccaagtatttcaagaatctccaagagacagaatattgaaacagaaaacttgtgagtaggatctggatttgtttccatatgttttactcttctgctacatctgaccttcatttatgttgcattccagctccaatatatgagatggagaagcactgcaatatcgaaatagctgcccaaatatcccaaagcacttctagtgaaaacagtatgtatgccttctaacacttggcgttgaaatgatgatgctggctcagttcttgccttcttagctaattttagtctgactttgagaacgagttttacttattttggtagatggggacaaagatcgttatcaaattgaaggattgatggaaagtcctgcagtagatgatgaagtagattgtttttcgccattgtcgctgaatgcaacctccataaacgtcgaagtctactataacaaggctgtgaactatacattgatggtcacttttgtatcctttgttccaatctcttttccattccatcagaaaatgacaaacacatggcagttttagcggattccttaacttgttattgtacctaggtctcgttcctccaggttcttttattgatccggcaaatggagcacagtaacacacaatccgtaagattctcattgtttgtttatctgatctttctaagagaagagactggatgctaacttttggatg

SEQ ID NO: 13753 - DNA, 1919 bp, Unknown; identical to SEQ ID NO: 13741
  misc_feature (1)..( 1919): cDNA_ID_3031681_gDNA_ID_2214648_Annot_ID_136395 3000 nt of promoter + ATG

SEQ ID NO: 13754 - DNA, 3000 bp, Unknown
  misc_feature (1)..( 3000): cDNA_ID_3031785_gDNA_ID_2214649_Annot_ID_136396 3000 nt of promoter + ATG
attttttcaacaacactgggatttagtgaagcctcaaatcttaagtgaggtctttggtttttttcagactggtgttctacctcaggattggaatcacactcatatttgtcttattcctaagataactacaccacagagattgtctgatcttagacctatcagtttgtgttttgtgttatataagattatatacaagattttgattgcaatattgaaaaaacatctcccaaaaattatttccacaactcaatctgcttttgttcctgaccgtttgatctctgataatatattggttgctcatgaaatgattcacagtctgagaaccaatgatcgcatagcttatgaacatatggctttcaaaacggatatgtcaaatggcatatgatagagttgagtggccttttttggaagctatgatgaatgctctgggttttaacagcaaatggatatcgtggataatgcaatgtgtaacatcagtctcttattctgttttgattaatggtcagccttatggtcaaatcattccagaatgtggaattcgccaaggtgatcccctatcaccagctttgttcgtcttatgtactgaagcttaattcatatccttaacaaagcataaaaagaaggaaaaataactggtattaggtttcaggataaggaagttttagtcaaccacttgttatttgctgatgatactcttttgatgtgcaaggctacaaagcaagaatgtgttgagttattgaattgtttatctcaatatggtcagccttccggtcaattgatcaatttagagaagtctacaattacgtttggggcacaggttgatactgaaaccaaaaactggataaagaatgcttcaagtattctcttggagggaggaactggaaaatatcttggcttacctaagtgtttaagtggctcaaaaaaggaattgtttggttttattaaggaaaaactgcaatcaagactaacaagttggtattccaaaacattatctcaaggagggaaggaagtcctactcaaatctattgctttagctcttcggtctattccaggtcttgtttcaaattgcctaagagtttatgtaagaatttgacttctgtgatgatgaaattttggtggaacagtgttcaaaggaaaatccattgtattagttggcaaaggttaacattacctaaggaacagagagggtttggtttcatagatcggcaatgtttcaacaaggccttattggctaaacaagcttggagactcttgcatgagaaagaaagtctgttttgcagagtttttaagagccgatatttctctaagtctgatttcattaatgctaccaaaggctctagaccttcatatgcttggaacagtattttatttggtagataattacttcaggaaggtttgagaattgtgattgggaatgggaatcatacttctgtttggattgataactggttgcatgatggtcataatcggagaccaatgaatagacagcctctcattgatattactttgaaagaaagtcaacttattgacccggtgtctaggaattggaatcttaatagagatttatttccttggaaggacattcagattattatcaagcaaaggccgatggtgtttaaagaagattctttctgttggttacattctaattctggtttatattcggttaaatcaggatacgagttgatcaataaacaagtccatcatctgatgtaccaagaagctgaaattgctccttctttgaactctctttttgacaaagtatggactttgtaaacagctccaaaaatcaaaattttcctctagaaggcattacatggggctctctcagttgaagctaggcttagaacgagaggaatcattattgctgacggatgcttaatgtgtgatgaagaaaatgaaaccatcaaccacattttactccaatgtccgttagctcgacaagtatgggcaatttctcatttatcatatccgggatttccagctctctgtatgcaaatataagtaaattgtttgacttaactcagcatcatggtggtcttcacaatgtgagatttgttaatccatggattatgtggtcgtcatggaaaaacatgaataagttgttgtttggaggtatttcctctatgacaactactattgcagacaaggcttttgacaatcataatcaatggttcttagcgcagccttatagacatgaagatgagaaaattatgaggattatgcactggagtccacctttgcctggtgatttgaaatgtaatattgggtttgaatggtctaaacaacatcaattcttgggcgcatcttgggcggtacgtgattcacaaggtactgtcttatttcatagtagacgttcttttgctcaggtaaattctctcttttatgctaaattacgaagctgggaatgggcacaagaatgtatgattcatcatcaacttaacagagtgacttttgctgctttctacttatgagattattcaagcattacacaaatcgaatgattggcttcttctattaggtcatatcacagagcttttgagtctcagtcatgcaaacccaaattggttcctactagtagaaccctctctttgtaatggaggagcgactgcaattgccacaagtgttgttacaggttttcgatttcaaagctacatggctagaggacatccgttgtggatgacaaagctttttactgaagaaagaggaaactagattggagattgggatgtatttttgttttatttagtgtcgctttcttaagtctcaggtttctttcgtgtcaggtcttcttagtctgcaggttctattgtctttatctttcttttatcattcttaatttgttttaatatcccaatagttttattattatactttagtctttttctattcgaccaaagttttagcttctttggttctctaagtctatatatattctctgttttttagttttagtgttagttatccctttctcttttctctagttctctacatctcaac

SEQ ID NO: 13755 - DNA, 3000 bp, Unknown
  misc_feature (1)..( 3000): cDNA_ID_2704026_gDNA_ID_2214649_Annot_ID_136398 3000 nt of promoter + ATG
gagcactttcacaattaatagaaaacactgcattatacacttccaattctgtgacatcttgagttaattgttgattcatatccaatgaaacctttgcttgaaaaccattcaaaaaattatcctggcctattggataagaagatgaaaaaagatgctgaaagaacgaagaagcaattttccctttctcactaatcctggtgtgttcttgtccattttcatccagaaggaagctcaaagagttccctaatctagaagatttcaaagaagcatgaaaaaaccaatgtttttatcttcagcaaacagccatttttgactacttttctgtctccaaaagagttcatcatcctcatcagcaagacccaattgatctttaatatatgcaattctaggccaatttggaaactcataacttttcagcaaatccaaatctttcctcaatctttgaatcctactctaagcattagtatcagctgatttttttccatacactaatagctcttcgacattcaataagactaaagatagaggagtgagaaccttgagacattgcattggtccaagagttggaaatcacttgaatacaagaaggatcatcagctattcttttgtcataacaaaactgtccacgaaacaactcgttatcattaataaacttgactaaaacaggacgatggtcagatccaaatctctcagaaaccactggtgagaatttggaaacaaagaaaaccaagaggaattcccaaagcatctatccaatctacactgaatccattgaccatttctagtccctccccaagtaaagccattgcttgtactacctagttcatgcatatcacaagtattcaacatgtcttgaaaagattgaaacgaagaaggtactcttctcggacccctctctttcccgttttcgacttaatatcattgaagtcacctatcatacaccaagcttgcttccgatgtgatccaagactacacaacttatcccaaacctaaggcctaagatatgtcaccagatgcccataaacacaagaaacaaagcatactttatttctagaagaacactgaagatccaaaagatgtttatcatcaaaaagaatctcaatgtccaaatggcttttccaaaagattgctaagccaccacttctcccttgaggttctattgtatacatatagttataaccaagccaatcaataacttttgaaacaaactcgtcaggattcatagtctccatgaagaataaaatgtccgagatatgattttttttcatctccttaaggtgtcgaattgtccaaggattcctcaagccttgacaattccaactaaggacgccttactgatccaacggtggttcacttggaaccaccgtattcttgtctctcttgaaactttgagcttctgtaatgtctgagggttttcttttccttttgaacaccttttcaaaatgaggagaggcaggagactgaataaccttattcttcagagacagctcattaactagtttttctttcctgaactgaaaaggagtgaaatcctgcattatatgatgtttaaaccctgaagtggaggaactagcctcaccaacacatgtggtaaatccagtactaatgtccaaatctagcatctcagctaacaaagtattctctggatgactatcaattgcaacagtagctgatagaggatttgctggcaaagcatctacccttcctttgggagcaattgactgaaagggaaactcagccagcctcggtaaaaacatcttcttctgtttgcctttctcttgtaatgatctcacatcatgtttgatggaatctaagactttggatgggcatctatttttatcatgagttaatctttgacacaagaaacatctctttctaatctgttcatagtcaaaagaaattgtgacaacttcaccagatggaagttgtacctctttattgttacgaagtggattggcgacatgaaacaaaacccgaacacgaacatagtcctgaaactgtgatttttcagagtccatcaccacctccttcacttccccaatacagctcgtgatctctttaattgtgtcctgagtataatagttcaccgaaatattcctcactcgaccccagattggaagaaaattcagataatcaattggaggattctcaatccatctatccatgactacaccccaatttatcttctgtccaaactccaattttcataatttcttctaaatcttcctcagatttgaagaaaaattggaatcgatcctttgagagagcaacacctctaacccgagaagaaattctccaaattcgtggcatatctaatatccaattagacatcctttgattctctagattcaaaaacctacccaactaacgacagttgtttctgttaattgaacaaaagcgcggttgatcagaaagaatcagaggcttattgtcttaaatcgacatattctgaatggctttatccagctccatgatgagatcctgatagagagtaaacaactttcccgaactcgtcaaacctgatttgcaggaaacaaactccaagagaaaaaacagtgaagaaatccgagtaattcagatgataaccaacacagaactgagaatcacaaagcaaactctcgtaacagagaaagagtcagaactaccaaaaatccgaggaagaaaacaacaatttagaccggaccgaacacgtaaatatttctggtagaagctccgttcagaatagaacacctgagagaaaagtctttaggctccaaattaactgggacgactattgttttaacggctagtttcagctactaagagaaagaagagagagaaaaactttttgtcaaactctttttgtgaactccttttcttagatgacaacacttatgagaaaaaaaaaaaaaaattagttttgacgagacacggacataaaaaaaaaaactagggcagagtgactgataccaaaggagaaacaacaaagagacgaactgaagaaaaacctctcggaagaag

SEQ ID NO: 13756 - DNA, 1673 bp, Unknown
  misc_feature (1)..( 1673): cDNA_ID_3031750_gDNA_ID_2214649_Annot_ID_188610 3000 nt of promoter + ATG
caaaatagataggctaaaatttctggtggaaagaattaagccgaaaggtcaacggtatggtacaaagcaaaaaggcaaatggaccattattgccaaacttttatttttattcattcagattttgtgtcaaattgccaagtttagagacacataacagtagtacacttttgcactgactatcaatttaaatacgaattctcactgattaaactaattaagacgcatcattataaatttcttaaatcataaacactagaatccaaaatcgattttcatttttccctcttttcttttttgaattctttcctttttttgattccttcttcttctttaaattcaaaataatctcttatctctatgtcgattgatggtgcgaaagagaaaaaattgtgcctcaatttgcttaattaacgaaaattcgtgattaaattgaaaatcaacataaaaattgagaatttaaattaccagatacagaactcatagtttaaatcaacaaaaatagtaaactactgatttaaatgacatttttccaaaaaagcaaattgtacaacatattgtgtgatttggaccatatggtaccaaaccattataactaaattagataatttatgtttatattattatttcttctcaatatataagagatttatataataaccaataactataaaatgatgaaaattaacaaaataacatcataagctcaataccttaggagagaacatatttaacgtgtaactgtcaaagttactccaaacaaagtttgtgttctttttttataaataacaatgtttgtgttgaatgacctcaatgaagagatttgtttgatagtattaaatagctaatattttcttaaattttagtatagttatgacatatttgtatatggcctatttgtatatgatcagtattattctgttttattgtcttaaaaatgatcaatattattctgtatttatagataaaaggctatttttcgctttggaataatttttaatttcaagaaatacatactagttttatttattcatttagacatgtttgacatgagtagttgatgagtttgtcaattttgaaatacccactgagaaaatttattttgttttacataatggaacttcctctaacttacgaaactcttaattttaatataaataaacaaacgaaagaaacgaaaattggtcagttttttttttttttttctcttctggtcaatgccatctctctccctcgtcttttcagtttcctaatttccattgtttcttcaaaacaacatttcacagatagctccaccacgacctgacgaagatcctccgcgtgagcaagtttcatgttcttcttcttcttccgattcatagttttttttttttccggtaacttgtcatcaattagatctcgtccgaagttgaatctttagttcgcgagcttttggacaacttcgaggtaaaattcgttattctctacacaacttccgattaacgcttgtgtagctactctcaactttgctgcttgatccaatctcgtcttaagttgattttagctgcgaattggaaccgaattggtttttatgtaaaactgttactttttttgtgcgtgtattgttaagaatgatggatctagttatataagcttgaaagaagttagtttctttggtaggtcttagctttgcaatg

SEQ ID NO: 13757 - DNA, 3000 bp, Unknown
  misc_feature (1)..( 3000): cDNA_ID_3031766_gDNA_ID_2214649_Annot_ID_188605 3000 nt of promoter + ATG
gcagttttcttttttttccttacatcaggctggttttcttataagcagtaaaatgctcaaccgtactgaaccgggaataaccgaaactaaaccgaagatattaattaaagggttttctgcaaaataacccaacaagtcgatctcatttgcaagtttaccctccaagtccgaattatgcaagtcaaccccaccatctctaaagtcacccgcaatacaaccctcccgtatattgatggtgtggcactcgataactccgttgaaaaacataaggattttgtgcaaaaaaaacttcaatataattttttttgcaaaataaaccttcatgtcaaataaatacaaaccacaatctgaaaaatctcctgcaacatagcccttccgtgtatcgatgacgtgacagtcaataacttatttagagcatgagtcatttatttaaggtgcaatgtgcaatgggtaaacactaaaacttaaataaatgataaccgtaattttaaacaaaaaaacaaaattaaatttttgaatcgataactgtaactaaccaaatttttatcagattcgctctggttctttttttctttcaaaataactaaaattaacctaatttaaccgaaattaacaaaaaaatacaaagaagaaaaatattagaaagaaaattaaaattttgttttattttgtaaaagagtatttaattttgaaaaatataactaacaatatttgaatattttgatcatttaaagtatttgattgtttttctaaaaataattaatattttgagtttataattatagttatgggtattaattttggatattttctaagtttctggatattttggttaatcgtttggttatggtttggttttattttatttaaaacttagatcaataacttaattaaattatatgcattaaagtaatatattcgatagacttataaaatctctaaatgagttatcgactgtcacgtcattgatacacggaagggctatgttgcaggagatttttcagattgtggtttgacctatatttatttgatatggaggtttatcttgcaaaaaaaaaatacattgaggatttttttgcacaaaatttttatgttttcaaacggagttatcgagtgtcacatcatcgatatatgagagggttgtattgcgggtgactttaaagatggtggggttgacttgcataattcggatttggagggtaaacttgcaaacgagattgacttggagggttattttgcagaaaacccttaattaaaacgaaatatttgcgattttcacccataacaatcttattataaaaattaaattatggttttcaagtagtaagacatataatcgtcatagatatcaagtttattgatcacaaaaaaaaaaattttattaattttaaaaatataattataagaaattataaatttaaacaattttaaaaatataaaagataataacaagaaaactaaactaatatctttagctgcatagaattggaagcaggtacgcagaagcgaaagcgtaaaagccagtttttaaaaatatttagaaagcagatacgtgttgtgttggaagcgtatatatatatatatatatataccatgtatattatatatctatatcccaagtattttatatatatatatatattataaaataccaaacataaaatcatttagaataaattagataataatcaagttagaatatattagttaaaaactaaatttcaaatactaaagattagaagttaaaagcatagaaaattcaaaaacttctttaagtttttataaacttaggagagtatatagttttttccgtcgaaaatataattatattaatttgaattgtcaagatacaattgttcactaagccataatagcgggtacatacaatcagaaaaagtaacaactagtttgacatccgcgtttagctaatagatgtaatgtcttattaccactcctcttcgtgaagctaaacttaatgttttgaaaattttctgtccagtaggcgatatcttgatgaattccggcgatagatatatcataggtttttccattggtcatattgatcggatatcgcaatctccttcaagaattatagatcaaaatctttttatccatacttgttgcaatgccgataaaagggtttcagcttcagcttccaagggtgatattcttgtaacaagatatgatgctccctaacttagtgactgtaacgcccgcgggcatgatcatggccggtctaaccacggccatcccgggggtggggtggggggtggggggggtcatagatggagagaacctgtcgcaattcggctaaggtcccagggttccggatcttcggccgattcgtatccggtcatctccccactagattcaccgcgtaggcttgccaacccttgcggtgaacccggtgttgtgcggttcggacaaagccttatatcattacgtaacattcccgatttgtaaaactgattgtacttatatatgtactagatattatatgaataaaacatcaccaaatccatacatatatatttatattcggatccaagttttccaaaatactttagtacaaaaacggttttacaaaagcaacataaaacaataccctagttcggcggtcttaacgttcgtcttccctctactggttgattgcgacgggttacctgtaagacaagtagaatcatgagtaatctagtattactcagtgagccgggaccatgtaacaaagaacctattgcaactctaagccgatctaatgcaattctaaaaacctagaggggttaacaaacgaatgaaaagtaaacatgcgacaaacaaatcagagaaacacgcagtaagcaagcaaacatgcaaagataaacaaacaagcaaagagactcgacaatactctagacgcgaacctatgggtcttgagctccattcctcctccctaaatattggaagttgagttctcctatatggatctatcaacccgataacaactcattgaatccacacatg

SEQ ID NO: 13758 - DNA, 3000 bp, Unknown
  misc_feature (1)..( 3000): cDNA_ID_2703998_gDNA_ID_2214649_Annot_ID_188602 3000 nt of promoter + ATG
ggagttgctcgaagttttttgaagcttatcataaaattgaaccgagtttcttcgcgttttaggcttgaactggagaccggcaaatgggaagggacttaccaccgatacagaactggaccgcgatggctatcacagttggcggtgttcggcgtgatgcatgcaggggtgtccaattacctgacgcgtggctcggcggagttccatcactcaacacgtgtcagcatctaaagattaggattttaatctcgaccgttaaaattacgcttgtactttattttgggcgtttccctatgtaaaaagtccattgggcctttcttaataaaatcgttggccgactaaaaaaaaagactaaaatcttatcaactatatatacgttaaattgagattagtatccacagatttgtgcatcacaccacacaattgctacttgtaagctaccaaattagacaacattaaaaatttatatttttcatatattgattatggttttttgtagtcataagtttttcttctacagaggaagaaaaaaaagagtaaaaataagttactttcttttccgcatcaccagttatattaaactagataaagcccgcctaaataggtgggtgtaagatataaattcaaatttttatcgataattttaaaatttgaatagtaaatagtgtttcacacacctttttaatatttaatttagtaatttttgtattaaacaaaatattaatcatatacattcgattttactatacattttaactatttatttgaggataattaaatctattttaattttatacgctccatcttatagttgatatttgaattttatatattaactcatacacttttcagcctacaaaaaaaaaaactcatacacttttcaaatatttaatttagtatttttttcaaccaaaatttaatcttacaaattcaatttttcaaaacaatttaaatatctactttatcataatacaatacattttgatttgattgtattcaaactgaaatacaagtcgatttgtaatacaaatatagttttagtctatacattccaccttatttttagtttttctttttagttaaaaaattaaaagttaaatattttaaatatctatgtttcttttatttagttttcctatttatttaagaaaaaagtaaatattttttgtcatgtcaacatctgaacgatagacttgatacgtgtcacgatcacgcgagttagtaactttgaaaaccatactttatataataagattataggaaatatactctattctacaaaaagtcattcatgaaccaatttgcttacatgagagaaaaggcaattacgatttcgagagttcttagctaaacaatctgctcgagtattaaaactacgagctaatgctgaaagaagagaaaaaacaaactaaataccaaaaagaggccaattccgttgcaaaagttggtcaatcgtcttggtgatcaacgagagagatcaaatctgcgcaatcggtagcaaaggtatctgtatcgccaatgctgatcatgcattccattgcccctagcaaagattcaagttcgacgtaaagcggagataagttttttcgaagaaaaaaaaagttactcatgtaagcgagtaagtaactcaaaaaaacaaaaaaaaacctagttttctctctcgcaaaaccagccgccgtctaaagaggttttgcagttttgaggctagaatgcggtggctaccttagcactgattctggccttgtgcgtctttgtttaatttcgtctgtagatttcttccttctcgtttttatggtgatatggttgtagggttgatggtgttggggagtgcggggaccaatttctcttctatatctgtttcggaggttggtctctatgttgttggcagctcccgtttttaggctttgtttcaattttggctgtatatgcggctggggttttgattgatttccagatcttgatctggttttgtcagttgaagctatgtcagtgtttgtcacgatatggaattgtttccttttgtcttcccccgttgtgttctgtgtgtttgcagttgaagatgaagtcgttttgagttggtggatgcctctggtgatgggttctgaccgggttatgtgacgttcttgttgtggactaggcgacgactcgtcagggtggtggctgtttggaggcgatttaggttgtcttccggtgcgggtatttggctgaaactgggtcggcaaatgcatgcgtgcaagaggtgtttgtcttatttggcttgtcatttggcgattctcaagggcttcccttgttcctagtttattttcgtcttctcgtgtgccttggtatggtgtgattgttgtctctctagtatcatttggttcttgctttcgttcctggcggtttgacttcagaaagatgtcttaattttgtggcattaccagtcttattgctgcttcacgtgttcttttggaaatcttagtgagaacctctatggaacaataggtcagcttagtgctttggtctccatctcttctttttgcgagtttatcttgttgtttttacctttcttggtaatttggctgtctggtttttagggattagttttcctccttttggtctttgtctctagggatttttgtttatccgccggcttatgtatgattttcgacttgtatgttctcgttgcaattctaataagataaaaaaaagcgagtcacatatcaaaatttcaaaaagcttggtacagttttcaaaacatgtaaaacatttccaataaccgttttgaaattcattatttcaataacacggtttacttaaccggttctacgtagtccacccttacccattgacatttgacactctgtcccgatataatctcttttgacgaaagtcaggcaaagaaaaaaatgagaatcttcaaataaaaaaaaaagaagagactacggagagtcaaaaacagtgagagctttctttcatcttcagccagatcggagcaatcttctccatagattccgtgaaacg

SEQ ID NO: 13759 - DNA, 3000 bp, Unknown; identical to SEQ ID NO: 13755
  misc_feature (1)..( 3000): cDNA_ID_3031773_gDNA_ID_2214649_Annot_ID_188600 3000 nt of promoter + ATG

SEQ ID NO: 13760 - DNA, 3000 bp, Unknown
  misc_feature (1)..( 3000): cDNA_ID_3031781_gDNA_ID_2214649_Annot_ID_188598 3000 nt of promoter + ATG
tcaagacatgttgaatacttgtgatatgcatgaactaggtagtacaagcaatggctttacttggggagggactagaaatggtcaatggattcagtgtagattggatagatgctttgggaattcctcttggttttctttgtttccaaattctcaccagtggtttctgagagatttggatctgaccatcgtcctgttttagtcaagtttattaatgataacgagttgtttcgtggacagttttgttatgacaaaagaatagctgatgatccttcttgtattcaagtgatttccaactcttggaccaatgcaatgtctcaaggttctcactcctctatctttagtcttattgaatgtcgaagagctattagtgtatggaaaaaaatcagctgatactaatgcttagagtaggattcaaagattgaggaaagatttggatttgctgaaaagttatgagtttccaaattggcctagaattgcatatattaaagatcaattgggtcttgctgatgaggatgatgaactcttttggagacagaaaagtagtcaaaaatggctgtttgctgaagataaaaacattggttttttcatgcttctttgaaatcttctagattagggaactctttgagcttccttctggatgaaaatggacaagaacacaccaggattagtgagaaagggaaaattgcttcttcgttctttcagcatcttttttcatcttcttatccaataggccaggataattttttgaatggttttcaagcaaaggtttcattggatatgaatcaacaattaactcaagatgtcacagaattggaagtgtataatgcagtgttttctattaattgtgaaagtgctctaggactagatggatttactgctttgttctttcaacaacattgggatttggttaaaactcaggtcttaagcgagttttttttttttttgagaatggtgttataccacaggattggaatcacactcacatttgtctcattcaaaaaatcacaaaaccgagaagtatgtcggatttaagacccatcaatttgtgctctgtcttatataagatcatctctaagatcctcactgccagattgaaaaaacatcttccaagtattatctcttcaactcaatccgcttttgttcctcaaatattggtttctgataatatcttagtggctcatgaactggtgcatagtcttagaactaatgatagaatgtcaagagaagagatggccttcaagactgatatgtctaaggcatatgatagggttgagtgggtttttttggaagctattatgaaggctcttggttttgacaggaaatggattgcctagattatgcagtgtgtaacaactgtttcttactctgtgctgattaatgggcaaccttatggtcacattattccagaaagaggtattagacaaggtgatcccctctctccagctttgtttgttttatgcacggaggctttaattcatattcttaatgaagctgaaaagaaaggaaaaatttcagaaattcagtttcaagctgaaggaatatcaataaaccatttgttgtttgctgatgataccttgcttttgtgtagggccacaaaggaagaatgtgaggaactattgaattgtttatctaattatggtcacatttctggccaactgattaatttagataaatctgcaatcacttttggggccaaagttggtgatgatctcaagaattggataaaacatcggtctgaaaaatttctttagaaggtggtttacctgactgtttacggggttctaaaaaggagctgtttggatttattaaggaaaagctacacactcgtttgacaggctggtatgctagaaaactatctcagggtggcaaagaggttttactcaaatttattgctctggctctttctttatatgcaatgacttgttttcgactgccgaagactttgtgcaaaattttgaccagtgtgatgatggatttctggtggaatactatgcaacaaaaaaaaattcactcgattggatggaaaaggttaactatacctaaggatcagggagggcttggttttaaggatctgcaatgtgttaaccaagctttattagccaaacaggcatggagattaattcatgagaaagaaagtctctttttcaaagtttttaagagcatgtatttttccaactctgatcttcttactactattaaaggaactaggccctcttatgcttggaatagtattttgtatggtagagaattactcattcaaggtttaagaacaatcattgggaatgggaatcagacttatgtttggactgataaatggttgaatgatggacaaaatagaagaccaatgaataggcagcttttaatggatattaagttgaaagttagtcaacttattgattctgtgtctagaaattggaatctcaacatgcttagagatctgtttccttggaaggatattcagttgattctcaacacagaccagtggtttataaagaagactatatttgttgggatcactcgaataatggtctttattcggttaagtatgggaatgatttgataagcaagaagactcataatcagttgtatcaagagtctgaggttcatccatctttaaatccattgtttgctaaaatttggactttaaagacagttctaaaaattaaaatcttcctctagaaagttttaaaaggggcagttgttgttgaagacagactcagaactagaggaatgattattaaggatggatgcttattgtgtgatgaaacaatcaatcatattttgtttcaatgcccttttgatagacaagtttgggctctttctcatttgtcattttcaggctttgaatttttgggttctgtttatgcaaacataagctctttgtttgatttaccacaaagacatgatattcatcatcggttgagattgttggtccttggattatttggttttttatggaaaaacagaattaaattgttatttgagggtataggatcaatg

SEQ ID NO: 13761 - DNA, 3000 bp, Unknown
  misc_feature (1)..( 3000): cDNA_ID_3031785_gDNA_ID_2214649_Annot_ID_188597 3000 nt of promoter + ATG
taagagagaagtactgaaacccaaagaaatgggacggcggtgattgaaatcaggaagattgtaatcgtagaaattgaccagctaggagagagaacagagcgaaagatctaatttttggtctccagaacggattagtatttgtatatgttcatatttctcttttgtgccatctttttaataatttaatcttcatacagaagataatctccaacaaattccatcgtcgtcgttaatcaaatcgatgtcccaggtttcttttgggcttaaggacttttctctcaggttgtttcaaccgttcggagctcctaccggagatttcaacgtactcggtccggttctgaaaatctttacatcgtgttctgtttatgagttctgtttttttctgctctgttctgttttgttgggttttcgatatctttctcaaaagtttggacgtatcaagagtatggatctggataaagctattcaagatatgtctattgaagataacaagacgttgattctatctaatcttccctaattttgctcagttgaaagaaacagctgcagtttgccgggatggtttttgaatccggaaaatcagaggatgtctaacttgattttagatatgcctcatatttgacgtctagcttctcgggttcgtggtgtagctctttccaaagaccgatttcagtttttctttaaatttgaggaagatttagaggaaattttgaaaacatgtgtatggactcaagatgattggggggttgtgatgcaacgatggaatgagaaaccaccttctgattatttgatgtttcttccgattttggttcgtgtaaggaatattcccgttaactactatactaaagaaacaattaaggagatagcggttgccttggggaagtgatggaagttgttatggactctgacaaatctcaagttcaggattatgttcgggtaaggttttttttcctatgtctaatctccttcgaaatagtaaagcggttcagcttcctacgagtgaaatagtcatcatttcttttgactacaagaggatccggaaatggtgtttccaatgtcaaaggttgactcatgttaaaagcagatgttcgttcaaagtttcaggttctgtaactcttgcagttatgaattctgtaaccatcgttggatcagtaaggcgtcctaagatggaattgtcaaggcttgaggaatccttggacaattcgacaccttaaggagatgaaaaaggatcatttcccagacattttattcctcatggagactaagaattcaatagagtttgtttctaaagttttctgttggcttggttacgattttatgcatactggtagaacctggagggagaagtggaggtttagcaatcttttggaaaggtcatttaaacattcaggttctcagtgcagataaaaatcttttggatcttccggttttttcaagaaataaagtttggtttctttcttgtacaagtaatgggttcacttggggtggtaacaaaaatgatcaatggattaagtgtaaataagatagatgttttgggaatccagcctggttttctttattcccaaatgctcatcaatggtttcttgacaattttggatctgaccatcgacctgttttggttaaattcactgacgataatgagctttttcgagaatattttcgatatgacaaaagatttgctgatgatccgttttgtattgatgctatctatcgttcttgcaattgtgcaatgtctcaaggtactcactcatctatttttagtcttactgaatgtcgtatggccattagtgtttggaaacactcggctgatactaattctcatagtagaattaaaagattgaggaaagatttagatgagttgaagagtctgcaatttccagactgacctaggattgggtttatcaaggatcagctgggactggcttatgggaatgaaaaattgttttggagacagaaaagcagacaaaatggctggcaggtggagataagaacacagggttctttcatgctgcggtgaaagttgctagaatagggaattcattgacttttcttgttgatgaaaatgaacaagaacacactagaaatagtgataaagggaaacttgcgacatccttttttgagaccttattctcatcttcgtatcaaacaaatcagaatatctattaggaaggatttcaatccaaggtctctttagaattatatcagaatctgactcatgatgtcacggaattggaagtgtataacgcagtgttttctattaataaagaaagtgatctggggccagatggttttactgcattattttttcaacaacactgggatttagtgaagcctcaaatcttaagtgaggtctttggtttttttcagactggtgttctacctcaggattggaatcacactcatatttgtcttattcctaagataactacaccacagagattgtctgatcttagacctatcagtttgtgttttgtgttatataagattatatacaagattttgattgcaatattgaaaaaacatctcccaaaaattatttccacaactcaatctgcttttgttcctgaccgtttgatctctgataatatattggttgctcatgaaatgattcacagtctgagaaccaatgatcgcatagcttatgaacatatggctttcaaaacggatatgtcaaatggcatatgatagagttgagtggccttttttggaagctatgatgaatgctctgggttttaacagcaaatggatatcgtggataatgcaatgtgtaacatcagtctcttattctgttttgattaatggtcagccttatggtcaaatcattccagaatgtggaattcgccaaggtgatcccctatcaccagctttgttcgtcttatgtactgaagcttaattcatatccttaacaaagcataaaaagaaggaaaaataactggtattaggtttcaggataaggaagttttagtcaaccacttgttatttgctgatgatactcttttg

SEQ ID NO: 13762 - DNA, 3000 bp, Unknown
  misc_feature (1)..( 3000): cDNA_ID_3031793_gDNA_ID_2214649_Annot_ID_188595 3000 nt of promoter + ATG
ccagagcattcatcatagcttccaaaaaaggccactcaactctatcatatgccatttgacatatccgttttgaaagccatatgttcataagctatgcgatcattggttctcagactgtgaatcatttcatgagcaaccaatatattatcagagatcaaacggtcaggaacaaaagcagattgagttgtggaaataatttttgggagatgttttttcaatattgcaatcaaaatcttgtatataatcttatataacacaaaacacaaactgataggtctaagatcagacaatctctgtggtgtagttatcttaggaataagacaaatatgagtgtgattccaatcctgaggtagaacaccagtctgaaaaaaaccaaagacctcacttaagatttgaggcttcactaaatcccagtgttgttgaaaaaataatgcagtaaaaccatctggccccagatcactttctttattaatagaaaacactgcgttatacacttccaattccgtgacatcatgagtcagattctgatataattctaaagagaccttggattgaaatccttcctaatagatattctgatttgtttgatacgaagatgagaataaggtctcaaaaaaggatgtcgcaagtttccctttatcactatttctagtgtgttcttgttcattttcatcaacaagaaaagtcaatgaattccctattctagcaactttcaccgcagcatgaaagaaccctgtgttcttatctccacctgccagccattttgtctgcttttctgtctccaaaacaatttttcattcccataagccagtcccagctgatccttgataaacccaatcctaggtcagtctggaaattgcagactcttcaactcatctaaatctttcctcaatcttttaattctactatgagaattagtatcagccgagtgtttccaaacactaatggccatacgacattcagtaagactaaaaatagatgagtgagtaccttgagacattgcacaattgcaagaacgatagatagcatcaatacaaaacggatcatcagcaaatcttttgtcatatcgaaaatattctcgaaaaagctcattatcgtcagtgaatttaaccaaaacaggtcgatggtcagatccaaaattgtcaagaaaccattgatgagcatttgggaataaagaaaaccaggctggattcccaaaacatctatcttatttacacttaatccattgatcatttttgttaccaccccaagtgaacccattacttgtacaagaaagaaaccaaactttatttcttgaaaaaaccggaagatccaaaagatttttatctgcactgagaacctgaatgtttaaatgacctttccaaaagattgctaaacctccacttctccctccaggttctaccagtatgcataaaatcgtaaccaagccaacagaaaactttagaaacaaactctattgaattcttagtctccatgaggaataaaatgtctgggaaatgatcctttttcatctccttaaggtgtcgaattgtccaaggattcctcaagccttgacaattccatcttaggacgccttactgatccaacgatggttacagaattcataactgcaagagttacagaacctgaaactttgaacgaacatctgcttttaacatgagtcaacctttgacattggaaacaccatttccggatcctcttgtagtcaaaagaaatgatgactatttcactcgtaggaagctgaaccgctttactatttcgaaggagattagacataggaaaaaaaaccttacccgaacataatcctgaacttgagatttgtcagagtccataacaacttccatcacttccccaaggcaaccgctatctccttaattgtttctttagtatagtagttaacgggaatattccttacacgaaccaaaatcggaagaaacatcaaataatcagaaggtggtttctcattccatcgttgcatcacaaccccccaatcatcttgagtccatacacatgttttcaaaatttcctctaaatcttcctcaaatttaaagaaaaactgaaatcggtctttggaaagagctacaccacgaacccgagaagctagacgtcaaatatgaggcatatctaaaatcaagttagacatcctctgattttccggattcaaaaaccatcccggcaaactgcagctgtttctttcaactgagcaaaattagggaagattagatagaatcaacgtcttgttatcttcaatagacatatcttgaatagctttatccagatccatactcttgatacgtccaaacttttgagaaagatatcgaaaacccaacaaaacagaacagagcagaaaaaaacagaactcataaacagaacacgatgtaaagattttcagaaccggaccgagtacgttgaaatctccggtaggagctccgaacggttgaaacaacctgagagaaaagtccttaagcccaaaagaaacctgggacatcgatttgattaacgacgacgatggaatttgttggagattatcttctgtatgaagattaaattattaaaaagatggcacaaaagagaaatatgaacatatacaaatactaatccgttctggagaccaaaaattagatctttcgctctgttctctctcctagctggtcaatttctacgattacaatcttcctgatttcaatcaccgccgtcccatttctttgggtttcagtacttctctcttaggtatcttctgtctgagcagagctttgcttggagatatacttgttttctgtccaaatttgggtttcagtttttcagaagtttgtgtttgaaacaaatcctctctggttctgatttctgctaagaacatcttggaagcgtttatgatttcttgtggataatcttttatctggtttttgctctgaacatcttggaagcgtttgtgatttctcttggatattctttatgcggaactgtaatagattttcaatagataagtatttgaaggagatg

SEQ ID NO: 13763 - DNA, 3000 bp, Unknown; identical to SEQ ID NO: 13758
  misc_feature (1)..( 3000): cDNA_ID_2703998_gDNA_ID_2214649_Annot_ID_136400 3000 nt of promoter + ATG

SEQ ID NO: 13764 - DNA, 1673 bp, Unknown; identical to SEQ ID NO: 13756
  misc_feature (1)..( 1673): cDNA_ID_2714038_gDNA_ID_2214649_Annot_ID_136408 3000 nt of promoter + ATG

SEQ ID NO: 13765 - DNA, 3000 bp, Unknown
  misc_feature (1)..( 3000): cDNA_ID_2704061_gDNA_ID_2214650_Annot_ID_136409 3000 nt of promoter + ATG
tttggattattcggtttttgaattgttcggtatgaaaaatttcccgccaaattataactgacttggtttggttcggattcggttaaaatcttttataaacttcattgattctcagatttgaagcaactcgtcagataagaatgatggagaaggaaactaaagagaagacaaatctcgaatggcatttaccgattctagcgatgactgcggatgtgatacacgcgacctacgaggaatgtctgaaaagtgggatggatggttacgtctccaaaccttttgaagaagagaatctctataaatccgttgccaaatcattcaaacctaatcctatctcaccttcgtcgtaatccaatcttccggcgagttttttttctctctccgcagccggaagagtggaccgattctgctgattgatatgcattttggtttctgtacatacagtaggttcacaatctagagattttgaaggtttttttttctttcaccgaagtaatgtagcttgccatgactagtgtatgttgttaaacgacaacgtctaagacgacggttcagtgttgatcttagcgtaagtattaatcccacgggatcgtttgtactgtatcagatttggttagtcgtttaaacattgtaatgttctaataataacttttccatatataacatcttcttataacttgagacgagaccattttgattcatcttttgagcttgtttagcaaccaaatcggttagctagttgaacgaagatcagagaaagagctcaaacaactcttcattagctatagctcagtcgacgacttgagctttcaaacaacagaaacagagcaaagcttaaaaacgactgcgttttactattggttcgtcgatctcactaaaccgagtgagataaccaaagccaatcaacaaccctttaatcggatctctcgatgtaatctataaaggatgagaagaattaggaacttgtccaagaagagtatatagaaaatatctgactttttgtttgttttttatatactctatcgacttattttatcagtttcagtaggaacgcaacgaaatactacagaatgaatttctcccgatttaggtagaattggatcaccacactgttaggttctaatttgaaatgccttccgactaataccaaggataatcataccgtttgcatttctaactaccaaataaattaattggaccaaatcacaactgagagactttctaaacaaatttgttattgttttcatgaaaaatcaaactcaggtataggagttaaagtttccttgtgccactacaccaaagaggtttggacaaatatctgatttttagaattattgagaatttaagaaatgattgaaaaaagaagtaagtgaaataaatgtggttgatgtgtgaccgtaacgaacagcaaagtggactagttgttgttgtcacgtaatctttctacgtacacaagtgttcgatctacatttcgtgcgagtttatagtatatggttggtgcgtataatacaccaatctttagctacttttactatttttctataagattaacaacaacaatatacatgtcccaatttctacatatcgtactataactatttttaaaatagtatagttataatatttattactagtgaataaaaacagacattcaataccataagaagaagaatagttctaggttagagtgaaactggtaagtaataataataactctccaacctaacaaacattaaaaattgtggtaaacggcgtaagataacgaccgttaaaaaatcagccgaatgaagattaatgcgtggctaatatgctccggatttcacggcgtctgtcttttacagttaaaaacttttttgtcgggactgcaaaaaaatcacatttatcttgtttggtcaaaattagtcatgagaagattaagaccatgcaatgcaaagtactcattaatcttttaattttttttattcaaagtatataattactcacgaagtcgtgacacaatgagtcaaaaaatgaattaaataaaacggtgtaatcttaaactgtctttagcacgttacgatgaaatttcaattttcgactaatctttgaccctaaacaataggtaaccaccgtcaccgtattaaatgctttttctattctaagaaatacagataagtttccacgtattgtattcgtcccacaaatattcataaggaggaaataatatcctttttttatagaagcaaatggaaataatgtgaacaaaaatccaagatctattacaaaataaaatattttaaaaatttaggaaagacaatcgatattattagcagtttagtccgaaaaatgccgaaatacactcaatcatagagatattacttttattattaccaattttgacacaaatcaattgttaaaacttcctaaaaagtaaaattctctaattgaatatataaataaaatatttcaaatgtgatttttatttacaaactttacaaatgttaataatatattcacctaaactgaaaacatctaaatgtcataaaatttgtatcttattcctaattctgatttttttttaatataaagttataaacacaattagtagataatctcattattcataattatggattattcggcgattttcactattgtttttcaccactaattatgccaccttgccagctgtattcacacacacacacacactctacacaagcaaaacttaaagtatgcatttttattaattatggttcatccattttattacagaagaataaatatttcatttgaatgagaataataaataaaaaggcaatgcttttatgatcctcttacctttaatcttcttcgtctctctatcttcctcgatctccgccgattccttcgtctttccctttcctctctgtaaaccttttcttcttcttcttcttcaatgcctccctaaaaccctagactcagaattctcaaaggcgacacctttaacctcctccactctgtttctttctccaacaaaaaatg

SEQ ID NO: 13766 - DNA, 3000 bp, Unknown
  misc_feature (1)..( 3000): cDNA_ID_2704057_gDNA_ID_2214650_Annot_ID_136410 3000 nt of promoter + ATG
agtaagacaaacctagttagtgtcacaataattatatttttttttttgtcatccaaaattattaaagctcaagtaaaccaatcctgagggatattatttacaaatgtgatatgatgcggttcggtgcggatcttccgcgccaaattatacgcttttatattagcattataaaaaattatagataaagagaagtttgtgaattcttcattgtcgctttgcaatttctctaaatacacagtaaataccgacaattcggttagagaaaatatatctatttcgtataataatgttaactttgaggagattttgggtaaaataataacttttgttggatggatcatatcatgagccattaagaaaaagtccaaaacttttcttcttcaaagttggactcaagttagaaaaagaaaaaagagctagagagatataaaaatgaaaagaaagttcatggcaaaaaactgatatagacagagacacagagagagagaaacgtatctgaagaaaatctaaaaaattcgattcaatttttttcttacttttaaaagcaaaaaatctcactaaaacaaaagaagaagaaagaagaaagaaaatggaatacctacatttgaagtgatgagaagagattttgtgtataataataatgcaatgttcaatcctctcacaactcattacaggtaactaaaataatttctccatgtgcttgcttattagtcgttcttcctaatgttatgtttctctctgtgttctttctttctttggtcaaagctttaattttttttctattgttggatttgagacagtgaacatagctatgttcttgttccaataataaacaatcacgcctgtaaagagcttatgattgattagtgtgttttttagtattaattaatttctctgacaataattacttagtttttaattcttctctgtaagaaacctttggaaactgagcaaagttgcttcttttgagaaccatgcgtttctttctctcttttgttcttgaattcgcaaaaacatgtcctttttcgtctacaggtttctagggtttgtttctgtactataaactatgtttatggtaacattcttaatcataactacactaccaatgcttttatgttatatgtatgcaaaaaaggctctaacttttgttttctttcactattgtttcttcttttgttctctattgttgtagctcagatatgaactgggcactcaacaatcatcaagaagaagaagaagagccacgaagaattgaaatttctgattccgagtcactagaaaacttgaaaagcagcgatttttatcaactgggtggtggtggtgctctgaattcgtcagaaaagccgagaaagatcgatttttggcgttcggggttgatgggttttgcgaagatgcagcagcagcaacagcttcagcattcagtggcggtgaagatgaacaataataataataacgatctaatgggtaataaaaaagggtcaactttcatacaagaacatcgagcattgttaccaaaagctttgattctgtggatcatcattgttgggtttataagcagtgggatttatcagtggatggatgatgctaataagattagaagggaagaggttttggtcagcatgtgtgatcaaagagctagaatgttgcaggatcaatttagtgttagtgttaatcatgttcatgctttggctattctcgtctccacttttcattaccacaagaacccttctgcaattgatcaggtcagtgtgtgctttattaaaagctcaaagctttggtgaaatttttgattcataaatgcaaagttgactttttttggaaccagaagtttttgaaatttactcttttatgtttggttattgagtaaatgaagggaaatttaggcctttgctttactcattggtttgtggctaattttgcaggagacatttgcggagtacacggcaagaacagcatttgagagaccgttgctaagtggagtggcttatgctgaaaaagttgtgaattttgagagggagatgtttgagcggcagcacaattgggttataaagacaatggatagaggagagccttcaccggttagggatgagtatgctcctgttatattctctcaagatagtgtctcttaccttgagtcactcgatatgatgtcaggcgaggtaatataaacattatcagacacttatggttttgttttttcggttaagtatccgacctgcacctcttctgaattttggctatcttttctgcaggaggatcgtgagaatattttgcgagctagagaaaccggaaaagctgtcttgactagcccttttaggttgttggaaactcaccatctcggagttgtgttgacattccctgtctacaagtcttctcttcctgaaaatccgactgtcgaagagcgtattgcagccactgcagggtaaagttcccatctgattactggagcaaacttttgcttgtgatcatgtaaaaagagattttcgagatttcatgattggtttatgtgtgtgatcatgtaaaggaaagaggttttttgagatttcaagattggtttgtgtgtaaagtaaagattgatgcttgaatttgaaatgcaggtaccttggtggtgcgtttgatgtggagtctctagtcgagaatttacttggtcagcttgctggtaaccaagcaatagttgtgcatgtgtatgatatcaccaatgcatcagatccacttgtcatgtatggtaatcaagatgaagaagccgacagatctctctctcatgagagcaagctcgattttggagaccccttcaggaaacataagatgatatgcaggtaccacacagaaaatcttaaagctaaaatactctctgatatctaaaaactgatatcttgtttgaacaatttcgagtgcaggtaccaccaaaaggcaccaataccgttgaatgtgctcacaactgtgccattgttctttgcgattggtttcttggtgggttatatactgtatggtgcagctatg

SEQ ID NO: 13767 - DNA, 3000 bp, Unknown
  misc_feature (1)..( 3000): cDNA_ID_2704053_gDNA_ID_2214650_Annot_ID_136411 3000 nt of promoter + ATG
aaaacattcttttacgaggcacacttatatcaaaaagatatttgttgatgatttttattttgttatcttacttaaggcattgttatttgtcaatatttgttgaggaactttatagtttcaacaaagccggttcactatttctaaattttaatgaggtgtgtagttatataataatatttttgacacaaacgaaaaatgataaagctaataaccatgtgattatattgatcaatgttgtatagtactgcatcatgtgaataattattgctttgtatttagctaacatgttcctgatcatatataccatatctttaaatagttgttagtgtaggaaaatgatgattggtgttctcaagcggttttatcactcgagcttcaaagtttgaacatggacattcatttgtttaatttcttcggtctgttatatataacgttccagtccacaaaattatattttgtatagtatgcaagtggatggatttaaaatcattagattccgccgaaccaatggcaatgaggccaaacgttatgtagtgtggtggggtgcaattttatcaataacaaattgagtacatatacacaagattcattcataattgttaattattttattttgttttgaagaatttttgttctttctttgtaggtccgtttctcatcatatattcccgacatcacaaacatacaatgcaatttttgtaacaactacttcatctatatataatatgtctaaaaactagagtgttaatcaatttatctccaaatgcggtatatgtttgagtttccttgaatcacatattgtataaaacgtaagtgacacaatttacgaattccttaaactcgtaatgtgtaactcaggtacggctaatcgtgcgtgagctttccaatgcatcattagtccttgcatcatctatgcgaatcgaacgttttagttacttggaaaaatttacgtctctcaaaatccgatgaagaaaataaagttgtttctatagaaacttttttttttttttttggttaaagatgttatgaatctttgttatatgtatatgatgtatctagttcttttgttcattgtagataataagttcttaattaattagttataaagattacaaattttctagcacatatatatgatgtacatacacgataagaagcttacatatttaatgattacaaatttacaatattacatggtgattttgaacatctgtctctggccccatggcggattttatttgccgcttatatatgaaaaaagacaaaaaatatattgattaaacttattaatagtggctctttgtgtagttcctttttttgtttctttacgtgagtggctgagtgctagtggatgaatagttatgattaagcagtatggttcatcacattggtcattggatgatcccatgacaaatcataagctttttatttctccaaaacttgaaagttcacaaaactttatgatcctaaaatattttatgtatttagattctaaatgggtgtaactaaactagttgtattagatcatgcacgaatgctcttatttatcgtatatctatctggttaagttaatcactgttatcaaggctttgtttgtaaattatactgttatatagaagttgacatatacttataaaagcgtagtgatttattgtatcttatgtcatatgaataaggatcatttataaacatgataatgtcgttgttggtatagttaaacttacgtgcaattgcaagtaactttaatgaaaaactatttggtagagagaaaaagacagcgaagataagtatgaagtcgtgttatggatagactgtttatattgttttgtggatgtgaatttgtctcaatctaatattgtcacgtcctcatttttcgaaccattgtgtggcaatatcataaccctcattaaatgtcattagctcaattggtaaagagtataggcaaagcttagaagtcgccgattcgaatgacgtttaggacgaaactaatattaaatgcggtcatttcgggtctgagggggttacgagcttcggcgcagaacttcctgatattaaaaaataaataataatatcataaccctcatgacaatttttattttgaaaagaaaaaaatttgggaaagcagtgcgataaattgataccaatatataatcaatgaagcttatttattaaaacattttaaatgaaaaattgtttatcttatccatatatagcttgaaatgtagctcgtgtggaccaaagacaccaatgggtccattttatgtacctaagagtcaaaacatctatcctcaaagttcgaatatgtgaacgaaatggaaaaattatattttcaaatatagtttttccgttatattaatgttgatttttatgtcatcgtgattaatcgaagtaccttcttaaatagggcaacacctgtggcgatgggtccatgcaacctaacaacggaataataaagtttgaaattatgattacagattattataaagtatgtaacttgaatgatttttctccaaaactgaatgaatttaaatggctagtgcgtattttaaaaaaaataaaaaatgtttcaaaggagtgctattgttttcctagagattttatttttattactaggtgatagtaaatatttacatttataattagaaaaaattctttataaaaaaatagaggataacaaaaagctagataaaaaaaaaaagactctcagaaaaacaaacaaaaatggcgattgttaaggcgatttcgctacggttacttcttcgtcatcttctctcgaagattctgacagttttttacgccggagtggggcggttcctcttctcccatgatcaggcggttgttcataataggatagtgggagttccccacgattctgttgttactccacgatggattcgaatctatttaaagaagagacttgcagatttcttctccattccctcacatttaacccctccaatcaattatctctttcgattctatcctctccgactaatcatg

SEQ ID NO: 13768 - DNA, 3000 bp, Unknown
  misc_feature (1)..( 3000): cDNA_ID_2704049_gDNA_ID_2214650_Annot_ID_136414 3000 nt of promoter + ATG
tgtttggcaacaaatccttttttttgttgtatatcttaaatcaatttacaaaaatatttcacgcttataatatcgacatgaacaaaccagtgttaataaaattttgtttatgtaatgtaaaactgaaaaattggcagatgggagttgtgggagagaaattagacatagattttgtgatatcagtaggagataatttctacgacgacggattaaaaggagtcaatgatccttcctttgaagcctctttctctcatatctacactcatcctagtctccaaaaacaatggtattcaggtaatttacttccttctaatcaaagtttatacacatgtttaatagttagttacttaattgtttatctatatgcctaactgagtttaaacactcaaatgtgttatgggattattgtgtagtttgcaattgttttggaaaatgtcatttttactaagatcttacagatttgtcgtacgtatttcaatttttttgttgttaaaaatacatattttataccaaatactaaacttaagatcagatggaaccgactgacctaaacataacgggtaaaatgcatgtttaaattataattttttagcttgcaaaatggcaaaatccataaactattcaaaaaaggcaaaatctataaatgccactaagaaaaatggcaaaatctgatattgattcatgtgttaatgcagttttgggtaaccatgattacagaggaaatgttgaagcacaactaagtaaagttctcacccaaaaagattggagatggttttgtcgcagatcttttgtcttatcctcaggtagattttaaggaaagaaacaaacaaaattaaactatcataactaaatcaaagttttagttagtgaatatgttttgttgtggttataggaatggtggattttttcttcgcggacacaaatccttttgtagaaaaatacttcactgaaccagaagatcacacttatgattggagaaatgtcttaccaagaaataaatacatctcaaacctcttacatgtaatacattttctttcataatcacatatatatatctcaatcttctttttgaaattttctactaattataacttatgttattgaaatatcaggatttagatttagagattaaaaagtcgcgtgccacatggaaatttgtcgtgggacatcacgggatcaaaaccgcaggtaatcacggtgtgactcaagagcttgtagatcaacttcttccaattctagaggtaaaattcataatatcacttttatgctaattacatgttatattatctttattgttttctacattgatgtaccccaatttaattaactacgatagtttttcatgatttttttcacttattactgaaggagaataaagtggacttgtacataaatggacatgatcactgcttgcaacacattggttctcacgggtaaaattataagtacttatttgttgagtttaaaatgtttctttctctattaagttgttatattttgttgaaagaaagaaaacttaacatatattttggaaatggtgaagtaaaacccaatttcttacaagtggaggaggatcaaaggcatggagaggacatgttcagccatgggatccaaaagaactcaaactgtattacgatggacaaggtttcatgtctcttcacatcactcactccaaagctaaattcatctactatgatgtttccggcaatgttcttcaccgatcctcattgtccaaaagatctgctcatctttaaataacatttctaagaataaaatttgcacacaatttaatttaagtttttatttacaataaatttattgatgtatgattattgaacacaatggtcttgaataatatagagttttttcacgttctgaaaacgtggttccgttgaatacatatcatttacaaaaataggcatgggcataatacctgaacccgatctgaaatacccgaacctgttctatttcagtttcggttaattatccgatcggattctattttcaaataattgtaggtatcggtattatccgaaccgaacccgatactcgtaagtaatatttattactcgaacatatatatacatataggacatatattcactaataacttgaatttgtgacatatttaatgatttgagttatggaacaagctcaaaataaggtttacttcttgttttatattattgtcttaaagaaaaacttgttataatttcagatttttgggttttatggatatttttatgtatgtttcggtatatttgaacaaaatttgggtaagtagtacttaaacccgaaatagttttggttatttatgggttctttaaccaatattcgaattatgcggacccaaagtaaacccgaaccgaacccaacccgaaattgaacatataacccaacgagtctaaaatttctaaattagaacccaaaagatccgacccgaaccgacccaaatatccacatacccagggctatacaaaaacttgtgtttaattatatatagaatatgaaaataacaagcgaattttcagtttatcttgcatgttttaaaattattactaaattttagaaagttcattaatctacgaaataaaaactttatggtgtttgaaacaaaaaatcatttttattcagcttagaattgttgtccggtattaaatgtgattcatctattctattattcagctgtttttcatagtatttctcttatataccttttaagaaaatattaaatttcatagtattctaattataaaaatacttgatatgaaatataatacattttttgggactaaaattgggcctttaaagccttatacttggaattatcacattaaaaatgggcccaattttgaatgtctggtgatataagacttttatgtaaaaacaactccctaagaagtaaagttatctacaactttgccatcaacaatgtccacacagaaaaaaatatcatcttccagagtggtgtagcagaagaaacagaggaaactgataatg

SEQ ID NO: 13769 - DNA, 3000 bp, Unknown
  misc_feature (1)..( 3000): cDNA_ID_2704042_gDNA_ID_2214650_Annot_ID_136416 3000 nt of promoter + ATG
atttatatcatgttgtttggtatatttttatttatgtgatttgtcatttcacattgttacctatatatatgtgaacgatagatacctgtcaaataccaaaatattttacacaattagtaatagtgtcaagtttaaggagacaatagctatacgtactatatgtctatataatttatattagtataactttgatcaatttaattttttatatatattgaattgaatctcattggctggccggtgcaatatttgattattttcgtacaattttaaattcttcctaccagccgagaggatatttactaattagacagaaagtgcaaatactttagaaaaaattatgtcaaatatcttcttcatcttttgtccaattataaatatctaagatgccgatattgcattacatattactttcattcgagagatatttagtagttcttaattatggattgtaaaaatacagtacttattaagaggtagataaatttgcgtaaaaagctattagtggttaagctaacaacgctacatcaatttcattaatattttgggaccactgagatcataaattccttttaggcactatacatgattatttatatttttaatcatataacattaattgtatatttgatttggtataacatatttaatttggattgtaaaagtttggtatcctataccaaatgtccaaatgcaacccaatattcattatagttttactgttttaatgatccagaagatatatataacatggaaaaattcaaacataatcatgattataaaataataagatggaaaactaaagattgttttatgtatgcaaatttgttgaataaactaatttcaaacaacacataagttggataaataaaaataagtgataaattgtctattaaaaattaataaataaaaaatcttaccaaaattgtgagtttttaatttcataacaaataaatcaacataaattataagatttatattatatcatattggtaaaactgagaacaacacaatggaaatcagaagagaaaatgggaaaaggttattcgaacttattaaccatactatcaattttatacagtctatttgaattttattggtatgagctcattcgagtgggaaaacaattttggttcaagtcaatgaaagctaaccaaaacgagtttggtaatttggtcttcttactcaaaatctgtttcaactttcaacaagcaactacacatttgttctactgttgggcttctacttccaattagtgatctgaccaagtatttggggcttctaattaactactacaaattgttttgggcttccgttggttaaagtaattgttataacaaacaaaagagaagagaaattctaaacaaatatcattgcttaagcatatgatgatgctctttaccaatttttatatacattcttttgtttcaacatactttatatcatacgcgctcgtgatcatatcattccgaagcatagaatctcatttgagatttcggatagatcggacatcatatatacgtggatactatttattttcgcatgtgtattttcatgtatggaatctcaaaataattgaaaagattttggaagttttcgtcgactctcacatgcattttggatattcttgtagtcgacgcctcttggatcttgtctagataagaaaaacaatacatgaacacaaatttcaataattgcaaatcttaaagaagaatatggtatgggttcccgtttggcttgtatgacatgacttcggatggtggaggaaatatacatccatgataaattaatatttttatcttataattccggaattaaactgataaactcctaaaaatgaataaatatctatcaaaaaaatataattttttttaccgtcttaaatttattatttattgcaaattatgagaattgttacatagccgaatggatataattgcacattgttgaagatctcctgcacacttgtctctaccaatctgcaaatctgctaataaatcacagtatctgggactcgaaccccagacttttttagtgtacaaaagcattaatgaaccttcggtcaaccaatgaaccaaaaaagcttctaaatatgaatttttaactgacaataaataatttttgatgttgacaacgactattttcattaagtttaaacgaggaagtaaacatttccaattggtgcagaggcctatttccaattactgttaataattagttgtatctttataaattataacagttttaaaactataaaggaggttcctagctccttcatggttgtcatatttgtttgtataatgactctgtcactcttccagtgacataatcaaataatctttgttggaaaaggaaaacaaaaaacaattttctcttttattcgaaacttgtgtattattcacgaattttttttttccttgtagcaaagttttatgacaaacagatttttttttaaaaattatgaatcaaaccttttgtgtataaattaacaactcgtacaatggcctttcacatatgtaaggcaattagcaaataaataaataaaatcaccttcaaaaagtccggtcaaccttttttttttttctttcaaaattctctttaatttccttgttaatatatatgggaactaaaaatgttatttatatgtggaacaatatataccacgttaattacctaaacatggaatattcagactacttctatccaccgccccttttcattgacgtgcaaataattttcacgtaattgtctaaagtccattttagtcttatatagtctcggattgaaacaagaaaaacaattttttcgactttaaaatttattaattattttgaagagttatttttctagtgacaaagttcattacattattttttctcttgcctttttctatttttaattcttgtccacataaggactagctataaataaacaaagccacacgaaaacccaccatcaggtccatcacctcttacattttttctccaaagtctctcaatg

SEQ ID NO: 13770 - DNA, 2054 bp, Unknown
  misc_feature (1)..( 2054): cDNA_ID_3031814_gDNA_ID_2214650_Annot_ID_188628 3000 nt of promoter + ATG
aaatgcagagaatataaaaagaatcaaggagattatgatagaaaagaagttgtggaaagaaggagggaaagagctaaggagaagtgcatcaaacatgaagcaagacttttacttaatcatccaagcaaagcctcctaaggatagacctctttttaggtctctttattcctctctctttaactcaatcaccaaggtacatttatcttcattttgctctcattactatatactcattactattaatttattaactatactttggaaatggtagatggattatgcagctagagatggagatgaaactaaggtgttggagtactatattaatattgttgcaatcctcgatgatatcttccctcgaatttaatttcgaacaatataatattagtttaggcaatcgattcgcatttgttgtcatgttctttcttgtctatccaaaagaaaacactagtgaaaatacaagtgacaagagaaaaagttggcaaatgttttttgtacgatttatcttgtcatcttaagaaacttacctacctacataaagaaatcatagcatatgtgagcaaacaaccgttcaaaaaaaaaaaaaagctaaacttcaaaacattgctaattacttaaactcaatccccgaggagttattaccctataacactcttttcaaatcactacgagattcatatatacatttttacataacaaattgttggacctttgataaaatcagaatcagtatataagtaattcagcaaaattttcttttgttaaactttcgaccgagttcttcaacaagttaacgagttcgagccgcaaaaatataaaatctcttgtgtttatttagcaaaatttgcttaacaatgtttgttttgtatgaaaattttgtggctacttatagaaataccgctaatattttaccgtataattatggtattttatatagactatattggtgtatttatagtaagcttgctttttccattcgcatacaaaaacggcttgttgaagtaaagcaaagtggtgtacctcatgctttccccttaacggccggctttagtgtgttttggttttccttttttgcaatttgtaattttaacggaatacgagcaaatcaatagcttttctctacatcaccaatcttcttcaaagccctaaaagggaaagaagaaaggaaaaaaaaagtaagacatgaaacaaagcgaaagattgttcggattttcaaagaaagatagcatctccttttgttaaaagcaagaaaagtgtatataatatatggtagttgttcttgtcatctttttagaccctgaacataatagtgatacaattccacaaatacagtaaaaattacatttttttataatgtttgactgatttacaaaggagacaaataaattgtttgttttactcttttacattaatattgtgattgtcatatatatatttgataatttgtttatatatagcggttatatatctatattttttaaaaatatctgaaagttcaggcccaaaatccatacattttcaagagacgggaccgaaaaggttaaattcatctcctttggaaaaaaagatatctctcaacgtgtctcaaacccatcacctccacctagaaaatcctaaaatttaccacaggaccaacatgctgttggttatataagggttgtaatgtgatatgttttgtaactttttatacactccattaacacaatgcatgttttgaagtttggcaccgattgctaatataaaaaaaaaaaaagacaatctacaaaaagtttgatcacccatacgccatttgaacgatatgaaaatggtcctgaaaaaagaaagaaaaaatagtggaaggttaaggaatctttttctgcctcacatcttttttcactgtggggttaaaaatccctccttttcatgccaaaaccaacttttgtttatttattttttacctcttcgctttctcttttatttttacccttttatacacacaaactcttctcacattcacattcacattcacattcctcctctctctcatttcatttcatcttcaccaaactctcatg

SEQ ID NO: 13771 - DNA, 3000 bp, Unknown
  misc_feature (1)..( 3000): cDNA_ID_2704034_gDNA_ID_2214650_Annot_ID_188627 3000 nt of promoter + ATG
attggtactttaactccgaatatttgtccttactgtacccacattaggctttgtcttctccaaataattagtttcactatttaaccgaaaaatctcacccaacataagagacaaataactaaagttgacaaaagaaaagacaaaaaaatgtgaaaataaagagagaaataactaagtttgcttggcatttatagatttttgtttgcaagctttctctggcggaatcctaacttcactgtaatatttactattacacaaaacaaatgtgagctgtgctataacaaaaatttcaataaacccttccaaattgtatagtttttttaattattattctcaaacaatcaataattcaggactgttgagttgtgaattgggtgtgccatgtcgatgataaaatccaaccactagataagtatatgattagatgatatgattagatgatatgattagacacttaatcccagtagcatcctaagggggttaagcacattattaaagtgattttatacctcttttcagtatttaaatctcatttagttttgttttgataaataattctctttgctttctactttatcaatcttaatatataaaacgaataatgtgattattagttaagtacattcctcttctaatagtataaaagtgattatgtttcttcataatcgtatcacgactgtatccagcacgacgttgacttttaatattcagtctcccacacatgcggtattaaattgggagatacagaaacaaatccaaaaaaaacaaaagttttcgtaaagattgttagtttatgtgtctaattctgttttattaagttacccaagcctaattattgagagaagtatatataaactactcccataattatttagatcatatacttaatgatagaatcatggaatttaaattgctacgaataagtcttatggttattgacttactgtataattgcatggaccgtattaaaaatttcattaccctacccaaagttgaaacctattctacttgttgttttctgcccaaccaccttaaatgttatttttctggttctttatgttaggagtttatgtgtcatcttttgtcttttaattccaaaaaattatagagatatatataattcagttaaacaaaaaaaaattaattagacacttacactgtagaaatatatggtaaaagaatttgaataaaaacttatgtatggtaaaatgatacgtatactaattttataaaattattaagcttgatcgttactcgtttataataaaactattttggtaaaacaaaatctaatatataatattgtatatgtatatatatacatataatgatttgcagcttgattagttggtacggggagcgagcaataattatgtttggatgggaatgggatactaaaacaaaagttgttaattaaattaatttaaaaaatagacatctacttttctcgatgaaactggtggagaagagcggtaatgagagagaccatacttttgattagaccaaattggcatctttcttgttattaagaggggtacatagtatcatcatcatccttaattaattagagtccacgcaataacaatagaagactctgtcctccccatttgtggtaaatcctcttctcatgattattgtttggttgagtatatgttttattctattactactcaccagaagaacattttcatatgtgattcgaatacaatgttacatttctaatatgagagataacatatgcacctactttttatacatgcagttgtatattgtgtgatgtatagttatatattttcgtctaatttctgttgagttcatatgtcatacctaatttgctataggattttattgactgaacaaaaaaaaatgtatacatggtctttatcttagaataatggatatatctatttcttttatttgatttgcttcgcaaatgtacgaatattcgatctttctaaatcgaattgaatcaaataacagatcgaaacaaatctaacgaatattttgtccaaccctaatattttttttaaaaaaaatgttagttgtttaattatattactaaaatcatgaaaatataataaatgttgtaaatgatagaaaaaaaaattgaaagaacgtttttctgaagagtttatataccttgtatacaaacatcttttaataaaaaaaacaaataattcatattaatggtgacatagactgcacccaaaaccgcagcgcaacagtgctgtaacagtattaaaatctttacatatacatatgtatctatgtatttttgttactattcgaaccgtatcgcactttttcgtaaaacgcagttactagtcagaaattaaaaatatataattttaaatgaaagcaaaaaattatcgtaaagtttacacttcaccgtcaaaacacagctacttatgtcagtgactcttcttctatcaccactacacgacaccaaagaaaaacactaacacactctctctgataactctcgcgtgactctcctccttcaactctaactggttcgtacccttcacgctccattaccggcaacgcgcttatcgtctggcacactcacccgcaccgtacccgtcgtcggtcttttcgccaatttatcgtatttttccgtgaaagagaataatataatactctaataaagtgttataataaattacaacgttactatttacaacgatttttaaaagaagctgattattatttcttctgtaactctcttctctgttgctctacctgttcttttctctctgttcattctcttttctttagcttaattcagcaaaaaatttatctttgtttctctcttttgtttctttcctctgcaaagtaaagttatgagagcttaataatgtttgtctcatcttcaagcttcagatctgattccttgtttctacaagtaattgtctctttctttttcgattaaccaccatttctgtgaagaaaacctttttgcttgcttcaagattcgagtgaggaaaattttagctgaaa

SEQ ID NO: 13772 - DNA, 3000 bp, Unknown
  misc_feature (1)..( 3000): cDNA_ID_2704038_gDNA_ID_2214650_Annot_ID_188625 3000 nt of promoter + ATG
aagaaaaaaacaatcaagctatttataggtttataatcttatcacaataaaacgaatgcagggaataatggacaatttgtccggttgtaatctaaacattaaacaatgaactatgcttctaattatatattgttatatattttgaaacaaataaaaggacgacatgtcgacatgtgcattataatactaaacaacatctattttctttacgacaagaatacaaaatacatagaaacactgaaacgttaacatatacaacttacacacctgaatgtttctacaaggagatgatcttagatcagtggtaaaactatattttctttttttatataattcttaacggttaatccgataaaaatatatagaagtgtttcagaatagacttttctttaatatcagccgcctatatttctgactagcattttaaccaattaggtcaaaaaacaactaatagattttctaaacaaatatgtttttgttttttcttttttttttgaaaaatacaaaatgtttttgttttcttttagtcttagtgaagcaagggttgtctagaaccaatttgccaatttgttgttagtatataattttgatttacatcattgtaactgccacgtgttgcatccttacttagcttgtctaatatgtcctaacaatacaattctaccataattttctcacaccccttaaagaactttttgactatataattcaaaagtatataaaagtatgaaactaattttgaacaataaaagaaaattcatatcgttctttttccttgttaaagtaaaaaaataaaaatccagataatatttctcatcatgtaatgatcaacaagaaaccaatttaagactgctaaacatcgatgattaatgctgaaaaaattcttatcgtgaaactgagactactaacatcgatgattacgctattctaatattcgttgagacaacccaatactaattatattcttgtgttttgtgtatgtatgcactgatacatataacatatattgatatatatagctttcgtggagtcaccattgagaatggttggatccagtgcaagttccatactcgaaacttaatttgttttcatgcaagttgctccataataagatacatttatttgtttaatagggcagcaatatttgctttgtcagatttaaaatattttcaaattcacaacagttaaacaaatattgccgtgataaatagtaattattagattaatttttattttttacttattttagtttgaattgaaatcttgatccatactaccaacaaaaataaaccactaactaacatactacgtgtagttatttttaagttttcatagtttattttgttatgtattaattacttttaattataagtgttgattcgatattttctgaggaaatctatattaaaactcaattatataccatatttatttattttatttaataaaactataaattcttacaattttataaataatacaaacttgtgttttaggaagggatgttaaaactttatggttcttttggaatttttttaaaaatcaatggtagttttagaaaacaaaatttaaatagtactatttgcgacctttgatatatcaccctatatatatatatatatatatatatatatatatatatatatatatatataggtcatttgataagaagcttacgaacaaattatcttctcgtaacagttgccattttagaaagaaaaaaatcaaattccatctctcctactgccaattggaaaattaaaatcttattatgcaagttactaactcctctggttagtacatatacgagttgcataacttactgttattgttctttcttagttaggttagatactattgcagagtcatgtgcttctgtgtactccataatatataatttgagggacctattaaaagactaacaaaataaaactgttgaaatgacttgcaagttacaaacagagcaccaaagtgatacgacgaatatttcccatacaatgtcaccactagccatcattattggtgaattgattagctgctcaaattataagccgaatagagaaattaataatatcgagattaatatatcgttaaacaaataaaagtaagcctttgaataaaaatatgtagaggtccacagtgattagaccgaccaaaaaataacaatatttaatttcactgctataagaaagtttatgacataatgataagattcaaagaccaaaatagtagaattctataattagaggaaaatactattttcttttctcattatactatacttgccagcccattttgtcatttatcatgaaaattaaattgttttacatatcttcatttaaatgtttatagtaacaagttggaccctcctcgttatcaaaggtaatcgccttcagtgtttaataaagtaatacgattgaggacacaaagtgaatggtttaaaattaatttccgtgggatttaaagacgaatacaatgtgatcaaggtggtttgacgtctaactatagctagtctaaactagctagctaggctaacaaccagtaataatagctgaccaatcatcaacattcatttctttggatttaataaagaagctcaataacatcgactgactaattattaaaatgataataaaaactatttagtataataatcgtcgtccacgtcagagtttcacctctttctctccggctttgcatggctctttgtttctccttatctccctcccttacctattatacttcctctacaatttcattgcttcttgataagagctctctcttctttctatctcttgttctttaatttgtctctctctttttctctagcaatgcttggaagctatagagaagtgagtattagtgtctctctctttactttcactatctctgtttagatgtgtgtgtcggatatataaccggactaatatacgtataacttatagttattctatcttgaccattgatatatgcgaatcactctatggtattaataaggtt

SEQ ID NO: 13773 - DNA, 3000 bp, Unknown; identical to SEQ ID NO: 13769
  misc_feature (1)..( 3000): cDNA_ID_3031825_gDNA_ID_2214650_Annot_ID_188623 3000 nt of promoter + ATG

SEQ ID NO: 13774 - DNA, 3000 bp, Unknown
  misc_feature (1)..( 3000): cDNA_ID_3031834_gDNA_ID_2214650_Annot_ID_188618 3000 nt of promoter + ATG
gactgaattgcccctgtcagtgaagtcatattacctgtctccgttggattcacctactactttacaaccaacgtcttttgtcttattgcttaccaaaccaaatcatattttacgtgaaaaatacaaatattatcatatcttttcttcctaaatttatactaattgccgtaaaaacaaactatactacatatgatcaacaataacatgaaactatatgaaaaattcattaccttcaagctgtcaataaaaaaaatatcatcacctataaaatggtataaaacattcttttacgaggcacacttatatcaaaaagatatttgttgatgatttttattttgttatcttacttaaggcattgttatttgtcaatatttgttgaggaactttatagtttcaacaaagccggttcactatttctaaattttaatgaggtgtgtagttatataataatatttttgacacaaacgaaaaatgataaagctaataaccatgtgattatattgatcaatgttgtatagtactgcatcatgtgaataattattgctttgtatttagctaacatgttcctgatcatatataccatatctttaaatagttgttagtgtaggaaaatgatgattggtgttctcaagcggttttatcactcgagcttcaaagtttgaacatggacattcatttgtttaatttcttcggtctgttatatataacgttccagtccacaaaattatattttgtatagtatgcaagtggatggatttaaaatcattagattccgccgaaccaatggcaatgaggccaaacgttatgtagtgtggtggggtgcaattttatcaataacaaattgagtacatatacacaagattcattcataattgttaattattttattttgttttgaagaatttttgttctttctttgtaggtccgtttctcatcatatattcccgacatcacaaacatacaatgcaatttttgtaacaactacttcatctatatataatatgtctaaaaactagagtgttaatcaatttatctccaaatgcggtatatgtttgagtttccttgaatcacatattgtataaaacgtaagtgacacaatttacgaattccttaaactcgtaatgtgtaactcaggtacggctaatcgtgcgtgagctttccaatgcatcattagtccttgcatcatctatgcgaatcgaacgttttagttacttggaaaaatttacgtctctcaaaatccgatgaagaaaataaagttgtttctatagaaacttttttttttttttttggttaaagatgttatgaatctttgttatatgtatatgatgtatctagttcttttgttcattgtagataataagttcttaattaattagttataaagattacaaattttctagcacatatatatgatgtacatacacgataagaagcttacatatttaatgattacaaatttacaatattacatggtgattttgaacatctgtctctggccccatggcggattttatttgccgcttatatatgaaaaaagacaaaaaatatattgattaaacttattaatagtggctctttgtgtagttcctttttttgtttctttacgtgagtggctgagtgctagtggatgaatagttatgattaagcagtatggttcatcacattggtcattggatgatcccatgacaaatcataagctttttatttctccaaaacttgaaagttcacaaaactttatgatcctaaaatattttatgtatttagattctaaatgggtgtaactaaactagttgtattagatcatgcacgaatgctcttatttatcgtatatctatctggttaagttaatcactgttatcaaggctttgtttgtaaattatactgttatatagaagttgacatatacttataaaagcgtagtgatttattgtatcttatgtcatatgaataaggatcatttataaacatgataatgtcgttgttggtatagttaaacttacgtgcaattgcaagtaactttaatgaaaaactatttggtagagagaaaaagacagcgaagataagtatgaagtcgtgttatggatagactgtttatattgttttgtggatgtgaatttgtctcaatctaatattgtcacgtcctcatttttcgaaccattgtgtggcaatatcataaccctcattaaatgtcattagctcaattggtaaagagtataggcaaagcttagaagtcgccgattcgaatgacgtttaggacgaaactaatattaaatgcggtcatttcgggtctgagggggttacgagcttcggcgcagaacttcctgatattaaaaaataaataataatatcataaccctcatgacaatttttattttgaaaagaaaaaaatttgggaaagcagtgcgataaattgataccaatatataatcaatgaagcttatttattaaaacattttaaatgaaaaattgtttatcttatccatatatagcttgaaatgtagctcgtgtggaccaaagacaccaatgggtccattttatgtacctaagagtcaaaacatctatcctcaaagttcgaatatgtgaacgaaatggaaaaattatattttcaaatatagtttttccgttatattaatgttgatttttatgtcatcgtgattaatcgaagtaccttcttaaatagggcaacacctgtggcgatgggtccatgcaacctaacaacggaataataaagtttgaaattatgattacagattattataaagtatgtaacttgaatgatttttctccaaaactgaatgaatttaaatggctagtgcgtattttaaaaaaaataaaaaatgtttcaaaggagtgctattgttttcctagagattttatttttattactaggtgatagtaaatatttacatttataattagaaaaaattctttataaaaaaatagaggataacaaaaagctagataaaaaaaaaaagactctcagaaaaacaaacaaaaatg

SEQ ID NO: 13775 - DNA, 3000 bp, Unknown
  misc_feature (1)..( 3000): cDNA_ID_3031838_gDNA_ID_2214650_Annot_ID_188617 3000 nt of promoter + ATG
aaatatagatatcaaagagaatgaagtataagaaaaagaggaaacaatggtcaatgccaaacggatcaccttttttataagacatttccctaaattaaccatacataacaaaaaaaggatatttgatatttccatcgacccattttgtcaattttcaaacaatttttttcaatgcattgactaataatgtatagggattcacacattgtatttttgttttcaattattttcgttaggttttaaccatttatgtttctctaaggtctaacccaaacccatttgagttaaattttaatatatatatatattaaaaaataaaataaaagaacaaaaaagaaaataaaataaattctttttcctttataatataaagtacaagtcccttgcccaataaaattatgccacataagatttgtttataatttaaagaattatttaaaattttttaaaaaaaaaacgctcattttttttttctacatatttaaaaacaaaaaaatattcctagattttctcacacaccacaccatcattatctttggaaatttgtaaccaactcaagattttccaaaccgttttatcttcctctacaaaaatccaattcacgttaaatctatctcttgctcttgcttcctccaaaaaaaaaaaaaaatcattcccagatccatcgatatgaaattgtatagaaaaaatggtattcgatccaagtttattgtcttctatttttcttaggttaatttcactttattccagattcattgtttgttttttctttctcggaagagcacaatgtgagtttcactggcctctgttataaacatatatagaaatctgtaacaaaaatcattactaaaattctgtgacatgtgcagcgatcaaagaatcaatagcggaaaaagaaactacactgcattcatctatgactgaaagcttctgatcaagccatgaaattaaggtatcccaaacacgtatcttctctatgtttatcaatcttgctttaagttctaattctgcatatttcaaaggaaccatacaagtgttcctaaaatccatttgaatattcaaaaacttctctcaaatatcatgtagttatagaagctactgtctctaagcgcacgagagaaagctacacaacccacgtcagtttccatctacacatataaggtaataataatattttcatgtatctttaataatagctctatgtttttttctgtatttttcattataaaactcataactatgttatcatttaatatggtactaatttaatgggattgatttactattgcctcaaacatgtaataatttaatgattttttgtttttaacgtttttagaaattcatgagcattttaaatttgtggttaggtcataacaatttgctattacaaaaaaaagaaacactctaaataatataaaaaatagtttaccgtataatactagtagtaaataaataatttgattgttattcataaattttgaattctaaaatctcctgaatcaactcatgcaattgtcttaagaattacacgtggataaatcatgggcttatgagtcaggcccatttaaccggggtattttcgtagttaagagactagaatggtgggtatttcaggtaaaaggtctatggggccagatctgcgctttgtcgcgatgtcattatcgccaaagatatgcgatagcgactctcgtacaaagtctctcactcacctatattttttgttttcttatatttcaacaaaaaaacgttttattttccttttggtgtaagtaaaaaaacaaaacaaaacgttttatttctaaagttcagaaaacttatttataccaaggaaaaaatagataataaattttgagaagttggtgactatatattacttcacttattcaagaaatttaaacatggtaaatgttactttaaatgttaaatgatgtataagaaatgtaatgaaattgaataaatgtagttttaaagatgttttaattagtaagacaaacctagttagtgtcacaataattatatttttttttttgtcatccaaaattattaaagctcaagtaaaccaatcctgagggatattatttacaaatgtgatatgatgcggttcggtgcggatcttccgcgccaaattatacgcttttatattagcattataaaaaattatagataaagagaagtttgtgaattcttcattgtcgctttgcaatttctctaaatacacagtaaataccgacaattcggttagagaaaatatatctatttcgtataataatgttaactttgaggagattttgggtaaaataataacttttgttggatggatcatatcatgagccattaagaaaaagtccaaaacttttcttcttcaaagttggactcaagttagaaaaagaaaaaagagctagagagatataaaaatgaaaagaaagttcatggcaaaaaactgatatagacagagacacagagagagagaaacgtatctgaagaaaatctaaaaaattcgattcaatttttttcttacttttaaaagcaaaaaatctcactaaaacaaaagaagaagaaagaagaaagaaaatggaatacctacatttgaagtgatgagaagagattttgtgtataataataatgcaatgttcaatcctctcacaactcattacaggtaactaaaataatttctccatgtgcttgcttattagtcgttcttcctaatgttatgtttctctctgtgttctttctttctttggtcaaagctttaattttttttctattgttggatttgagacagtgaacatagctatgttcttgttccaataataaacaatcacgcctgtaaagagcttatgattgattagtgtgttttttagtattaattaatttctctgacaataattacttagtttttaattcttctctgtaagaaacctttggaaactgagcaaagttgcttcttttgagaaccatgcgtttctttctctcttttgttcttgaattcgcaaaaacatg

SEQ ID NO: 13776 - DNA, 3000 bp, Unknown; identical to SEQ ID NO: 13765
  misc_feature (1)..( 3000): cDNA_ID_3031842_gDNA_ID_2214650_Annot_ID_188616 3000 nt of promoter + ATG

SEQ ID NO: 13777 - DNA, 3000 bp, Unknown; identical to SEQ ID NO: 13772
  misc_feature (1)..( 3000): cDNA_ID_2704038_gDNA_ID_2214650_Annot_ID_136417 3000 nt of promoter + ATG

SEQ ID NO: 13778 - DNA, 3000 bp, Unknown; identical to SEQ ID NO: 13771
  misc_feature (1)..( 3000): cDNA_ID_2704034_gDNA_ID_2214650_Annot_ID_136418 3000 nt of promoter + ATG

SEQ ID NO: 13779 - DNA, 3000 bp, Unknown; identical to SEQ ID NO: 3112
  misc_feature (1)..( 3000): cDNA_ID_1568553_gDNA_ID_2214651_Annot_ID_136419 3000 nt of promoter + ATG

SEQ ID NO: 13780 - DNA, 3000 bp, Unknown
  misc_feature (1)..( 3000): cDNA_ID_1033841_gDNA_ID_2214651_Annot_ID_136421 3000 nt of promoter + ATG
ccaccgacaagaagacctacttcgccggatacaaagactgccacgtaaaacccggattccggatcgggtcctgatccaaattttgcgtgagtcaggtcccataccacccgaatatccggctttcgagataacttctttgatccattttttctccagaatgtcaagggtttgatttcgagccggaaggcgaagggaatggagtgacggtaacaatctagagagtgtagatagcaatttgtggagttgcatgagtagaaatgaaggtggagagagcgtcggaggaaggatcgagaccatgaaagaaagaaaacaccaacgttagtgtggtactgacaagttgtggtagcgtcgccggaggtggagatatacgatggatttgatggggatggaagagccgacggtagatcgtcgttgatggcggtggcggaaggatggaaacaggcggacaaaggggaggagccaccgcgaccaagagcagagattttcatttttaggtatagtcaattaatatgactggttgatcttatatacgcacatgcatacaaaaagacactaattatatgtaaggatatgactatttgagtatttatctatacttgagttggcttatgtgtctgaaaatgagttgtcatgttgtgaaaattcaaaagagtgggtcaatgtcgagaaattgaaagcaactttgtggataaattttatagaccgaaactgacgttcattgatattttgtgctggttttcacattatttatatgtagattatgttctagttcaattcttttgaagtcgcttgactttttgtctctttcctagtttccttaatcttttccacttatattagtttttaacgtttgtagtcacagtgaaagctaccaaaattctaaaaatggtaaagagaaatagaactgtatcttgttaaagctcggttttcatgttacttaacattacatatgttgtgtttgatagtataaaataataaatttgttatggataattagatgaaaaaattaaagagttttgcgataagtaagatatttgtttcttgttggtttaagagtcggtttgggtccatgatataacactaattaaccaatagttgtggccttgtgggaggtaaatgatccaacaaactttgctttactaactcacatcttttttcttttgaataactaagaggttttggcctaggccaatacatcctctcgggatgggactaaagcattttatagaattttctttcaaatgttattggaaccagcaacctctaggcttagctaaaatattttaccagttttgagctattgacacttgataactcacagtttttagatgtagtttctctaaatcatgcatataaaataaacatcatagagatcactagtagatgatttcatcaactagttctatattcgatacgattttacacgaaactcgtattttcgaaatgttgtacattgtatgatataaactttagaaagggaagatacaaaattaagttgctgactatatgctaaacctatagacacgtgaacaatgagatgacggcaaacatgtggatttaagtttgcttcggtttgtttcagtttgttctagtttgctacaacaaaactccaaaatattgttgatttggtggctacaaaaaaattataatataaaaatagaagatatgtgtttgattaaatatactaacatagttttgatcgtattaggtagagccatatttagataagtttgtggactgcgatgaagttatgaagccacacaatatgtatttttttttccctcatgcttgattcgttattttctctgtgatttgatatgtatgcaaatttatttattaatggttcctttttggattccagctaacaaaagaaaaggtttgaaaatgtccaactacaaatttaatatggaaacgtacaccaattcattgcgagattggtgcattactcgcttgctttttgtttcataccagacaattcaaaacatgtgattgatttctcaactttcattctctaatcatttagaggatacctaccaaaaattaatatcctccaaaattatttggccattgacattacaaataaagaaatgtctttggatgaaatatttcaaaattatttttattcattaaaacaataatgatttaaatactaagcacacatatagtgtgacaaaaatatgtgatttaaggatctcaggatacaaacatctctaaactagttttacaagcattcgaaaacacagctctaacaaaccaaatcactatgatattctcgaattacttactttctaacaagaaaagattgttggagatttttatttgcgttaaacgattaagttcttaatcgatgtaatcggtgtactagacgacttaaagaataggttagctatgatgttgagtcaatcaaccacatcccctccacaaatccaggagagttaaaatttaatcttttaccattcattttttccttctacaggttcgaaatcgaagtccggtccaatcttgaaaacatcaattatccaacatttttgtgctggaccgaagccaatggcaggccagatattataaccgaaggcctgaaagtaagttacaacgagatagtaagaagatgcttaagtaaatgggcctttgtggcccaatctataaaacctaaccctagcatcgtgtccccatataaaactcacctccatcgctttctacaagtttcttctccagatttagggtttctcagtgtttcggctcggcccagaacaagatcgcaagacttcaagatggtaaatcctttcacatctccttcattcttaatccttatacttttctattatcaattagtatgtaaatgttacggaagttcgagactttgaatcattttgatgatcttctctgcttcaaccttaatcatctacactgaattttatcttaatgttacgaaagtttaagactttgaatcatttttgatgatatcttctttgtatgaaacagccgtcgcacaagtcgttc

SEQ ID NO: 13781 - DNA, 3000 bp, Unknown
  misc_feature (1)..( 3000): cDNA_ID_1812649_gDNA_ID_2214651_Annot_ID_136422 3000 nt of promoter + ATG
caataataagagcatgattaattatttatgtatatgtaaatgacataattacatataaataattaatatgtgatttcagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataatttccagtgaaggaaatttctttgatatatgatattttcttactatcgtgtaagataatatatctatctatctatctattttgttaaaagcgatttataatttacaccgttttggtgtatatttctatctatccttttacaagacctatatatgttatgttatggtggtgtactattttaagtgagcgacatagtattttcttcatatagctaattaatcaacaacaatttcccaacttacaactatttgcgtactttaaacttatattgaaagagaactacaaaattatttttttgtacaagagaattatggtcttcggatcaataatttctctagatataatatgtaaagccaaccctataatttgtaaaatccatgatttgatataattttcttttaaaattgtgaattggcagacaaaaacaacattacattttgatttaaattcataactttgacttgctaaggaaacaccatgattcattttttgtcatttgttacatcatcactagaaatatttgatctaactttattatgataatagactacatactacatatgcagttacgattttaaatactacatatttaagcgtgtttaaactgtaaccatatcatataaaatgacatatctaaaagtgattttcaatattttgatatgatatgtgttgtagcacggataatgatctaatttttaagtaataagcttgttcattacaaaagagaagaaagtagtattgggccatgattatgtaaggacaaaataggaagatgtggaagaagccattcgagggttttattacaaaaacagagtatataattggtcataatgttttattcacttaatttaacattattgcattatattttcatgaacacatatttctttaactaaaaatatacacatatttcttattgtagatgaagtgaaaagaacaatatttgggttcacatctatgggtgaatccttttaatcaccccctaaaataaaaaaggtgccatatttctatttttagagaaagatatagagcaccattggagtggttttgctccaaatatagagtttagagaaatatataatacaccattggagatgctctaaaatgaatttatttatttatttagatggaagattctaattggttagaaaaagaggaagtgaataataggattcacctataagagtgaacccaagtatttttaagagataatgtgtaaagtaaatagatggtcattgtgtgaattatgaatagaaccatggttttccatttttaattgcttaacatagggtaatcaacaatggggtttaatatgtcaatagacaatagtaaagaaagtatttgatctatcccaaatctttcttcgttcgttagttcatcactttctttctttttggttatattaatggtagagaactaaaaattcaactttttattcaaaagctccctttctctttccctcctttatttgccataaaagtgatttcaagaagacagcgagagagaaagtgatagttcgttcactcttcgctttctcaagaatttcaaaacaccaaaaaagtctttagattgaatttcatcaaaaacttttcttttcttagcaaaaaaaacaaaaaaatgagagagcttcttcttcttcttcttcttcattttcagtctctaattcttttgatgatcttcatcactgtctctgcttcttctgcttcaaatccttctttagctcctgtttactcttccatggctacattctctcctcgtattattcctcgttgacttcatttcattttatttttttagtttctgtgtttcttgatttgatctatgcctatgcgttctcgaacttcgaaaaatataaagaaaaaatagtttttaaaacttgataaattaaatgctatttatgagctactcacttcttgtctttttgtttttgtttttaaaaaaaaaaattgaaaatattatatttttcttatcagaattctttcttgaatttcgaaatatgggtttgattcagaatttctaagaaccatacttgacaaatttgacagttgaaaatcattaaaaggatttttttctgtgtcaggaatccaaatgggaagtggtgaagaagatagatttgatgctcataagaaacttctgattggtctcataatcagtttctcttctcttggccttataatcttgttctgttttggcttttgggtttatcgcaagaaccaatctccaaaatccatcaacaactcaggtactttcatcagtaatgagagaatatgcaataagtttcaatcactctatgttttcaatggaagttcaagtttcttgattgttctttgagatttagtagttcattgattcttatcactttcaagtttgtgtgagattatgtgttgatcttggtgcaatgttttatatgaagattctgagagtgggaattcattttccttgttaatg

SEQ ID NO: 13782 - DNA, 3000 bp, Unknown
  misc_feature (1)..( 3000): cDNA_ID_1808945_gDNA_ID_2214651_Annot_ID_136427 3000 nt of promoter + ATG
aacaaactataactatacgatagggtattaataaaacaaagtaagagttctagatatcaaaatagtattatgaaaataaggactgagaatgtaaacgatacgtactcttcctctatatgtgcttgttgaagccattgaacaaaggcccaaggcctatttagaacaacatatccctgcacattatatacaattcatcatcacatgttttttttgtgtaaatatttctttaagaaaatttcatcatccttggaataaaatttacacatattatcatttgttttacgaggttttttcatgtttgttttaaatcttataatttcataaaagatgcttatgtttattaaaaataatgttttaatttttttttgataaagaagaagttttatcctcaacatgatttcgtgaacatgcattacttattttgacaagtcaatcaataatataatacaagatttgagattgtttttttttacgttactattttcaattataaaataaacctctaaatcgaaaaataacatcatgatgattctaaaatctagctataaccaatacacctttcaccaataacaaagaattaagtaagataaagaaccttgtcaacaccggagggaagagggtcagcaacgaaagtagggatctcatccatgagtccatcgggtcgacccgaatgcaagatccgggtatacccgcccatatccgacccgggttcgtccctgaacctgttgtaccaataatacatgacccgacactgccacgtgctgtacacggaatccgtggctgtcaccgccgtgtgaaacagtctctttgtcttctttgacggagtcttgacggtatatgtgatgtcatctccggaagaagctgatcggcgaccggggagttcttgccggagaggaggatcatcggagactatgtagttgtatctgattattagaaataacgatagagtcatgagaattgggaagaagtacttcccacggaatcccattttctctctttttctgtatcaaaaattcattcatgtgcatatgcatttgctaatgtgtatatattatatatttttgatgtttgtgacaaggaagaaggcataagacagtttcaagttgtatgaaaagtcgtcgcttattgtgttattttgaaatgaggagtagttgtcagaaagtggctggtcccacaacgttctggtcttcgtttcattttctatacatgtatgagttatcaattcagttttcctatgatttgatgttataatagtattgcttttgttgttcaatatgattctacttgtttttatttgttttctcactttgttcttgtcggggaatatttcataagcacgaaaggggtttgggttctggacaaaagatggctaattcggctactacgaaccaaatgtttggtgttggatccgaccatcggattttgggtaataaaagcccaaggaaaagaaagctcatcttaacaatgaagataaatcaaggattataaaaaaaataatcatttcatacttcttaaagaggtaattgatcgtttgtaaggaaaattacaagagtcaaaatgtatggttaaatctctaggaagctgttgtgaatagatgttctccattaatgttttctgcttagtgtaactcgtattgatttaattgttagttactttcatggcttatgtgatacaagccacttgtaagattaatcaaaagttgtgaatttagtagataactcatatcaatcgagtatttaagactagtacaacaattgtctcacgcatcaaaataaggtggcatgcttagttaaacgcaatgcacatgtcttttcagtttaatatttctttagtttctataccaagttaatagtatcgacttacattgtactcggtttccacttgtgatcttcaaattgatcttcattgttttggtttaaccaggaagttgctgctacctcaatgaacatgaaaatgattgagcatatgatttgctaaaccataaataaaccaaacaatttatttcggtttggtttggttcggttttcggttattttactcacccactacagaacaaaactgacatatagaacttacacaaaatttctaataaaaatttttggtttcataatcttaaaatacaaaataaataaataactaaaacagtttttatataaccaaactgaactgaatctaacaaactaaaattcattaaaatttattttagttgtatgagagatataaccatattatataaatataatattgagtgaattattatttgtttctatttttagacatttttttgaaacaaaaaatgtaacccttatttaccactacatatactttaatctagttagataatatatacacatttaagacaacaaatctaaatttctaatacacataatctaataattttcttatacatttatgttataaaatacatctattctaatatcacacataaaaggattacgtgtcctaaacctgaaaaaaaacacataaatgtctatataggagaatctgctgtacattaatatttttattttatccttgtttttcttttcaattttgtttgtcttctttcttgtatctgttccattgcataactataattacctaaaaagttaataataacatatgttaataccgtaaaacattaaaagttcaattattttctttgtgtgattaaaacaaacatgtaaatttcctaaatcataactgtactaatatttaaagtttagaacaataacaattaattaactcacgcggtaaaagtgaaatctacaaagattccattgtccaataattcacttcagaaattgtaagagaaaacctggttttgtgtgtatcatcaaagtctaaactcattacagaaaaactgcaaaaagtcttttgtgggtcatagattttctaaaaagacacatttaagtttattgtcctccttctctctctctctctccactgcaactctttctcactttcactcaagattgcgtcactgtagtagtagtagta

SEQ ID NO: 13783 - DNA, 3000 bp, Unknown
  misc_feature (1)..( 3000): cDNA_ID_3438027_gDNA_ID_2214651_Annot_ID_136428 3000 nt of promoter + ATG
cgttggattctagtgttgtacttgttagagatgtgattaaggatcggtttcctgctctgaagggttttctgatcaaatatagagactcagagggtgatttggttaccattactacgacggatgagctgaggctggctgcgtctacgagggagaaacttggctcttttagattgtatatagctgaagttagtcccaatcaagaaccaacttatgatgtcattgataatgatgaatcaactgataagtttgccaagggatcgagtagtgttgctgataatggaagcgtcggagactttgtggaatctgagaaagcatctaccagccttgagcactggattttccagtttgcgcaactgtttaagaaccatgttgggtttgattctgattcttacttggaacttcataaccttgggatgaaactgtatacagaagcaatggaagatattgtcactggcgaagatgcgcaagaactctttgatattgctgctgataagtttcaagaaatggctgcacttgcaatgtttaactgggggaatgttcatatgtccaaggcaagaaggcagatctattttcccgaggatggttcaagggaaactatactagagaaagttgaggccggatttgagtgggcgaagaacgagtacaacaaagctgcagaaaagtacgaaggcgcggttaaaattaaatctgatttctatgaagctcttctagcactaggccaacaacagtttgagcaggctaagctttgctggtatcatgcattgagtggcgaggtagatatagaaagcgatgcttctcaggatgttctaaagctctataacaaagctgaggagagcatggaaaagggtatgcaaatatgggaagagatggaagaacgccgtctaaatggaatctccaatttcgataaacataaggaactgctacagaagttaggcttggatggaatctttagtgaagcgtctgatgaagaaagcgcagagcaaacagctaatatgagttcccagattaatcttctgtggggttccttactgtatgaacggtccatcgtggagtataaacttggcctaccgacatgggatgaatgtttggaggttgcagtggagaaatttgaactagctggagcttctgcaaccgatattgctgtaatggtaaagaaccactgctcaagtgacaatgcacttgaaggtaattacgtttatctataaaaactataatctagcgaaattacctgcaaatattggcagtgaatataacaatcaaacaataactgtaggtatgggattcaagatcgatgagatagtacaggcatggaatgagatgtatgatgccaaaagatggcagattggtgtcccatctttccggctagaacctttgttccgaagacggtcaccgaaacttcatgatattttggagaatgtgttttcagggcctcagtgacgaaacagtcatcatatcagccggcatcagttttcagtttttataaaggtttgtctgaaaattcggagtttttcaggttggtgtttgatgaaaaactaatctcttgatctgttccagcaattgttattacaggtatagtattcactattcattgggagttatacgcaagttttcttcgatttttggtttggttctcagcttatggaagcattgaagcaatattttttttaatctcttggcgggtattgctgtgaagaagatgagcgtgatgttattttttttgtgcagatgggttcaacatatttgttaattcattatttcatttttggtgggtttgtaattatatcatagttttgtatttttttttttttttttggacaaaagttttttaacttttttattcatcgattttttggattagtctttgtatctatggattggattggttattaattaataagatggtgaatgtttttggcttgtggcactcagaactgttaaccatcctacaattagaaacgacgtgctgtttctattcttgaagtagaatggcaagttgttaacaggcatggtagattggtagtgtagggtgagctacgatagactcgatgacgttgattccaaagaatagccgttcgttcttgaaaatcgttgattcacgaagaataaccgataacaaggaagatacgaggatagaaaacgatgctcaaaagaagaactcaaagctctatattaattcaataatcaaaagctgtcctacaatagagcatagcggctaacttaaatagaagacacaaaacataaaatcctagcctaacgtcagtgccaaagctcaataaacaatagaaaatcaacatgaaaataaagcccaaaaccataataaagtaaccaaggatctacactacaccacatgggcatatttaaccagcatagaaccgaacagaaccaaaatttgggatttggttcggtttcgggtatttatttcataagaactgaatggttccaatttgtagaacctaatggtttttgatttggttcgtgtaaaacccacagttctttagttcggttcagattctagtggtttgatcatattattatggttttgtatgggtattttggttaaatcgggtagtttggttactcttggttacacaacaaccaatcgaaaccgaaaccttttcgagtcttatttgcttcaaatttgaataatccatatggaaccgaatattaatcggttccaaatagatttaccaaatttacataccagaattacctgaaaaccgaaagaaccgatccaaacgaaaaaccgaagcccaggtacttgttgtcatgcgtatctgtaaagagtgtagtaaggaaaaacagcacgaatgtttataggaaaaaataaacacggcacacagttttgcactgagtttcttccccgagttggcgaagaaacccagagaagtaacacaacacagaagtagaatcttctttagtcatctcccgcaagtttaggaaagctctgaaattagggtttttcgtctgcgatcacgatccttcaattactttgcgataatg

SEQ ID NO: 13784 - DNA, 3000 bp, Unknown
  misc_feature (1)..( 3000): cDNA_ID_2704102_gDNA_ID_2214651_Annot_ID_136432 3000 nt of promoter + ATG
ctccatcagcatctaccttcagatcattgaccctcgtggaaccagttcatctctgtgggactgtttcgctagctaccaactctctatcatcaaccatgtcgatgattctctcacaatccgtaagaattcttggcatagattctctaataagaagagatctcatggatggtgcgatttcactttaaactctagtgttttggatcctaagatggggtttttgtttaacaatgattccttgcttatcacggctgatattatgattctcaatgagtctgtgagctttagtattgataataacaatgagtccgtagttggatcaatgactgatgtgttgagtggaactttcacttggacggttgaaaattttagcatgtttaaggaaatgataaagacacagaagataacgagtcctgttttcgtagctggggagtgttttttgaggattggtgtttaccagagtgtggttaatgcgcaagagtacttctccatgtgtttggacagtacagataccgaaaagagtgttttatcggacaagagcagttggtgtttatttagcatgtcagctttgaatcagaagcatggttgcactaacatgaataaagagtcttatgggaggtttgctgctgataataagagtggggacaatacaggattgggatggaacgattacatgaagatgtctgactttgtgaacccggacgcggggtatttactcgatgacaaggctgtctttagcacctcatttgatgttatcaaagagttcagtagctttactaagaatgggactggaaatggatacatgggaaagttcagttggagaattgaaaatttcacaagcttagttgatcttcttgagaagaggaagataaccggtctttacatcaaaagtaagaggtttcaaattgggaaccgggattgtcgacttattgtttatccccgaggtatgtaagttcacactagatttctcattgcatcttatgttatgctgttttatatggtagagactataatgtcggttttatattgttgttgtaccttactcttgatggtctcagggcagtcgcagccaccaagccatctttctatatttcttgaagtgacagattcacgaagctctagtagtgattggagttgttttgttagccaccgactatcagttgtgaaccagagatcagaggagaagtcggtgacaaaggaatctcagaatcgattctcgaaagccgaaaaagattggggttggcgtgagtttgtgacacttactagtttgtttgatcaggactctggatttcttgttcaagactctgttgtattctccgttgaggttcttatgttgaaagaaacatctctaacaaaagactacacggaggcagaatctgctagttcagtttcacaaattgataaaaccgtgaaaagttcatttacttggaaagtggagaatttcttggccttcaagggaataatggaaaaacgaaagatatttagcaaattctttcaagctggtggatgtgaacttcggattggtgtatatgagtcctttgacaccatatgcatatatttagagagtggtcaatctgcgggtaacgatgtggataataatttatgggttaagtacaagatgggtattctgaaccaaaagaatccggccaaaagtgtgtggaaggagtcatctctatgtaccaagacatggaataattctgttctactgtttatgaaggtgtctgatatgttagaggctgatgctgggtttcttgtgcgtgacactcttgtgtttgtgtgtgaaatattggattgttgtccttggtttgagttttcagacctagaggttagttcatactttatttctttcttaaacattgtaattatgttactaaacattacattatggaactattgttttggcctttatttttaggtcttggcttcagatgatgttcaagatgccttgaccacgaatcctgatgaagttattggttctgagaaaagtgaggaagacacattccgtaagtgatttcgtgtctctatcagtttctcgtctttgttgcgattagagatatagtttgctaatcttggctaattaacctaagaattttcctcatgcaggtcaggtcagtccgtgagaggcttaaaagtctaggtgctgatattgccgaaaatgagacttaggacatcaacggtgacttcgttcgtgggtctttgatttaggccattttgtttagattttgaataaggcttggttttatattctactttttggagactagtgtgtttaagttttaaggcttaatgttggttgaaaataaaaaagaagcttaaagtttagaattgacatttaaaagatttattaatttatccaatttagttaaaaccatgatttacaaaattgtttattacaattccttacctttataacaacaatacatccataatcaattaaaaaaaaaacaaattaggaaaatgaagcttcatcaaatagtgattttctactttttctatggggtcggagatagattgtgaaataaaaacacatatgttttataaaaaaaccatgaacttatgactctattgttaaccaccataaataaatatgtttggtttattaaacaatgtatatctcttaggaatggatacttctagattttgatatttctaatttcttacaaaatttgtgagatgagatgataactacatcaaacttttttcaggtctaaaaaatgaaataaagcatgaaatatgttaccaaaaaaggaattttattttttgtgataaaagcattttggacaacgaaaatcaaattgaaaagaaaatgaaacaaaaggcattgggagaagtcgaggaggcgcatgttaacacaccatgcgcacgttaaatcctgtctttgccctctctctgtagcgaaacaaaaaaaagaaaattgatcaacctagataaaatagcagaagagaagaagctgtgagaggaaaaaaaaaaaaattgaagacaaaaaccgccattgaaatgatg

SEQ ID NO: 13785 - DNA, 3000 bp, Unknown; identical to SEQ ID NO: 13783
  misc_feature (1)..( 3000): cDNA_ID_3438027_gDNA_ID_2214651_Annot_ID_188645 3000 nt of promoter + ATG

SEQ ID NO: 13786 - DNA, 3000 bp, Unknown; identical to SEQ ID NO: 13782
  misc_feature (1)..( 3000): cDNA_ID_3031892_gDNA_ID_2214651_Annot_ID_188644 3000 nt of promoter + ATG

SEQ ID NO: 13787 - DNA, 3000 bp, Unknown
  misc_feature (1)..( 3000): cDNA_ID_3031896_gDNA_ID_2214651_Annot_ID_188643 3000 nt of promoter + ATG
agaactcaaaatgctaagcagtgaaaacaacaaagccaaatcataacttgtaatattttctcttaactcacattgcaataacagtgaagatgaggaggaagatgagggagacaacataagcaactttagagtatccaacagaattggttctatggcaaatgtgacacatacagatgactaataaacagatgccaaacccaagaaaccaaacagcagcaagaacaaagagaggaacagctgtatagctcactgactgcaatatcaaaacacataatcaacaaatcacagcaacacacaaagaaaaaacaacaatctaattgaagtggagagaatcttacagcccagtaatgttggttgctgatattccatcctccagtatatttctcaaaaccattgagaggatcttttctatatgttctttgagcagctaaagctactgaagcaacttcaattacttgagggttgttgaaacctgcaggtcctaataatggtgcctctgctactataaatttcattacagaaccggttttctccgaagaagctgaaaagagacgaatcagattgaaattcaagaaacaaaaaaattgtagtaaagactgaaactttttttctgttatctcaaaccctagaaattgcatatagatgatgttcaagagtcatcaagttctagaagctactgagaaaattcagattatagacaacccccattgtgaaattagtcgaaaatctgtaaagaattaagcaaagttttgaactttttgagcattttcatggaaacaagaaacagagaatgtagaagaagagagaaagatttttttttcttttttggtaaaaaagagagaaagttttatcaagaaagaacctaagagaggaaacacaaacctgcgggaggctgagtaggagaaatgtgaatagtggaagctccatgagaatgagaaatagaaagagaggtaaagaagcaacagaagagaagaagaagagacattactactactactacagtgacgcaatcttgagtgaaagtgagaaagagttgcagtggagagagagagagagaaggaggacaataaacttaaatgtgtctttttagaaaatctatgacccacaaaagactttttgcagtttttctgtaatgagtttagactttgatgatacacacaaaaccaggttttctcttacaatttctgaagtgaattattggacaatggaatctttgtagatttcacttttaccgcgtgagttaattaattgttattgttctaaactttaaatattagtacagttatgatttaggaaatttacatgtttgttttaatcacacaaagaaaataattgaacttttaatgttttacggtattaacatatgttattattaactttttaggtaattatagttatgcaatggaacagatacaagaaagaagacaaacaaaattgaaaagaaaaacaaggataaaataaaaatattaatgtacagcagattctcctatatagacatttatgtgttttttttcaggtttaggacacgtaatccttttatgtgtgatattagaatagatgtattttataacataaatgtataagaaaattattagattatgtgtattagaaatttagatttgttgtcttaaatgtgtatatattatctaactagattaaagtatatgtagtggtaaataagggttacattttttgtttcaaaaaaatgtctaaaaatagaaacaaataataattcactcaatattatatttatataatatggttatatctctcatacaactaaaataaattttaatgaattttagtttgttagattcagttcagtttggttatataaaaactgttttagttatttatttattttgtattttaagattatgaaaccaaaaatttttattagaaattttgtgtaagttctatatgtcagttttgttctgtagtgggtgagtaaaataaccgaaaaccgaaccaaaccaaaccgaaataaattgtttggtttatttatggtttagcaaatcatatgctcaatcattttcatgttcattgaggtagcagcaacttcctggttaaaccaaaacaatgaagatcaatttgaagatcacaagtggaaaccgagtacaatgtaagtcgatactattaacttggtatagaaactaaagaaatattaaactgaaaagacatgtgcattgcgtttaactaagcatgccaccttattttgatgcgtgagacaattgttgtactagtcttaaatactcgattgatatgagttatctactaaattcacaacttttgattaatcttacaagtggcttgtatcacataagccatgaaagtaactaacaattaaatcaatacgagttacactaagcagaaaacattaatggagaacatctattcacaacagcttcctagagatttaaccatacattttgactcttgtaattttccttacaaacgatcaattacctctttaagaagtatgaaatgattattttttttataatccttgatttatcttcattgttaagatgagctttcttttccttgggcttttattacccaaaatccgatggtcggatccaacaccaaacatttggttcgtagtagccgaattagccatcttttgtccagaacccaaacccctttcgtgcttatgaaatattccccgacaagaacaaagtgagaaaacaaataaaaacaagtagaatcatattgaacaacaaaagcaatactattataacatcaaatcataggaaaactgaattgataactcatacatgtatagaaaatgaaacgaagaccagaacgttgtgggaccagccactttctgacaactactcctcatttcaaaataacacaataagcgacgacttttcatacaacttgaaactgtcttatgccttcttccttgtcacaaacatcaaaaatatataatatatacacattagcaaatgcatatgcacatgaatgaatttttgatacagaaaaagagagaaaatg

SEQ ID NO: 13788 - DNA, 3000 bp, Unknown
  misc_feature (1)..( 3000): cDNA_ID_3031910_gDNA_ID_2214651_Annot_ID_188637 3000 nt of promoter + ATG
aagactcgaatttgggacctctcccatattcagtcgcaaggttaaccaacggagctatcatctactttttcaaaccggtaaaggaatatcatctatttttttgttatgataacgtatgcaccaagtcaaattctaagtaagttactacacaattgtgtaaattgtgagtcatactcttgttgcatacgcgttttttccttcgtcttttgttttttcctctgtataatacttgtatcaagcatctactaaatcatcttataattatctcattggttgtttaagcacaatcatatagggcttattttgcacccttgttctaattctggtggcttttgccttttttctaaactgattaaatctccaatgaggcattgtttgttaagaaattttcacaaaacacacttttttaccctttgcttgttcttactactctactggttcctttgcaacgacgagtttctggtctgttttgaacaaaacaaaaccaaaactctgattcttacacactttcatatatcctcaaagccaattggttgctttatatacaaataaaattttttgataaagataagttgagtgtgtttttacttcctccaagcatagataatcaaagagaaccaactcttagacccgaagctcctctcatcttcttccctacaactagaccactccatcacagaagacatcctagaagaagaccaatgactatacgtactcgcccaaaacgacggtgttcgacaattctccttccgtaaaatgacatcgtctcttacacgcttgttcatcatcaaaacgtcgtttccttcaacctcttggttctcaaaccggagtaagaacacggcgggaatcttatccggtttaaccttatccttgccaccaaacagccagttgaaaacatcccatgatatctgtattgtcacaccatcgatcacgatctttgtgtttcctctgaatttccattgaagctgactaatctttaggacactcttatcgtctacgctaaaccggagactagcatcgtcgttaacaaccttaacgtcgatactaatctctctaagttttccttgaatcatgattttcgtagagtaaactctgtttccaaacagattctctttcttggacaccaagatttgtctcctcggtctctgtttcaagtttcctccaccgacaagaagacctacttcgccggatacaaagactgccacgtaaaacccggattccggatcgggtcctgatccaaattttgcgtgagtcaggtcccataccacccgaatatccggctttcgagataacttctttgatccattttttctccagaatgtcaagggtttgatttcgagccggaaggcgaagggaatggagtgacggtaacaatctagagagtgtagatagcaatttgtggagttgcatgagtagaaatgaaggtggagagagcgtcggaggaaggatcgagaccatgaaagaaagaaaacaccaacgttagtgtggtactgacaagttgtggtagcgtcgccggaggtggagatatacgatggatttgatggggatggaagagccgacggtagatcgtcgttgatggcggtggcggaaggatggaaacaggcggacaaaggggaggagccaccgcgaccaagagcagagattttcatttttaggtatagtcaattaatatgactggttgatcttatatacgcacatgcatacaaaaagacactaattatatgtaaggatatgactatttgagtatttatctatacttgagttggcttatgtgtctgaaaatgagttgtcatgttgtgaaaattcaaaagagtgggtcaatgtcgagaaattgaaagcaactttgtggataaattttatagaccgaaactgacgttcattgatattttgtgctggttttcacattatttatatgtagattatgttctagttcaattcttttgaagtcgcttgactttttgtctctttcctagtttccttaatcttttccacttatattagtttttaacgtttgtagtcacagtgaaagctaccaaaattctaaaaatggtaaagagaaatagaactgtatcttgttaaagctcggttttcatgttacttaacattacatatgttgtgtttgatagtataaaataataaatttgttatggataattagatgaaaaaattaaagagttttgcgataagtaagatatttgtttcttgttggtttaagagtcggtttgggtccatgatataacactaattaaccaatagttgtggccttgtgggaggtaaatgatccaacaaactttgctttactaactcacatcttttttcttttgaataactaagaggttttggcctaggccaatacatcctctcgggatgggactaaagcattttatagaattttctttcaaatgttattggaaccagcaacctctaggcttagctaaaatattttaccagttttgagctattgacacttgataactcacagtttttagatgtagtttctctaaatcatgcatataaaataaacatcatagagatcactagtagatgatttcatcaactagttctatattcgatacgattttacacgaaactcgtattttcgaaatgttgtacattgtatgatataaactttagaaagggaagatacaaaattaagttgctgactatatgctaaacctatagacacgtgaacaatgagatgacggcaaacatgtggatttaagtttgcttcggtttgtttcagtttgttctagtttgctacaacaaaactccaaaatattgttgatttggtggctacaaaaaaattataatataaaaatagaagatatgtgtttgattaaatatactaacatagttttgatcgtattaggtagagccatatttagataagtttgtggactgcgatgaagttatgaagccacacaatatgtatttttttttccctcatgcttgattcgttattttctctgtgatttgatatgtatgcaaatttatttatta

SEQ ID NO: 13789 - DNA, 3000 bp, Unknown; identical to SEQ ID NO: 3112
  misc_feature (1)..( 3000): cDNA_ID_3031914_gDNA_ID_2214651_Annot_ID_188635 3000 nt of promoter + ATG

SEQ ID NO: 13790 - DNA, 2762 bp, Unknown
  misc_feature (1)..( 2762): cDNA_ID_2704491_gDNA_ID_2214652_Annot_ID_136436 3000 nt of promoter + ATG
aagcttgaccattaaacaaacagaaccttcttgataaaatgctcgaattcaaaatttaagtaccgattggtcctagaagaatctgtaaattaaacagctcttggtaagaaccaaacctagctttcaaaacatgaaataacaataagaaacctttttcgattgaacggcgaaatatatccattgaagatgttgagagtgagaatcgaagacgaagaggtgcaattactcgcagtttttttttttttgtaagttaattattaatttttgacttcattaaagttaattatttgctgaaaaaaaaaaaaaaaaaagttaattatttagtatcttcaaatataatatttaaaaaaatctagccatcttaatgcattttaatgaaaatcctacccaagttttttaaaggtcaatttaaaaagtatcagttttgatttttaattatattcaatatttgttaaattttgtttcatatgttaatattaaaaacacaatctatttcctaaacatttatatacagatcttttttaaaaaaggttagtcaaaaactgttggaaaagctaatctttttttaacaaaaatagtaaaatactcatatacgtaactttgggcctttcttaaatggctttgggcctttcgtaaatgggcttatgggcttaagtacttcaaatctgatagtatttggtttattgcaacaaaaacaataaatggaaatagcgatctgagctgaccaaccacagtcgcggacagagctaaaaccaccatttgaagaaggagaagaagaagaagacgattcggtgaaagcgaagatgggtggaggaatggaaacgaacaagaacaagttcatcgaggactggggatctgctagagagaatctcgagcacaatttccgctggactcgtcgtaacttcgctctcatcggaatcttcggcatcgctctcccgatcattgtctacaagggaatcgtcaaagatttcgtgagtttaaatctctctatctctatctcattctcgatcctatttgcatttcgaatcctcccgagttagatatctgttttgtgccctaatttttcatgtatcgtatggaattggatcgtttgatacatttgaaattggggtttaattttagctgtagatgcatttgaattagattagttcttttgctgcaacgattggattcggaactggatttcaattttcacctccatactagtattcttaggtgatgatggttcgatttcagattgattataactcaaaattttcgagaccgaccaatgaaagtctaagattggagttagggcagaagaaatttagttctcttttagcttgtaaaaattggatctttggctaaaaaaatggttttaactgctttctattgttctgagtttgagtctgagctgatttggttatgaaaaattatgtatagtggactttcaaggttcttaatctctcagcagttcattgctacaatccttgaggattcttcctccatagtagtttctactctgtgtccttgaatatagattcttgttaggaccatgtttatgtggttgatgatctatgccatcccttgttagtggaatttgtctatgacgattgagatggaaattttttttatgtgttacttccaatacaattgtgtagttattgtgattaatatactaagttcaatctaatggactctaaactcattttttgatagcatatgcaagatgaagatgcaggcagaccacacagaaagttcctctgaggttgtttgcaagaacactctctgcaataaagtctcagcaatgtgaaatttcaagacgaggatgttaaaacccgcttttgttttttcatttcaatcaacatctggaacccaaggatataatttattttttggaaaagtttgttgtaatgactacactttgttatgcaaataaacaaaactcagttttcccttgagtttgacatacttattgtgtgtgttgattcagcatatgcaggatttaaacacttgttctagaggcacaaaataaaatgaagcattgaaccaaatcaaggtccgaaacaaaataaatggttatcctgaaagcaaacccctgaacttggatatgagtcaaatggtgtatgtgggtaggtgtatagtcttaacaagtaatgctcattgtgaacttgaagcaaaaataccccctcactagtcactatgaaaccatgtctttaactttaacattaagttttgatctatggatcgtcgaatggatttataagttcaacttttgtttacaaatatagttattttcttaagaatttttttaacaaaataaaacaattatgaacaataggtgaaaaaatggcgggaggaggaaacagaaaggaagggcaacaaagttaacggaatatataaaaaaacacaacaacgaacagattgtcttaaccaaaaatagaaagatttctccaatccatccaatatttgtttccctctcaatctcctctcctctcttttaggactttccctctttcttcaaacatacaacagattaacaaatagaaaacgaagcacaaaagatatcagaagaagagagaagtctcctcccaaaaaaaccaaaaaaaaaaaaaaaaagagaaagaaaagaactcgagtgcaaaaagcttctctcttccttcccatggggtgcatttgaactaatctcctccttgaaatcgcttgattgattgttataaatcgattaatcgattcaaaccgttggatattattccaaaacaacccaaaaagagaatcccatg

SEQ ID NO: 13791 - DNA, 3000 bp, Unknown
  misc_feature (1)..( 3000): cDNA_ID_2714082_gDNA_ID_2214652_Annot_ID_136437 3000 nt of promoter + ATG
ttacaccaacacggggtatacgacaaggagatccgttgtcaccatatttattcatcctatgtggagatattcttagtcacctaataaatggaagagcgtcaagtggagatcttcggggagttcgcattggcaatggagcaccagcaataacccatttacaatttgcagatgattctctatttttctgccaagccaacgtacggaattgccaggctctaaaggatgtgtttgatgtttatgaatactattcgggacagaaaataaatgttcaaaaatcaatgataaccttcggatcgcgggtctatggttcaacacaatcaaagctaaaacaaattctggaaattccaaaccagggtggaggagggaaatacttgggcttacctgagcaatttggtcgtaaaaagaaagaaatgttcgaatatataattgaccgagtaaaaaaacgaacgtcaacatggagtgcacgtttcctctcgccagcaggaaaagagattatgctaaagtcggtcgccctggcaatgcccgtctatgcgatgtcatgcttcaaattacctaaaggtatagtttcggagattgaatcattacttatgaatttttggtgggaaaaagcttcaaaccagcgtggaatcccatgggtagcgtggaagagactccaatactcaaaaaaagaaggcggcctgggctttcgagatctcgcaaaatttaatgatgctttacttgccaagcaagcatggcgtctcatacaatatccaaactccctgtttgcacgtgtcatgaaagcccggtatttcaaagatgtttcaattcttgatgctaaggtaagaaaacaacaatcttatggatgggcatcgcttttagatggcattgcacttttaaaaaaaggaacaagacatttgattggtgatggacagaatattcgtatcggattggataatattgtggactctcatcctcctagaccgttaaatacagaagaaacatataaggagatgacaattaataacttgttcgaacgtaaaggctcctactacttctgggatgattctaaaatttctcaatttgtcgaccaaagcgatcatggattcatacaccgtatctaccttgctaagagtaaaaaaccagacaaaattatttggaattacaatacaacgggagaatatacggttcgttctggctattggctccttactcatgatccgtccacaaacattcccgccataaaccctcctcatggttcgatcgatttgaaaaccagaatctggaatttgccaatcatgccgaaattaaaacacttcctttggcgagccctatctcaagctcttgctacaactgagaggttaactactagaggaatgcgtatagatcctatttgtcctcgttgccatcgggaaaatgaatcgattaaccatgctctctttacttgccctttcgcaacaatggcttggtggttatcggattcgtcactcattcgtaatcaacttatgtcaaacgactttgaagaaaacatctccaatatcttgaactttgtccaggataccacaatgtcagatttccataagcttctcccggtttggctcatatggcgaatatggaaggcaagaaataatgtagtattcaataagttcagagaaagcccgtcaaaaactgttttaagtgcaaaggctgaaacacatgattggctcaatgcaacacaaagccataagaaaacaccatcaccgactcgacaaattgcagagaataaaatagaatggaggaatccacctgccacatatgtaaagtgtaattttgatgctggtttcgatgtacagaagttggaagctacaggaggctggatcatcagaaatcattacgggacaccaatttcatggggttcaatgaagttggctcatacgagtaatccgcttgaggcagaaaccaaagctcttttggcggctttacaacaaacctggattcgaggatacacacaagtattcatggaaggcgattgtcagacgctaattaacttgattaatgggatttcgtttcacagttccttagcaaatcacctggaggacatcagtttttgggcaaataaatttgcaagcattcagtttggttttattaggagaaagggaaacaaattagctcatgtcttagcgaaatatggttgtacttattctaccttttattctggttctggttctttacctatttggcttgatcgatacttttgtaatgactctaattgattaatataattgttttgacgtaaaaaaaaaaaccaactctaatttttcaacatcatgctattgtagtattatcaatcacataaataaagaattagattcctacaaaaacaaagattttaataaataatttagaaaaaaaattctattaatacaattcagttatacttctttttaatatatatatatatatatatttatttatttgttgatactaaatcaccatctgaattgagtacaaaataaatgtcatggttgatcatataaataaaaatactattgagttttaatgaaaatactaagatctaatataataagtgacaaaaaaatattatagatatttaggcgatataaaattgattactttctccaagaagtaaaggaaaaaagaaaaacaataatcttcctccaaaatcataatcatttccatttgttgagaggcatgttagattttttggtactaactttatgaaaatgataaatgtgatgtagtaagtgatacaagtctacactctattccagttatcgcaaacccaaccgatccagtctctttagattccctttctcctagatcagaccacaaccatttggccacttctgtcctaatttattctctcatcaaaacctctattttgcttctccctttccttacaagctgttcactatatcccctgcgatttgtgtttcccacaaaccctaattttgcaagaagaggggtttcttctaatttatataaatctcggttctttttgccatttcgttttctctgatcatg

SEQ ID NO: 13792 - DNA, 3000 bp, Unknown
  misc_feature (1)..( 3000): cDNA_ID_2704136_gDNA_ID_2214652_Annot_ID_136439 3000 nt of promoter + ATG
taatgattcgacccgggataaaagcagcttgagaatccgaaacaatcgagtttagatgagattttaaacgattcactaagcatttggagatgaccttgtataaaacattgcaaagtgctataggtctatagtcggagagtgttgtagggttagtgatttttggaatcatacatatgttagtatgatttatgctgggtttcataaatgatgtttcaaagaattttttgacttctaatataacatcgtatccgactatatcccaacaattcttataaaatcttgctgttaacccatcaggccctggggctttatcatctcctatttggcagatagcatcatatatttcggtgtcactaaactcttttgtaagatctaaattgactgtattagtgactgtggatttgaagtccgcaaagtctattggtgatacctttataccattggtgctaaagatatttgtaaaaaagtcctgagcgtggtttccaatttctttatctcctgtgaacatccttccttgatcgtccatgattgtgttcactcgattttgagaatatcttgtttttgtacaggcatgaaaatagccggtgttttgatcgccttccttcatccattgattacgactcttctgcttccaataaatctcttcgtcactaaaggccttcgctagtgactcttgaagttgtggaattagttgtctgtcaaccctccttgtactctccattgctctgtttaggctgctttgaagttttttgattcgttgttctgagtttaaattagaagcgtgtttcagtcttgccatggcttgtcgacaactactgatccgttccgtgataggtgtagaacgtgaattccggtttgtcctccagcttgtttgaacaatacgtttgaatgtcggtatgtcaattaagcggttatcaaaacggaaaagctttgatcgacggggaaatgactcgttgaagtgaactaggaccggtttgtggtcagagcccgtgaagtccaggaattctgtttcagcatatggaaatgttgcagtccaggctgaattaataaaaactctgtcaaggcaacatttgactgtgtgtgtatgtctttcccctacccaactgaatctatctccttttgatctcatatcttcaatgtcacaatgagaaaccatgtttctgaaatttctaaaagtccattcctctctcatgggaccaccaattttttcagcgttcgaaagtatctcattgaagtcacccactagcaaccattcagcatttcgattatctgagatatgttcaagagtttgccatagttgatgacgttcagattgagtagggtgaccatacacacaagacaagtagaagctcttattattaaatgttacatgagaatcaatgagtctttcatcctgagaaatcaaggataaagagacattgtttttccacataagagctaagccaccactccttccattagggggctgagttattacattagggaagcctaaatcatatgctagtttacatactttatcacactggtttaaggtttcaactaaaaataaaatatcatagttatacatacggaataagcgaaacaaccgcgattgagtcagcggcataccgatgccctgacagttccatgagatgatcctcatattggatcccttaggggtaccgggccccccgcgcctccgtcacgtccatcatgtatcgaacacgatcctgcagattcagtctttcttcctttcttgcaaagttgactcagaacgcccatttcatctgcagcttccacctgttggtacatttcttctaatcgaaccctctttctcttcatgaagacaaactcattttgtgcattgtcagaggactcaaggagcagatctttctcaaccggtgcgtcagttttaactcctgcaagtttggcgtgaaggtagcggagtctttcaactgtgaggtctgtgtcctcaatgacgcatggaaccgaataaccatctgaaagtttttgtacctggcgttgattcccctttgaaagcgaagattgaaggccgggaataagagtcgctggatccactgtctgaagagtatcagtgtcgcttatgtcatgttctttgttgtcgtcgtgatgatcgtcatcatcatcagcatcatcatcatcacttgtctccaccggatctgcccaataggagactaatattattttggggttctttttgtcagaaattacttggatttgttttttttttcaaaccacacagtaattaaaaataaaactttttacattggcattttggtcttaacagcattgtgattcttctcctgccaacaaaaattcatctaataccatcatcaattatatggattattacaattttgttttgtcatttcattctaaaaaatatgagtgatctaattcttgtaaaattttgatgtgtaacctgaaatattgatacactaatctatagccaattaaaaatgacaaaacataacattgggtaaatagtaacataaaaatatacatgaatcataaattttaaaagtatgctaagtatgtataagatttaaaaaaaaaaagattttaagagagttataacagtaacacacttgaaagccgaagttttgttcttccttgtctcagcgccgcgttttttctctcctcatcctctcgatgaattcctctcaagcttgcttcttccatttttctcttagaccaatctcgctttcgcatccctcctatgccttcctctcgaaacgtaagttttccttccccaaattaagtgcttgggaatcgaaattttaagagattgttgttacctagactagttcaggatacaatcgttagagtttcgttgcttcgaattgattaaaccctaatttcaaaagcacagacctgggtttttcactgttcctgcaaagttgataactttttcactgatactatctcttagactagttctcttaacccggaaattctctcaaagtatccaactttatgaacagaaacaattgttgaggc

SEQ ID NO: 13793 - DNA, 3000 bp, Unknown
  misc_feature (1)..( 3000): cDNA_ID_2714080_gDNA_ID_2214652_Annot_ID_136442 3000 nt of promoter + ATG
ttaatggcaaatatttaaggccaaactttccggtcttatttgtatcctccttgatgtattaatgaatttttatttcaagactatatagttaaagatcacaatgagtgacgaaagattgttttagatgttaaaaaaaaagtgaaatcaattcatttacttgtggcatatttggctaatttgaaagcacaaatatgagccaaagtacatttgatttaaaaacaaaagtcgacaaatagttgcattaagaaacaagaaaaaaacattgtttcagttttgcaaatcgtgatgatcacttaagcctgaaacttcccacgaatcagaggatccagacgattgcctatgacattataggtagcttccgatggatgaatcgagtcaaagaacataaactccgaccgattttgacacacaggagaaaagacattacacatgaagctcgtctccaagaaccctgttccacaacatcctctcttcgtctctttgaaccctgtttcgattccacacacacgaatcatatatatataaacaaataagataacttgtggagcaagaaaaatctttatgtacataccgtatttgctagggttttggatcatctccatcataggattatagacatcggcgtaaaggaatttgcttcctggaagagatgcttcgatttggggcaagagcttctgaagtttctcattgtacaaaacagagtctttgttatggtgttccaagcagaatctaaaaatgttgcggaatttagcagtcatatggatcggtaaacaccccattggcggtaaacctccaaccaaaacattccggacacctaaactgtaaagctcctgcatatacaccggagagattaacaaaacaaacaaattatcataaaactttcagtcactatagtctgttccaaaaccctaattgtggtaatatatatatgaagaaatattttagacgttacccgcacgaaattttcaagcctcttaagaataaaatcttggtaaccagaaatgaaaggatactcgagacgccttgagggaatatcgtaatagttcaaaatgaaatcattaggccctgcactcacaaccacgaaagcattgtttatgatctccatcgctttcttgtctcccacgatacctttgagacgagcaatgtaactcttgaacatgtttggttgttccgagacacgaatggcttgtgtcgagagactggttaggtcgtcgtaaccgcaccagctgatgcgaaacagactccggttagaatgtcttggtcggagagatttggttgtaagaaaggaggaataaactctttgatgttgagtttggttgcgattatgtcggagataagttttccgtttgagaatcttccgttagcttttccgtctggaagatccatgccgtaaggaaagtgttcagctctgaagattgttggtaaagggtagttgttgttgcctgtgtcgacggttgaatcgccgaagattagaatcgctgggaagagcggtttcgttgttgcatttgcggctgcgtcgcaggacgctagtaatgttgttgtgatgaagagagttaaggttatggctttagaagtcgacattttttgttttggtttttgttttttagtagatttgaagaaatgtgttgtttttgtggtgtatttataaggtgactttttttttgttaccaagctggctttgtgaggttgtttttcttttaaagtgtgtaacaaatggatgaagtcaagagctttgaaccttatagtctaaataaagattttgttaagatattgatgagcttttcacaaaactgaaaaacaatgtggtcaaaagaaaataaatttcgttggtcgagcaaaggaaaatagaaaagcaaacgtttttgtttagcgtttaagaattgataatgtgaaaaaacaaatcgataaagaaacaaacaaattaaaccaacatatcttgattccaactgaactccaattctgaattctggtttaagaaaatgacctaaacttaagctgagagtgttttgtcgttttcttgctaacaagtcatattaagattgctatatttattaaaatttaacattaacccaaaagaaaaaaagattaacatgtttataaatacctgaaccacaaaaaaaaactaataaattctgttctttcatatgatatggataacatttaacaacatactataacatgttccagcatgagatacttaacttactaaacacgaatctagagacagttagaacaagtgtctagaaaaataatttataccaatatctgaaaccaaaatcaaactctctgaagtaggccatacttcttctgttcgtgtggccagcggcgactccgtgcatagttttctttagataaatccaatattgataagttgaaaaaaaaacaatttgaaaatttacactttttaagtttttataaattaatgggacgattttaacatttcttgatgaccaatgacaacattgcttgatgttgtaaacaatgttatgaagaagatgtcaacttcatgtcttctcaggtcgcaattcaattttatatcatgtaaataaatgggattactagtgatctcttctgcaatacactttttaatatcagaatataatttctcatgttcatttgaatacactttgttttctccttccaattaagtagtatacaaattttcacaacaatactttatgtttctcgatgtgattcaatgtttatgcaacattattattagtaaaatagatgtccataaattaaatagaagttgaaacttgaaagacaaaccgagacgaatcccaaaatggaaacccaatgtttctcgaacacacgtttcatggaatcattgattcgtttgcatatggccccacaacaaagatggcatatatgcaataattgatgcttctacgtcgccacttttctaagaaagaaaccatctcctttatataataatctttcctcaccactcaatatgttatatccgataacaaaaaacaatcacagagagaaaaacca

SEQ ID NO: 13794 - DNA, 3000 bp, Unknown
  misc_feature (1)..( 3000): cDNA_ID_1808682_gDNA_ID_2214652_Annot_ID_136443 3000 nt of promoter + ATG
acaaattgttacctttaacttgggtcgtggttaggattgatggctgtcactttcacaggtaattgtctatagcttacctttatttcgtaaaagtttgtcagtctttttactgcattgaagccttagactagtaaaatccttgcgctccataggattcagctaggctagcctgttcagttttattatgttctgttgtggttgcatttgtctagggaatattctgattattgaatctgaacttgcattttcagaaagaagtcattttgttagtgattactagtcttctgtgttgcaaattacgactcatggagcttgcttggattttgatagattttctgacgttcatgaatttgagaagccaaatgatgagcaagctctgaaacttatgaattcatgtgcagtggctgttctcgaggagtttgaggatattcactttgcctatggtgtcagtgatgagtataggtgtccatctcgcaacctgtttatctcagctttacataatttagatattaattaagttcatcatcgattacagctttgttttgaagaaagaatctgagctctacaaaagacaatccaggttaaactaaatttctctttttccttacacttttggccgtatctccctgatatccttagtcttaatacttagtattgcattacagtaagataatatctgcagtcgcatccttctttacatccacatatgtgttacaatggggagaatttttccctcacaaagaattgaagtaccctccatcattcgatggacgagctgtatgctatccaacatacaatattctcttggattatctggcgtggagacaagttgactgttagtataataacactgtgataaattatttggaatcgtctatatctttgcaaaattttagatgagtagtcttatgttttctttgtttttcgtttggcaggccacatcaataatcagtacaatacatgtttctggatgcttgttaagtctggaaaaaacaaaactcaatcccaagattacttaaaggtactttgttataatggattgaaaaaaattattctcaagtagtcaatgcttagaatggttcttatcttactctttgtgaatgacattcccagggtacacaaacacgagagaaaaatgagctgcttagccgtcaatttggaattgagtacaactcattacctgtaatctttcgaatgggttcttcggttttccgtctaaaggttagtattgccttaactttaaatctatgcatagaaagattatgatacagtggactggctgagaaactttataagtgccaaactggttctgctcttatcgtatcgtatgaatcaattaagttactcaaacctttggctgttaactcgtaaatggctaaatccatataccaaacctgaaatgtaactacctgccgaggtttcttactgtttctatcaaactcatcaagcagtcgtgaagatcttcttccgttgcagaacttgatatttgtagagctgtctgaatattctttttcaggaagctgagaatggagtagtttcagggaagaaactggaaggagaagtggtcgtggatcattgcaacatcatcgaacgctgtttctgggaagaacacctacacattcttagctactcataaacagctgcattttagtattttacttcacttgtaagactaatttattgcaaattcttaatctccaattagcacagctttacttcttttcaacatgtgttataccttagtttttcacatgtatgtcaaccattgttaagattttagaaaagttattggttttgtatgttaaatacatttgtggaagacgagagaagggagatagatagatatgtaaaacattaaattcacaccatacctgtgcaccgaccaactgctaacttctcttgcgttacgtaaaagtaactttatcctctccatttattttgttaatgtataatcactagagaccagtattattaataattttctatcatgttgttgaatagtactagtaattcaaatgtctattaagtcggtccaactacttgataagacctatagactaaaattttcaggtccggtggttagattctgagatatgtttttgttctcattccattttaaattccgactttatgtacttgtatatatttggtgaaaaatttgtatataacttttaaattattcaaccgagcaaaagtatacttttttgtttgtttgccacacattgattgatttattacttttaagtatatcaatttaacagggaaatataactgaatctagtaaatataataactttcttgatttgggtctcaagtctgagaaccaaaaacccaatgatattttgataaaatactattttttacgtgacaacttgcagtaaatcagtatctataaattctagatgttttcctataattttcttgctttttgaacaagctataattaagaaaaatcaggtcaaacattggaaagcataattggcagcgaatcctattacagattttttccattaatcatatcgttaatatctaaaatgaaagtcaattgtagtggtcgttttggaaaatatgaaaggtggcaatttgatatgtttttttttgtagtgaaatttatttccaattacgttaatatttaaataaattccgtgtaaatattgatactcgacacaacacgcaaaaaaaaaaagaaaaaaaaaaaaagagttatatatttgagatttcttgattttaaataaggaattgagttcatgtaccaactaatcaatgaaagacagaaataagaaaaatataaaaatgagaagggtaagcaatcaatatgaagtcgtggatgcttaccccaccattcgtcacaagagattcgtcatttaaagcattctgatcttataacatttatcaaccatatatatacacacaaaatatttgttaacaaaaagatttatatttcttctcttctttgttcataactaagaactcagaaagagaccaacgacactgcaaatg

SEQ ID NO: 13795 - DNA, 3000 bp, Unknown
  misc_feature (1)..( 3000): cDNA_ID_2714076_gDNA_ID_2214652_Annot_ID_136444 3000 nt of promoter + ATG
tcatcaagacgtgttgaggatagggattccaacaataacctgcaccttggcgactcatccaaacgcaaaaacatgataatcctacaacgtgaaaaggattcagaacagaacaagcaacaagaaacatatctaaacatgggaggtattctgaaacctcctaaaaaaacgttaacatcactcgtttgattctgtcaattttttatttacaactgacatggtttcatgttacagttgaagttaacagtttgaataagagttcagatatggtctcagtatcactttttggaacatgacatatctcaattttttatttttttttcacaagagtgtccattttattataaggtcatttgcaagaataacacttttctactaaaaaattaagaatatagcatactatatgtatcaattaagaaactaacatgaagggtataaaaaatgaccaacggtggtggtggtatgagttccggcgaaggtttccggcgacggagctccggcgagggttttccggcaagggagttccggtggtgggtttcggcgatggaattccggcaaaaatttccggcgagagttttccggtgaagaagttcaggtggtgattttccgacaacgtagttccggcgagggtttcccggcgagggagttccgacggtgatttttccggtgagggagttccggcggtggtttccggcgagggagttccggcggtggtttccggcgagggagttccagcggtgatttttccggtgagggagttctggcggtggtttccggcgagggagttccggcggtggtttccggcgagggagttccggcggtggtttccggcggtaattttccggcgagtgagttccagcggtggtggcaaaggttccggtggtggtggtggtggtggttctgggctgggatggtggtgtgaatagttatggtggtgaggatattattgtattattacactttatacacttaatatcattgtatttttttgcataggttagtttctcaatttataattttttgatggttataaatgtgaatttccctttattatatcaacataagccaaaatttgagacaaacaacagagccaaattcaactaaacataagtgtaagacttttcaaacccaactatgaagcccaagtaggaaaccgcatcaggaagaaagaagaatcattgaaacagaacctaaaacacgtgtcatgagaaggttaggtgctgaagacacgtgagaagaagaagatcggagaatcactggtcgccgccgaagaagattgttgactccatagaaacccagaacaccgcgatatgcatgttgaatccggtgatagcaattgtcaattccaaagctctaaaaacaaatcttcaacttcatgaaaattcaacttcaaaatcttcccgattaaacgtcaacggttcaggaactcaagcatcatattcatcaatcttatgttggagagaattgtgtttaggcaaaaacgaatcgcctaaaaccacaacactaatatagatcgcataatttattcaacagaaaaaacaaaaagcggcaacagatagccgaaacaaagccgaacctcgccgtagacaaagctggaccataccagagacaaaaccagtaaacaaactggatggagaaacaaagatcatgtttcctctctctgaataatcgtagagagagaagagagagaaattgatcttttgccttggttgactctcttaaattatagtaattaaaataaatctaaactgataaaaaaccacagagccgactctcttcagagagttttaagagggtgagagagccgtatacgtggcaacatgtgatagggtgattaattttaacaaaggaaaaaaaaaatcaagttttatttttttcttcacaacatctctcacaccacgacggctatgaaaccaaatgatcaattccgtcggcgttgttagaaaggaagctgagaattgcaactgcttacaaggtaagaatcactcactatccatttccatatttcttcatcaatcgagcttaattcagctttgttgccttttaattttgtcaattcgaagtgtttagagttgtggatttgatgttcttgttattgattcaaacgtttgaacaaattatagtatttggtagtgtatgatgagaaacatacagatctatttattatgtgaccgtggcattgagatgattttagattttcgattgtcaataggaatactaaattgtatctttcataaacatcgttggctcttatgttagttccactaatctctctcaccttattgccactgatttcatcttccaaaatcaaatttagctcagagatcactaaatagacaatggtgatagataaatgaacctaaacaatgatctaaagcttcgttgcttgtttttcttcttaagctcctctttgctgtcttactttcgcctctcctctgtgtggtagtaagagttaatgtagatatagaagaactatcttcgtgctcttattatttattttccgctttgacacaaaagttttatgatttcacacgaacccttcacttgttgatgttgtcgcttctctcgaaccatatttgtcttaaggtattaaaacttgtcctaattctccttgtcttactggtgaggatttgaaattctgtactttcctgcacacgattccctagctaagaattcattgtttttgaacttgagaaaatgatcttattggaaagttttatatgttcctgaattgattgtgatctttattggtactgcattaagaatcttatatgctcctgaactagtattggtaaggaatactgccatttttttatctccttatgtgaagtaaaccgtctttgctcatatagtttggtttctctttcacagagcaatgtcgactcagctttcggtttaatatcctgttcgattgcagttttttttgtgtctggtagtttcaaagtcgatagcgtagaagcaaagaagaaagaagaaaactttcgtgaaaccttgagggatatg

SEQ ID NO: 13796 - DNA, 3000 bp, Unknown
  misc_feature (1)..( 3000): cDNA_ID_1663221_gDNA_ID_2214652_Annot_ID_136447 3000 nt of promoter + ATG
aaagtgttattcttgcaaatgaccttataataaaatggacactcttgtgaaaaaaaaataaaaaattgagatatgtcatgttccaaaaagtgatactgagaccatatctgaactcttattcaaactgttaacttcaactgtaacatgaaaccatgtcagttgtaaataaaaaattgacagaatcaaacgagtgatgttaacgtttttttaggaggtttcagaatacctcccatgtttagatatgtttcttgttgcttgttctgttctgaatccttttcacgttgtaggattatcatgtttttgcgtttggatgagtcgccaaggtgcaggttattgttggaatccctatcctcaacacgtcttgatgattctcctgtttcataaacccgtctgactcctggtgtgggcgcagcaacagaggattgaagtctgccaataccactttgagtagtaggatgagtgtaaggctggaaggctgcagttcttgaagatgagaagtagggagtagcagcagctaacctgattacatctaaaccggccaaatttggttcctttttacttttttagtatccggtcgctacttttggttgtgactattccggttcctcttgaaattagtttcctaaattaaaacgttcggaaaaattctaaaccggatagccaaaaatcgaagtatgccaagttttggccacccataatttcgaaaatacaatttgtcaattgcaaagcatcgttgcctgagtctcccattagccattagaccatttcgattttgcatacgcttttcacaagtaaattttagaaatgaacaaaattgcaactaaactgaaatggacatctccaaatgttagaatgagttccaacttccaacacactagtttttgtgcttatggatctgttatcttcttattaagcctaataaactaccactatctaaactactataccctaccggacactgtaacaaaacctctcttaatagctcagggcagataaacatccgatacctacactgtaacaaaatctgtagacgattaagagcgcaacataatacgttttatgtcacttcttagaatgatatagtaaggcagagatcctcaccttttcccttctgggacatacacaaaaataacttctggcaacgctaacagctcaactcagcttgtattttcttcttttactacacttttaagtttacactccttctgtggattttttcgtttcgcttgaatatgatgcacaaacgcagctactataacatggagctttgggggaggcttgcttgttgaagagacattatgaccagcatcctttaaagctttagccacatgcttttgggctttctggaagtgtatattacacagtgcaggaacagtcgacgcaagtgttggttttccacaaagtaatggtcctgctggggctctgaatgtacaatggaaacaatgcagagttaggtgagaattgcttaaattatcattatatgctaattacaaaccagcatacaaacttacctatatatgaaatctaggttgtaaaaactcaaatctgaaacttggtttatgttttaatactaccacaatgggactattctaacacaaatacattttcaaagggtgatatagttatgctaatactcatatcctgactattttacaaatacacatcaaaacagacaacttcaagcatctgcgtcagttatgtgtatcaaccagaacaacaaagcacatagagcaatattttaacacaaggcaactactgaatctataaatgattaccgacgatcactatctcgatgtccaaagctaagacttctcccaaaccctatgaaaaactttgaaaaaaagtcaagtgtcaatcccaaatcctttctgcaaacttgaaaaaaaaagagaaacaatctcttggctcactacataacacaaaacagctttgcagtttcaattcatcatcactacaacatcttcaccaactataatatgcaaagaacacaacttgaagcatcaattactttggtttatacgagaattttaaaaccaaataaagggaaagtgaaacaaaccgtttaatgacgtttgtgcaaccagtgtagagcttctgcttactatccttgagaatatgcaattgacagtatttcgtaagcgccatagctttagctttgcatccatacatacaactcccacaattactattcgcatactgatcactcttaacaccatcattgttagtaacattgtctccactaccttcaacagcatcaccaccatctccgatatctccctcttgaccaagcctccgtctcttattcgattgattattttcgtctttaaactgactaatcccatacttccaccaataatccctgtgttgtgccttgacatcctccattaaagcccaataattgtctctataacacttggccagctgcttcaggttgtgtgatcggcgtttgagaagctccgaccgggttatgtgactggagcgtgcgaggatttcatcttcttgtgacatcgtaatcggtgaattcgatgtcgacggtaagccgctggtgctagggttaggatttaaggtagagtttcgaattaggggctcggctgaggtggaagccactgcggttgttgatgcagcgccggaggaatacggaggccgtggtggtttcgaggagaaagggttttgctgaatgttcttggaagctgacgccattgccgtcgtcggaaaatgacagagcttcaaaatcagatgttcttgtcgggaatgaaattattaatttttaaaaaataatattagtacttaaattttaaaatatattaaagcccataaaatgtccattgggctgacatattcaacaaataggcccaaactcaattggatgtgagacctaagtttctgaattaggtcaatataaatactaaaatcatatctgataacgaacacgagcttaccgattctcttcgtctcaacatttagggtttcagagatcggctgattttcacatccacaagt

SEQ ID NO: 13797 - DNA, 3000 bp, Unknown
  misc_feature (1)..( 3000): cDNA_ID_2704128_gDNA_ID_2214652_Annot_ID_188675 3000 nt of promoter + ATG
tcatagatgctacaaggacaggaagcattgctcacctgattaatcattcatgtgtggtatgaatatatctgttaatctaattcaatttagttagcatctgcaaaaactgagcatttttgtctaactttaatgcagcccaattgctattctcgagtcatcactgttaatggagatgagcacattatcatattcgcaaagaggcatatccctaaatgggaagagctgacctatgactataggtttcactttgatgccctttgaatcatctgagatattctatgatcattttctgcctctgatcttgtaatgtttacaggttcttttcaatcggggagcgcctttcatgttcgtgtggcttcccagggtgtcgaggtgttgttaatgatacagaagctgaagaacaacatgcaaaaatatgtgttcctcgttgtgatctaatagactggaccgcagaataagcgactaaaactgtagttagtaacaatcatccctttataatgttgtagctccttataatgagagagcatctgttgtttagttttgccacaatccatttttttgtacagatactaattagtgagtagtaaactacacggatcacagagtggtaaagcaacagtacaattctctttttctttcctgatttgagtgtgccttaggttttatcctgatggtgtcaatttttagcaattgggatgcagagcataatgtttttaaccttactgtctagtatctctacctgaaacagaggttttgcaaggatttaaatcattgatttgtccaaagcaatatccctttggtaccaaaaactgcatttacacaaagtatttatagtttcgtacatttataaaggcagagcaactaattgcattttgagttatttgtgctatgactacttttctttgacaattactacaagacagataaccacagggtttttcacagagaatactatagttttggcacaaggtgaaatgcataacggtatctttcaggtaaaatagagctgccaagggtggcacattcataggttgtacagttttcaatcgattgttgttcattgtaaaatacacttttggtaaaggtgattgcatgcggattccctcctttagaaaacagggataaaagatacattctgaaaacgactttttcggatgtggctcgccaacaaaagacgagatggtaatccctgagtcgtcgtttgttcttcttggttgagaaagttgtaaatgtcaagtccgactccttacctaggaaattcacagcagagtctttttgcgtctgaccgcagattagacttgcagacttggaaaaacaagtggtgaacgacacctttgtcatattgtctgacatatggctggatggtgaagaggtgatttggagtactaatttactgtattttagcttcaatctttgtgcttagagaacattgcttgattggccaaaatgtgttgtccataatgaaggttcttgggaagctggaaacgttattgatggttttgaaaatgtaaagatagtgccctctttgtttgttttcatgggaaacttttgttctcgcccatgcaacttatcttttggctcttattcaagcatttggtaagggatcattaatgtgcttagaatctcctcgattgtcatcaaaactttaatcttatataattgttgagtacatgcatccattcatttttcaggcagcagtttgataaacttggaagaatgattggaaatcatccacggctaatagcaaacatgagtccatgacgcatgtacaatctccttcactatccaataaataaagccagggtccatgaggagacatgactaataaaaactcattatctgtgacaggtctctcgacagtcttgccaagatgcggtttaccagagtatttaaccgaagagcttcgagatgttattaccaatccagagagttttctatactgcatgtgaactctccattgttcatctatatggttattagtcttatgaacacaaaagctgcagctatgatcttgtatttgtaaaatgcagagtaaagttctacaacaaggagattgtgttcttccgacacgagcttctatacagaatgagccgttcatgcttaataaccccttcctgaaaagaaactaatgacccattttattttccaacttctgattttacagtttttcgaattaatctgaaacttgtgaaatgtgtttgttcagcttgtctccacattaattcatcagagccatctatgttatctaactctcttggttcaacacatcatttggaactatgaccactgtccactgccttcgactatatccaactccacacacggtacattcttaaatcttcttaataaagattgaatgccacctagtttggaagcatgaaacccgccttaaaaagaaaaaggattgttaaagttgttgttgtttggaaaacagatattattaggtgacaagagtgagcaaaacgtatgcaaatttgggggagaaatatgtttcaatccaggctccttttcaactgatagcaccttcgtagcttatcgaccttccactcaagaagtcgaactctctgctctgtgatcagataaaaagccattagcttaaaacataacttcatgtcttcttctttgcttctctgttttcttcttatcatctccatcatgatgtctatattaaaccaaaattagtcacaatcatcataaaatcaagtatatcaccataagctccactatacatttggctggtacgttatttttgatgtatattgattttcatggaggcatatagctaacgtgtaacaaatttgaaattttaatgtagagtaaattcagattttaaaagtttcaaaacttttcaactttgaccttttcatgggtccttcttttccctcgccgtaaataccaagtctcacacccaaacactcctctctcttgtcatttaaaagactagagtcattcttttctacaaactgaaatgagcaaatataaaaacactctaacacaatg

SEQ ID NO: 13798 - DNA, 3000 bp, Unknown; identical to SEQ ID NO: 13796
  misc_feature (1)..( 3000): cDNA_ID_1663221_gDNA_ID_2214652_Annot_ID_188674 3000 nt of promoter + ATG

SEQ ID NO: 13799 - DNA, 3000 bp, Unknown; identical to SEQ ID NO: 13794
  misc_feature (1)..( 3000): cDNA_ID_1808682_gDNA_ID_2214652_Annot_ID_188669 3000 nt of promoter + ATG

SEQ ID NO: 13800 - DNA, 3000 bp, Unknown
  misc_feature (1)..( 3000): cDNA_ID_3031975_gDNA_ID_2214652_Annot_ID_188665 3000 nt of promoter + ATG
ctataggtctatagtcggagagtgttgtagggttagtgatttttggaatcatacatatgttagtatgatttatgctgggtttcataaatgatgtttcaaagaattttttgacttctaatataacatcgtatccgactatatcccaacaattcttataaaatcttgctgttaacccatcaggccctggggctttatcatctcctatttggcagatagcatcatatatttcggtgtcactaaactcttttgtaagatctaaattgactgtattagtgactgtggatttgaagtccgcaaagtctattggtgatacctttataccattggtgctaaagatatttgtaaaaaagtcctgagcgtggtttccaatttctttatctcctgtgaacatccttccttgatcgtccatgattgtgttcactcgattttgagaatatcttgtttttgtacaggcatgaaaatagccggtgttttgatcgccttccttcatccattgattacgactcttctgcttccaataaatctcttcgtcactaaaggccttcgctagtgactcttgaagttgtggaattagttgtctgtcaaccctccttgtactctccattgctctgtttaggctgctttgaagttttttgattcgttgttctgagtttaaattagaagcgtgtttcagtcttgccatggcttgtcgacaactactgatccgttccgtgataggtgtagaacgtgaattccggtttgtcctccagcttgtttgaacaatacgtttgaatgtcggtatgtcaattaagcggttatcaaaacggaaaagctttgatcgacggggaaatgactcgttgaagtgaactaggaccggtttgtggtcagagcccgtgaagtccaggaattctgtttcagcatatggaaatgttgcagtccaggctgaattaataaaaactctgtcaaggcaacatttgactgtgtgtgtatgtctttcccctacccaactgaatctatctccttttgatctcatatcttcaatgtcacaatgagaaaccatgtttctgaaatttctaaaagtccattcctctctcatgggaccaccaattttttcagcgttcgaaagtatctcattgaagtcacccactagcaaccattcagcatttcgattatctgagatatgttcaagagtttgccatagttgatgacgttcagattgagtagggtgaccatacacacaagacaagtagaagctcttattattaaatgttacatgagaatcaatgagtctttcatcctgagaaatcaaggataaagagacattgtttttccacataagagctaagccaccactccttccattagggggctgagttattacattagggaagcctaaatcatatgctagtttacatactttatcacactggtttaaggtttcaactaaaaataaaatatcatagttatacatacggaataagcgaaacaaccgcgattgagtcagcggcataccgatgccctgacagttccatgagatgatcctcatattggatcccttaggggtaccgggccccccgcgcctccgtcacgtccatcatgtatcgaacacgatcctgcagattcagtctttcttcctttcttgcaaagttgactcagaacgcccatttcatctgcagcttccacctgttggtacatttcttctaatcgaaccctctttctcttcatgaagacaaactcattttgtgcattgtcagaggactcaaggagcagatctttctcaaccggtgcgtcagttttaactcctgcaagtttggcgtgaaggtagcggagtctttcaactgtgaggtctgtgtcctcaatgacgcatggaaccgaataaccatctgaaagtttttgtacctggcgttgattcccctttgaaagcgaagattgaaggccgggaataagagtcgctggatccactgtctgaagagtatcagtgtcgcttatgtcatgttctttgttgtcgtcgtgatgatcgtcatcatcatcagcatcatcatcatcacttgtctccaccggatctgcccaataggagactaatattattttggggttctttttgtcagaaattacttggatttgttttttttttcaaaccacacagtaattaaaaataaaactttttacattggcattttggtcttaacagcattgtgattcttctcctgccaacaaaaattcatctaataccatcatcaattatatggattattacaattttgttttgtcatttcattctaaaaaatatgagtgatctaattcttgtaaaattttgatgtgtaacctgaaatattgatacactaatctatagccaattaaaaatgacaaaacataacattgggtaaatagtaacataaaaatatacatgaatcataaattttaaaagtatgctaagtatgtataagatttaaaaaaaaaaagattttaagagagttataacagtaacacacttgaaagccgaagttttgttcttccttgtctcagcgccgcgttttttctctcctcatcctctcgatgaattcctctcaagcttgcttcttccatttttctcttagaccaatctcgctttcgcatccctcctatgccttcctctcgaaacgtaagttttccttccccaaattaagtgcttgggaatcgaaattttaagagattgttgttacctagactagttcaggatacaatcgttagagtttcgttgcttcgaattgattaaaccctaatttcaaaagcacagacctgggtttttcactgttcctgcaaagttgataactttttcactgatactatctcttagactagttctcttaacccggaaattctctcaaagtatccaactttatgaacagaaacaattgttgaggcatgtgttttgaccttgataatgtttttgcaggagacccatttctgtgttctcaacccagaaaatgccttactacgaatttgaatatgtcaagaacgagacaagggcattctatacaa

SEQ ID NO: 13801 - DNA, 2762 bp, Unknown; identical to SEQ ID NO: 13790
  misc_feature (1)..( 2762): cDNA_ID_2704491_gDNA_ID_2214652_Annot_ID_188662 3000 nt of promoter + ATG

SEQ ID NO: 13802 - DNA, 3000 bp, Unknown; identical to SEQ ID NO: 13797
  misc_feature (1)..( 3000): cDNA_ID_2704128_gDNA_ID_2214652_Annot_ID_136448 3000 nt of promoter + ATG

SEQ ID NO: 13803 - DNA, 3000 bp, Unknown
  misc_feature (1)..( 3000): cDNA_ID_2714060_gDNA_ID_2214652_Annot_ID_136451 3000 nt of promoter + ATG
tttgtcactctcaaatatctgctgctgccttactgcaggacctgcaccatcaaatatgcaaattaatctaaagatcttccaaacgctaagccgagacaagataattagaatacaaaattattaccacaatcctcaggtgaccagttcttagcaattaaatttttgaactgaatactagcaatttgacgcactgccatgtcacaatttccatccacggctatctgcaataacctcaccaaatgctggggcgtgtgctccaactgcaagacaaaagaataacgagaaactcaggcatcagaaactgcataactttaattgatcattagaaatagtaaacaccactgaaatctggctacagtgaattaaagcaaataacgatttgttcaaaaagagtgggaatctttgaactatcttcagtaaaaccagaaagtgaacttataaggaaactctatacatgaactcagctcaaactttaagatactactagcagaataagaacaatcaaactcgcgaccaagcaaccgtgtaaatacatcgaaagagaaattgaagtggaaactgagaaacctgattgagttgctgctcagaaactttacgctcatcgggaatagggctaagagcggcggttcggaggatcaaagcgaggctatgcagatccattctccgtggagtttgagaatccggacactaaacagagtaaaccttgatgacgatcagaggcagtggttgatattcgatttgaaattcccaaccaagagagagagctgaattagaggaggggagaatctcagaagagcatgatagggtttaagagggacaagaatggcggagaagaaggagaagaagatttgattgatagttggcgagagtggaggagagggacaaatagagctggacgatttacagtatttaaatccctagggttgtttaactaaccaaaaccacccaattttgattctgattgacccgggtcttctttagccggtttattccgaaccgggtcttctcttactaaatgacgtcactgattctcttactaattaagttcaggtgaatttgaggggaaaacaaatatttttggacatgtatgtgtctgaaaatgtgattttccctctttttttttgatgaatatatagtttaaaataaaaactaacaaagacataaaaaaatgtttttctccttttaatcaagtatgtattattttatttgttctggtcataatcctaagtgagtgtggttggtattttgatgaaaatttaaaattgttcattccataatatttatgtccaagtatatatggacgtaaatcatgtaagcgatgatgaatcccaatgttagatgacatcaaagaattttgtgaccataggccatatgtgttgtgtaaattttgtgggtatctagagaaagccaaccaacaaacgctatatggatactttgacaataagttccatccatcagctgccagtttgtccaagtatcaaaatttcatccgaaaagctgataagccgccaatctgccccaagtatctaggaaacgacatattctaatgcctagttgatgggaagaactttggaggtacacacatcacctatcttgaagctcatgaaagcaagtattttaaccttacttacttttaaatatatatgtctctagcgtgtatagcatccctatgtggatcaatttagagcactagtgagcattgtatgctaccgcataagaaaatgcaactactgttaaccatgatgattacatccttattaacatatatgacacactgcaaaagtcactggatgcgatcaagttagcagcggtattttccatgtgtcaaaagcatactaatatactacagtcaaccgtatattgttctttagttaagttaagtaaagactactcctactagacagatattcggtttatgaatccaaatcaagtaattgctatgaatagccgttcatttaagaatgaagataagggaagtgagttgaaatgtttcttttaacctcatatctttacttcaacttatcacaccttaaaaactggattagagttccacttgtccgattcatagaaaaaatcttgtatctatcacaaaaatctttaacatatgtttgattatttatccacaaactaagctttttaggttgaaatattatattattctagaaaacttcagaacaatccaaaacaagtaataccaagggagcaaatcgttggaatttcctcacaagaaaattctctagctcatttgagaaaataggtagtattacttgaagaaccccattcaataattgaatttatgagcaattcggttgatttctaccttcattcaaattctagtcaatcttgtctttttgttccaatggaatttaatttggattaaccagaaaaatatgtcttatacactatacttaacagactaaaaacccaaaaatatacgtatgaactgaaaaaaaacaaaacaaattccatgtagtgaagattacacaaaaactggtaaacaacaattatctgaaaacaaaactatataaaagaatcagagactcttgttgaattttgcccaaaaaaaaaagactcttgttgaaaataaaatacatgacaaccgggattttttttttctacaagtggaatttttatttattttatttttagttttatatgtttttattaaccagatattaatttttatatacatacacacacacactatatatgaatgtatgtatgcggagatatataaggagacagagcaatagatctgaaagacttgtcatcatcttaataaacccggcgggaaacgtaaaaaagccttttagcttctccctccaaaggatctgtttttttccctttttctctgattcttcttcctaaaccctaatttctccaatccacgaaattccctagcaatttttttgggggtttagtgaaagaaggatagagagagtgagcaaaggtgtctcctttacgaagccctgtgctttctccctccgaataatctccatg

SEQ ID NO: 13804 - DNA, 3000 bp, Unknown
  misc_feature (1)..( 3000): cDNA_ID_2714056_gDNA_ID_2214652_Annot_ID_136452 3000 nt of promoter + ATG
catcagtgcaaaacaacagcgcaacagtttcaaagtccatgaatttcaacagttaaagagatgataggtagaccctaacctgacccatttcttagctgaacgagaagccagagtcgccttgtcctgattcttgctagaagaccccttccttcgggatgacccattttgcttattcccactaaacgcattgttttccttacaccttcttaaaccaatcgactccatacccgatttcaccaactcacaattaccaatcttccttctcttcttctcctcaaaacaatcaatttcatcaagctccacactttcagtcttcacagccaccgcctgatctagtaaacactcccgtagcggcctcttacggcgacgatagtagacgcgaacaatctcaggacgctgaatccgcaacttataatcatccgaacgacaacaatcgtcactagcactaacaccgctaccttcaatctcgaattgctcaatcatcggaagcttctgggccttaaccttcttagacatcagactgtgagaaccaacggcattaacacagcacaatgccgatgaaggaatagagtagatactctcaatagaatcgtagcgaatcggagcttccactagatcgtggacatcaatttcgatctgggtttcgttagaaaaacacgccatggagattattcggagggagaaagcacagggcttcgtaaaggagacacctttgctcactctctctatccttctttcactaaacccccaaaaaaattgctagggaatttcgtggattggagaaattagggtttaggaagaagaatcagagaaaaagggaaaaaaacagatcctttggagggagaagctaaaaggcttttttacgtttcccgccgggtttattaagatgatgacaagtctttcagatctattgctctgtctccttatatatctccgcatacatacattcatatatagtgtgtgtgtgtatgtatataaaaattaatatctggttaataaaaacatataaaactaaaaataaaataaataaaaattccacttgtagaaaaaaaaaatcccggttgtcatgtattttattttcaacaagagtcttttttttttgggcaaaattcaacaagagtctctgattcttttatatagttttgttttcagataattgttgtttaccagtttttgtgtaatcttcactacatggaatttgttttgttttttttcagttcatacgtatatttttgggtttttagtctgttaagtatagtgtataagacatatttttctggttaatccaaattaaattccattggaacaaaaagacaagattgactagaatttgaatgaaggtagaaatcaaccgaattgctcataaattcaattattgaatggggttcttcaagtaatactacctattttctcaaatgagctagagaattttcttgtgaggaaattccaacgatttgctcccttggtattacttgttttggattgttctgaagttttctagaataatataatatttcaacctaaaaagcttagtttgtggataaataatcaaacatatgttaaagatttttgtgatagatacaagattttttctatgaatcggacaagtggaactctaatccagtttttaaggtgtgataagttgaagtaaagatatgaggttaaaagaaacatttcaactcacttcccttatcttcattcttaaatgaacggctattcatagcaattacttgatttggattcataaaccgaatatctgtctagtaggagtagtctttacttaacttaactaaagaacaatatacggttgactgtagtatattagtatgcttttgacacatggaaaataccgctgctaacttgatcgcatccagtgacttttgcagtgtgtcatatatgttaataaggatgtaatcatcatggttaacagtagttgcattttcttatgcggtagcatacaatgctcactagtgctctaaattgatccacatagggatgctatacacgctagagacatatatatttaaaagtaagtaaggttaaaatacttgctttcatgagcttcaagataggtgatgtgtgtacctccaaagttcttcccatcaactaggcattagaatatgtcgtttcctagatacttggggcagattggcggcttatcagcttttcggatgaaattttgatacttggacaaactggcagctgatggatggaacttattgtcaaagtatccatatagcgtttgttggttggctttctctagatacccacaaaatttacacaacacatatggcctatggtcacaaaattctttgatgtcatctaacattgggattcatcatcgcttacatgatttacgtccatatatacttggacataaatattatggaatgaacaattttaaattttcatcaaaataccaaccacactcacttaggattatgaccagaacaaataaaataatacatacttgattaaaaggagaaaaacatttttttatgtctttgttagtttttattttaaactatatattcatcaaaaaaaaagagggaaaatcacattttcagacacatacatgtccaaaaatatttgttttcccctcaaattcacctgaacttaattagtaagagaatcagtgacgtcatttagtaagagaagacccggttcggaataaaccggctaaagaagacccgggtcaatcagaatcaaaattgggtggttttggttagttaaacaaccctagggatttaaatactgtaaatcgtccagctctatttgtccctctcctccactctcgccaactatcaatcaaatcttcttctccttcttctccgccattcttgtccctcttaaaccctatcatgctcttctgagattctcccctcctctaattcagctctctctcttggttgggaatttcaaatcgaatatcaaccactgcctctgatcgtcatcaaggtttactctgtttagtgtccggattctcaaactccacggaga

SEQ ID NO: 13805 - DNA, 497 bp, Unknown
  misc_feature (1)..( 497): cDNA_ID_2994569_gDNA_ID_2214653_Annot_ID_136458 3000 nt of promoter + ATG
taccgttgatttcttcgattcgattttttgggacgtgttttgaggattcttctatctctgggtttacgctgattgatttcgagagctgtagctagggttatctgctactctttgttgcaaattttgtttttgttattcctttttgaggtgaacattgttcttctctttgcgtgattctgttggcatttgtcttgttatattcttcgtttgattatatgctcttctccgaagactggacttttgttattcggtcgattcgattatgatgttttttgaggttttgatagggcttcgttatttaaagatgttcctagctgcttgctattgatatccgtggagtgctattgttctaactgaaacccatcttgtaactttccaggtttttgtattctattgaagattataaactaaagggaggagctttgagaatttgattgttgatatccaaggatttgcaagctagttttttttttacgacgttatacttttcgattatg

SEQ ID NO: 13806 - DNA, 3000 bp, Unknown
  misc_feature (1)..( 3000): cDNA_ID_1808014_gDNA_ID_2214653_Annot_ID_136460 3000 nt of promoter + ATG
agcgggaggggtgcttggggcaatcggcgagactatagctgagattgcacagacgacaaagaacatagtgattggtgatgcgcctgtgaggacacatgagcatggaactactgatcctgactatatgagacgggaacatggacaacgttgaaaagtaatgtataatggagaaatgttttggtgtgtttttgctttacttaaaaaggtcttttgtttttttgtatgtaaataacaagaagctctgtttgacagagttttgtggtaaataacaaaaaaagttctgtttctgttaagaagtttgaagaatatattagtggtttcctttgaaatgaaactgtaccaacctttatctactctacaaaactaagttgtagtgatccttgtaatatacgactcatattggtattaaaggactctctcaggcattgtaacaaacaaattgactgctacaaataattatcccaatgtcccacatatagagacccaaactttgttgcagacaaagaagaattgatgataggcaaagcatagagaagcaagaatggtatttggtattcaaaaaggaatgagcttttctgcatatatgagtgtacgaaacgaaattattcaagcaaaactgtatttcatagttaatggtgtaacacacattgtgaattgagatctacattttggtaacattatgtaacttgatctacaattctaaactaagaaacagatacgaattttcaacagactattgaacagaaacgaaactagaagctggaggcttcaaaggcataatcttcaacttcaagggtttaatcccacctttcttaaactgtgggggctttggtgggataatctttagcttcaagggcttcttcgaaacattcgtcggtttctccggtgctagtttaatcttcaacttcaacggcggaagcgagaagccggagaccacttcaccacgcaagaactgatgagacaataaatccgaagcacttcctctctccttagggttccttgaaaaacacgtctctagaaacttccttgcatcacacggtaaactctttggaatctccggcgctttaccttttgatagagcaggcgcaagatcctcaaattcaacctccgaccatggaatcacaccggtatacatctccaatactatgcaccctaacgaccacaaatctagggctttctcagccacgccgctacggactgattctggcgacatgtaaacaggcgttccaacaaacggcaaatcaacatcccagcaatcagaatattctccgacttttctcgaagacccgaaatctgaaatcttcaattcgtaagattgtctacatggaaagacaagtagattatcgggttttagatcgcaatgaacataaccgagtctatgaacagagactaatccttgaagaatcatacgagtaaagtctttaatcatcgtttccggtaactttctatctttgtaactgtccatgaaactgaataaactccctgcagctgcgtactccataaccatcttgtagactcggaatccaccgacatcgaagtcctcttctaaagtataattcccatagcattgcacgatccttcgacatccttcaagtttggatagaatctgaatttctctttcgagagagttgtagtcttcacattcggcggttttcacggcggcgtaaagaggcaaagcgttatcgtcgcgtttgatgtacttgacgagatcgactgatccatacgcaccttttctcaagaacttcacgaactctgtttttggttgcatcttcggaacaacaacaagagttattatgcttcgaatctcttagtatctctcaaggtttttggtaactttgaactgtaattaaaaaccctagaaaaaaacgaatctcttgaaaagttgcagcgacagatagagagagttaaaaaggaaactttggtagctttagggttttttcaagtctgtgacttataaacgtcgagagagtgtaagcacgctccataatctaccgctgttcacaagtaataatagatcttgtccgttgaatttattttagactttttttttaatggacttcattttaaatttttacaaaattaaattattgcattttctatttcatattgaattaggagatgttactgtccgtcagattctctagacttttttttttaaagactgatctatgatcagaattccaattttttttttctttaaggaaatacatcagagagaaaaattattacgaaacgattctattacaagtaatgattttaacctttttttttttacaattgacaatcttttcacaacaaaaatccacaagaaacgttagacaatggcataaatttatttaaattaatccgtatatattcgccttctatgagaattgaattctataccactgtaaaattcttaaacgagataagattattttcagcatgtaaaaaatggtttgtggtttcaactcatttgggctattagttttacatttaggcttgcaaccttgtcggtttattttgtgtaggcttttggtagatttgggcttgcaaacccaaattaacttgttggccgacatacatttgtttctattacaaatttaacaacaaacgtcaataaatacacgtgaaggaaatgagaacgaccctcttaagtagtactggaaattgaaaaaaagaaatctagaaatgctaacatgtaagtttttgttaccaaaaatgcaatttgtatgtagccacaatttcatggccgacctgctttttttttcttcttctttctgaaaaccacaaatatgattacacgtggcctgaaaagaacgaacagaaactcggtaatgtgcaaaaaatatcttactcttaatacgtgtaattttggagtgtaataggtctatcgatctataaaacgatactattggagattagattcttctcatctcactttgttcatctaaaaactcctcctttcatttccaaacaaaaacttctttttattctcacatcttaaagatctctctcatg

SEQ ID NO: 13807 - DNA, 3000 bp, Unknown
  misc_feature (1)..( 3000): cDNA_ID_3032007_gDNA_ID_2214653_Annot_ID_136463 3000 nt of promoter + ATG
agttttaaaaacatctgtgacataataatctaatccatggataaatgggctcaatcctatgtctacaggcccagatagagccttctttggttcttccgttgacgaaaatggacccatctgttatttgcgatagtaccaacaaaaagaagaatccttattttattttctcaatatttaaggaaatcatttaagtcgagagttgaattgaatgatatggcggatgctaggtaggggcataaagtattgtgatagggacaatacaaatgtagatatgtatatgagcctatgacgacatgagtttgctcaattccacactttcttgtcaaatctgccttaaatccattattctcacaagttccggtttgtgtcacttcactaatgaccttcgaattcccaaatctttattagtgagactttatagcccaaattaacctggttctagtattaatttaagtatgtgaatcctcaaactgttcatgcctaaatatttataacgattattagaacaatactagtcataatggtataaattttgcagcaataaataacaaaatatgtacagctgaaatctgatcagaagtttaaagggacataactttttttaatagcatttcaattttttttataaattcaggtctacgaacgaaacgattggcatttttagtatgaaaagttagaataaaatcaaataatgtattaattaacagtttaacacatataacgatcgtattaaaactcatacgaacgagtaaacttgatgaattggctttctttttacagctcataatagtatagtactcaaaaaagtattggtatatcagtgtgtaaagaaacaaacgactatcgccagtatgtttctgtcacttatttagattatcatgagagattgaaaatggcgaaacgtgggtggaccatttttttttttttttataatctccttctcatcaattattgaacaattcaatctccagcagattattattgattggttctatatattgagttattgactaaattattcgcttcgtgttgccttcgaaattggatctcaattaactaacttatatactcatcttacttattttcttgtattttttttttttgataaattgtttgattcacagtcgagactttcgaccatatagatgtgtggtttgtggtactcaaaagctacatgatattgtatgaaaaagaagatataatacaatagtcttatgtctagcggccataacatatacattagttattcgtacaagtcaatgtgttattatccggaaactcataaaaatatgtttttgaaaattaaatgtaaagtaaaacaactggttagatctatggaatcatgaactagtgatatatagtttagattgacgggtgacatattgtgttggttagatcggagaataagtggtttattcataacttgaggtaccttgcaggcttccaaatgttttgtctttgtgtggtatgcattatgaaaacttattttgtttccttgttagctcacgagatctctagttacacaaaagtttactgtattagtatgcattatggtcttgaaaatttcttatttgttttacattatggaagcaaatttgtgcattgcattaaaaaaattaaaaatatcgagttgttcaattgttagtgtctgtttatccggatacatggccacatttaataattaatagggtttataaatagtattttacatttttcacttttcattttcaacacgtctcataattaatataatataaatccaccgattttcatttatacatttaatcttcataatcaaaaaagaagaagaaattctccataatcaccggcgaaaagatgatggtgagacgttgtagatatttttgggtttctctagtattcacactattgcatgagtgcatatatatgagagatctagattatatatctgtaatctaaatttcgatgaaagaagtataacttcattccaaaaaaaaaaagtatgattaaaaaaaaatgacaacaaataattttattttgacacgaattacatataattttatttagacacgaattatacactttctggttcattatgtcaatgataataactataattacacccacacagttatcgaaggtttacgaataataattggacaatatatggctcttactcttgtactatttgtggggcttatgtatactcaaatctacacgtacgtataaatcggtgtaaagtcaaagttggacccgcttgagactctctctcacaaactattttttttatattttttttcgacactcacaaactaaattttatgaaattgtattttcctattttttgcatcctttacctaccaagcgtccaagcctacttttatgagttttttttttctcatccttttaattctttcgtaataatgaatctatactgaaaaagtgtatttattagctggcaattgacacaaaatattaacccataatttaccagcaaattacttatgagcttataccagcaaatcttttaatatttttgtattttttataagactgatagtttttgggtaaaaacgatgatttattattgataacacgaaattaaccaataaacattgttggtttttcaaagtcttggtttcagcttatttgaaccaagctaactaaaaacagtgttgcaaatttcaacattttcttactgttgagataatttaaagaaacgaaaagaactactaatttactacagtaaaaaattctaaaacaagagaagtaaaatattggaaggtacctagtaccaaattaactaatataaatcgaataaagacatataaaggatcttgtttcttgtttcccccttcccatgtgatgtgaacaatctcactctctttctctatctctctttcgagtttctttggagtattatataacaaatcagtccaagacacctcttttctcacaccaatctcgctctcaccacaaaacagagaatctcagatcgaagaagcaaagaaagagagaatg

SEQ ID NO: 13808 - DNA, 3000 bp, Unknown
  misc_feature (1)..( 3000): cDNA_ID_2704179_gDNA_ID_2214653_Annot_ID_136464 3000 nt of promoter + ATG
aattcgtgtagtattttgactaaggaattgtcttaatagaattaagcagttacaaagttttatttacacaaatattttttcctctcggcacaccttgaatcaaatcaagcatcgtttaaattaaattactgtaatggattagataagtactagtaataagtaaagtatgtttgccgacgggtgaaattgtaaaaaagattggatactttcttttgtttgatatgaaactcgaatctcgtgattaaaaagatggcccgacagtgatttaatgagagtcaacaaaaaagatgtaaaacacattattagcaactaattgtactttatttttataattttcacacgtttcctcttttgtctattttgattggggtcattcatgctcaaacattacagcctgcgcattgtattatgttttgtatgtctccggcggaacaaacaatgtgacatgcgtttgaataatcagtctaattgtatgattggtgtgttcattcgctattaatgcaaatggtgtccaaattattaaattttgagttaaatccgtggagaaataatattcctttcattttaaagcaagtgtcgttttagactgattttttttatttatgtcgtttatgaattaagataataaagaagtattaataaaaatgtgagacataaatatataattctgaaagccaatcttatcttcaaatgcacatttcacttatacgtattcagtattctgccattcaacaaacccataatttattttgtctatggtaaaaaaaacgcatatagtcagtcatattagaattattttacgaatgtaatttttattgctacttatcatgtatgcttaagtgaaaatagtgagtcactatcgtcattcgtcacccatctcatgcttggcgttggcgggctcgaggtcagttttcgaataatccgtcggtgttaacagaataatccgttattgaaaaactaaacgccgttaacggaaactgtgtgcttagctggcagacacagcagagaagtcaataaccagctggcatgatcaccgttttgcaattatccccataattaccgcaacacccttctatttttttatccttttttttctttaattagtatttactatttattatcgttatgttcttaattatcctattattgttttaaatatttttatatagcgaaataatttatttaagaaaaagtcaagagaaaattaattgactatatatggaaaataatttgagggtgcgaggcatgacctagctagagaaaaataaaataaaatgaaggcatgcatggtgcttggttcaatgtaattagtggttccgtaggtctgaacggtacggactggccatgatctactagaaacagtaaatagttaatacaaagtaattaattatgagtttcagcaaattaactactctatatcgaatgaattaaacagtaatccccagaaaagaaaaaaagagaactatgacagccttttcaaaggacacccgaaaaccaaaatgaagattttaaaaatgccagctctgcaatagatattgaactttcatttgtaattttctttatttttgttgcattacacacatttgttatttacatttaaattggctattgcaataaaagattactttatatgcttataatagtacaatatatatggtggcttaaacaaaagtttggctggcttgataaatacatcttacatcgaatgacgattttaccctctatcttgctgtctctgagtacgagggttgaaatccttacgtggcattttttctcatttttcttggtcaaatagtttaaccaaactccaaaagtctgtgatttgttgacatacttctaactaatttttttttataataaaaatctattgtatctgtagaaataatcattagatttactttctagaatataacttcttatttcttagtaatttgtccagatttttttttacaactaactaaacactagttaaaatgttaatgtctaaaaaataccattacaattattcaatttaataaaaattgagtcggccaatttaatgcgagacttctgtacaacgaccctaaaagtgggtttgataaatgaaacatattgcaacaaaaaaatactagtaataatgataaaatagtaacatgtcgtggcgcattgaatatcctacgaaggtttagtgtttacttttaaaaaatcctaatatgatactagtacatatagctagcttgccttgcttatgctattgcatagtctgtattaataaatgatgttatacatttcgatagagtaacattttgggaacatgagtgaacgtgcttgaatcttcgtgcccttgacgtcagaagctagtaattttaaatactaattaacattcatacaaattaacagatacaatgtactatatcataattcgtttccgtaacacaacgcaacaatttgaaagtagatgtactttagtacttagttagtgtgcaccaaaaaaaaaagatgtagttagttagtaaggggttaaatgttttaatttattaagaaaacttaaattcattaaatgttagaaaaagtctaattagtttatattcgaacactgtgctcaaaattaaaaagtcaactattttagactatagagtttattaattaataataaattcgataaatcaccgtattattttcttcaacgacaagtagccgtgaagacacgggagcgaagagagataaacagaagatgaagaagaagatcaatgtcataatcttcagggagataaatccgtaatctttattaatcaaggttaatccttttttttttcttcatcttaattctttgcgtcttccttttctatttatcacgagatctgtctttctttttcctcttctttctctctcttctctctgaagacagtacttgtttctgtccggcgttaaaagcttcggtggtggtctcttgacttctctgagaagaagaaaaggaagctgagtctcattttagattcagctcacgaggaagtgacgacg

SEQ ID NO: 13809 - DNA, 3000 bp, Unknown
  misc_feature (1)..( 3000): cDNA_ID_2704183_gDNA_ID_2214653_Annot_ID_136466 3000 nt of promoter + ATG
gcacggataacgtttggtttgaccttttgggtttgtcataggtcgttttatttggtcggtacactcgtaatctctaaacaaaaatatatcactttagtcacacctttttatttggggtcattgtgcatgtgtgtaataataagtgaatactgaatcatcattctagtctctaatacatcatatacaactacataatagttaactaaatgctaactcgtgtgcgtaaattactgtattactatagtgttactgttatgcatttttgtctgagacgatgcaaatcttgatcatatactatatacagggtaattttagcatgcacaagtttatatttgcatataaatatccgaagaatatccgtagaacagttagaatatattcccactagccaccactatctcaaatttcattttcagatctaaagttatgcttttattgtttcttttctatataactcaatcatataccattaatatcaaacatcacccatcacataagttacgaatgtccatttccgcaccggacttaacttgtttggagaaaatgtaatatcactcatggcaataatcaaccatgtatgcacattgattaaaatgtgttttcccgatggagagcaaatatatcttattcgagtgatcaagttcataaagagctcgaattagttatgcttttattcaaagtagagcaatttcataaaactataatatatcttaactgtaataacagatcagctggctaaatactatgatgctactactgaagatgagattgcaaaacataaaacttgtggcttgatgagttcatatagaagatataataattatgcaaaccaaaatatgtatacgtacgaatcttcttttaccatacggatcgtcgtcggatactgcttgtctttttctctgtttttttctcctaaatatcacatatatattcaatgtgagaaagtatgagaaacaggacaaaatatagatattggttcgtaaagtttttagtggctagagttaaataaggaattaaatgagagcaaatctctttgatatacacctcatatcaatgaaaaaacttaatattggtgtatttgtttctttcgtccgactcttgaagaattaaaaggttatatacaaaaaaaaatttgccctttcacattttctaaagatcatatcatctttgatataatcgtttgatgcatgtttactcattcataaacattttataaaatcttctatattattttgattcgaaatttcacactcaaaacataaaatttccaaggataaccaatgaaatgaatacacaagatataatataagttatcaccataaattacataatcagtatagataaagaaaatgttctgaataccaatttagtttataaatttatttttttcgtttatgatttatcaatggttcagttgagtggtttttaattaaaaaaataatattttgttcaacaaaaattcagaacgatggttggaaaaaataaattaaaacaatgcgtatattggattaaaaataaatcatattatatgattctatttgtccgggatttataaattgatatgatacgataaggtcagtgataaaataaattgataagataaggactttatatgattctatttccacccgttggaatctttggttggctatttattcttagattcgagaatcaattagcgaaaacaaatactagtttaaaaaagaaaaaaactatatgataagagaccgtaatagacgtggtacgttttaagtcaaaggtcaaaaagccgaattatatatttctggctccttccacaacttttggaaaatttccttcgtagttttcacttgaacccattttttaacaacaattcttctacttggattgataattcaaaaggaaactaactctcccatagttaaaactgaatcactgttaaaaaaaaaaaaaagtaaagtaaatatactaaatcaatgtttttttctctggaagtaaatatacaagtttaaaattaaaggagaagagaagctatatattgctttgcctcaccatttaggagataattcatatgaagcaaagaaagcatatcctttggcatattcgataatatatggcatctaatcatctgtataagcttttcatatttttgttagatgctttttcgtacaaatgcattaagataaaattaaacaaaaaaacaagatatgatattcagtttcgtgaaatattaaaagaagtcaaaaaaagggaaaaatgaaaagtcgaattggtggacagtggactcattggtccacttaaaagtcatcagaaccgtacacatgcaagcttggtccattttcgtatgacgacgtacaagttacaacattcaaaaaacttcctaatttacaagtttttgcttatgtttatgggaaatatttttctgcaacgaaaaatcattaagactatatttttctgttggcaaagacttgactcagtccctttttactgcccattagtaatctttggagtgaaaatacgaatttaactaattttctaaaatttgattaaagtctaagagagaaaaaaagatttcggctataaataagttacaactacacatcgaatggactagaaaattttcgcttcttatatttttttaaaaagaaaaaccaaaaaatcctttgaaacttttttagcctgtcgcttctctttccatcgtcttcctcgtgaacgaaacttctcgatcttcttttcttttttttcacctgtttttcggtatcacgagaatactacacttcccactccagtaatacgccactccttctttttttttttgtctcgtttaaatttttataaactccataattttatcttaaagtgaatcttttttgttttttttgttccagctttatcggatatatttccttgattttctccgattgtggtcaatctggaaaattattgagaatctctccctcacttaaccaaaagcgtttttaatcagatagagagagaggaaaaagcatcaaccaaaccatg

SEQ ID NO: 13810 - DNA, 3000 bp, Unknown
  misc_feature (1)..( 3000): cDNA_ID_2704191_gDNA_ID_2214653_Annot_ID_188709 3000 nt of promoter + ATG
ccaattttagtttcattgttttggttgtaatttcttcataaaaccattcaagttctaattgttgttgtccaacaaaaaaaataaaaaaatcaagttctaacgaaatagtaatattatgattcttgagtagcaagaacgatcaaaaactcaattttaaaatgtttttgtacgtgagatgaaagaatatttgaacttttggagatctaagttgattcgttatgtgttttgatgtccgtcagttatataatatgtgggtattatgagctatgaagtgcgtttgatgtccaaagtctaaaagaaaaggtgagcaaaaataagacattcttactttataatctgataatatatatataatgtagtcacttatccatacattatatataggattagtaccccctcatcatgcttcaacgtgtgatctctttctccacaaactattttttaagggaccgtgtcttcgtatgtggtttttctgctcgtctaaaaagtcaaaatttctgatggatttattttaccatccattgtttcacgttttccatttcatgatttcatgcgtgctaagtaaaaggtaacttaaagtatgctatataaataattacatattattataatgatcattctagggatttatctaaccaagcatgaattctgataaagtcaattaccttttctgtgaagaaaaaaattactcaactacaagtgcttatagttcatggtttctcgatggtgcaagtgtcactcaagacatcttccttcacaattccctactcacaactaagtgcctttgatccaggaccatgagacgtcttttagtttagcaagtacaaattgtacaacttattccttttttctaataatttaaaatcattctttatggatgtttttgaatatttatatcaactagaaattaatctgtaaaatttttagaaaatattttaatgcatttgacatgacctctaaatagtttgaaacggttgaattgtatacatggttcattgaattatattcactttgataagataatattgtattacattaaccaaatatatgcccaagttaattcagccagtctataagcatgggcacaaaaacatggtataggtcagtggatttgaatatatttagtacatagtcgcgtttatatgttgacgcatgtgtaatcacatgtatatgtatgcgtgtatgtgtttttgtgaccggcaagatgagtaggcaagagataatgcatgccctacaaatcttaaatttctcactttgtaaggaaaaagagaaaaacgaaaaataaaatttagttgcaaatttctcactattgctttcgtgattatgctcactgagttatccattaagctttttaaaagttaaacactattttgaaaatataaattgtatttacgttggagaaataatcaaaacctatattttatttaatttgtaacatgactgagcgccgcttattaagcgggaaacgtatctaattaaatactctttgaactgaatcgattcactgtattggatctatatttctcttaaaatggaaatgaagttcagcttatcttttagttgttgcatgcattcttacgtgattccaattatgaatttggaaaagactcgatattcttacatatatgttatgggtttgggatttatctagatcctgatcttatagtaaaattatctgcagtttaaatacatttctgtacatgacacaaatcagtgtttttgatgctgttttattccgacttcatctcttgttgcagtcagtaacttaatattgggggttttcttaatattttaaggttattgaattctaaatcttgcaaaatagttgtgtttagttttagttattttcctattaaagctcatgtctatcaacaaagaaggttggtattattcttgagggacataaacaaatgttagatgcatgcacgggaaaaaggtggattgttctttacaggaaaaatatgcaattcaagtgggaacataagggagagagagggataggttgattttgactcttgcaatttgattatataatatcaaatatgtatatttgtttaatgattaagaacaattgtcaagttacggcgattccataataatacgaatgatctcacaaacaaaatttgctgtgcctctaccaaatgaagtattggtcaacttgtgacaatggcgatgattcaaatctattatctcatacaatttttttaaagataaggtattttttgtaaaacatttgaaaggagcttaagtaactatgacacatactgcatgtacagtaaagcatacatgtacccgtaattaccaaattcgaagatcaaagtttcgaaatcttttgagtcggttaatgtgtaaatctctctttatcataccaaagtacatgcatagattacaactaaaagctgatgagaacacacgaacgaaatgaaatagtcaggacattacatgcaagcatgcaacttcgtatatcctaaacctttcattttgattagtgatataatgatatttacattcatagagaaaaaagggtatgcaactatgattttggtttctccaaaatagtatatcatcgtataagtacgcataacaatctttttgaccaatgacaacacaatcccattatctattggttatgagtattttgataaagtaaggatttataaagtacaatttgaggatgaatattttgtaggcttaattaaagaatgtatgttctattttttttttttttttttttgacatcgtatgttcttatataattaacctcaaagataatttagatttaatcatttaaatacatatgatttttcaatcaaattacctcaaaaaaggaaagaattatagtactatctatattaaaaagaaaaaaaacataaaagaagagagaagaagaatgtcagtatcatcacgtggctctctctctgcccaacacaaatctcttcttcttccttcttccctctttcttcttctaaaatctcctctcttgtagatttgccgcttctc

SEQ ID NO: 13811 - DNA, 3000 bp, Unknown; identical to SEQ ID NO: 13809
  misc_feature (1)..( 3000): cDNA_ID_3031995_gDNA_ID_2214653_Annot_ID_188706 3000 nt of promoter + ATG

SEQ ID NO: 13812 - DNA, 3000 bp, Unknown
  misc_feature (1)..( 3000): cDNA_ID_3031999_gDNA_ID_2214653_Annot_ID_188705 3000 nt of promoter + ATG
aaatcctttgaaacttttttagcctgtcgcttctctttccatcgtcttcctcgtgaacgaaacttctcgatcttcttttcttttttttcacctgtttttcggtatcacgagaatactacacttcccactccagtaatacgccactccttctttttttttttgtctcgtttaaatttttataaactccataattttatcttaaagtgaatcttttttgttttttttgttccagctttatcggatatatttccttgattttctccgattgtggtcaatctggaaaattattgagaatctctccctcacttaaccaaaagcgtttttaatcagatagagagagaggaaaaagcatcaaccaaaccatggctgcgagaaatttggagaagatggcttctattgatgctcagctcaggcttcttgctcctggcaaggtttctgaagacgacaagcttatcgagtacgatgctctgttactggatcgatttctcgatattcttcaggatttgcatggcgaggatgtcagagaattcgtatgttttcctccttttctcactctttcttctttcttaaatactggatttttgctaaaattttgaacttttagttacatagtgggttacccatcagtgaatcatcatgtgggtttgttgtttctgcttagattatccataaagttgaatccttttcagtgatatcgagcagatcagatcacactgtgttaagattgttcatgttattctctgtttttgttgggtttgtgagtatatttgtttgcttcagtggctcattgagtttgcatctgtgattgtttctgatgattttcagtttactgaatcatataatgtcttttgttttgtctaaaaggttcaagaatgctacgaagttgcagctgattacgatggaaaccgcaacactgagaagcttgaggagcttggaaatatgctgacgagtttggatccaggggattcaattgttgtcactaaatcattctccaacatgcttagcttggctaatctggctgaggaagtccagattgcttaccggcgtaggattaagaaactcaagaaaggtgatttcgctgatgaggcctctgcaacaacggaatctgacattgaagagactctcaagaggcttttgcagcttaacaagactcctgaagaggtctttgatgctcttaagaatcagactgttgacttggttttaactgctcatcccactcaatctgttcgtcggtctttgctccaaaagtttggaaggtttgtttaacttttttagtgtcttgacattttggattccttgtgtgtgtgacttgactgatgtatttttttgtctcaaatgttttcaggattcgtgattgtttgacgcagttatatgcaaaggacattactcctgatgacaaacaagaactcgatgaagctctgcaacgagaggtaagcgaaactaaagaactcaataaagcttcttttgcatgaattctactaaaactctgtttttgttgcaccagattcaagctgcttttcgcacagatgaaatccgaagaactcctcctacaccgcaagatgaaatgagagcagggatgagctacttccatgagacaatctggaaaggagttccaaagttcttaagacgtgttgacacagctttaaagaacattggaatcaacgagcgtgttccttacaatgcgcctctcattcagttctcttcttggatgggcggagaccgtgatggtacactcttgcttctttcttatctcaaaccattaaaacatgaattggttcttatgagtgaaaacattttctgaatctaggaaacccgcgagtaactcctgaagttacaagagatgtatgcttattagctagaatgatggctgctaatctctacttctcccagatagaagatcttatgtttgaggtagcaaaaattttattcacatcacagcaatttagtttattggttaatgttaaggacagagatcttattttttttggtttgatgtgtttgtttgcagatgtctatgtggcgttgcaatgaggaacttcgggttcgtgcagaacgtcaaagatgtgcgaagagggatgcaaaacactatataggtgtgtgttacattcttgacatttttttatgtgtccgacatgttaacagtttgttatattatgtttgatgtatgatcgatttttggatggatgtagaattctggaaacaaatccctgcgaatgagccataccgagctattcttggagatgtgagggacaagctgtacaacacacgtgagcgtgcacgtcagttattgtcaagcggagtttcggacgttcccgaagacgcggttttcacaagtgtggatcaggtgtgttttcgtgctgtttgcagatcaactagagatgtttaagccatataactgcaacttcaattcctttgaaaattagaatcgtatttgattaaacatggaagctataccatactgatgcatagtttatttggtaactatttttctaaatttgaaaatcccaaaccaaaagagaaccaaaatatggattgaaccactctaagatcaaagctgttgtttgtttcttgtttgattgattttataattttctaacctttgattgtttctgtttctatccaaagtttttggagccacttgagctttgttacaggtcgctctgtgattgcggtgacagacctattgctgatggaagcctgcttgatttcttacgccaagtgtcaacatttggccttgctcttgtgaaacttgatatccgtcaagaatctgaaagacactctgatgtcttggatgccatcacgacgcacttaggtattggttcttacaaagaatggtcggaggataaaagacaggaatggctgttatctgagctaagcgggaaacgccctctctttggaccggatcttcccaaaaccgaagaggttgcagatgtgttggacactttcaaagtcatttctgagcttccttcggatagttttggtgcttatattatctcaatg

SEQ ID NO: 13813 - DNA, 3000 bp, Unknown; identical to SEQ ID NO: 13808
  misc_feature (1)..( 3000): cDNA_ID_3032003_gDNA_ID_2214653_Annot_ID_188703 3000 nt of promoter + ATG

SEQ ID NO: 13814 - DNA, 3000 bp, Unknown; identical to SEQ ID NO: 13807
  misc_feature (1)..( 3000): cDNA_ID_3032007_gDNA_ID_2214653_Annot_ID_188702 3000 nt of promoter + ATG

SEQ ID NO: 13815 - DNA, 3000 bp, Unknown; identical to SEQ ID NO: 13806
  misc_feature (1)..( 3000): cDNA_ID_1808014_gDNA_ID_2214653_Annot_ID_188699 3000 nt of promoter + ATG

SEQ ID NO: 13816 - DNA, 497 bp, Unknown; identical to SEQ ID NO: 13805
  misc_feature (1)..( 497): cDNA_ID_2994569_gDNA_ID_2214653_Annot_ID_188697 3000 nt of promoter + ATG

SEQ ID NO: 13817 - DNA, 3000 bp, Unknown; identical to SEQ ID NO: 13810
  misc_feature (1)..( 3000): cDNA_ID_2704191_gDNA_ID_2214653_Annot_ID_136468 3000 nt of promoter + ATG

SEQ ID NO: 13818 - DNA, 1224 bp, Unknown
  misc_feature (1)..( 1224): cDNA_ID_2704198_gDNA_ID_2214653_Annot_ID_136470 3000 nt of promoter + ATG
tttttcgaagattgaatacattcgttgattttctattatactcttttcaaaaaaagttcatcctcatttttcatcaaactcttgttagattcttgttcatttacatcatcctcttttaagaaatctatctcatatgcatgaacaatctgataatatattgtcattcatagtgtaatgactatcaaatatgtatcttgtttcgaagatctttgagatagaaatggatgacaaaaacaatccatgtaggtagaggacaaaattgtacttatgaaatatatcctgtgaataagtgcttctcggcacgtgactcataatccctcgcacgtgacttgcttcgtcactttcgtaaaaccccttgactgtgtttttgcttcttccgccatcaaaatcaaaactttcaaaacctccaaaatccaatttttatctcatgaatctctgttgcaaatctctatgcatatacgtacacatactctatatgtgtgtacgtttagctctttgttgcttgatcatggcaatcttcagatctctcttctgtctttctcttgtttcgcagtgcgatttaagcagattgattgctggattttggaattggaaggacgtttatctgctttctgtgagttttttcataaacccttattcttcttttgctctttagccttttcttatatgattttagaccgtttggtttatgggttcttgtgtgtttgaatccatcgaagttggtgggattttattttgaaatgggttttgaaatctatgcaggaatttgaaattttgcaaccgaggacttgaaaatgggagctaagtgttgcagaggtcaccgaggatcagtggtggaatcaaatggttccgtgatcttgtcgtaagttctgaggctgaattattgaagtgaatctcttctataagtatcgaaaagtccaacactttgaataagttttgtagccagtctttgagaattgtctactagttaaatgctttgataaggaatatatggaatgcaacttagtatgtcactgaaacatttatttctgcaacagtatatccgagtctatatttacttaaccattctgcttttgcctatgtaggttagctgacctagaggtccaagctactggtaagcgaagtttgattcttaatattttggtacctacgttattcgtcttttcttgagtgaaacctatgggctaaggagacactcttgtgattttagaccttagggagatg

SEQ ID NO: 13819 - DNA, 3000 bp, Unknown
  misc_feature (1)..( 3000): cDNA_ID_1029952_gDNA_ID_2214654_Annot_ID_136474 3000 nt of promoter + ATG
cagaacctttcaagaaaatttctggccggcaatgaacaatcttctgatcaaaaactgtattagtatatgtttgatatataaagtcgtcgagtagaagttttgagcaaatctttattgcttattactattagcctgcaagaaacacacaacaacaccatctgcattagtataactgtatatcatattatatcttccccaagttatagtgatagtgaaagaaacctttttcaggaatttttcatggatcttcaacgcttctttacatgcttttttggcgtcaagattacccgcaatgtctcctagtatctgcataccaactttaactttgaagttccagagtttgatttttccttgtttggctttgagagaaacgagtgaaaagatacagagacagacctgaacaacatcgtctaagcctttggcctccttcaagagacgtttgttctttgtctgtagaacgcttgcgaccacaaaaacagcaagcgtgttgcgatgttgctcgttctgcccactgtttatgtatttcctttcaaacttgccataccgttttagtaacttgggatcggatgctgcgttgtttcggttttctagttcctcgtacgttgcaaacatggttggattgtactccatcgcccacatcagctgcaaccataatccatctcacattattctcattacccaaacagcagataacgcaaaaaagaagaagataataaacacacagcaagatcttacggcttcataaacaatcacggcaagtaaaaccaggaaccaagaaaagaaatgcagaaagtttgtcattacctcccaaaggtacaaagcgtcaaggaaagagaattctctcctgaaaagtaccatcagcatccgaatagcaaatagatactccccaccatcgagatcctctgtcacattaacacgttttagcccaccacaagaagagtttttatgataggaaaacactcttacctagatgttgatggagacgaggatccactgtcttaatgacctgtgagagcacacccagttgagtctggacacccattgatgttgctgttgccctgaaattttctctctgaaattcaaagaaaacaataaaccgtgaatacaatggtctggtaatgacatgaaacatgagaagttatgtcataggctattagttattactagtctccgcattgcccgctcaaagcaccagaaagcgtcgccttcatcatcaaagaggattatcattggggaacatatatcattcattcctacatgaatagacaaagtggatcagttctgtttcttatatagtttcaaaagattaatcgttaacagcaagtacacttaccctgaacataaccaatatcaagattcaaccacgtatatatggcaagaacgtcccatagttttgattgattacgatcattctcataaaaacagagataccgatctgttctagcaacatcaaggcctgaaacaaaatatacaagaatatgtaaaaagaggttataagaagataatcagatagaactaaacttatttatatgtaaaggcataccgatctggtgtagtgagagcatccattgtagcactctctcatctgtaacagtgtttttcacgatccatccttggttttctacagaagattcgtctattgggttcccattttcttgaacgactgccattgtgacgtacttgccactaccaatgacaggaaccattttcttacattcttctttccatgcaccgtactgctcccttagatgatcaataacatttaaagttagccatgacgtgcatctacaaaactagtaaatgatcaaccaattctatagtaccttctgcgattcctcagtatgttcctttcctcaaaagtgctgtctggatcgtagcatcctaacaaaaactcccaaacagcgcctttgatggaaggatgaattccctagcaaagaaaccaagtgaacaacaacaaaaagagcatatagatagaaacaagatcaggaaaagaaagtagactcactccgcgctgtatacgtctaagcactttttccatatccaaatggccatcttcagtaaaggcagcgtgccatcttctagcacttagagtctttccagcctgacaaattacatatcaagatgaatcatttcatcagctacaaacaaacaaacaagaacctaatgtatcatcaattcatcaagacatgaaacaggtgattgagaagaagaatggtacccttgatttaaaacgggtcctgggaacatctggttgacattcaggtctaactggatagaaaccttgcaaatcttctcctccggatttccacataaatccgcagcaaaacattcaaccttccttcttcttgttcaaaccaaacttatagtttcatccatctcccacataaatcattcatggattcatcagaccactgttcaagaaataaaacccaggatcagaatggagaaaaaatgaaaactttacaaatatgtaaacgaaaacacaaggaagatatattctttttgcaacgacgaagctcccattgctcaataatatatataaccttaaaatcagtatcagaacaccatcatcattatcatttggataatccagaaaccgattagacccaacaatttgaaattgtctacagagagaatacgaacaaaagaaaaatacatacagattgagatcctaaacagccggaatcttcagagacatgcccgtcttcttcttccatctttcatctttcatctttctatttctagcagagtactttcctttttaaccgaaccaagccgattttattagctccgatttcaaacattaaaccgatcggtttcggtattcttaaacgacgtcatgtaatctctccacatttaatgggcctttaaaattgttagtgggcttctatatgcttatgtgcctaattcttttatatcaaaaaccctaataatctcttgggcacataaaaatctcttcgccgcacaattgctccaatctgtttcttctagccggccaaa

SEQ ID NO: 13820 - DNA, 3000 bp, Unknown
  misc_feature (1)..( 3000): cDNA_ID_2704240_gDNA_ID_2214654_Annot_ID_136476 3000 nt of promoter + ATG
acaatagagtttaattcatgagtaagaatataaaataacaacacagtttttttaacggaaacagtgacttttgagagtccacaagcaaaaccaaattcacagaaaaagtatcaacaagcaagcatatagtcttattctttttaacttctacaagagatgaaacatggaaatttaatagtaaggtgtcaaaaccaagcgcaatgtatatgaaacggaacttatatctgctaaaatgaagattaaacaagcaaaaccaaactcaatgtgtccgaaagaacttctatcttccttagcttaagatatatcaaacagcaaattttaagattaagcaaacataacaaagcttcagtgtatctacgaaatttaaccttcaagaactattgaattgaatgtatatgaaactacctataacaaagtcggtaactctcctcaagaacaaaaacagagatttatttccgaatcacagaaacacatgaacgaagttataaaatacgaattaagaatactgaagaagaagaagaagatatgaacagtgtgaaggtaccttagttgtgtaaaccttctcacccttctcgttgatatagcactgaagatacatcttcgtttagtctctgtggagataattcaagttagagctgacgacaagagaaaaaaaaagtaacaaagctgattaagaaattggcaaaccaagatggtacctcagagatgtttcttggttctgaatttatggagacgagaagctgattagggtttttctggagcagaagtagcagaggttttacggcgaccctcgtcaatgtgtatataaagttctagaagagaaaacaaaatgggcttttttgatataaaaaattgtaaccccaatcaatgggcctactatattcagagcccaactaatgcacgtgagtggttccgtcacgtgtgaaaatcgccactaaatcccctaaaagtgaaatttccgatatttcgattcgccggcgaaaaagaaagagaaaacgatgaagaaatctacagagactccggcgagaccgaacgcaactgttaaaactcagaaacctcctttcagacctgccgttgatgacaccaaacctgttcttcaggaccctgtaaggatctctctctctctctctctctattttccgtacattgtgtgtgtttcgatgtccttaacgatgtcatttgagctaaagatcactaatttcgttttccatgtcatatgaatcgatgtatctccattttgtcaattttcttatgtttaggtctgaaatgtgaaagttaattgagagatcatgaagaatcatttgttcttctagaaagccatagaactagagcttcagatcaaacaaaaactttttttaagtatagataagaattttaaagccaaatggtgaaagttcacttcatttagtagccattagcaatttccatttgaatacattctagttacaaagaggaactatttcaccggtggatcaatgtttttccataatgaaattctgacttctttcgtgtgcgggtcaaaactgttttgtgccaattgtttgacgtgttgatgtaatatctagttgtaccattcttccaagaatatactgactctggattccaatggttctggttagggtttatcttctcaatacatgttatcttgaatgatttagtggatcttaatgcagtttgtaacatttatttttattagattctgagatcggatccaatggagacagaagaagctgtgctgagattgccttctttcccaatgatcagaccatctgaatcgtagctacctggattaacaaggttttttatctgatttgttttacattttgagcttgttgttgcttgtaaaaaccaatggggatttttttgtatgcttgataagcttaaattacaatcccatgttgattaataaagacacagctttaagagcagacgagtgatttagtagtagagcatctttgtgcctggctgcaacagagtgaatttcaataggagtctaatgcattactcatcacatgtatatgcacgcaacatttagtgacgtaaatggctttgaagggtaaagtttctttagctttgtcgtctatgttttcatatgtttgtttgttttatagttttgaggacttttgaatcttttgatgctgttgttgttggcccattgattcttcagcttgatgaacagagaagtgttgcaaccttttgatttaattgagagttttgtattcatcacgtgagaatcacgtggggtcggttaaatggttgttgcaacgactcagggttatagtggtcttactaattggaaatggggaatatttcgtttcttaaacaaaatattattgattttgtagacttttgaatcatttgtataaataaattcttgcgatatagtaacaaatattgtaaatttgatttgtttattgttgaacaaaactagttattaaggttttttttttcatagataaaaaatcaacacatattaaacttgatttttctataaaatatataaccaacaaaaagagagagagaaaaagtctgcatgtaagcatcagagaaaattacgctgagaacgaaggcagatattgatcctttcttcatcaacatgtaaatgcaccaatcttcatatatacacacatgcttatctgattaatggtaataccatacaattcatgcgaaataggtgctatgctctagagagtttcacgctcattcaattcctcttttcttctctttctcctttcctgatttttgttttttttttccctgctttgctttgaatctgtcacgttaaggttgttacaatcgcagattaatctagctttgttattttgactgagattttcaaagatcgtaatgtattttttgattccaattcgtaaggttatgttttgattgtagtgatgatgtgtgttgatttcgaaattattgtttgctatgcagaacgattcggtgatgagaagatgatcaatcatcagtgaaatttgtgtgtattgttaaagagttatg

SEQ ID NO: 13821 - DNA, 3000 bp, Unknown
  misc_feature (1)..( 3000): cDNA_ID_2704230_gDNA_ID_2214654_Annot_ID_136481 3000 nt of promoter + ATG
cggtgaatggcgggggaggtgtatgttccaggaacttttttctagatgggttcccacgtaactcatccttcacaatgtcaagtgcttgctttactatatcaaagggtttggcttccttcagcctgtaaaacacctcggatacctttggtgaagaaagacttgacttgaattttgcaaaaaatgtatgtagttcctccgtagaacctgattgctgtttttctccttgagaggctcttgtgcctgatgaactcgctgactctgcattctcctccttcccgagcttgaatgactccttgacctcttcactggctgctgagagcttgtctttcacacttgaagagacctgcaccgtcaaagctgttttgtaagggacgattgttagccttttacaatgtacaattttggctactcatacacataaacactgacttctaattcactaaagcaatttcatcagtaaactattttgttaccaaaactaaaagagaagaaagcatattcttaacataggaagcatcaaatctacgaaacaagcgaagacagatagcgtgccaattcgaggctcgtgaacaagaaccatacctttttggccgcagattcagcctcagtccacacaccatcagcttgcttgtaaagcttttcagtcgtttgtttcgttctgcaatagccaattcattcataagcttccattgacatacaagtgtataactcttaagtaaattcaaattacaaatgtttaacttacctcactttcaggtcctctgttacacctttaaactcttctgttctttccttgagctcctttactgttctttcaaattcaggattgctgcaacatcaaccatgttaacaaaaattgaactaagaacatcaaccactgattacaaatttcatatgcctcacatacataacaaatacacattacctatgagcttctcctctaatattcttcgagaactcggtgaaaacgctgaaccggcgatgactcgtatacccaatagcaggaagaaactctgatcttgcgtttgctctctaaatcaaacacagagttactaaatcaatcatcctaatcacaaaaactagttagaagaaaaagaacaaaatattcaccagaactcgttggtggaatagttgacgtaaaagaggctgctttgtgatcagtaaatctcgaattatctttctaatcgccattagaacaaccttcttcgtagtgaattgtacaaacaagatttgaagaaacagagcagcaaaagccctaagaatcggtcctcgagaatgattaagatacaaaaacatatttctggttatattgtttggaagaaaatggaaagttcaaaaaaattacttgacaaacaaacaaaagaagaggggattagattcgaatctgtaccatattttaaagatttgtttggaaagtcggatatacatatcctgagtcgggttaataagtaaatagagagtatataagaagagtcgttcccaaacactacaaagcgctcaaggtctgtgtttaatttgggcctttcggaggcccataatctagtagcaaactgatcggaatcaaactttggttacacgacaaaaagcttaaattcaaaacctaaagacgacaaaagtaactgtctcagtgtttttagtcacaagcaacgttagcgacggcgaaatgttcggcttgccggcgagccgccgactccgaaaccatggcttggatcagcatcgtcttcacttcccatggtgcataagagaaactttttctcgcgtaagagttgatcagagctgcgatcccctgtttcagcaatgcaccgtacgcgttcccttcttcgtcattcctagccgttgattccactagcgttagatcagatctccaccgttcttttgctaccatcactccgaatattttctccacggttgatctctcaggtaccatcctcggccatgcttccctctggctgctccaatacctgctcaaaaacaccaccaacgagttgagatatgactcagctaaagatttttgtaaagaaaatgaaattcaagattgattgatttactgcggcgtgcatcgtcctctgtgtctggtgtagatgaaaccaggcctcgtcgccgatgaatctccggcaaagaagcagaggaggaagaaggtgaccagaacgagtcgactcggagaacaaagtgtgtccatgatatgcatatggttaaaacagcattaattaatcagcccttggtcttgggactcttgggtcttcattaaatcgctatcaagaatctgagtttgcttgagttatcggtctcctctagttgcctattgctattacctcggaaaaagagacatactttgacgcttttacccttagaattcaaattaacgtgatctttttgtcaaagtggatagagtgaatataattattagggggatataaacgtcatttttgaaacgcacatgagtttgtctgaatctgctgctaaatacgtattctttttattatttttgctgcatgtcatcgtcagtcctcacgtgagctacgcacggcgcaccatgtgcccacaaggccacaagaggtccgaacgattttaatcctaaaccagtacaacgctattttgtattaagaaagtcacataattttaacagattagtttcgtcagtcgattatgattccaactttgttaatttttcatgtttttaatgggccttttcttatagtcatgccctacgaggatttttccagttccagcccaaattttgcccatgccaatgtcatgtagagcagtttcgttgttataatatatatgacccccacgttgcctatcaatgccagactatattcgactatatacacgtatccacatcattttaaatacagaaaaatgtaaagatattcatgaaccatgaccagctaacattttcaagttgtttttgttgttgtgtaatctaactggtgaaccatgagtttgtatactatatacgatatatattgccctacaaatctcttatgatcttatcgg

SEQ ID NO: 13822 - DNA, 3000 bp, Unknown
  misc_feature (1)..( 3000): cDNA_ID_1010115_gDNA_ID_2214654_Annot_ID_136482 3000 nt of promoter + ATG
aatattttctccacggttgatctctcaggtaccatcctcggccatgcttccctctggctgctccaatacctgctcaaaaacaccaccaacgagttgagatatgactcagctaaagatttttgtaaagaaaatgaaattcaagattgattgatttactgcggcgtgcatcgtcctctgtgtctggtgtagatgaaaccaggcctcgtcgccgatgaatctccggcaaagaagcagaggaggaagaaggtgaccagaacgagtcgactcggagaacaaagtgtgtccatgatatgcatatggttaaaacagcattaattaatcagcccttggtcttgggactcttgggtcttcattaaatcgctatcaagaatctgagtttgcttgagttatcggtctcctctagttgcctattgctattacctcggaaaaagagacatactttgacgcttttacccttagaattcaaattaacgtgatctttttgtcaaagtggatagagtgaatataattattagggggatataaacgtcatttttgaaacgcacatgagtttgtctgaatctgctgctaaatacgtattctttttattatttttgctgcatgtcatcgtcagtcctcacgtgagctacgcacggcgcaccatgtgcccacaaggccacaagaggtccgaacgattttaatcctaaaccagtacaacgctattttgtattaagaaagtcacataattttaacagattagtttcgtcagtcgattatgattccaactttgttaatttttcatgtttttaatgggccttttcttatagtcatgccctacgaggatttttccagttccagcccaaattttgcccatgccaatgtcatgtagagcagtttcgttgttataatatatatgacccccacgttgcctatcaatgccagactatattcgactatatacacgtatccacatcattttaaatacagaaaaatgtaaagatattcatgaaccatgaccagctaacattttcaagttgtttttgttgttgtgtaatctaactggtgaaccatgagtttgtatactatatacgatatatattgccctacaaatctcttatgatcttatcggatgtgggatacaattctatatatatatatacattttgtcaaccttcttatagtattgttttgcatttcttaattataaacattatcgtaaaatgtagactaagttgttaaaaacaatggatcaacttcttttgcaagtcacgcatacatgtcgtcttaaatctctccttaaaatctttctatataatacctaaagggttagctctagcacaagcacacacagagagatagagaaaaatataacaaattttaagccatgtcctcgtcactattctcttatgttgtcctcttaatcttccttttcaccatcccatacattcaaagccagcccactgctccagctccaaccactgaaaaaagtcccatcaatctcacagcgattcttgaagctggtcaccaatttaccacattaatacaactcctcaacacaactcaagtcgggtttcaggtaagtgtacaactcaatagctctgaccaagggatgactatatttgccccaacagataacgcattcaacaagcttaaacccggaaccctaaacagtctgacatatcaacaacaaatccagctcatgctctaccatatcattccaaaatactactctctaagcgatcttctcttagcaagtaatcccgttagaactcaggctacgggacaagacggaggtgtttttgggttaaatttcacaggacaagcacaaagcaaccaagtgaatgtttccaccggtgttgttgagactcggatcaataatgcattaaggcaacagtttcctctagcagtttacgtggtggacagtgtgttgttgccggaggagttattcggaacaaagaccactcccaccggagctcctgccccgaaatcctcaacttcatcgtctgatgccgattctccagctgctgatgatgagcacaaatctgccggatcaagcgtgaagaggacaagtctagggattgttgttagctttgcattgttttgttgctcggttatatatattgcttgaacctttaactaaaagcgagggaaacgttcccgaaaaacaaacatttatttgcatgattgatttgattcatctatgccttgatatttcttttttgaaatttcctttataaaaatacatgtattatttttttgaatttaaatacatgtattattaaatgatgaccaattttgaaccaaagtaagttatcaacaaaataaccacatcatctatatctcactttatataagttaagaaatttcatttaggtttagtagtaaatcatcaagaagtttagagcctttgcagtttgcaacaaaatatgggtttgaaagttacatttttgaaaagtgataataattaatctactatctattaatcaaaatgagaattatttcttttgtatagaaagtaaggaaatgtcaaatatggccgtttatatattaagaaaaataaataaaaatcgtttactaaaaaaaaaatatattaagaaaaataaataaattagtgaattcactaatgggcctgaatacaaattttgggcccaaagatctctagtaacagaaaatgcgtgatcgaccaaagcgtcaacaaaatcctgatttctgagctttaaaccctaacccctctcttctctcttctccacgccatttccagaattttcaggtacttcctctcgccattttcattatagatcgaattcttagtttaagcgagtaaagcttcagattcttcggcttcaattttgtgatctaagtttttgtttcgtttcagctaatttgcagattatctttgtctctttttcgttgatccaagttttccttgggtctaatctacaaacgcatttcgtttctctatttatctgtttctgccttggattttgattgggttccaaatttgcaggtgttcgtgaaaag

SEQ ID NO: 13823 - DNA, 3000 bp, Unknown
  misc_feature (1)..( 3000): cDNA_ID_1390897_gDNA_ID_2214654_Annot_ID_136485 3000 nt of promoter + ATG
aaaataggctataaaattcagtatccccaaattaaaaggccaaaacttttatttgttacaaaaataatggtaatagatttcaattacaaagacacgaaaagcaatcgatttccaattagttctaacaaaacattccattacgcagtcattaactttggagctggtgttggagcttcaccataaccgtttttgtgtgtgtgtgtgtgtttacgtttgcatgtttatgttataacataaagttaaagcacaaacacaattacaaaaacgtaaagaaaaaaacgaagaagaccaatgctttgttgcggtggcaactggcaagagaccacaaacgcaaccgcgtgagtaaacttcaataattcttgctttgtaaaatttcatgaaaaaaattgtcactgttatcacaaacaattaaaccaatattttgattcaactggtggagtttattttcgttattattttggttaaaatgaaaaatctattttgttgtggatgagcttgtggtgagcaaacttttgtctttgttttcaactactagttgggaccatgaactgaaagctacagtttgaattcatttgctgttcctttctattactgaaaaacatctcttcatttgattttcttaacggtaataaataatgtccgagtttctcgtgggataattgatgatactccaacaatcaagtgcttgccgttttcatcgactcaatggggcacttgtaaagaaaaaaacttgggtcagaaatagtaagcctcataacttaaaataacccaagaataatgaagcttctaaaattttgggccagaaatagtaaaagaccaaatgtttgatgatgaagagactagagagatagactatgatctgcccaaaataaacattttagatctcgtgaataactatggcctcaaagtgaaacggttccaacgtcgttaaccggttttatgtaaaacgaaaatcttcctctttctgatttggttaaccgttcggttcatccaaatcgaaccccatgaaccgaacgaaaccgaaaaccaaaggagatcagaatttgtttttatttttattttacatcaagggaaatcataactgatttggtaatgtttttggatctgcatctgctgcataaatttttatgattgattctttgattattgattttaaaagtcaaacttatcatgaatttcgtgtggtttgttgtgtagctcctggtattgctatggcttaacgaaagtacctatggctatggctatggctaacaagaagcagtggattacaaagctctcgctaatatcattatacaatgcaaccttttttattactagttggtgaggtgttaattaatcccttctcccagcatgaaataaatgtggaatccaaaacagaacattttgaagacaaagttaattacaatgattttaataattttatcttctactgtattttaaactagctatgttaaatcgtggggtacgtatgtatgttcccatcacattttgattccttttggtgcttgtaaatagtttttcatatttcatatgacaaagagttttattctataatattctctaatgttacacccatgtggttgcacaacttgcagttgcatcttcccttttaaaagttgtattcttctctttgaataaattcggtcttagaactcttccacaagccacaagaggagcattcatttgttgacaactttgaaaaaggaaggttccaagacaactcaaaagtcttgtagtttccccaaaataaccccgttgacttcagttaatagatgctaaacaaatagaaaccggaagggtattctcgtatttcagaaaaacccgccgcgtgggttcgacggttacgactctctcaacttcattcattcatttgaaaaaaactcacttttctccttttaattctctcttcctctttctaagaaaccgaaccaaaaaaaaaaaaacccaactaaaaacttagtcttttgtcttcacaaaatgggagattgtagacctctaggtttcttaataggactaccatttgctcttgttgctctcgttctcgccctcgttggtgctgttatctggatcattgggtacgtgtccgtttcttttttctttaatacgtatatacaaaattcatactatcattgggtattatgtctgttttttagatccagttatcttcattttcaatctccaatttcggttcatgtgttatttaaggaaatttcggttgaatatattgttgcattgcgtaaatatagtttataaattttcttcttacattacaatggagaaggaataataaaacattgataaaaatgaataaaacttttgcaggacggtattgagttgtttgtgcccatgttgcttctgtttcgctgcgctggctaacttcgccgttgatctcatcaaacttcctatcaaagtcctccgttggtttacccactccattccttgttaacaaaaccacttgttgtatttctttcttaatttatcactaattatttgttttattccttctcgttttcatgtaattttcttttgtaatccaatttttttttttctttgaaagaagggcttatatgatataagacaaccgattcgttcacaaatccataattaaattgaatctaaaaagccatatactacggatttgggtagaataataaaaagctcactttgagtccaatgttgtaaaatgggctttagcattttaaactccacagcttaacgggctagagagttacggtaacgaagaaaagcctgtgatgcaaacacgcgtcacccaaacaatcagaggttttcagagatttctcgaacgttccacagaattctccacaactctgagaagaaacatcatgaatccgtcgtttttaagaccaaaactcatctaatcttcaacaaaagactatcaaaagaagaaacagagcaaatttcattctctcagaacaaatatatacatattaatcagaatcaggaaaagtgaagaagcgaaagagagaagaagatcggatg

SEQ ID NO: 13824 - DNA, 3000 bp, Unknown; identical to SEQ ID NO: 13822
  misc_feature (1)..( 3000): cDNA_ID_1010115_gDNA_ID_2214654_Annot_ID_188731 3000 nt of promoter + ATG

SEQ ID NO: 13825 - DNA, 3000 bp, Unknown
  misc_feature (1)..( 3000): cDNA_ID_1389401_gDNA_ID_2214654_Annot_ID_188729 3000 nt of promoter + ATG
gctatatgccgcaaacataagattcactagtaatgctaagcctaacctaacttcagctagatgtcacaaccacaagattcattgtcaatatacagattcagaagaaaccaatttttgcagggactaaccttgtctttgataccaacaagccggttaaagacaatggctcgatgacctccatcgacattgtagagagtgtgcgtagcaccgtaaagactgagccccccaataaccaccgcagctataacaccaccaccaggacctttgggaactttgacattcttaaaattcatcttttcacgaacacctgcaaatttggaacccaatcaaaatccaaggcagaaacagataaatagagaaacgaaatgcgtttgtagattagacccaaggaaaacttggatcaacgaaaaagagacaaagataatctgcaaattagctgaaacgaaacaaaaacttagatcacaaaattgaagccgaagaatctgaagctttactcgcttaaactaagaattcgatctataatgaaaatggcgagaggaagtacctgaaaattctggaaatggcgtggagaagagagaagagaggggttagggtttaaagctcagaaatcaggattttgttgacgctttggtcgatcacgcattttctgttactagagatctttgggcccaaaatttgtattcaggcccattagtgaattcactaatttatttatttttcttaatatattttttttttagtaaacgatttttatttatttttcttaatatataaacggccatatttgacatttccttactttctatacaaaagaaataattctcattttgattaatagatagtagattaattattatcacttttcaaaaatgtaactttcaaacccatattttgttgcaaactgcaaaggctctaaacttcttgatgatttactactaaacctaaatgaaatttcttaacttatataaagtgagatatagatgatgtggttattttgttgataacttactttggttcaaaattggtcatcatttaataatacatgtatttaaattcaaaaaaataatacatgtatttttataaaggaaatttcaaaaaagaaatatcaaggcatagatgaatcaaatcaatcatgcaaataaatgtttgtttttcgggaacgtttccctcgcttttagttaaaggttcaagcaatatatataaccgagcaacaaaacaatgcaaagctaacaacaatccctagacttgtcctcttcacgcttgatccggcagatttgtgctcatcatcagcagctggagaatcggcatcagacgatgaagttgaggatttcggggcaggagctccggtgggagtggtctttgttccgaataactcctccggcaacaacacactgtccaccacgtaaactgctagaggaaactgttgccttaatgcattattgatccgagtctcaacaacaccggtggaaacattcacttggttgctttgtgcttgtcctgtgaaatttaacccaaaaacacctccgtcttgtcccgtagcctgagttctaacgggattacttgctaagagaagatcgcttagagagtagtattttggaatgatatggtagagcatgagctggatttgttgttgatatgtcagactgtttagggttccgggtttaagcttgttgaatgcgttatctgttggggcaaatatagtcatcccttggtcagagctattgagttgtacacttacctgaaacccgacttgagttgtgttgaggagttgtattaatgtggtaaattggtgaccagcttcaagaatcgctgtgagattgatgggacttttttcagtggttggagctggagcagtgggctggctttgaatgtatgggatggtgaaaaggaagattaagaggacaacataagagaatagtgacgaggacatggcttaaaatttgttatatttttctctatctctctgtgtgtgcttgtgctagagctaaccctttaggtattatatagaaagattttaaggagagatttaagacgacatgtatgcgtgacttgcaaaagaagttgatccattgtttttaacaacttagtctacattttacgataatgtttataattaagaaatgcaaaacaatactataagaaggttgacaaaatgtatatatatatatagaattgtatcccacatccgataagatcataagagatttgtagggcaatatatatcgtatatagtatacaaactcatggttcaccagttagattacacaacaacaaaaacaacttgaaaatgttagctggtcatggttcatgaatatctttacatttttctgtatttaaaatgatgtggatacgtgtatatagtcgaatatagtctggcattgataggcaacgtgggggtcatatatattataacaacgaaactgctctacatgacattggcatgggcaaaatttgggctggaactggaaaaatcctcgtagggcatgactataagaaaaggcccattaaaaacatgaaaaattaacaaagttggaatcataatcgactgacgaaactaatctgttaaaattatgtgactttcttaatacaaaatagcgttgtactggtttaggattaaaatcgttcggacctcttgtggccttgtgggcacatggtgcgccgtgcgtagctcacgtgaggactgacgatgacatgcagcaaaaataataaaaagaatacgtatttagcagcagattcagacaaactcatgtgcgtttcaaaaatgacgtttatatccccctaataattatattcactctatccactttgacaaaaagatcacgttaatttgaattctaagggtaaaagcgtcaaagtatgtctctttttccgaggtaatagcaataggcaactagaggagaccgataactcaagcaaactcagattcttgatagcgatttaatgaagacccaagagtcccaagaccaagggctgattaattaatgctgttttaaccatatg

SEQ ID NO: 13826 - DNA, 3000 bp, Unknown
  misc_feature (1)..( 3000): cDNA_ID_3032056_gDNA_ID_2214654_Annot_ID_188726 3000 nt of promoter + ATG
tcttttctctacaaactctaacctagagaaacaataacaacaagaacatatccttttaacaactgaaagatttgtaatccttctaacacagatgaactcaggaaatcatacctccccaaatgcacctttcccaatcattgtaagcaaatcaaaatcagcaacacctaacttatggcgttgaaggcgcatgtactctgtctccttcttctctaaaaacttgagaagattattttgatcttcttcagacacgtcagcatctgccagtttctgctctaacatgcttcgcctgtttaagcaaaaaaacactaaatcacgctccatttgcaaagaagagatgtacatttggtagagaaataagataatacctttctttcctctcttgtagaatcttcatctgctctttgtaatgattctcaatgtactgtttagctgctgcaactttctgtttggtagtgtttgaaacagcttcttcatcagtttcgacgttgtgctcatcggcagagccattacttccacctccaccagcaccacctgaagcacctttatatctggatcctccacgcatctgccgcttctgaaaccaaccctttgcagaatccataactctttaacaatacacacaaatttcactgatgattgatcatcttctcatcaccgaatcgttctgcatagcaaacaataatttcgaaatcaacacacatcatcactacaatcaaaacataaccttacgaattggaatcaaaaaatacattacgatctttgaaaatctcagtcaaaataacaaagctagattaatctgcgattgtaacaaccttaacgtgacagattcaaagcaaagcagggaaaaaaaaaacaaaaatcaggaaaggagaaagagaagaaaagaggaattgaatgagcgtgaaactctctagagcatagcacctatttcgcatgaattgtatggtattaccattaatcagataagcatgtgtgtatatatgaagattggtgcatttacatgttgatgaagaaaggatcaatatctgccttcgttctcagcgtaattttctctgatgcttacatgcagactttttctctctctctttttgttggttatatattttatagaaaaatcaagtttaatatgtgttgattttttatctatgaaaaaaaaaaccttaataactagttttgttcaacaataaacaaatcaaatttacaatatttgttactatatcgcaagaatttatttatacaaatgattcaaaagtctacaaaatcaataatattttgtttaagaaacgaaatattccccatttccaattagtaagaccactataaccctgagtcgttgcaacaaccatttaaccgaccccacgtgattctcacgtgatgaatacaaaactctcaattaaatcaaaaggttgcaacacttctctgttcatcaagctgaagaatcaatgggccaacaacaacagcatcaaaagattcaaaagtcctcaaaactataaaacaaacaaacatatgaaaacatagacgacaaagctaaagaaactttacccttcaaagccatttacgtcactaaatgttgcgtgcatatacatgtgatgagtaatgcattagactcctattgaaattcactctgttgcagccaggcacaaagatgctctactactaaatcactcgtctgctcttaaagctgtgtctttattaatcaacatgggattgtaatttaagcttatcaagcatacaaaaaaatccccattggtttttacaagcaacaacaagctcaaaatgtaaaacaaatcagataaaaaaccttgttaatccaggtagctacgattcagatggtctgatcattgggaaagaaggcaatctcagcacagcttcttctgtctccattggatccgatctcagaatctaataaaaataaatgttacaaactgcattaagatccactaaatcattcaagataacatgtattgagaagataaaccctaaccagaaccattggaatccagagtcagtatattcttggaagaatggtacaactagatattacatcaacacgtcaaacaattggcacaaaacagttttgacccgcacacgaaagaagtcagaatttcattatggaaaaacattgatccaccggtgaaatagttcctctttgtaactagaatgtattcaaatggaaattgctaatggctactaaatgaagtgaactttcaccatttggctttaaaattcttatctatacttaaaaaaagtttttgtttgatctgaagctctagttctatggctttctagaagaacaaatgattcttcatgatctctcaattaactttcacatttcagacctaaacataagaaaattgacaaaatggagatacatcgattcatatgacatggaaaacgaaattagtgatctttagctcaaatgacatcgttaaggacatcgaaacacacacaatgtacggaaaatagagagagagagagagagagatccttacagggtcctgaagaacaggtttggtgtcatcaacggcaggtctgaaaggaggtttctgagttttaacagttgcgttcggtctcgccggagtctctgtagatttcttcatcgttttctctttctttttcgccggcgaatcgaaatatcggaaatttcacttttaggggatttagtggcgattttcacacgtgacggaaccactcacgtgcattagttgggctctgaatatagtaggcccattgattggggttacaattttttatatcaaaaaagcccattttgttttctcttctagaactttatatacacattgacgagggtcgccgtaaaacctctgctacttctgctccagaaaaaccctaatcagcttctcgtctccataaattcagaaccaagaaacatctctgaggtaccatcttggtttgccaatttcttaatcagctttgttactttttttttctcttgtcgtcagctctaacttgaattatctccacagagactaaacgaag

SEQ ID NO: 13827 - DNA, 3000 bp, Unknown; identical to SEQ ID NO: 13820
  misc_feature (1)..( 3000): cDNA_ID_2704240_gDNA_ID_2214654_Annot_ID_188724 3000 nt of promoter + ATG

SEQ ID NO: 13828 - DNA, 3000 bp, Unknown; identical to SEQ ID NO: 13819
  misc_feature (1)..( 3000): cDNA_ID_1029952_gDNA_ID_2214654_Annot_ID_188720 3000 nt of promoter + ATG

SEQ ID NO: 13829 - DNA, 3000 bp, Unknown
  misc_feature (1)..( 3000): cDNA_ID_3032131_gDNA_ID_2214655_Annot_ID_188750 3000 nt of promoter + ATG
atgcttctcgacactgcctccaatggaaactttctgaacaaggatgtagaagaaggctgggagttagtcgaaaatctggcacaatctgatgggtgctacaatgaagactatgatcgctcattgagaggaactggaagaaatgaggataaactagcaaagatatgaaggctctgaatgaaaagctagacaagctgttgctggctcatgagaagcagatacactacatcactgatgaagaacacttccaaatgcaagaaggggggaatgatcaaattgaagagctgtgctacattcagaaccaaggagggttcaataagcgctagaacaactacaagcctaacccaaacctctcctacataagcactaatgtagctaacccccaagatcaagtgtatccaccacaacagaatcagtctaaagccttttgttcagtacaaccaaggttatgtccctaaacaacagtttaatggaggctaccaacaacagaatccaccaccagggttcactcaacaaccacaacaagcgccagcaactcaagatcctgaaattaagcaagtcattcaaaaatcattcaaggacaagctactggagctatggcttttgacaagaagatagctgaattacacaataagatcgattgttcttacaacgatctaaatgtcaagttcaaagctctgcattcaaaaatcaagtatgtggagagtcaatttgcatcaacctctgctccgaagcatccttagcaacttccagaaaaagcagtccagaatcctaaggactatgctactgctaatgctatcaccatccaccaagaagatgagtttccaccaagtcatcagactcccaatactgaggattgtatgattcaagattcaagaaggggggattcaactcaaattgttgcacctgccacccagcaattcatctggactatagagcacatacctttgctgaatactcaccattatggaaaaaagctcaaaattgaaaaactcaagaaagatcagaatcaagagatgattagtagagtcatcactcaagaaacgtacaagaagaaagttatccaagaaaagcttgatgatcccggtttattcactttgccatgccctctaggaccattgacattcaatatgtgcctttgtgatttgggagcatctgttagccttatgcctctctctaaagctaaaaggctagggatcatgaaatacaagttctacaacttagctttactcttagctgatggttctgttgcacatcctcatggtctaatagaaaatatgcctgtcaagattggaaatgtcgagatacctacagattttatggtattggacgtagatgaagaaggcaaggatctccgaatcctaggtagaccattcttagcttcagctggagcagtcatagatgtcaggaatggaaaatttgatctaaaccttgaaaaaggtatcaagatgagatttgacatcagaaaagcttcagggaaatcaacaacaggaggtaagaattttgggattcaagacatggatgttgatgaagaaacagaagctggaacccaccaagagttaactatacttctcaactcagcaagttaaagagaacttttgaccataagaagagagtaatagaagggttagctcagactgaagatcctacagaagatgactggtatgagatgagaaaaaaatttaaatggcaaagcagagtcatagagggattataatcaagggtgatgaagctgaaagatcaactatggatgtttgaaaaagagttaataagttttcaatgggtattgaccgagagaagatggaaactgcactagttatcaaggaggacgaagattttacaacagaaatggtttgcaccagaagatcagaaagcagttcacttagaggaaagaagcctagagagcaagttgttgagtgaggaggaaattcctattccgacttattctccaggagtgcctaaacctcccaccaacccctatgctgaagaagaacacttgattcttgattctgttgctaaagaactcctggagctctagattggatataaagctcaggaggatacaattggaaagttaactcataagatggaaaagttaaatagcaccattatggaacttcaagaaatggttaaaggctacccgaactttgaaattgaggattggtgaaagaagcctagtttagaagaagaagactactctgctgatcaaaaagaggtttattgtgaagaaaaatcaaatgagtactcatcataccatacgtcatgagaggatgcagagtatgattcaggcattaaaaattcaaccactgaagatgaggacttctctgtttcgccttcaaccttttttctcactaagctcagtaagagtcaagcttagtaacttaaaacaagctcacgtgggtggaagtcccatgtctatccatgtatataactttctatcttttttgttatttttgatgtttttgtttaagtgtttcaggtttgttttattgaccctaaggaagtcaacagtcgagtaaattcaaaacaagtcaacaatcatctcaaccgttgatcgagtaaagtgcggaagagagctttaagccggtgatttgaatgaccaaatgagagaagcatcactaccgtttgatcgagtgacttcttgaggtttattctggtccgtttgatcgagtgattaaaagcgaagcattctccactgtccgatcaagtgaagaaaccaaagagaccaccttctggactccgacgcctcgtgacccgcctccattgaaacgatgttgtctctttgtcttcttaaccccccatagttgctttggtccccccattgcaattcccgaactcaacaacctcatctctccacctctcataccaaagcaatctcgaattcttatatctctctctctatctctttttcttgcacttccgctttctatcaaaaactcaacataatacatctattttcttcatcactcgatctcttaacctttgagtctctctttctcaatg

SEQ ID NO: 13830 - DNA, 3000 bp, Unknown
  misc_feature (1)..( 3000): cDNA_ID_3032119_gDNA_ID_2214655_Annot_ID_188753 3000 nt of promoter + ATG
attgggagtctgatgacttggtggaaactcatcttcttggtggatggtgatagcattagcagtagcatagtccttaggattctggactgctttttctggaagttgctaaggatgcttcggagcagaggttgatgcaaattgactctccacatacttgatttttgaatgcagagctttgaacttgacatttagatcgttgtaagaacaatcgatcttattgtgtaattcagctatcttcttgtcaaaagccatagctccagtagcttgtccttgaatgatttttgaatgacttgcttaatttcaggatcttgagttgctggcgcttgttgtggttgttgagtgaaccctggtggtggattctgttgttggtagcctccattaaactgttgtttagggacataaccttggttgtactgaacaaaaggctttagactgattctgttgtggtggatacacttgatcttgggggttagctacattagtgcttatgtaggagaggtttgggttaggcttgtagttgttctagcgcttattgaaccctccttggttctgaatgtagcacagctcttcaatttgatcattccccccttcttgcatttggaagtgttcttcatcagtgatgtagtgtatctgcttctcatgagccagcaacagcttgtctagcttttcattcagagccttcatatctttgctagtttatcctcatttcttccagttcctctcaatgagcgatcatagtcttcattgtagcacccatcagattgtgccagattttcgactaactcccagccttcttctacatccttgttcagaaagtttccattggaggcagtgtcgagaagcattctgatatttggtaaagcccctctatagagtgtgcttaataaagaagttttcttgaaaccgtgatgggggcactgagtggtgtagcttttaaacctctcccaagcttcacagaaagtttcattgtttttctgtgtgaagcctgagaatctcgttcctcaatctagctgtgcgagcattagagaagaacttggcaagaaaagctttcttacaatcgtcccatgaggtgatggagttagggggcagagtcttctcccaatggtgtgccttgtctcccaaagagaagggaaatagtctaagctgtcaagatggtccaggggatcttcaataggtaaaccatgaaacttgtttccttggatcattgagatgagaccactcttgatctcaaagttgttgttctgaactagtggaggcactatcctttgtctttggtgatgattccttggggcatcaccaacaccaatgtttcttggttgatcaacattaggtgggtcttgaacatcaactcgtctgttcagttgatccatagcagctggtctttattgatcacaggctgcctttgctttggtttcttgtaatgtaacttgataaatgtaaaagaacttgatcttaactttttctgatatcttgaatgtaacaatgcaacaatgaattggcaacggcgccaaattgataagtaggtttttacgcctacttaatgtgctgaagtgtggtgtgttcagttcaattctgcttaaacactaacatatcgatgcagctatagggggtgtcaatccagtccactgttattactagcaatcaagatgtgtacagaagcaactaagtcaaaccagattatagagatggttggtttctagtaacaatcctaggtcaggattcaaacaacgaaaatgagaactttaaaagcttttctcgatcattgggtcgagtagaaccaacatgtaacaaatttaagaactaaaatgcaatcaacaagtgacacaaataacagttaaatagaagtgcaatgagggggtgaatacaaataaatctaagaagaatagaagtcctaaggatggattcattgataagggcaactctagggctcatccgtggctaacaggtgaaaggcagaaaccctagacgatagattcaaaaaaaccgggtcaatccactctcgtgacagagacccccataactctaatacttcctaatctcaactctcgttgatgaaacatagcagagcagggtttgagcaacaatctaccaaagccaataagcagactagccaatatcttggtctatagcctacaaatctctagaatctctggaaggtctgaagtagagctagaatcgggaggagctgaacaaacataaccgttcaggttactactttgtacccgtttgaccacaaaaccgagcatcaagtcaaaaatgaaagctcgtacctataggagggatgaccaaaggagttggttggacccgtggaacctcttcaactagattctatggagctgctggaagagcttgatatgtctataatttgcatgttttcagtgttcattcatcattatttggagtctagtttcatatcattcatcactgttttatatcatttctcatcattctcgcacactttgcatgattaggatagctgttggagctggattcccctccaggaatccacctgcgaaaataccaagccagcccacaaaagtccactaagcccattaagtagaggacctacgcagctgacgaaatgacctaggaactgacgaagagatattcgtggagcggacctgatatctcggaactgacctgccgaatatccaggaggatctccgcagatcccggacggagctaccacgtgcgtagacctatataagggaggtaggacgacttggaagagacattcaatccaacttacattgatacacacacttttacacttgtaatcccttttcacattgtaaaagctttgtcataattaatacaaaagtccattcgttcttagcaatacaactctcaaggtttcagtgaagatctagccctcctttctcataatcttaaatacaaatatctagtgtggatttcagaacccacatttggcgccgtctgtggggacgacaatatatcattccaacaccaaaactaacacatcaattgtgaccaacgatc

SEQ ID NO: 13831 - DNA, 3000 bp, Unknown
  misc_feature (1)..( 3000): cDNA_ID_3032115_gDNA_ID_2214655_Annot_ID_188754 3000 nt of promoter + ATG
accgaccgtcatagagtagaatcggatcggccagaccgactgtcggacggatcggatcagccagaccgaccgtcggacggatcggatcggcaagaccgactgtcagacagatcggatcggccagatcgatcgttggacggatcagatcagatagaccgatcgtcggatcgaatcaaacataccgtccgttggacggatcggatcggacagatcgatagttggacggatcggatcggacagatcgatcgttggataaacggatcggatctaacaaagagacggattaccgaccgggataggcggatcgggaaaggtgttcgaggaagcacaaagataagtgcatccgaacacacccaagggtcgcccatggatgcaatattaccgataaaaggaagaaagcaccgaagatgggtaaagaacgtgattcacccaatatgatcaatatggtgtccgcctttgtgtatcaatcgccacggccgatggtaaaaccgatccgagattggtgaaagaccaaagggtgactcgacagagaaccaacgggaaagtccatggtgagaaccgatggacaaaacagatgtttgacccgcgagtaaaccaaaggccgacggaagaaggatttcatgggcaagcctacgatgattcaatggttgaatccacggacccttgtgtgtgataaggatatcgttcggatcgtatggatggatcgataagccaaaagttttaccgaccaccatggaccggacgggtaaatggttagtaaactgtgggcagtcgtagtgttaaacgaccgaatcggaaaaatggatggttcgataagctgagggctcaatcgtccaccatgaaacccaaggggcgtacgtttggaggacggatggaccaataagcctagagctagattcggccatcgtgaacaaagggaatcgtacgatccccaatctctatcgttggacttagaccagtggggttggtttgttgtatggctaagtaacgatagagattggtccatcaatatacaagtcttacgaaaggaatatggaacaagaaggctaaggaaaggattaatggacggatcgaagaggaatcgaatccgcatattggccaaggtatgtagacgatctaacttattagttaagatagacgtttggaaattgaccgtgaaaataggataaatgaatatgcgattgttaggcttagaggggttagcgaacaatatgcatgtcttgaccgagtaaagaatcgatctaagtataagggacaaagacgatgaaaccggtacaagggttggttggtattaaaccaaggttagaaagacttccgctgtgtaataagaaagcgattatagaattaggcctcgtaaaggtaattctatgttgaatcgcgaaaaattaagaggttctactgggaataggctcgaatgtgagtccatggtcgtcggacgccgagacgtccgggacggggtctcacatcgacgaggtccgatagtagctctgataataggtttttgggatcaattaatcctatagcactatcatatcgttgtagtgcttaaggttgtcaatccaaatgagtgtgatgcaaacagatgagatgtgatcagaagtcactaattcaagccaagcaataacagttttgaggtttctaacagtcctaagcgaacatgcagaaaacggaaataataacagaattactaaaatcactcgaccacaacaggctgatgccagaagcaggatgtagtcgagtagcaggtcgagtaatagacaggaaatgaaacagctatactcgactgcacagtctgttgccagacactgggtggggtcgagtaagctggtcgagtaattgcaaacactaagaaacaggcaatgagaacgattaagcgataacgataaaacagagaaatcagatagaagagaaattcctaaggatggggtaatcgaatagagtggtatccttgattgttcgaatggttaacaagcgcaatcaatctatccctagacaacatgttcaacaacaaattaattcactcccgtgatagagatcctcaagcaaagctagcccaaactaattcccattaacggaatctacctatgcaggcaataagaacggactgataaagtcaataaacgctctaaacggccaatcccttgggatagacacgaatatctcaggaactagtggatcaagcattccatcgaacaccttctgggtgcgggaatgctttggatcgaattccagttgatcagaaagaaataagcagtaaacacaaatagtcctgaagggattcaatcaattctaaaacttaaccattctacagactacggattccacaactactctatcccatccttaagaattctaagtcactactcagacaacatgctcaaagacataaacgcaggtaaatgataatattgcataagtatagagataaagagtagatgacagatgacagatgaaatcaaatgccgaatctgaataacttggaaaaatctcgaattataggttgcagaagcaaaagcggcacaaccagagtaaaacagaaaataaaactgaagcaaaaactcaatgtcgactagatgtctcaggacagaaccctaaaacaatctatttatacaaaacgaaagaaaatgatagtagacgggccaataacctaatcgccccgcccatagagtgataatgggccgagatgggcttcgtgatccgatggaggtccaagccgcttccaaacacttcgtcttctcctcttctcttccttgtgctcagcttgtctggttgagtgcggatttgagtagactccgaagatgtgatcgagtgcttggtcaagtgatggtattggtggtgagtgatgatactcgaccaggggtcgagtaacgtggtagagtgaacagtcgagtgtggtcaggtggtatggcgaagtgatactcgaccacagggtcgagtggcgtcatcgagtggcctgagctgaggttactcgaccacgcggtcgagtagatgggaagaatg

SEQ ID NO: 13832 - DNA, 3000 bp, Unknown
  misc_feature (1)..( 3000): cDNA_ID_2704294_gDNA_ID_2214656_Annot_ID_136490 3000 nt of promoter + ATG
tgttaaaatttggaccaattttttgacaaatcccactagatttttatgtaagaagtgaattttgtttactaacaccatgatttataaatcaacttttggttgaaaaaatgcaatttcatggagatgcaagtggaataattaagttcaagttgattctttaaccaaaataaaaaaggaagttaaagttgattacacatgcatatgaatctgattttttaaaaattaaacattctcctatcagtaagtcaggacctatacatactacgcagtcgtaaatgcttcagcagcagcagactcaagtaggaccattacatgactttattcacgtaaaatccaaatatcaattatatgagtgaggaaaaaaaaatagtaataattatatcagtgaggacactagcttgtcttttttccgagtagtcgatgccggagaagtaatgtatccttcttcatagccatcggaatcgccgtagcagcaaaagtagccatcgacaaataaagaaggctgcgaaatcagaaagtaaattgactgttggagtagagtgaatcaaaccaaaataatcactttatttgggccgtgactgggcctttcaatgttagtgacacttagaaaaagtatgaggccgagatagcctcacattttaggcccaaggtttggtaagttaacccttaaatagtgtgactgtatgcaattaatagtgcaaggtaaattatctacatatacatttttcagccattttgtgaaataaatcctgtatttgagacttatttactattgctgccactggattttaatgtttgtttttgataattagaaaaaaaatcttcgaattaaatatttgacatttaacaatcttccctaaatctctccatattaactacacgattagttactaaaataaaacttccaaaatatttaatatcattaaattactacaaaattatcatttttgatattgcttttctccatgactataacaattcgattataatcatcaaaccgcagagatatttgatagcatttaattactacaaaattacaaaatatttagacaataattcataaacatatcataaataagatcaacattaataaaataaatagttttttacggacgggttggcgggacgagtttgacaggaagttacttaataaccattgtaaactatattttataaataaatacaatttacaaacttttatatatattaactttgaaaaataaattgttctcgcggtgtaccgcgggttaaaatctattttaactttgattagtggagcaaccacataaaagtatttgttgacctgattttaccaaggttaatttttcttaatttatttctcgaaattgagaaatttttagtattattttacaaaaatgttactttatttaacaaacgagaatacacaatatttttttgaaataagtagtctagtcttatcattaatgtgaatattaaaaagtcaattaatattgggagctggaagcttggggtcattcatgatggtcggtcggtccatatatcaaaatttaaatgagacagtttattgtatttcgctggaagaaataaatgatactactaacttgttgacactaaaaaaaataaaaatgaaaattaatgataactgttttaattttatcaatttctcttaattttatttatttgagaaagccaaaagccatcagccatgccgttcataattatattgtcggaaataaaaaatttagttaacaatttcaaagtaagaaaaccagctctcttcctaatcattaattttcttttttagagtcataaagaaaaaaatacagcatgattctaattttcatttacattctctctttttaagtccttacataagtttgtttgtttatcatttaaaattactgttataaatgtattatataacatatcaaaatatatatctttgtctaatattttttttttatgtccagtatatatattaattagagttagtgaaatagtattaacttcaaaaatattaataaaagctatttaaaaagagaagaaaatctattcatttaagaaaccgaattactagtagttcataatttatttaatttttttgacagttactattagttcataattattgtaaaatattatttagggtggaaaactaaattgggtaccattaggaaaataaaaacatttgaaaacagtagtaataatgttttctcttccatttacaaatatcttaccagaaaaacggcaaaacacgcgcctttcttcttctccctacaaaaatggcttcttctctttctctttctcttaccagggacaagttacaatgtaaataaaggtcaaaccttttttccaataaaacccttttaatggattgtgctaaaactctctctctctttggattttcaaaacaaaggtaaaacctttttgtcaatatccttataagctttctctctcttttagatttgtttctctgaggtttcgcattctaaatctggagccgtcctttttttgggggggtaagagagaaccaaagagaagtatatacacctctctttctcccttctttctcctttccttagcttttgatccttattaggtaaaaatcaagaaccttcttctctataactttttcttcttcatttgtttcctccaccaacctcaatcgctaaatgtttgaatattccgattgtttccaacctccctgattgattatttcaattttctgtttcttataacaaaaaatgtgggtttgattcttattcagatgatcttgaatctctgttttagtcctcaagatttctctgtttgatcaaatgtctaaatgggtgtctctagttcttgtttttatcgattgattgttttccaaggaaactctcttgtaaaactgaaaccttttgtttatttgcatctcttgatgaaattagattggattctgctgtataatctatggattttaacctgtatttatgtgtgtttatgtgacaacagaaatcttaaatccagactttaaccatg

SEQ ID NO: 13833 - DNA, 2962 bp, Unknown
  misc_feature (1)..( 2962): cDNA_ID_2714092_gDNA_ID_2214656_Annot_ID_188777 3000 nt of promoter + ATG
cagaagactaattctataagagtattttattatcaattcacattgtgcaaaaaggttactcttgaggcttcagataacagcttcttcttagccactctgcttgatcttagtagatgtaatatatatccttcacctgcaagtttcattaaaacctaactaagtcttgaaactagagacaatttataaacatctgaattcatcaacaacagtacttaaagaagcataccctgcatgaaaccatcccatatgtatcatatcaaaccgtaacagttccacaaatgtcaacagaagtcgtctttgctggtgtaagcacaaccgccactgattcgaccttcccccaaaatgtaccatcttcctttctttcccaagcaatctctatgcaccaaatctctcttttcctacagtcataccgcctaagccggtgcacatcagcgctcaaaatcaccaacttcccgccaaaattagccattttatatccatccacaaagagaccattagctggaaaaccttgtaaaccttgcaagtaaaaccaagtcttcttctctggatcatatatttttattggccatccaaggaaatacactgatgtattgatgcaaaacagcaaattatcaaccacacaagacgaatcattccaagaagcactcaacggtccatgagtccaagactcccatttactttccttaggatcataaatatgaatattgcgagtaagatccaaacagtaaatcttctccttcatcaccgcatatgtcagaaactctcctcttccaaacgcttcagggtacggacctggcacagaactccaactctgtttctttaaatcgaacacttcaacccaatcagatgttcgtaccttacgacctccgatcacataaatctttccgtcaattacacccgcggctgcgcgacagcgagccatcttcatactcgggagggagcgatactcgtgaaatctgcagtttatgtgagtcacatccgagatgcgtcgttcgcctgcgtgtccacctcttatggatgtctcgccgcggcgtccaccgcttatgggtttattatagcctacgcctacatcttctaaaagtttctcgccgacgcgtccaccaatgacatagatatccgatccgatagtgacgacagtagatccccaaggcatgggagggagggaatcgattttgcacaatttcaacgaaatcgtgttaggcaagtttcgatagggtttacgatggagaatgtaccagctagggttttcaacaggagggaatccaacgtaggcgtaaagaacgttttcggtgtagccgagacgcaagcgatcatcgtagagcttcgacatgagactatggaaggatctgcagacgagggaaagcgacgggtggtgacatctccgaacgagtaggaagcaacgtaagatgagttcttctggaattggtagcgacacctgaaccttttctttcaatttcttgtttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaatg

SEQ ID NO: 13834 - DNA, 3000 bp, Unknown
  misc_feature (1)..( 3000): cDNA_ID_2704289_gDNA_ID_2214656_Annot_ID_188775 3000 nt of promoter + ATG
tttttagagaacaagctattatgagctagttgaacaacaacatacttattccagaaaacagttttatgtattggattgctacaaatgttagacaaaaatcaacaaaagcagtggcagtttactgataaaatcactcttaaaaaaaagaacaaaaacaacagttctatggtaacaatgtcagatgagaagaagattaagatcaattcttaaaagaaaatgattaagatctttttccttatatattctctcatcaaccaataaaaacccctgagcatggagattctccatttcctaagttctttattcaaagattccgagaaacaagaaaataaaaagaactctactgttataggctgctactatggctgattttggaccaggcttgtgtctgtggatacttttttccctcaaatgggactagctcttatggattcctggtgataatatgccatttccttcttttgcgtaaagtttgtccgaatccaattttgtaaagggatcattcttttgttgataataatatctcaccactatcctcgaaaatccttcgaaaacattttgagctacagaaacttccattatagagtgattacttcaggttcgggttcttttccaagttgcaaaaggagagcaaccactaggagaggaatcagaatacttagtttttgtttcttgctagatttggggataagggttccaaatatcaacagtaattttgtaacaaattaaaatgcttactcttttaccttccttttcatacagattccttgtaagctactccgggtaaattctcagcaatgatcactcaagacctggagatatcagaataaaaccctcaagcgtttactgatgcaactattcatagtgagaaagtaaaaataaccatcttgctcaacaacaaaataatcgaccttatgaactcaagattatcgttttcacagctaaagaatttacctaaacttatgacttaaatgtggggaaagtgttccttttttaccatttcaatacctaggcaaagaaggtcgctgtgaagcatcgtgacgatgagaatatcagtagtgccccaatgcctactagcagaatttcttggcaacttgcaatctattatctctctggaatatattgtgccccaaggcctcattattgttaagattctttctctgtttaaagttttccttctcgataagaagtttcgccgcccctaccctgaaaccaaaccatgacatcttagaaacagaaccatccattatcataactagaataaaaatatcttaataatataagtgcttatattggcatatatccagaaagagagcaaattaaagtatcataagacctatacacgtaaaggaatatcatcttacttagcaaaactaataacatttagtgaaatggataaacactattatcaagaaagatccgagaagtatggttcttaaatagctttactttaaaaagtgtgtagacaataactttatatagtcttgtggtcttttgataacaaacctgattcaatagtgataagatatgagtatggtcctccatctcccatgggactttgaatcacctgtgtttccgagagagggaaaatcttgagactttaaatcaaaatgtcaactttattatgaactaaaaatcaaacaacaagtggatcattaatgaacaacctttgttgcatgaaaagaaaatcttcaaatcttttaaagaatgaaacaaaatgctcactttctgagataaaaccaaacaacaagtggaccatttatgcatgttgtctttttgccaagtatgtatattattagtcctattgtgcattatttagcaacctaatttagttatatgacaataatctatttgcccatcccaaccctggattcttaccaaacaaggtaattaaagtgttcatgtgaaacattaatgtttgtattttgtaatacgacaacttttggttcccgcccatattcaataatgcagacactaaagaacagaagaaacaatttgaatatccaccaagaaaagtgattatttaacaaattaacaaccaagaatctacattagacaatatatgaccaagaaaaacacagttgcctaacttcaaggagatggacccaacaagccaaggaaaaaaaaaggtaggtaaacaatgttgacgtttatttttttcaacaacaagaaaacacagaaaaatgtcgatgattgtacggaaagatcatcaatacagctagataaattgatatggttttcatggcagagaatctcaaggtaaagctctgcccccacttttctttaagaattcttcttatacaagagaatatatgacttatggtgaacacacgaaaagctccaactttgtgtttgtggatacaaattaatcctcacaatgtttcaaaatcactgagatttttgataagaaggaaatctgattagtcaatgaaaatcatctgtcaatagagacttgtccctaactttcaaccaaagacttgtaattttccgcgagcacgtgagctttgtgctctgattagagaccagactgttccatgaattaagtaccataggtagagagattttcctaactatttattacctaaactgtttctttttgacaagaagcttaatctagagaatgacgtcataaccactaattgggaaagaaaagtaaacatattagttataacatttatagaaaagtgtgtctagggagcatcatatgccaaatatggatggaaaaacgcaatctttggttgattagtttggatctttgatactgatctccacaaaaaaatttgctcatattcttttctagctatagagacaaagacttaaaattctctttgttttggcaaagatatcttttaacaactggccctaccccacaccaaaacctctttataaagagcaaggactctgcgacatctgtgcaacatatcatttcctcagaatctctttcttttctaggtttattactacacaaaaccaaacatcatcaactttagttactaaaca

SEQ ID NO: 13835 - DNA, 3000 bp, Unknown
  misc_feature (1)..( 3000): cDNA_ID_1393970_gDNA_ID_2214656_Annot_ID_188772 3000 nt of promoter + ATG
ccatgttaaaactatgagaaagttgactcttatctataaatggaacatgtttttttttctctctaagagctggtcatgcatgcatatatcccaaaaatatggaaataaataactctaatcactgggacgatccttaattgatctttagaaatagttgtagaaaaagtgattaaaacatgggatatatcatatatcattattatgtgaagtgtatttttaattggtacaaattatgtaaaatgagttattagtacttacttcatatagagaagaagcgcttccacaaatgaaatcggtggctccttcaatatagcagttcttgaagtaatggtttccattgtcgtcaaggagagtgtcttggtacgacgttatcacgcatccgtagaacgctgccttatccgccgccaccctcagtgcaaccgcacgtcccgccgttccaaacttattctacttacaataaaacgaaacacatcaatattagtaactttctttttttgttaattaataatgattcacttacttatgatattttggtgatctactttgaattggtattttataaaatgaatgtatacgatgtatgatgaagattgacctgaatagtgagaaatcggcatacaaaatcggatgcaaagatagtgagagtgggtgattccaaaatgtcttcgccatcgctccatatgagaaaagtgttggaagcttgtgtcccactcaatgttatgtagggtttctccgcaggtatcaccactttttctctgttatcaatgaaatcgctaattctcaaaactatatactttaaaagcatagaataaactaatcatcaataacatatactatttaggaaaaaaaatcataaatatattagtaggtcaaaaaagcctagtacctaatacccagctgataaatatcaacaaaatctaaaccctaaaccattaaggtctaaaaacctaataaaccttaagacgacttaaatatagaaaatctaacaaaatattttatatgtaccggtaaattccaggcttaacccaaatgaaatagagttgagagttgtttagattgggagggatagattcaattgcttcttgaatcttactgaagtctcctttgcccgattgatcaactcttattagaattgcagtcgaaaaatcaatggaagatggagaagaagaagaagccatggaagaagatgtgattgaagagaggatgaaaatattgatgattatgatatgatgatagttagcaattgaacgtttggacttcgttttataaagtcccatcttggcataacccatgtgaggtttcacgtcttggcgattgtgcagaggacaaaaaaaacaaatacaagatagaaataaaaaatgaaaactattgaattcaattagtgaagcaagagtgtgaaaattagaattttgaaaagtttggtttgcacataaaggagattgttttatatacataccaatggttgactaaaaatcaagatgacgtggtgggattggccagcggtcgaattcttatgatcgaagttgaaagattgcatttcgttgacaagagattttttctatatcagattcaaactttaaactctaagacacaagttctatacacacaagaatatatatttgtatatttaaccatggtacataacctagactactctccaaaacttgtataaaaaggattttattgtcatcctacaagactacaacgtgtcaacgtctacaatgacctaattaaacagaaccaaaccagtttttaataatgttgggctgaaattcgatttctaacctcttgaccaacaaaacaatcttccatttgaataaactacacgtttttggttcacttgaaaagtttttatcatcgatacgtcaatttatctacatttatcttacgtatgtttggtaaatggtaattgaatatgaacattaaaaaaaaaaaaatcaaacattaaactatgagttacgtcgttaatatgtaattgcttaccaattttttttttgttaaatttaagtcattagagaatacttaagatatactttacgtgtagggttggcggcttgcatgcttcgtgcattagttttagcaatcaaaaagagatctataatgagtatttttgtatgtttgaatgtaagaactaaggaaaaaaaagcgtgtatctatgttttccgtcaaaggccgaatatatatcccgatatagtaatgggccgaaacccaaaactaaaggcacatactaacaaaactacttctatagaaaattatagatgcactcaacacttttgtctatatactattcccaatagtttgttttttatcactaatggtagtagacatgttgatttgcacattgcagctacaaaactacaaaaaaaaaaacgagccatatggatgcttgtcagattgttactgtcacatgaagaaaaccaaagtcttatcttttatttttatacatccaagtagaacacgacacgattggtaaacgaaacctatatagtcaaaaaactcaaaatcaacggattttgtttactgtttgaattatgttcttgttagttagatttattcttttgtatgcatatgtaacaattttgtgtagggaagaaattatagtcataataactcattaactaaaaataaaatatggtctaatgattagactctaatccgaacaataacaaacaattattttcgtttagtgtctctcttattttatccaagaaaaaagaagtgtcaatttataatatcttctggaaagcagccgacagaaaattgtgggctcacatgaaaaaaatttcaatgatgcgtcaaaaagcaaccaaacgactccaaaataaaatcaaatcaaaaatcaaattctctacacgcaactttctttcaaatacaaaaccaatcatctcgattcatccaacccgcgaagacccagaaaccaaaatcgaagacccaacaaaacccacaagtcgaaatctcgaaatccgttgagagtttgttcctttttttgtttgctcggag

SEQ ID NO: 13836 - DNA, 3000 bp, Unknown
  misc_feature (1)..( 3000): cDNA_ID_3032197_gDNA_ID_2214656_Annot_ID_188771 3000 nt of promoter + ATG
aaagatgaaaaacaaaacagtcttcgtggaaacaacacttgaactttttcttcagggtttaggatcttctgagcgtgtccagtccacgatcgactcgtctccagcttctgcattacaatcaaaaggtttctagttatatacaaatgaatgtgatgatcactccggttttaccatgattgattagtaatgtaccttttccaggaacgattatgacaggagcagatttgcaattgtggaaacaatactcgcttacgctcccctgtagcacgctgcacaagtatccaaaagagaatcatcgacttaggaaaggcaaaagagaagaaaaacaagacatagatcacacaactagtagttgtttttgtattataagttataaccaaccttcttactaagctcctgcctcgtgtgcctacaatcacagcagcaggcttcactttctctgcttccttgcagattactttaccagcatcgccttcaacaacacgagccacactctttacctaaacataacaaaatcagtatcaagttatgtcatcgaattcaaagaatatatctataaagtgtgtaccaaactcatttttctgattattctcatctaaaatcatcacaatattgatttccaagaatacatacaccagaggttttgtctctacgcagttggtagcaaatgcgacaaatgaatagactagaactagtgtttggattcaagagaagaactaagcaacgatctcaattctaagaactagtagttgttaggaaatgctactaatgaaacatctgattgaattggattctcagaccctaacttagcaatcaagaaacaacattatcaggcaaaccaaaaagagataatacaatataaaggttaccatggcaacttgatacgcctcaacagcaagtttctccatgagggcttggctcgtctcatacacaacatcgttcttaacacctgcgaagaaaatcaaaaaccagctttagaatctccgattccagatctggaaatgcaaatgaacacgaaatcggactatatactattcacattgaagagagaacgaacttgagacggcgtggacaagatggagagtatcggcgagacgacagaaatgaacaagagcccaatcaaaagcgtgtttgctattgggaccatgatcaacggctacgataacatctcttcctcttctcctctctccgctctctctctcaagttccggctccggcactaccggaatcaaagacggcaacactacttccctgaaactgtactcttcatcctccggcaaagcctccatctccgagcaaacaaaaaaaggaacaaactctcaacggatttcgagatttcgacttgtgggttttgttgggtcttcgattttggtttctgggtcttcgcgggttggatgaatcgagatgattggttttgtatttgaaagaaagttgcgtgtagagaatttgatttttgatttgattttattttggagtcgtttggttgctttttgacgcatcattgaaatttttttcatgtgagcccacaattttctgtcggctgctttccagaagatattataaattgacacttcttttttcttggataaaataagagagacactaaacgaaaataattgtttgttattgttcggattagagtctaatcattagaccatattttatttttagttaatgagttattatgactataatttcttccctacacaaaattgttacatatgcatacaaaagaataaatctaactaacaagaacataattcaaacagtaaacaaaatccgttgattttgagttttttgactatataggtttcgtttaccaatcgtgtcgtgttctacttggatgtataaaaataaaagataagactttggttttcttcatgtgacagtaacaatctgacaagcatccatatggctcgtttttttttttgtagttttgtagctgcaatgtgcaaatcaacatgtctactaccattagtgataaaaaacaaactattgggaatagtatatagacaaaagtgttgagtgcatctataattttctatagaagtagttttgttagtatgtgcctttagttttgggtttcggcccattactatatcgggatatatattcggcctttgacggaaaacatagatacacgcttttttttccttagttcttacattcaaacatacaaaaatactcattatagatctctttttgattgctaaaactaatgcacgaagcatgcaagccgccaaccctacacgtaaagtatatcttaagtattctctaatgacttaaatttaacaaaaaaaaaattggtaagcaattacatattaacgacgtaactcatagtttaatgtttgatttttttttttttaatgttcatattcaattaccatttaccaaacatacgtaagataaatgtagataaattgacgtatcgatgataaaaacttttcaagtgaaccaaaaacgtgtagtttattcaaatggaagattgttttgttggtcaagaggttagaaatcgaatttcagcccaacattattaaaaactggtttggttctgtttaattaggtcattgtagacgttgacacgttgtagtcttgtaggatgacaataaaatcctttttatacaagttttggagagtagtctaggttatgtaccatggttaaatatacaaatatatattcttgtgtgtatagaacttgtgtcttagagtttaaagtttgaatctgatatagaaaaaatctcttgtcaacgaaatgcaatctttcaacttcgatcataagaattcgaccgctggccaatcccaccacgtcatcttgatttttagtcaaccattggtatgtatataaaacaatctcctttatgtgcaaaccaaacttttcaaaattctaattttcacactcttgcttcactaattgaattcaatagttttcattttttatttctatcttgtatttgttttttttgtcctctgcacaatcgccaagacgtgaaacctcacatg

SEQ ID NO: 13837 - DNA, 3000 bp, Unknown; identical to SEQ ID NO: 13832
  misc_feature (1)..( 3000): cDNA_ID_3032205_gDNA_ID_2214656_Annot_ID_188765 3000 nt of promoter + ATG

SEQ ID NO: 13838 - DNA, 3000 bp, Unknown
  misc_feature (1)..( 3000): cDNA_ID_3032197_gDNA_ID_2214656_Annot_ID_136496 3000 nt of promoter + ATG
aacagtcttcgtggaaacaacacttgaactttttcttcagggtttaggatcttctgagcgtgtccagtccacgatcgactcgtctccagcttctgcattacaatcaaaaggtttctagttatatacaaatgaatgtgatgatcactccggttttaccatgattgattagtaatgtaccttttccaggaacgattatgacaggagcagatttgcaattgtggaaacaatactcgcttacgctcccctgtagcacgctgcacaagtatccaaaagagaatcatcgacttaggaaaggcaaaagagaagaaaaacaagacatagatcacacaactagtagttgtttttgtattataagttataaccaaccttcttactaagctcctgcctcgtgtgcctacaatcacagcagcaggcttcactttctctgcttccttgcagattactttaccagcatcgccttcaacaacacgagccacactctttacctaaacataacaaaatcagtatcaagttatgtcatcgaattcaaagaatatatctataaagtgtgtaccaaactcatttttctgattattctcatctaaaatcatcacaatattgatttccaagaatacatacaccagaggttttgtctctacgcagttggtagcaaatgcgacaaatgaatagactagaactagtgtttggattcaagagaagaactaagcaacgatctcaattctaagaactagtagttgttaggaaatgctactaatgaaacatctgattgaattggattctcagaccctaacttagcaatcaagaaacaacattatcaggcaaaccaaaaagagataatacaatataaaggttaccatggcaacttgatacgcctcaacagcaagtttctccatgagggcttggctcgtctcatacacaacatcgttcttaacacctgcgaagaaaatcaaaaaccagctttagaatctccgattccagatctggaaatgcaaatgaacacgaaatcggactatatactattcacattgaagagagaacgaacttgagacggcgtggacaagatggagagtatcggcgagacgacagaaatgaacaagagcccaatcaaaagcgtgtttgctattgggaccatgatcaacggctacgataacatctcttcctcttctcctctctccgctctctctctcaagttccggctccggcactaccggaatcaaagacggcaacactacttccctgaaactgtactcttcatcctccggcaaagcctccatctccgagcaaacaaaaaaaggaacaaactctcaacggatttcgagatttcgacttgtgggttttgttgggtcttcgattttggtttctgggtcttcgcgggttggatgaatcgagatgattggttttgtatttgaaagaaagttgcgtgtagagaatttgatttttgatttgattttattttggagtcgtttggttgctttttgacgcatcattgaaatttttttcatgtgagcccacaattttctgtcggctgctttccagaagatattataaattgacacttcttttttcttggataaaataagagagacactaaacgaaaataattgtttgttattgttcggattagagtctaatcattagaccatattttatttttagttaatgagttattatgactataatttcttccctacacaaaattgttacatatgcatacaaaagaataaatctaactaacaagaacataattcaaacagtaaacaaaatccgttgattttgagttttttgactatataggtttcgtttaccaatcgtgtcgtgttctacttggatgtataaaaataaaagataagactttggttttcttcatgtgacagtaacaatctgacaagcatccatatggctcgtttttttttttgtagttttgtagctgcaatgtgcaaatcaacatgtctactaccattagtgataaaaaacaaactattgggaatagtatatagacaaaagtgttgagtgcatctataattttctatagaagtagttttgttagtatgtgcctttagttttgggtttcggcccattactatatcgggatatatattcggcctttgacggaaaacatagatacacgcttttttttccttagttcttacattcaaacatacaaaaatactcattatagatctctttttgattgctaaaactaatgcacgaagcatgcaagccgccaaccctacacgtaaagtatatcttaagtattctctaatgacttaaatttaacaaaaaaaaaattggtaagcaattacatattaacgacgtaactcatagtttaatgtttgatttttttttttttaatgttcatattcaattaccatttaccaaacatacgtaagataaatgtagataaattgacgtatcgatgataaaaacttttcaagtgaaccaaaaacgtgtagtttattcaaatggaagattgttttgttggtcaagaggttagaaatcgaatttcagcccaacattattaaaaactggtttggttctgtttaattaggtcattgtagacgttgacacgttgtagtcttgtaggatgacaataaaatcctttttatacaagttttggagagtagtctaggttatgtaccatggttaaatatacaaatatatattcttgtgtgtatagaacttgtgtcttagagtttaaagtttgaatctgatatagaaaaaatctcttgtcaacgaaatgcaatctttcaacttcgatcataagaattcgaccgctggccaatcccaccacgtcatcttgatttttagtcaaccattggtatgtatataaaacaatctcctttatgtgcaaaccaaacttttcaaaattctaattttcacactcttgcttcactaattgaattcaatagttttcattttttatttctatcttgtatttgttttttttgtcctctgcacaatcgccaagacgtgaaacctcacatgggttatgccaagatg

SEQ ID NO: 13839 - DNA, 3000 bp, Unknown
  misc_feature (1)..( 3000): cDNA_ID_2704281_gDNA_ID_2214656_Annot_ID_136498 3000 nt of promoter + ATG
ctatacacacaagaatatatatttgtatatttaaccatggtacataacctagactactctccaaaacttgtataaaaaggattttattgtcatcctacaagactacaacgtgtcaacgtctacaatgacctaattaaacagaaccaaaccagtttttaataatgttgggctgaaattcgatttctaacctcttgaccaacaaaacaatcttccatttgaataaactacacgtttttggttcacttgaaaagtttttatcatcgatacgtcaatttatctacatttatcttacgtatgtttggtaaatggtaattgaatatgaacattaaaaaaaaaaaaatcaaacattaaactatgagttacgtcgttaatatgtaattgcttaccaattttttttttgttaaatttaagtcattagagaatacttaagatatactttacgtgtagggttggcggcttgcatgcttcgtgcattagttttagcaatcaaaaagagatctataatgagtatttttgtatgtttgaatgtaagaactaaggaaaaaaaagcgtgtatctatgttttccgtcaaaggccgaatatatatcccgatatagtaatgggccgaaacccaaaactaaaggcacatactaacaaaactacttctatagaaaattatagatgcactcaacacttttgtctatatactattcccaatagtttgttttttatcactaatggtagtagacatgttgatttgcacattgcagctacaaaactacaaaaaaaaaaacgagccatatggatgcttgtcagattgttactgtcacatgaagaaaaccaaagtcttatcttttatttttatacatccaagtagaacacgacacgattggtaaacgaaacctatatagtcaaaaaactcaaaatcaacggattttgtttactgtttgaattatgttcttgttagttagatttattcttttgtatgcatatgtaacaattttgtgtagggaagaaattatagtcataataactcattaactaaaaataaaatatggtctaatgattagactctaatccgaacaataacaaacaattattttcgtttagtgtctctcttattttatccaagaaaaaagaagtgtcaatttataatatcttctggaaagcagccgacagaaaattgtgggctcacatgaaaaaaatttcaatgatgcgtcaaaaagcaaccaaacgactccaaaataaaatcaaatcaaaaatcaaattctctacacgcaactttctttcaaatacaaaaccaatcatctcgattcatccaacccgcgaagacccagaaaccaaaatcgaagacccaacaaaacccacaagtcgaaatctcgaaatccgttgagagtttgttcctttttttgtttgctcggagatggaggctttgccggaggatgaagagtacagtttcagggaagtagtgttgccgtctttgattccggtagtgccggagccggaacttgagagagagagcggagagaggagaagaggaagagatgttatcgtagccgttgatcatggtcccaatagcaaacacgcttttgattgggctcttgttcatttctgtcgtctcgccgatactctccatcttgtccacgccgtctcaagttcgttctctcttcaatgtgaatagtatatagtccgatttcgtgttcatttgcatttccagatctggaatcggagattctaaagctggtttttgattttcttcgcaggtgttaagaacgatgttgtgtatgagacgagccaagccctcatggagaaacttgctgttgaggcgtatcaagttgccatggtaacctttatattgtattatctctttttggtttgcctgataatgttgtttcttgattgctaagttagggtctgagaatccaattcaatcagatgtttcattagtagcatttcctaacaactactagttcttagaattgagatcgttgcttagttcttctcttgaatccaaacactagttctagtctattcatttgtcgcatttgctaccaactgcgtagagacaaaacctctggtgtatgtattcttggaaatcaatattgtgatgattttagatgagaataatcagaaaaatgagtttggtacacactttatagatatattctttgaattcgatgacataacttgatactgattttgttatgtttaggtaaagagtgtggctcgtgttgttgaaggcgatgctggtaaagtaatctgcaaggaagcagagaaagtgaagcctgctgctgtgattgtaggcacacgaggcaggagcttagtaagaaggttggttataacttataatacaaaaacaactactagttgtgtgatctatgtcttgtttttcttctcttttgcctttcctaagtcgatgattctcttttggatacttgtgcagcgtgctacaggggagcgtaagcgagtattgtttccacaattgcaaatctgctcctgtcataatcgttcctggaaaaggtacattactaatcaatcatggtaaaaccggagtgatcatcacattcatttgtatataactagaaaccttttgattgtaatgcagaagctggagacgagtcgatcgtggactggacacgctcagaagatcctaaaccctgaagaaaaagttcaagtgttgtttccacgaagactgttttgtttttcatctttctgtcgctactgttgcagtctttgtttctgtatgtccctaaaaatcttagattgcttcttcttcgtctctctgtgtgtgtatgtgttttgatttgggtttttgtagtttcaaaatttctgtataaaacctttgctcaggaatgaatgtattgtatgcaatggtgtgatgtgtttcagacttttcagtaaacaagcctatagcagacactatttcttttacgcagttgatcgaacacttggtgtgcgtcttggtgaaatatagaaagattacagatttgtttgttgtttactagagaggttagtcaacc

SEQ ID NO: 13840 - DNA, 3000 bp, Unknown; identical to SEQ ID NO: 13834
  misc_feature (1)..( 3000): cDNA_ID_2704289_gDNA_ID_2214656_Annot_ID_136500 3000 nt of promoter + ATG

SEQ ID NO: 13841 - DNA, 3000 bp, Unknown
  misc_feature (1)..( 3000): cDNA_ID_3100736_gDNA_ID_2214656_Annot_ID_136501 3000 nt of promoter + ATG
tgtaatatatatccttcacctgcaagtttcattaaaacctaactaagtcttgaaactagagacaatttataaacatctgaattcatcaacaacagtacttaaagaagcataccctgcatgaaaccatcccatatgtatcatatcaaaccgtaacagttccacaaatgtcaacagaagtcgtctttgctggtgtaagcacaaccgccactgattcgaccttcccccaaaatgtaccatcttcctttctttcccaagcaatctctatgcaccaaatctctcttttcctacagtcataccgcctaagccggtgcacatcagcgctcaaaatcaccaacttcccgccaaaattagccattttatatccatccacaaagagaccattagctggaaaaccttgtaaaccttgcaagtaaaaccaagtcttcttctctggatcatatatttttattggccatccaaggaaatacactgatgtattgatgcaaaacagcaaattatcaaccacacaagacgaatcattccaagaagcactcaacggtccatgagtccaagactcccatttactttccttaggatcataaatatgaatattgcgagtaagatccaaacagtaaatcttctccttcatcaccgcatatgtcagaaactctcctcttccaaacgcttcagggtacggacctggcacagaactccaactctgtttctttaaatcgaacacttcaacccaatcagatgttcgtaccttacgacctccgatcacataaatctttccgtcaattacacccgcggctgcgcgacagcgagccatcttcatactcgggagggagcgatactcgtgaaatctgcagtttatgtgagtcacatccgagatgcgtcgttcgcctgcgtgtccacctcttatggatgtctcgccgcggcgtccaccgcttatgggtttattatagcctacgcctacatcttctaaaagtttctcgccgacgcgtccaccaatgacatagatatccgatccgatagtgacgacagtagatccccaaggcatgggagggagggaatcgattttgcacaatttcaacgaaatcgtgttaggcaagtttcgatagggtttacgatggagaatgtaccagctagggttttcaacaggagggaatccaacgtaggcgtaaagaacgttttcggtgtagccgagacgcaagcgatcatcgtagagcttcgacatgagactatggaaggatctgcagacgagggaaagcgacgggtggtgacatctccgaacgagtaggaagcaacgtaagatgagttcttctggaattggtagcgacacctgaaccttttctttcaatttcttgtttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaaggtctgttacacgccgagatcggactccgagtgatatcgatg

SEQ ID NO: 13842 - DNA, 2962 bp, Unknown; identical to SEQ ID NO: 13833
  misc_feature (1)..( 2962): cDNA_ID_2714092_gDNA_ID_2214656_Annot_ID_136502 3000 nt of promoter + ATG

SEQ ID NO: 13843 - DNA, 3000 bp, Unknown
  misc_feature (1)..( 3000): cDNA_ID_3032281_gDNA_ID_2214657_Annot_ID_188799 3000 nt of promoter + ATG
cttggtgatctttccccttctctgacaagggtcctattgtgaccagagtatcccgaaacattgtaggccaccaaaagcctgcttgaagaactttggatactgttttgaaagttgcaaaatgaccaccatagctagagctgtgacaatacgatagtatatcagggacctctgttgcagcaatgcatctcctgtaaattccatcagaacaatgcttatatagataaggctcatcccaatgatatcgcctaatctctcgtaggaatctattcttgttgtaatctgtaaaattatcaggctgcacatctgcagctaggtaattaacaatgtcagcataccatgggtaatctttctcgaccgttgtgacggtgcaattctcggttggtgaccaatttcttgtcgatttagaagggtgtcgatcgacaggtgcaagggtgtcgatcgacaccatcgcgcaactacaaatatcaacttcctctgaaatatgagtgtcgatcgtcataatgggtgtgtcgttcgacactgaagcacgatcctgcaacctgtcacgtttgtagtcatcgtcttcagctgtatcaatcatgtatatgttctcttcaggcaagaaatcatttatagggacatcatcatcgatcctaatgcgtgacaaatgatcagatacaccattctcaactcttttcttatctctaacttctatgtcaaattcttgaagaagcaaaatccatctcaaaagtcttggcttagcatccttgttttgcatcaaatacttcaaggcagcatgatctgtgtgaacaataaccttggatccaacgagataagatctgaatttttcgaaagcaaacaccacagctaacaactctttctctgtagttgtataattcctttgagcatcatcaagagttctactttcatagtagattgcatgaagtttcttatccttcctctgtcctagaatagctccaactgcaaaatcacttgcatcacacattacctcaaaaggtaaatcccaatctggtggctgaacaattggtgtgttgatcaaggcctgttttatctgctgaaatgcatcatgacacttctgtgtaaactcgaatttgacttctttacagagtaaagcagtcaatggtcttgcgattctgctgaagtctttgatgaatctcctataaaaaccagcatgtccaaggaaattcctcactgctttgacattatccagcgcttgaagactcgtcatgacctcaatcttagctctatcaacttctataccatgctcagaaatcatgtgtcctagaactattccatcctgtaccatgaagtgacatttctcccaaatcaaaactagatgtttctcctcacatcttgctaacactttgcagagattctctaaacaatcctcaaatgatgatccataaactgaaaagtcatccatgaaaacctccatgatatcctcgatcatatctgtgaagatagacatcattcctctctgaaatgtcgcaggagcattacaaagaccgaagggcattctccgataaacaaatgtaccataggggcaggtgaaagtcgttttctcctggtcatctggatgaatcgggatttgaaagaatccggagtatccatcaaggaagcaatagtacttatgatttgctaacctctccaacatctgaccaataaatggtaaggcgaaatggtctttcctggtagcagcattcagctttctgtaatcaatgcacatccgatgtcatgtgattgtccgagtaggaattagctcgtctttctcattcttgactactgtgacacctccctttttagaaaccacatgaactggactaacccaactcctatctgagattggatagataatccctgcttccaacagtttcataatctctttcgtgaccatttctttcagattcggattcaaccttctcttatgttcgactgaagacttagactcatcctcaaggtgaatcctatgcatgcatacatcttgggatatacctgcaatgtcatcaagagagtagccaagagctttgcaatgattgcgcagcttgcttaggaataaggtgagctctgcgggattaagagaaacattcacaataacaagataagtagaattttcactaagaaaagcgtaccttagccctgctggaagtggtttcaattcgattttaggagctttggctggatcccaatctgaagtaggagtcggcgttgaagtcaaagatggaagagcttcttcaactgtaagttgcatcacatgttcggtctcatctagcagcttagtatatgttgaagtttcacagtccaaatctgcactatcctctatggaagagaccaaaactcgcactagtggtttttttaattccatctctcaaatactatctgaaactgaggaggtgaaaggatctgttaagaaggttttcccttctatgatcggtttcttgaccaaagtgttcatatcgaattgcatagttagatcaccaacattcagccctatgctcccttgtcgaacatctatgattgctccagctgtgtgcaacaaggatctccctaggattaatggatccttagagcaggtccattgggagggccttaacagatccttaaccaaaatctttgagtaattttgagaaaaaataaataaaaattttgattaaatgttaggatcgcacctaattttaggatttttgatgatgttaaggatcggatacgtggcatgttttcattggttgagcttttttgacaaaacaagtttttttcttctttgcctttttttttcatttatcgatttctctctctctcttgaactcggctgtgcaattgaacgattgattatcgccggaagatcttcatgcttttatatgatcaaatcggaagagattatcgcccggaagtcgtctctaatccactgtgctcatcatctcaaccgacggtgctcaacgtcgacgagtttggtgaacctaatcggagaggattgtgaatcatatcggagtcttgtttgaaacc

SEQ ID NO: 13844 - DNA, 3000 bp, Unknown
  misc_feature (1)..( 3000): cDNA_ID_3032229_gDNA_ID_2214657_Annot_ID_188813 3000 nt of promoter + ATG
ttcgtgtttacagtgtcttatgttaacttcgagccaagagacttcagactgagttactccatcatcttagcgtgtttatgctacaaagttgacaaactcggaacaatcatccagttccaaaaagctttgtgttcagccgttggatttggagaaatctgaacctgagtttaatgatgaactcgctattaaggaggtaaagaatgcagagataactgagatggttgaaggtgctggaattacagataaagggaagggtgtgataagcaagttttttaggcctacttatgttaaacgtgtgtgaggttcagttcaattcccctacaaacactaacatgtcgatgcagctatagggggtgtcaatccagtccactgttattgctagcaatcaagacgtgtacagaagcaactaagtcaagccagattataatgatagtgggtttctagtaacaatcctaggtcaggattcaaacaagtaaaaatgagaacttaagagccctactcgatcattgggttgagtagaaccaacaggcagaactaaaatgcaatcaacacgggatacaaataacaggtagataaaagtgcaatcaacaggggatacaaataaatctaatagaagtcctaaggatggattcattgataagggcaactctaggattcatcagatggctaataggcgaaaggtagataccattgacgatagattcaaaaaccgggtcaatccactatcgtgacagagacccccataactctaccacttcctaatctcaactgtcgttgatgaaacatagcagagtagagtttaagaaacaatctaccaaagccaataagcagacaagccaatgtcttggtcgagtatacatatctttggaattcgtagatcagacatccatttgaatgtcttttggacgttggacgtctatgatcgaatctccacattagccagcgaaaactgcataggggccaagcgaatccagaagggttctaacctaatctctaaccacctaactaacctagagattaccctaatctaatccatcctcaagaaccctaatcactactcaagcaacattctcaagaacacaaacccagaaattactaaaatcataccaaaatgtagatctaaacaagctaaacaactctactcaaagaaataaatgcagaaacgaaataaattaagagtaattaagattttaagattcataaacacaaagaaaaactaaaggataaaagatggatcctttggacaaacccctaagtgatctatttatagtaaaatgttgaaaccctagattcactagaagacaagagacttgagccggtttgggcgaatactcgatcttggggatcgagtaaagagggtgctgcaaagtctgcgcctttgtgtctatgctccaagtgatcaattggttgagtagatgcttcttcctctcctatatgtatgctcagatgtctggttgagtggggaatgaggaggatccgaagacgtttttatagctcaacatgttttgtagagttggtcacccttggtcgagtaaatggatcgagtaggaggggcgagtagatcaatctgctgcttcatctgaggctgccttgatcgagtaagagggtcgagtaaactgcagcctcctctgttgcatcctagatcgagtaaagaggtcgagtagaatgatacctcttctgtagctgcctagatcgagtgaagtccttttcagctccttctgcacctgaaaacacaccaaaacatgcaatgcgaatggaggatgatcctagatgcctaagtatgcaaaataagctaaaattgtgcaaaatgatatgctacaatgagcaaatgcacagctgaatgatgataaacatacacctaaaatgagtaaaatacagtgttatcagggtgtgaaatgacacgagacacctcaggtggtagtcaagaaggctccaaataaggtggttactaagcctatacatgttttcaagttgtcttgatccatgactcatgtttttgttggttttagaagttattgctttggttttggtttccaaacaattgtttaagtttattactttttgttctaagatggatttgtttctttatacgttgatattaatatgtttctgtttacttttcttggttttgattattatctaatttataaggttatgcctataatcaagctaatgttagtaaccattagctaatgaaggttatgcctataattaaactaatgtatataaaagttttaacttatgcatgattaatcaatcttatagtaaattaagtatgaatattcatggaaagaggatatttaccttatgctcatagtgaacttcaaatatttgaattcctgaaaacaaatgtaaatagttagtatacacgcagtaataatttgtatagtttttacaaaataatgattgtaatctgaagtcgaaagatatgtaatatatgcaatcattagcacaaagaaagtttctattttttgattggatcaaggatcggttattcataatctcgatattatcattttatttacagtgtttatattatatggaattaggaaatatacataactcaatcgttccgactttcctatcctttcactgtctatatatatgagatacctttggttaaaaaataaaactctctcctctctttagtttctctgtaaccagttttctaaaaaactaaacctaatgggtaccattgactatatccgtgattttaatctcgagaggaccaactgggtcctctacttgaagatcttaagcctctgaaaccatcaggctgtcaacaatggtgaaccgacaaccatgattctctgtgatgagaatgtgagttcataattcaactacttgtgaagttttcattttttttgtttctgaatcctgttcataatctaaagtatgtttgtttatgctgttcagggatgcataattgatgctagagtaccttctcgaaattatttgtataattttagatctaccctacgtgagggaacgtagtattac

SEQ ID NO: 13845 - DNA, 3000 bp, Unknown
  misc_feature (1)..( 3000): cDNA_ID_3032261_gDNA_ID_2214657_Annot_ID_188804 3000 nt of promoter + ATG
ttctacctcctcaaaaccaatgtcctgttgctcctgatgttgacatgaaacaaacgctacaatagctgcttcacgggcaagcctttggctccatggagatggcaaagaagatatctaagttacataacaagctggactgtagctacaatgatctgaatgtcaaggtggaaacactgaataccaaagtcagataattagaaggacattctgtatcttcatctgctccaaaatatataagccaacttccaggcaaagcaatttagaatccaaaagaatatgctcatgctatcactttgcgtagtggaaaagaacttccaacaagagaggaaccaaaaacagtcactgaggacagtgaaggtcaagatggggaggatttcagtgtcggtaaagatcgagctgaaaaactactcgggcagccactcgaccagacactcgagcaacctctcgagcaaccactcgactttgcttcacgacctatcttcccagcagcatcaccatccgctccaaaaccagttgttgtcaagaacaaagaaaaggtctttgttcctcctcaatacaaaccacaacttccatttcctggccatcacaagaaagcattagcagataagtatagagctatgttcgccaagaacatcaaggaagttgagttgcagatacctcttgttgacgctccagcgctaataccagactctcacaggtttctgaaagacttgatcgtggagagaattcaagaagtgcaagggatggtggtattgagtcataaatgcagtgctatcatacagaagaagatcattcctaagaagcttagtgatcctggttcattcagtctaccatgctttttaggtccattggctttcaacagattcctatgtgatttaggagcatcagtcagtctcatgccgctctctgtcgccagaagattggggtttactcaatacaaatcttgcaatatatccctcatcctagctgacaggtcagtaaggatccctcatggtttgcttgaaaatctaccaatcaagattggagctgtggagataccaactgactttgtagtcctggagatggatgaagaacccaaagaccctttgattctagggagacctttcttagcaactgcagaagctatgattgatgtcaagaaagggaagattgatctaaaccatggcaaagactttaggatgacctttgatgtcaaagacgcgatgaagaagcctaccatagaagggctactcttttggatcaaagaaatggatcagttagctgatgagttactggaagagcttgcagaagaagatcatctctgatatgtctataatttgcatgatttaggcattcattcttcaccactttgtcattgtttcatccacatttcatctcattagatgtcgttttagtgtgttttacatagttaggacgattttgcattaggattgcatgtgcatggcatatttggttgttttcaggtactttggatgcttttggagttcaaacagaggaaaaacagaacatgaagtcagaatgcccaatgacgccttcagcaaaagactctatcgcagcctcggagccctgccagggtagaagcaagtagctcagtttcactcaatcgcgaagccggaggaatcaccccatcagaactactcgatcaccactcgaccaccaagaaacctatgtgctcgttctgcactcaaccagacaagttgagaacaaagaagagaagagaagccgaagaaaccactcgatcaccacctcctgacatccactcgatcgcactcgatcacagggtcactggaccattgaatctcgacttcactgcatctcactcgatcgcaagacgaagcccctaaagcccagtttgatcaatgacatactcgatcactgggaagctcatttcagcccgtcagatgccaatgacacattcagtcgaggggtcatgacgtgaagattcgcttaatatttagtttccttatttgtttcgtttctcgcttatataaactgcctcttagggttttccctagggcatccgtttttatctcgcttttatattttcgcaactttcatagccgcagtgtttctcctgcaactttgtattttcactttcaagtatttgattttcagttttcgtctagtctttcatcatatctattatcatgtttttaatcgttgctttgctattgtctttgattatgtctgagtagtgaactgtatttctgaggatgggatagattagttgtggtttacttcgtcgttttaggtggttgagtttagaatactagaatcccttctggattagttgcgcttattgcttgtttcattggctaatgtggaatatgagtccagacgtccagcgctcagaaggcgtttaatgggcgttggatcatattaattccagagatatctgactctaccccaagggattgactgtagagagggtattggctttaacatgttgattcgataatgcctgcttagttagagatcgctaaagggatttaggtcagtgtctagctttgcttgaggatttctatcacgggagtgaattaatctgttgttgaacttgttgtctagggatagcttctgtgaagttttgtcaaccgcttgaatagattaaggagaccacactattcgattaccccatccttaggaatcgtttatccatttgattgccagttatcatttctgctttgttattcacctgcctgctattgccatttctagtcttagtttcatttcatttctgttattgcatactaggactgttagaaccaaccaactctctgcttggcttgacttaaagctttctgatcatatctcatctgtttgcatcacaccggattggattgacatcctaaaatactacaacgacaggatagtgttttaggattaattgagaaaaatcctactatcaatctcaacagtgctttaacaaaaagtggtgaagatgggtttctacatttggaaacattgggataccagaagctgttagactcccataaagcgatg

SEQ ID NO: 13846 - DNA, 3000 bp, Unknown
  misc_feature (1)..( 3000): cDNA_ID_3032265_gDNA_ID_2214657_Annot_ID_188803 3000 nt of promoter + ATG
taattaaaactgaaccatgcctagattgctctactctaccacactgtcatgatctgataccattccctatcaatttgaacctgaatttgatctttaattatcatgtcagcatcaaatttgaactcatggttaccctaaaatacttggattttcttattcattttgatcactcttgttaatccacgtagctgactctccttattagagcagttaacccgaacccaaacctagacattctttcaagccctatatcacttgtgagtgtttgtgaggtcttattccgattaagcttggtagaaagtgttaggttcgtaacgacagagatagtgtctcatgtagttctagtttgcattttttggactagatagaacttggtgggcacttatactttgggttggggtgtgtttaaaataaaaaaaatgggttgattcattgatgagaaaaggtaaaagactctaggtgaagtaagctaaagaagcagaaaaagtctagtaaaggttttgggatttttaaagaaaagaaagagtttttgttagctattgaagatgggaaaaagctctcggttttaaaatgttaaaaacaggaaccttagttgttaaagaaatccaaatccgctagatgtatcaaagtgttgagaaaccttctcctaaagttaagagaaaagaaaagaatgattagaaaaagggcttaaaagattcatgaatgcaaagggtagaattaagttcttatattaagattggagatgggattaccattagagcttcatcagatatactctgggtagatgggatcttatctttgtatgcatagcttgggacttacctttaacattctactaaagcttaatcattttttgagagatcccctgttattgaagcctattctgtatgggaccatctttgtctcttgaccttttacttagccaaatgagttccttgaggatgcattgctttattcacgttccagagctaatgaatgttaaagggattggtagatttgaaaacatgtgtcggtcgagcatatgagtcggattaattgataataaggcatggctaacgtttttgagtagaattcgatcatatcgcagcttagaactatcaacttcgacattgatttcatctggtttatttggtgttttggctctaagtccccgctttcaaacctcacctccaacttgttcttaattgtttgcttgtgggaaagcaaagactaagtttgaggagttgataagtgtgtattttgcatgttttgagcatcaatttgtcatcactttagcatcatatcatcacagttttatatcatttctcatcatttgttatcactttgcatgtttaggatagttttgcatgcatgttgcatatttgtgttgatttcaggtgatttggtgctgttgacgagctaactggaagaagcggacctgatcatgtcaaacccctcgactccctggtcgagtagatgcttcacgacttcaacagaccactcgacctcttggtcgagtagaagacctcagcacttcacgtcaccactcgaccccctggtcgagtacagccaagggagacactcgatcacatcactcgaccccctggtcgagtatcttcacctccaccacctgaccatcactcgatcacatcactctacctggtagttgagtatcaccatcaccaccactcgactacatactcgatggcaagcttcagagtcttctccattctgcactcaacaagacactcgagcacaaggaagaaaagaagactctagcttatcactcgaccactcactcaaccacttgggtcgagtacagttcttaattcgtcccaataatgcgttgttttgagtattagggtttcgggatattttgctataagtagcatgtactttacattttcgagaacaagtttttctaggttttattccgtagacactgtgttcttgaccttttgtaatccggatttctctttatctatttagtattcagtattcagtatttgttcttaacctgagtagtgaataggtttctgaggatgggttagagtagtttagaattctcattatgctaggtggttgagtttgattgatagatcccttctggattagttgttcttaatgcctattgctttccaatcaacttgaatttgagcccagacatttccgcgcccaaaaggtgttcgatgaaatgtctgaaccactaattccagagatttgttggcctgtaccaaggtattggttgcagagagcgttttggctttgacttattgattcgtaatgcctgttaggttagctctcttcaatggtcattgagtctgggactaggttaacttgagggtctctgtaacggtggcacttatatttggttaatgaacttgttgtctagggataatttattgagcatatcaatcacctataaactgaggaaacgaaactactcaattacctcatcctcgggaattctttatctgattgattttattgtttactctactgttgtttactacatcttgtcatctgttgcttagtttctataattctttcctgttactcgacctgatactcaaccacccagttgtctggtaaccgactgtgcagtcgagtgtctttatttcgcttactgcctgttactcgaccacacccaatgctctgcaacgagctgtgttggtcgagtgttttgctgtttctacttgattttctgttttctgcatgttcacttaggactgctagaacacaccaaaacctgttattgcttggcttgacttagtgacttctgatcacatcttgattgttcgcatcccacccatttggattgacaacctaaaatactacaacgacaacgataattgactaaaaaccctattatcaatttggcgccgttgccaattgggtgtatgtttgttacatttaagatttcagacttgcttagatcaagttctttttcaattttcatttcacttactaacagtgtgtttttttgttgtcttcttgatcaaggttcacctctgctatatg

SEQ ID NO: 13847 - DNA, 3000 bp, Unknown
  misc_feature (1)..( 3000): cDNA_ID_2702152_gDNA_ID_2214658_Annot_ID_136504 3000 nt of promoter + ATG
caggagcctaaaaataggaggataacaactcagtaatatgtgtcttgtgtggcaagaaattaaggattactatatcacaactaatttactcagcagaaatgtgacttgtgttgcaaggaattgaaaaagacagattctctaaggattaaagtcacaaagtcaagatgaatggcttacatggtttgaaacagaatggcttacatggcttggaggaattcgctttccagttagcagattcacaatgatatttagtaccaaatcaatgtcacacttttagggttcacgattcctacaataagaatatattatataacatcacattcagatatgaatagtatgaagagacaagcaagaactgattacctcttgttctttgacttcaacatatccattaagcaaataaaaacagttaagcatacttaattagatcattaagaaggcataagcttgaaaatgttgtttcgtataccttatcaaacagaaccgagtaagcacttaagttaccgtacgataaaacatgtattattccaataatccaatgcttctattcgattgtacgggaaattattatatgtatctttgaaaacgccttgtatgcaccaagataaggacataaaatttagttaaatcacaccgttttcattacaaaaatgtgatatcatcttatcatgggcatatatatatattttacaggtttttttttgctcacacaaaaattgttcatacaatcagtaattactttacctcagggtttggtctcctagcttttgtacccatcatactcaatcacgagatggtttgacatcacacgacttacgctatacataacgattaatgaacataatttagtttttctttcttttgtctcggatcgatcaatgatattgatcttatatgatatcaaaatcttatagtactggcagtgagattaaaaacactaattttaaacgacattattgttacatgtgtagataggacctgccgtattcagacgaataacaaatgacaaatctaagaaatagaggaagagagagagagagaaagagacgtcgtgcgcatttatagtataaagtataaacctttgattattattgatacgttatttatgatttacacgaggattcaactattttcaaagagtttgatgacctttggtttggtcatgtcattgtcccggacgcggctaatggggatcggactatggctccccaaatcattgagggccgttttgatcatttaactaagcgtctaagcccgacccgttggatatcaatgtacatattaatatattatatacacaaatattcaagtttaatcattaaatttggttgaatgatgaaacctaagatgaatgatttgtttcttctgttcgctttttttttttgggtttgtttttatatcgatttagataatgtgtaacattgggaagttcacaacctgtctagttagcacccaacttatgacagtaatttttgtcatgaaattaataaaatgacgacattttggaacataaatagcaatttcatgtgtaagaataaatattaccataattgtgtgaatcattatgcctttaatgcaattatttatatatcgatcatatatagattccatcctatatacaaaatgttttaaactttgagactcgagctgatgtcagaaagaatattcatataagagaaatcgaaaataaagtattaaaggtcaaactatattgatgaacgaacgaacctgttcaacacgaaagacatgtcttctctaagaaatgatcttgatccgattgatacagccaagttctaaccaatgaaacatccccgaataaaaaaacacaaagtaccgacgaagaaataaaacaaagtgtacgcatacgtaatcaccacaactgttatagtaataataataataatcttatacgaattaattatgattaggggcaacaaagaggaggtcagaataacaccaatcacacgattaaataagaacatttaaccatcaggctccaaaccaaaacttagaaacttgttttttttttttgtttccttctttgatctttctttcagaagaaaagattgatttaaatttgagaaaccaagcgactgtttgtttactttctttattattacagatttacaggtacagacaaagttgtatgtaagtgtgattagaacagtggatgctcttatcacgggtccacttgctctctaaaaagaatattgaagctcataattacatctttagagactaaaacaatcttaatcattcaccttcaccaagtacttgtgtccagaagaaaaagaaggaaaaaaagaacacaccattcaagaaagagagaagcttcttgtgataagaaatttcacaggttttgtttttgttttgtttatatatattctcagatttgattttgcttaccattatatgtatgaagaaatagagagaccaattactttttacattagacagagtaaaatccagtctgtgcatcttctcaatgttttttttttgtttgttggtgctttctctaagtgttcttgggtataggtcccaaagtgaagctttttctgtttctttgtgcaaacaaatcttgataaagttagtaacttttggtgaaaatcttaccctttcatggacaatcagatttgatttcgtttccatgtccataggtgagaattttgtaattgaaattgatggcactctactttgattgatggataccttcttaagtcaactcttcattgaaagcgaagctacttatatagattatatagcatctctatgatatgattcttctcttgtcttattcttgggtgggtctttgacaatgtttctgcaactttttcagattgggttttaacattccaaggagaggactttgtcttgtctctattcatcttcaagacccttatgagtttcggttcttgagtaaacaacagctaagcacagtctctgagaacttgaggatttggtagtatctgttggaggtataaaaacgaatctttagacatg

SEQ ID NO: 13848 - DNA, 3000 bp, Unknown
  misc_feature (1)..( 3000): cDNA_ID_1808445_gDNA_ID_2214658_Annot_ID_136508 3000 nt of promoter + ATG
tcctgagcttggtcatgtgctcaatgacccaagcatccttcgtcaaactctagaagcggcaagaaacccagagcttatgcgtgaaatgatgcggaatactgatagggctatgagtaatattgagtctatgcctgagggatttaacatgcttaggcgtatgtatgaaaatgtccaggaaccgttaatgaatgctaccactatgtccgggaatgctggaaacaatacaggctccaatccatttgctgctctgttgggaaaccagggggtcactacgcaaggaagtgatgcttctaataattcttcgacaccaaatgctggaacggggactattccgaatgcaaatccacttcctaatccttggggtgctacaggtggtaagtaactgcattttcatcttctaatctcctgtcgattttatttgtcttttgaaggatgcagtaatattttataaatgaaaaagtggcttgtttataagaaatggacgttactgttcactgctctgcttcaggaacaatattgtgtatagtaaattggtgagttagtgtagttaccacaatttgttgttatgtgtagtttttgcatatgattttcttggcttattgtttctaatttaacatttactcataatacactaaatataattgaacatattgtgggctacttgacaggtcagacaactgcccctggaaggacaaatgttggtggggatgcgaggagccctggacttggtggccttggtggtcttggaagccttggaggccttggtggactcggtatgcttggagcggattcacctcttggtgcgactccagatgcttctcaattgagccagttattgcaaaacccagccatatcgcagatgatgcaaagcgtattttccaatccacaatacatgaatcaggtaggcctagaatgatctgaacttaagagccttttaccattgtgaacatatattaattgttttcccttgattccagcttatgagtcttaacccacaactccgaagcatgctagattcgaatcctcagttgagggaaatgatgcagaacccagatttccttcgtcagtttagttctccggagatgatgcaggttagtttgtcccctattgtctgtatgcatatgaatttttaacatggtagtctctcaaaagaaacatttctttgtatctaagctattttcaagtaaagaagtttcttttcttttttttttttgggacaaagtaaagaagtttcttaaacctaatgttttctattgttttttggtcttcagcaaatgatgactctacagcaatcactatctcagaatagaaatacagccagccagtaagttttgttaaaacccttcgttgtttggatttgcttaaacaaagttgagcatttacatgtcctttacatattgttttttgggttgtttagtgtttagacaatgttgtaactagctaaaaagattggttgtgaacgatctctataataagaaaaggattgaaccatgactaatgcagcaactcttgtatgatttactgggctgatcactagtaacatctatcaaagaggctataaataaagcattttaatcgttggaatacacttgaatagggctcataacattttgtttgtttttgattatgccttttagcataagctatgtgtgttaatctccatattttgattttcatcaatccgcattcatgttcccaaatctatcttctctgtagggatgcggggcaaactggtgctgccacaggtactcttaaagatattatatgtatttattctacagtagtataaagggtttagttatgttacgtagtatagcagctactctttagttctctttgctttcatgtatgttttattttagcagatattgtatcgtatacaagttaatagtagaatgacaatactgatggggacaggaaataacggggggctggatttattgatgaatatgtttggcagtcttggtgctggcggcctgagtggcacgaaccaatccaatggttagagactacaaattttttttagcttacgcatctgttgtgatggttccactgaaacttgtctgtttgattccagttcctcctgaagagcggtacgctactcaattgcaacagttgcaggaaatgggattctatgacagagcagagaacattagggcgttgcttgcaaccaatggtaacgttaacgctgctgtagaacgactcttggggagtatcggacagtagcatacaggttcatgaactgatgtctctccatctggcttctcagttatagaataaacagcttgaatgtgtgtttttcagtaatgatatattcatcgaattcataaaaatttatatatgataggatcgtgaactttgttgatagaaaagccgcatcaatacggtatttgttatcagtggtcactcttcgtctttaactacccttaaacctatatatcttgggtgtttatctttgataacttatttcaagttgttacaacatacaacatctgtaaatgtttatagacatcaaagtgaaattgaacccattaaatttttggttccttctgatccggttcaaaggttaaaccaaattgcccaaagagagaagtggcatgttgcaaaggaatatccaattagttgattcatcatcttcaattagattcaagttacagccaattccttcctgaactatataccaaatgcctcaatttagacccgacccggcccaatcttacccagtaagagtcgtcgatacgttctctgaagcgcaagtcatttctggattctcatttaattggccgttcggggccaaataactctttaattttctgcagtctcatttgttattcgaccaaaaataatttatatccctttcctcaagaaatcttcagaaccgacttattagagcttcgagtctcctcaaatcttcttctacgattttttcttctaggtttagagcttttgattctccgatcaatttcgcgatttgttgaactaggatctgaaattagaatg

SEQ ID NO: 13849 - DNA, 3000 bp, Unknown
  misc_feature (1)..( 3000): cDNA_ID_3032291_gDNA_ID_2214658_Annot_ID_188828 3000 nt of promoter + ATG
  misc_feature (46)..(46): n is a, c, g, or t
attatacatcccattttcagaatcaaatttactatttacaaaatcntgaggcacaaaattatttcctaatgaaataatcccatatattaataccttgtatttaatggtaacgccatttctttcttagaaaaaggttttggcgaattatctatttttaatctataattactactgctaattggacatgtaccatgagactaaaaatacacacaaaaaaaactttaattatttgtttcctccctatacacagatatatgttttatttttcttctaacacatgcacaagagcacatcaacttttaattttatttattttaaattgttccatccacaaactatattgatgatggttctttgactgacgcattacgcgtgaaatggtttccttgcttatattattgtagtcgtgttcatattattttaatgatgctcatatgatttgtttgcatcctgaaaaatcttaacacgtttgttttctatgttattatttttcctggccagcttttcgtatgttgttcatttacaagaatactacatactgtatacacgtactcaatctacctcttttggatatattttttgtggtacgccattctacacttccgaatcaataataataaaaattaatctccacaaatgatttcttcacaaattggagttaattatatggagatagatatccctctctttacaaattgacaattttaccttcatgcactctaaatatataggcactcttcctgggagagttacaaagtaaatcctaaatcgaatggattaaacaaaaacaaaaaagatcaaaattataaaaacctgattcttttcaaatttgtgtccaattaagtgtttatttaaaccataattcctatttcttttatacaagataaattatcgtaagattactgatctgcttttttctctttgcctctgcttgataatttcaatgagtttagggttttgttatcaaagttttcgtttatttttgaaattagttagaggttctttccaaagatcattaatttacaaggtttataccggacaatgcctccccgactaatagatttacctgcactatatacacacgacaaacatttttaattggacacataatcacacaaaaaaattactagatgaaaaaattaaacacttaatcaactattagactacaatttttactttttctatgaccatttaatattctaatttcactcatttgttgattttaaaactatatcttcataaaaaatggactatatatcttgtttgatgaaatatgttgtttatatataaaagtttcaaaaactaactaatttgtgagctagggtgaaggacatggtactccaaagattgtacaatttctttgtgttcttgaaaaggttattacataacgataaatatagctagaaagatattcaactaaaaattggaatataagagaaaacataaagataatagaaaatgattggtgaatgaagaattatgcagggttctacaagaagaaaacaaaaaaaaaaggcataatgaagtaaaagtgtttgaatctttagagtagtaaaaataatctcaatttgcaaacgtttggaataataacttttctggaaaatctccaagttagtaataaaattgtttgaatcttgtgttggtgtttgtagaattatcatcaaaatcaagctgcttgaaccttaggggttactccttcacttcgttttattggttactgtctccatttgcattgcgatgttttcttctcgtttttactactattactacggtttatgacgcgcctgaactcatcttcaccatctcctatagtaccatttatgaattcaagtgataatcgatgactcaagttttcaatggtgaatcaatttttttttgagatctttctcttgagtatctttctattcacatcaaaatccactatttaatacgccaacatcacgtctaatgaacttgacaattatttctttattttgttttgtttgtatgtaaccaaaatattcagttttggattttgacacaataatttaccaaaaaatgccgtgaaaaagaattctaaaaacagattaatagtttttaacacaaaaagagctatttacttttatttaattggacatttatccatctttcatttttttaaattttatataaagaaaatacatggatatcaatcataaaatcatcaaccaagattgaaaatggtaattatcatttagttttatagaaaattatatctgtgtaagcaaccctgaatattaattgagtttacatgataaaaaatatagcttttgaacaattattttaacaacagtaaatattaatttgctatcttaaattatagtataaaagtgaaattaattatttaaaactataatctaaacatatttataatccaaccgtatagagacttgttgaaaagtaaaataaagttttcaaatgaagaaaatacagaggataattgtaggggccttgattgttttctctttatttggtggtctcatgtaaattatttttctttatagttgactttgacctttaaaacctctataattctctctttccttattcttcctcaaatctttgcaccaccattcttttatgactcagtcttctctctctcttctctcaatgcccatgataacaccaaaccacttgcttctgcttctcacaccacaaaattctctattcaataaataaatctctcagaagaaatttcttcgaattggagaagataaaaaaagttttatcttttcttgattttttttcttttttttctaatcattcacacccaatttaaacgagacttgtccaatctctatccatcaatattgtatcatttcttgtaaagtactctgttttagcttcacacgccattttttgtttttccatttgacttctgtaaaatcctgacaaagaattgtttaagacatacatatacgtgttatatatttgtaaaggaagcaaaaagtgtttggcttttaatttctctctgttgggatg

SEQ ID NO: 13850 - DNA, 3000 bp, Unknown
  misc_feature (1)..( 3000): cDNA_ID_2704325_gDNA_ID_2214658_Annot_ID_188827 3000 nt of promoter + ATG
gtagctcaactggctctgaaatgccttggacccgaacccaaaaaccgtccatcgatgaaagaagtggtggaatcgctcgaactcatcgaagctgccaatgagaaaccgttagaacgaaggaccactagagcttccccatccatccgtcaacaacaaggccattatcgcccgcaacaactctcttcgtttcgtcctagacaaaacgtgtctcgagctcactagtgttgtttgaagacactgagattcttttcttagttttgtatttgttaagattatcaaaacccattcgtatgtatactacatgaaagagaaaacaaatgttgtacctgtattagtatgtagtgtttggtgtgtgtaatataactacttaaacggttaaaccagattatgaaaaggtttaactaatggtcatcaatatataagccattgttcacacaattttgttgttaaagcttcaaactttagttgtggtttgaagtatggtaatgggatcacacttgtgttcaaagctacaagctttgtcttcgaagattaagcaagcttctgttagtggaaaatggcgggaagtggtctctgggtattcagagatacagagagctggagttcaatttaacgatcctttcgttttccccattgtttttaaagcttgtgctaagctctcatggctgtttcaaggtagatgtattcaagcaagtctgttaaagagaggttttgagtcttttgtttctgtagggaactcaattgctgatttctatatgaaatgtggagacttgtgttctgggttacgagaatttgattgtatgaattcgagagattcggtgtcttggaatgttatcgtttttgggcttctcgattatggttttgaagaagaagggttatggtggttttcgaagttgagagtttggggttttgagcctaatacttcaacattggttcttgtgattcatgcgtgtcgtagtttatggttcgatggagagaagattcatggctatgtgatccgtagtgggttttgtgggatttcgtctgttcaaaattcgatcttgtgtatgtacgcagatagtgattctttaagtgcacgtaaactgttcgatgaaatgtctgaaagagatgttatttcttggagtgttgtaatccgaagttatgtgcagagcaaggaacctgttgttggattgaagttgtttaaagagatggttcatgaggcgaaaacagagcctgattgtgtgactgtgacaagtgttctcaaggcttgcacggtgatggaggacattgatgttggaagatcagttcatgggttttcgatacggagaggttttgatttggcagatgtgtttgtttgcaattcacttattgatatgtattcaaaaggatttgatgttgattcagcatttagagtatttgatgagaccacttgtcgaaacattgtttcatggaattcgattttggctgggtttgtacataatcaaaggtacgatgaggctcttgagatgtttcatttgatggtgcaagaggcggtcgaagtggatgaagttacagtcgtgagtcttctccgggtttgcaagttttttgagcagccattgccttgcaagtcaatacatggtgtaataattcggcgtggatatgagtcaaacgaagtggctttgagttctttgattgatgcgtatacaagctgcagtcttgttgatgatgcaggaaccgtgcttgattcgatgacgtacaaggatgtggtgtcatgtagcacaatgatctctggattagcccatgctggccgatccgatgaagcaatctcaatcttctgtcacatgagggatacgcccaatgctatcaccgtcataagtcttcttaacgcatgctcagtttcagcggacttgagaacttccaaatgggcacatgggattgctatccggagaagcttagccatcaatgacatctcagttggtacctctattgttgacgcatacgcaaaatgtggtgccatagaaatggcgagaaggactttcgatcaaatcactgagaaaaacatcatctcttggaccgtgatcatttcagcatatgctattaatggtctaccggataaagcattagcattgttcgatgaaatgaaacaaaaaggttacacaccaaacgctgtgacatatctggcagctttatcagcttgtaatcatggaggattggtaaagaaaggtctcatgatcttcaaatcaatggtagaagaagatcacaaaccttcattgcaacattactcttgcattgtagacatgcttagccgagctggagagattgatacggctgtggaacttatcaagaatcttccagaagatgttaaagcaggggctagtgcttggggagcgattcttagcggttgcagaaaccgttttaaaaaattgatcattacctcagaggtagtagctgaggttcttgaactcgagcccttgtgttcttcaggttacttgcttgcgtcaagcacatttgctgcagaaaaatcatgggaagatgtagcaatgatgaggaggttggtgaaggagagaaaggttcgggtcgttgcgggttatagcatggttcgtgaaggaaacttggcaaagaggtttttggctggagacaagttaagccagagtgattctgaattaaatgatgtcgttcagagtcttcatagatgcatgaagttagacgatactgcaggaccgataaactaaagccctttgggcctcaacgaagcagataaatgatattattatacgatgccgtatgtattctcggatccgggtgagaaaaggaacgaaccgggttttgtttttgacccgacccggtcccttcgatccgttctctgaagcagaagtcttcttgttttgttctcttcgatccatttcgtcaagcaatctaccgaaccgactcagagcttttgagtcttctaaatctctatcgaatttttctagggttagggctcctgatcgatttcgcgagctctgcgattattttaagtattaggatccgaaattagaaatg

SEQ ID NO: 13851 - DNA, 3000 bp, Unknown; identical to SEQ ID NO: 13848
  misc_feature (1)..( 3000): cDNA_ID_3032295_gDNA_ID_2214658_Annot_ID_188826 3000 nt of promoter + ATG

SEQ ID NO: 13852 - DNA, 3000 bp, Unknown; identical to SEQ ID NO: 13850
  misc_feature (1)..( 3000): cDNA_ID_2704325_gDNA_ID_2214658_Annot_ID_136509 3000 nt of promoter + ATG

SEQ ID NO: 13853 - DNA, 3000 bp, Unknown
  misc_feature (1)..( 3000): cDNA_ID_3032291_gDNA_ID_2214658_Annot_ID_136510 3000 nt of promoter + ATG
atcaatcataaaatcatcaaccaagattgaaaatggtaattatcatttagttttatagaaaattatatctgtgtaagcaaccctgaatattaattgagtttacatgataaaaaatatagcttttgaacaattattttaacaacagtaaatattaatttgctatcttaaattatagtataaaagtgaaattaattatttaaaactataatctaaacatatttataatccaaccgtatagagacttgttgaaaagtaaaataaagttttcaaatgaagaaaatacagaggataattgtaggggccttgattgttttctctttatttggtggtctcatgtaaattatttttctttatagttgactttgacctttaaaacctctataattctctctttccttattcttcctcaaatctttgcaccaccattcttttatgactcagtcttctctctctcttctctcaatgcccatgataacaccaaaccacttgcttctgcttctcacaccacaaaattctctattcaataaataaatctctcagaagaaatttcttcgaattggagaagataaaaaaagttttatcttttcttgattttttttcttttttttctaatcattcacacccaatttaaacgagacttgtccaatctctatccatcaatattgtatcatttcttgtaaagtactctgttttagcttcacacgccattttttgtttttccatttgacttctgtaaaatcctgacaaagaattgtttaagacatacatatacgtgttatatatttgtaaaggaagcaaaaagtgtttggcttttaatttctctctgttgggatgggtctttgttggggatctccatctgattctcctccaacaacaacaccttcctctactggtaacatcagttcaggtttgtcctatctatatctactgaattttcccatctgggttttgcttaaacttgcgtgatacgttgcaatttctgtacttggttgtttgatgcataaaggttacgcttttacatcttcttgtatcgtttgtgactcttcttttggtgttatctcgtatgggttctatgaaagttttgaccttttgattaaaagactctgttcttcttgtgtttttgttgaatcagattcattatcatacttaatgctgtttgtgatctgttatgtgactctctgttttgggcttgactttgttttcttgtggttgtaattgaagtagggacttttaagtcatcaaacaacacgacgactacaggaacatcaaggggaagtaacatatctagcaatagtgggttctctgtggcaagtggtgaagatgcttaccccgatggtcagatacttcccattccgaatttgaggatattcagcttagcagaacttagagcttcaacaaggaatttcaggtctgagaatgttcttggagagggaggatttgggaaagtctttaaaggctggcttgaagacaagactccagggaaacaaagcaacggaactgtgattgctgttaagaaactgaatgcagaaagcttccaaggattcgaagaatggcaagtgagtaaagtgaactatgggaaactagttttctaactttgatatacaaagtgaagttttgtttgctgagtggatagattctttgttggttgttgtgcagtgtgaagtgaattttcttgggagggtttctcatccaaacctcgtgaagctgttgggatactgcttggaaggtgaagagttgcttcttgtgtatgagtatatgcaaaaagggagcttagagaatcatctcttccgaagtaagaacattctttaatcagaatcttttgcttatatgcacatttacatctcgatgtttcgatgtgtaattgcttctattacttcagaggggtctgccgttcagccactctcatgggagataaggcttaagattgcaataggagcagctaaaggcttagcattcttacacgcttcagagaagcaagtaatttatcgagacttcaaagcgtcaaacattctacttgatggggtaagtacatacagattgcttatggatttgatgtagcaaatcatcaagtgtgaaatttcaactggtttgctcttgatgcagtcatataacgcaaagatatcagattttggattggcgaaattaggaccttccgctagtcaatctcacatcacaacacgggttatgggtacacacggttacgcagctccagagtatgttgctacaggtactacaatgttttgtattcttagttcttttggtttccaacaacaaactgtgaacatgtttgttggttccaacaggtcacttgtatgtaaagagcgatgtttacgggtttggcgttgttttggctgagatcttaactggtttacatgcgcttgatcctactcgtcctaccgggcaacacaatctaaccgaatggatcaaacctcatctatccgaaagaagaaagctaagaagcataatggaccctcgtctagaaggaaaataccctttcaaatctgctttccgagtagctcaactggctctgaaatgccttggacccgaacccaaaaaccgtccatcgatgaaagaagtggtggaatcgctcgaactcatcgaagctgccaatgagaaaccgttagaacgaaggaccactagagcttccccatccatccgtcaacaacaaggccattatcgcccgcaacaactctcttcgtttcgtcctagacaaaacgtgtctcgagctcactagtgttgtttgaagacactgagattcttttcttagttttgtatttgttaagattatcaaaacccattcgtatgtatactacatgaaagagaaaacaaatgttgtacctgtattagtatgtagtgtttggtgtgtgtaatataactacttaaacggttaaaccagattatgaaaaggtttaactaatggtcatcaatatataagccattgttcacacaattttgttgttaaagcttcaaactttagttgtggtttgaagtatggtaatg

SEQ ID NO: 13854 - DNA, 3000 bp, Unknown
  misc_feature (1)..( 3000): cDNA_ID_1450859_gDNA_ID_2214659_Annot_ID_136521 3000 nt of promoter + ATG
gggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgttagttaataatctaaaagacatcagagagtgctaacaacctatattgaaactgacatgtcaagctttttgcaggtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggtacaagcagtaaatcttgaaacttcacatcattaggttggagacttaccggtaatcttacaaagcaaactctttaatacaggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttcagttctgaaagaaggggtcaagcatcgttacttacaaaatttcaatcagtttcggagtttacataggataatggttatagacttatagtggatcatatttgaagctgcctatgaactcaggcttctctcagtgcctcgaggtgtaaatttttaactaaacgtaggtggatcgtacctaattcatggatatgaatctcttgtacatatgcgttatatatttgagatggtatgaggtttttgttgtgacggtgagagagtgtcccgcaatctgaaaaattggctaaccttagtttttcactttttctggttgtaatttttttattgaatgcatcccctaaaaaattttgtttggtgagatacctattgaatctctcactaatataattttattatttttggttcacttttgtgtctctcatcaatataatgtatttttagtgttatttaataattttaatgtaatttaacttgaatacttcttttaatgtcttattttaaattaaaatatttctaactaatatttttaaaccatctcaaactacattttaaaaatattcattttcagacatattcattttaaacatatacatttctcatagagagctctgagaagcaagtgatcaagtggaagcaactcccacatgggtgggttaagtgtaactcagatggagtttggaatgcagaatgcaacaagtgtggcatttgctgggtgcttagaaactccgacaagaacgtgctttggatgggtgcaagggctataccaaaggctcaatccgccttggttactgaggctgaagcgttgcgttgggcggtgttgtcactctctcgactcaactaccgaaaggtaatctttgaatctgattcccaacaattggtgtctattcttgttgataacgatgatatgcctactctggaccctattatacaagacatcaagttcttgcttcagcattttgaggaaacaaagtttgtgttcatgcatcgtggaggcaatggagtggcagataggatagcaaaggaatctctttctcttgagaattatgatcctaagttgtattctatagtgccaaattgggtaaaatcgtttgtggaattagacaagttgtaaaactctgttgtttaatgataattattgttgttgagccaaaaaaggaaaaaacatattcattttcaattactttgttatcttttataaaaggaaaaaagatggctaactacacgaaatatagagaattacgctgtcatatataccaagtataatattgtatcttgagctacacgaagtacatgtattgcatgaccatatttatgaactatatgacgtcatctggttaatattatgaacatacaattccggtaaaccgatcagttgacttcggcgttgacaaacaaaaaaatgctaaccatagttcaaagaaaaagaattgttacaaaaacgattctacgataatttttataatttataataaataataaatctagacggtaaaaaataataacttaaaatttacgttttttctgacatagaagtctatattttagtacacagattcttttattttatttatgtagaatgatatgtcagatttgtcatctttgttagagtccaaaattggcctcttccaaatttcttatggttctttttcattttttccccaaatttaaataaattcaataaaaatttgttgattttttgtggccgttgattaaaaccgggaaagcagcagaaacaaatctgaaaatctgagttaagccaaccacaaaacaaatccactccaaacactccaaattacttgtctctcttctcttccccaccaccactaccttacaaaaaccctaaccctaatttctccacccccaaattcttttcctcaatctctgcgatg

SEQ ID NO: 13855 - DNA, 3000 bp, Unknown
  misc_feature (1)..( 3000): cDNA_ID_3032337_gDNA_ID_2214659_Annot_ID_188847 3000 nt of promoter + ATG
agtgtttttgaaaagtccaactatattagttcatctgaaaacgaatgtgcttgagttgttttttattgttgttttagattttcagttttttattttaatttatatatccttgttttttttgttatctgtttagattgtgagacggtgaaattttagaaaatttatatcttacactaaaaatataacatgtctttattaaccatgtctctatatattcaatgtaagcatattcaacttgatgttcttagaaagtttagttaaatttttgtcataatcttatatcttacgtattagttataaggatagctcctcaaacatctttcaaattacttgttttcttagcataaatctcgaaaagcttagatatatttaatctgtcatttagtttctttcataataatcgtctaatttttaggcaaggaatatgtgtagcatgtttggattttatgatcactttaaccacttaattgaatctcaaaattaaagaggatatattgaattaaaaaatatagaaagagtgatggttcaaattctcattaattatatcctcctattttagttgtttttttttttttttttttcataattttccaattaaaagaaaaaacagattacagagggaaactcccccaacaaacacaggcacgcaggccctacaaaagaaacaaaagacaagaaaggagaaaaacaaggccaaagcccacccggcacgcaggcccacagaaacccacaaaggccaaaaggccgacaaagacccaaagaaccaagaagacccagcaaccgaaaccacgtcgcagaagccatacctgcacccaaggaccacaggagacgttgaaggaaagcaggtccacaaaaccagccgaagagaactaaacttggaaaagttcgaaccaagtagctagaagagatgatcgagaaagccccacaggtctttcccgacagataggatccaacctagctcggataagctgctggacctccttaatgatagtaggaggggttcttgaatgagtagtatgaattctacagtttctctctctccaaatcagatacacagaagcttggaagaggagcttgatgataagagaaaggttctttgaggaagaggccgacttcaaccaaagcaaaatgggaccaaaaagatgaggaggagtcatacccgcccttatcatgaagaaactccagatttcattgctgaactgacactggaaaaacaaatgatcatgagtctcatccacaacattgcacaagacacagacggtaggaatgttaagcccccattgagtcaacctatcacgagtatgaagtctcttccaagctgccacccaacatataaaagcatgcttcgggattctgtctttgaaccaaacagatttctgccaaggcaccaaaacaccatcgggattgagagcagtccaagtttttgacgctgagaaaatgtttgaaggagcatgatggtccggcttccatttatagacatcatcatgctgacattcaatcatactctcgctcgaaggcagaacactttttaacagagcaatggacgggtttctgcttctactagaagacaaccaccagttatcaccacgcaaggcatctcttaccacggcattaagaggcatccccacagatcttggaccgttagttcccgtcagatcaattaaaggcccctgcccggtccagttgtcctgccagaagcttgccgtttcccctgaaccaatctcacaaacaagaaagggcctagcaagagggcgcagtttacaaagcttcctccaaatccagctgccagaggaatagggatttagagtccaaaaactcctattttagttgttatgttgaattaattactaattatgtattatttattttatgaagtctatgtggcaagttttcataatgaaattttcattaaaaaaagtcaataaaatacgtgttatacttcatatggctctttcaccacggacaagtcaattccatcagctaccgttgtggatcctatggaggatttggaaaagcaggaacgttttatattttcaaagaagacatattccctgggaaattactttgcgtcttgctcaaactgatgctcatgagtataccgaggcgaatacagtagcacaaataaatacacgtagcagaggggtgagagaggaggataaccatgacagatggagacgacctgaagaggatggatcaaatgcaactttgatggctcattcgttaatggtgatgtagaaagtaaagcaggttgggttgttcgggatagtaatggaagttatctactggcggggcaggctataggaagaaaggtggacaatgctctggagagtgaaattcaagcgctaatcatttcaatgcagcactgttggagtcatggttacaaacgggtttgctttgaagaagataacaacatgctgtttgacctaattaacggatccaaggtacattttggcgttcacaactggatacgggacattcattggtggtcaaggaagtttgaatcaatccatttcaattggataagaagacatcacaatactccagctgatatttttgctaaaggtactcttcaaaaccaatctttattcttgaatcatttctgggttcctaatgtaataacatatgctgtacattgtgactacactgctgatttataaatcaataagatgctgatgacaaaaaaaaaaaaaaaaaaaaaaaaactgtttagatactcaaataaaaaaagtgatttcatataaaacggtgccgtttggtccgtaaataacgatgtcctctttctcttctcctccggttgattcagtccttttaacactcctcttttgatctcgccggcaaatatcatcccacatccttcatgtctcaaaatctccgtcatcgttctcttccttcgttattactctcgtactttatcacctccgtcgttctataatactctcttccgtcaatcatatcatttgtcgacaatttcattctgatcagtttaaaaattgatccatg

SEQ ID NO: 13856 - DNA, 3000 bp, Unknown; identical to SEQ ID NO: 13855
  misc_feature (1)..( 3000): cDNA_ID_2714104_gDNA_ID_2214659_Annot_ID_136522 3000 nt of promoter + ATG

SEQ ID NO: 13857 - DNA, 3000 bp, Unknown
  misc_feature (1)..( 3000): cDNA_ID_2704389_gDNA_ID_2214659_Annot_ID_136524 3000 nt of promoter + ATG
aacaagtcattctcaatgcattcatacctgcaaaaagcttgacatgtcagtttcaatataggttgttagcactctctgatgtcttttagattattaactaacatattttcgcagagtgtatcgaccgcaactgacaaattgatgacttgaatccttatctgcatgaccttatcatcagcaaattgatcaaaaggttcctccaagaacttagaaagtttctcaacattagcctcaagctgctgctgctgatcctcaaacagattttgttttatttctctttcctcagagctcatctcatctttaaacagctcatctccaaacatgtaaaatgcgaaagggtatgaatatgaaagaactcgtcttgatctaaataaccgatggagtccattggtagcccagctgaagtctttaagttgtaactccctcttttctgaaatagacacctttttactaatattattactaagcttagcctctagcttggaggagtcgatatgtgctttgtatcggttatgataatgcatataccgcttgagatcccttttcgctctctccatttgtttctctttatcttcttggaaccgaccacaactatgacccgagattctagcccaagtgtggtcccttccagtagcttcaccacacaaccaactgtataaagtaataaccaaacaaaaagttcatcaccacctgatataatgttcactagaaagcagaggagaaacaaggctaaaattcataccaaaaagattgtcgacaaagacaagtcacgagattgcatccaccattcttttcaacaggcttgtgacatttgggacacggctttgtgtgaacagttatccaattaacagtctcggactcatcaaagcacttctttctccatagttcccacatcacacaagagcaaggggagtgagcttgagatgaacaactgaaacagaactgcaaaccacaagagcattcaacctcacagagctcgtcatcctcaacacgtatggcattcccacaatgaggagtactcggacaccacttcaccattttgttatcttcgatatacgactcaagaagaaaacgatcaaacttctcagctaaatctggttggcttttactaactagagccctgacaacatcttcatcacaaatagcattacacttatgagccatgcatataatccttttgctctgaccttcatttatctttacagtaaaatgcccagtccaacctaaaacaacaaaaccatattaactaaacaacttcatttcaggatatcattaagaaaaggatgagactcacagttattgcaaaagctatggccacagtccatccttgtcagctgataacccggtacatcctctacgcagatatcacaactcatcatcgaagaagaaccagaaacggaagaatcacaactttggttttcaagaagtgtaacaccagcaccagaaaacaagctatctttccctttctcaacaagaacagcaaacaacttctccacatcccatcggtaatgtataagaagagtccgagcatggtgctccttaaccgataacaattccatcactctccgcaaatcctccctctacattgattcaaaaacagtttagccttcaaaattgaaactccacagtatatatggatcaaaagaagagtcattgctctttcactaacctgtgcagccaaaagtgattccttcgtaataacctacaaaatgcagattcacattcatgcaaacatcaaacgcttttattctaattgaaccaatgccactactcttctaatcctcttcacagcattacagagatgaaatttcacagtataacacaaaaccctaattttaactagagaacaacagagatcacagaactgatttttcaaatcaacatttcaactaagtgattcaatttcacgaattcgttacaaaattaacaaaatccgaaaaagaatcgagagaaatttagctcaaaaaccttgacagtatttgatcgggaagaaacaggtatcgaaacggattcatcattatcaatcccgttgagagattcctgatcggaggagtaatagtaatcttcttcctcgccgcttaaattatcatccatggatcaatttttaaactgatcagaatgaaattgtcgacaaatgatatgattgacggaagagagtattatagaacgacggaggtgataaagtacgagagtaataacgaaggaagagaacgatgacggagattttgagacatgaaggatgtgggatgatatttgccggcgagatcaaaagaggagtgttaaaaggactgaatcaaccggaggagaagagaaagaggacatcgttatttacggaccaaacggcaccgttttatatgaaatcactttttttatttgagtatctaaacagtttttttttttttttttttttttttgtcatcagcatcttattgatttataaatcagcagtgtagtcacaatgtacagcatatgttattacattaggaacccagaaatgattcaagaataaagattggttttgaagagtacctttagcaaaaatatcagctggagtattgtgatgtcttcttatccaattgaaatggattgattcaaacttccttgaccaccaatgaatgtcccgtatccagttgtgaacgccaaaatgtaccttggatccgttaattaggtcaaacagcatgttgttatcttcttcaaagcaaacccgtttgtaaccatgactccaacagtgctgcattgaaatgattagcgcttgaatttcactctccagagcattgtccacctttcttcctatagcctgccccgccagtagataacttccattactatcccgaacaacccaacctgctttactttctacatcaccattaacgaatgagccatcaaagttgcatttgatccatcctcttcaggtcgtctccatctgtcatggttatcctcctctctcacccctctgctacgtgtatttatttgtgctactgtattcgcctcggtatactc

SEQ ID NO: 13858 - DNA, 3000 bp, Unknown; identical to SEQ ID NO: 13854
  misc_feature (1)..( 3000): cDNA_ID_1450859_gDNA_ID_2214659_Annot_ID_188846 3000 nt of promoter + ATG

SEQ ID NO: 13859 - DNA, 3000 bp, Unknown
  misc_feature (1)..( 3000): cDNA_ID_3032341_gDNA_ID_2214659_Annot_ID_188844 3000 nt of promoter + ATG
gatcgcttatcgtatactactcaccattccggtttcagttgctttggcggagagaactttttcaaaattaaagctcataaaaaaatatctacgttcgactatgtctcaagagcgattgaatggtttggcgctgatatctgtataacaagaactggttgagaagctcgattaccaaaaattgatgaatgaatttgcaggagcgaaagctaggaggattatgtttcgccaggaagaaaactgagatttctatttattttttttcttgttaacaatttttatgttcaattttcttaaacaaaataaatttcatattattttattttgcgaaaaaaatatatttgggcatcaattttgaatttgctttaagcatcaaatatcctcggaccggcactaaatctagggttaccattctgcttcttcttccatcttttcttctgctttcccatgatttaatttcctttgaaaattttccaatggaaacaatgtcctattctttccgctgcacgctgcattttatagattttttttagattcacccgtataactatgattaaataactctttatacaaacaatctcgacttggcccagtggtctaagtctctctcttttaccctacgcgcctactagcgcctggtttgaccttttacatctacatctttttctctctttttttttcccttcatttaaaccagatcgaaccagtttcgattcggttaaattatcgaaatagtcaattacaacatcacaatatcgactttttctactggttcacttggtatttttaaacgacacttatatgtaagatcattgtttctattattgttatacgaaccaatctaaatatgatttaattagctacccaatcaaacccctttctttcttaaaaacatgttattttgttataatctggataagtatggatcctaccaaaaaatctggataagtatggatgtaattatccatcactcatctatatccataagatatggataatgcgtatctctatccattattttctccctaagtctattatttcctcgctaagtctattacttctttgttaagtctattacttcttagtaagtctattactttttcgttaagtctattactttattgtaagaagtacagagaagagaagagaatgagtaagcaataagaaaactctcgtttcggtctttactctttttagttttcattcttctttaaatattttataacaggttatcagtaagagcgtctctccgggtgattgtctaaccgaccgatcgtctatttgttcaagcatcttttgaggtaatatttgaattatgttaaattcattttaattcattgcggcggacccataaatactttttaccgaattaaactacaacttaaaagaattagtaatttaaaaaaattaaattactaaataaaattatttccttaaaaaagaccacaaagtaggttaaatatttatgggtgaatcaaacaaaaaggctaaaacatgtcaaaaatagtatcaaaacacaaagtagaagaaaaatatgatcaaatttaaagggtttcgatacaaatttctaatttcaagggggtcaacagagaagaaatataaataatattttaaatatttaaagggctgtaatacgaatttagaattttccagggcatctcatcccttcccatctatactctttaccgtgtcaaaataaaacttaaaataattaataactaaaacttttaaaaaatctttatttactgaaaattaccacaaattaggttcaaactttattggtgaaacaaacaaaaacaaatacaaagagtaaaaacatataagaaatagtgttaaaacacaaagtagaagaaaaatatgataaaaacttatagcgtttacatgcaaatatgtaattttaaggagattagaaccgaaaaatataattaatatcataactattaaagggatataatgtaaatgtagaattttagtgtggttttcccctttaatcatctttgggtctgcccatacatatttcttatcctgaaatttgaaatagacatgcgcgattttcttaacaacttataaacaaatatgttcttatacatttttcttacacaacttttaggatatttatcttaggattttatttatttattttacgtttaaagattacaaataatttttagacgttaccgccacaaaaaacttatccacaaaatattttacgttattttattttacgattaaagataacaaaaacttatcggtttattaataattgtcttgtggatcgtcgtataccgtaatttgataacaattctaaactataaattataaatattctataaatagatacaatttggaaaatttaatatatattaactttaaaaaatagtgttaaaaatctagttttaaggttaatagttgagttatgttctaaatctttccaagtttatatatttttgtactttaatgtttactcatcaaaaataaattaacaaaaactcttatttcaaaagcaaagtcaatagtacaaaatatcaagttttttcagaaaaaaaagtgaattagcgtattgaattttaaaaagtgaaggtttttatatgagagatgatttttttttctataattaccataaatatctgatccttaactatgtcagcagaggatatacatttgttttttgttacaaaagagttgggttctaacttcaaaagagtgaaggtttcaaacagttaaaaaaaaacatttactgttaatatttataatttcatcaataatgggcagaaagttttataccaattaatattctacattcttattctcttatggactttcttacatttgcagcaacttaaagattccacttgataaactcccatctttctttttggatgctccaagtcacttgattaaagcttctccagaatctcctctataaattatgattcataccaaactcttgtagacaaaaccgattttcaaaaaaacaaaacataaaaatattttttaaaaaca

SEQ ID NO: 13860 - DNA, 3000 bp, Unknown
  misc_feature (1)..( 3000): cDNA_ID_2704369_gDNA_ID_2214659_Annot_ID_136530 3000 nt of promoter + ATG
aagtgtttaatgttgattgatgatttgtaagttttgtactttaaaatattttgtttagatatttttggtagagattaaaaactaaatagtatttacataaatgattttttacaaaagtttcaccaaaaatgtataagtagatatgtttattaggttattttcagaataggcccatccaataattatctttgggtctctagtccaattacaccaaccaaacctggaaccaaaccaaaatcaacctaagatcaaacccaatctaaactagcagataaccgatctaaacccggagacacataactcctaagattctatcacaaaatctaatcaaagctgccttccactgtgtcgtggaaactcgcttgaataagaccaccggtgagtcaggaagacgggagtcgaacagagaaggcggcgcagggtcatcgccatcccaccaccgtagagttgtgaaaagaaggaagaagaaaccgatatacaacgtcgagaaaccaagctccttcgtgtgacccgttttttttttcataattgttgtaaataaaaatggataataatgactcatgtttggataaatttacgaaagatttgaaaataaaaagtattattcatagatatcttataacaataataataaacaaataaaaactcagttatcaaaactatactacatatttgacaaaatcaattaaatctttaatgtggattacgttgaaagctgtacaaatccttacaaacccgtttatttacaaaaataataattaaatatacatatctcgttaacaaacaagtctatatataccaccattgtagtcattcttcatcatcactttacacctcatgagtgacgacgaagatctcgatttgtctttaaggttatatacacaaccaaaaaaaaccgttaatgagaaaaacgggttggttcctcaaagacaagaggaacaaggcgaggtcatgcaactcttgacatcagatcctccacaaaatacccaaccctctcctcctcaaccaaatgacatgacttcttttgccaacggaacaaaccatgtgattgttcccacgcaggctcttgagcaagctgtaccgcccccaaacgtctcagtgaggaccccattgccttatcaaccttcagaagaagtccttccccctcctcaactgaaccaggttgccaccgtggccttggcaactccccgcagaggtcgtccaccaggaggacaagcacgtcgtaactcaaaaagaccggtggctggggttgaaagaaacgtaggtgacagggagatcgtaccaccgtatccatgggccaccaaaaagccaggcaaaatccagtctttcagagacttgtcttccaacaatataaacgtcatctctggacaagtccactgcaaaacttgcgataggaccgacacggttgaatataatctggaggagaaattttcggaattgtatggatacattaaggtgaacaaggaggagatgcgccatcgagccccgggtagttggtcaaccccgaaactgattccgtgtaggacatgcaagagtgagatgaagcctgtgatgtccgagaggaaggaagaaattaactggttgtttcttctgttagggcaaatgttgggatgctgtactttggaccaactaaggtacttttgtcagttgaattctaaacatcgaaccggttctaaggatcgtgttgtctacataacttatcttagtctatgcaaacagctcgaccccgaaggaccatttaacctgtgacttataagaagatcagatcgtatctttagcgtttgcttttggtttgcatcgtaagtttatttttttttatttttttgcatcgtgtttctctttagggttttgaggatgacgattacttttattgataatttgcgcttttgtattattatttcttgtgataattactctggtaatcaatacgaaaaatactttatttaaattaaggatatatactcatagaaaccataaaatgaaagcaaaagttgaagggaaaaaaggggtcctgaataaaacttttgtagattcttaattcgtttgttaagtcaagatcatatcttttcgttatttttcttatatggaagactcatcaacttgagcctacaagatctacactatcattaatattctttttttttgttgtgaggaatagataaacacatatgagtgtatatagcgttaataatcatttttgtgatgaatggataaacatatgagaaaatcttattaatttaatgagaaaaatgaaaatgtcatgcctttagttttaatttttgttttaactttacgattatcattttctttttcttcttacatatcttttcttatgtcatattgtattatttaaattcgagtgaactttttgaattataaacttgacaaactttcgagaatatatatgcaaagcatcttaacagtgtatgagagatgacagcaatttttccttattcgaactcacaatccattgaaatgataaatgtacttaattaaccactctgcgaatttgtactatcgaccaattaaccacataaatattaaagtaattttcacgttggacacctgactttttctttcacaaaaaggcaaagtgggctgggtcaaccacattttagccattagaactaaaatggccgaatttgctctggaacgaaaaactgacggaggcggtttagtttcgtggagccggttcagtttccttaaccgttttctggtttcaaaataatttaaatatttaaaattattaattttaaaacttaaaataaataaaaaaaactgtcttcttcgagaaagcagaacagttccgacgaaacgaagaatgatttcgaagaaccagagaaattccgacgaaactgaaacacaattccgattgaggctctgttcgagttcgagtcattgctaaagtggagaaaatttcgatagggttcgtgttaaagtgtggaacaataatacgatttttgggtttatcgattaactgttcagagaagagctctaatg

SEQ ID NO: 13861 - DNA, 3000 bp, Unknown
  misc_feature (1)..( 3000): cDNA_ID_3032436_gDNA_ID_2214661_Annot_ID_188877 3000 nt of promoter + ATG
atcaccttatttgtttatcatatgtagtgaaatactctttggattatgcaacaaagctcaggctaatggcagcttacctggaataagggtctctaaaggcagtcctcgagttaatcacctcctctttgtagatgacactatgttcttctgcctctctgacccgaaaagctgtaggaagttacagcagattctacaaaagtatgaacaagcttctggtcagaaaataaaccaagagaagtcctccattactttctcctcaaaaactaaaactaaagttaaagtgcaagcaaagaatatcctatcttttcaaaaggaaggaggacaagacaaatatttgggtttacctaagctttttggaaagaagaagatggatcttttcagccaaatagttgataaagcaaaaagccctgagttggtcttcaagattcctctcaactgcgggtaaacacacaatgctgaaatcagttttatttgctatgcctacatatattatgactttcttccatcttcatagctccctctataaacgcatacagtcagcccttacccgtttttggttggatggaaatacagaaaaaaaagaaaatgagttggatttcttggaagaaaatgacaaaatcttttaggactgttggtcttggtttcagagatatcagtaccttcaataaggccctcctagcaaagatcagctggcgtctactcactaaaccctctagcctcatagcaaaggtattggtagggaaatactgcaagttttctactctacttaattgctctgtaccaaacactccttcacatgtttggctaagtatttgcttaggacgtgacctgctgaaagctcagttgggcaaattaattggttcgggagaaaccacccatatttggagaaccccatggctatctttagtttcaccactctccccaatgccaccccccccccacggaggctactcaacatatgcgagttgctgatctcttgctctcggattcctgtgattagaacaaaaaccttattagacgtatccttctatcttatgaaatagaaattttaactcttagaccaagctagttgggagcagcagatttattggcttggttaccaacaaaagatggcatatacacagcaaaatcagggtattatgaggcttattcggatacttaccccatcgttgagatcacgcctgcccccacagatgatgaatttgattgaaagactcatatttggtccctcaaaagctcaccaaaaactaaacttcttctttggaaagctggccaaaattctcttccagttggtttaaacctcctccatcgacaggttaatgactctatcaagtatcctcattgtggactagaggaatcagtggtccacatgttcttttcctgtccttttgcgtcaagactgtggaatttggctcttttcaaatcacaactcaacataaccaacagtagatctatgcaagaggaaataaagagcttcaagaaactcatatgtctccctcccacgggtattggagatggaactctcgcaccatggctattctagaccatctggacctctaggaatcacctaattttcagcaaaaaaacagatcactgtcgaagaagctcttcaaattgcaatctcacgagctaaaagagtggcaagcagctcaattgcaaaaaccacaagtgcataagcttcgactacctgttgttttaccctctgctcccacattagctgtgacttgcttctcagacgcatcatggaaagacgatggtaacgctggatttggttggtttctaaggatccacacgatattaccctcttggaaggatcagcctcaacctcctccgtcggatcacctttgatagccgaagtcatggcaactctcgccgacgttagagttgcggtcgaatcggcccaacaaaacctcttcttcgcttcagactcgatgattctagtcaaagctctcaatctgaagatccatcagaaggaacttcatggaattctacacgatatcctgcatctatcctctaattttattgtctgcacctttaattacattcttagggcacttaatcgacaagcggatctcttggcaaagaacgctctgttttctattatgtaatatctttctaattaataataattagatattttgatcaaaaaaaaaaactctttcaagcgagtctgaaattaagcaagcatatttcacctataaaattttctaaagttttaaaaaacgtaaaatagacaataaataaaattaaaaacaactaacgacagacataaatttttatagacttccaatttggaaaaatggatccaagatgaacatgtgtaaattctcacagtttacttggaaatattattatcaaaagagtgctaaaacgtttcaaatgatatttacaatatacatacatatatgtccaatggcaaatctagattttttttttgccaggggcaaaatattatatcgacttttaaagataaaaataatttattatgtactttttaatattgttactttattattgttatttatatttctaaataggttagagatgatattatatgtcgtaagttattaaaataaattaattctgggaaaatatattagttagagaatatgtataacttttcgaataacaaaaaacaaaaattttagaaataaaccaataaaatgcaacaataaaaagattttgagagaaaactaaataaataaataaagaaaaaacaaatctaaacaaattggaaattatataaaatctggaaatgagacgtttatattagaggaaaaataaacaataaaagctaaaatttagggaagttaataaaaaaaaaggaaagaaaagaataaatgaaaaaaattaaaagggcattatgggatttgattttgagtttatagggggaaagttggttcaaatttccatttaagctaacaaatctttattaaaatcaatgaaaatctagaaatttgataatttacccggggcagctgctcctcttttccctacatg

SEQ ID NO: 13862 - DNA, 3000 bp, Unknown
  misc_feature (1)..( 3000): cDNA_ID_1808564_gDNA_ID_2214662_Annot_ID_136534 3000 nt of promoter + ATG
aaaccaaaccgaatatagattgacccaaactcaaaccaaaccatactaagagtgcctctaatgtagggttgtaatgcaatttttcagaggttctcttgatattttggatcaaaaataaatcaaaatagaattaaaatgatagaggcgttggagataggcgacacgtatctaaattgtattggttgtgcatggataattttttttgtctcttaaaaggttttgaaaatatatgattattagtgacataatatttagtctgtgatcgactatattgacataaaaacgacataattgtcatccttttcactatgttttgtatttataattattgaatgctttaaatatttggagcagtcacctagcaaagttattgaatgggttcgttcagtggtacataaatgataaaaattctcaaaggagaatcatctttatttgcatcatatcaagaagtaatttgtaaagatgtcgagcgtgcatttggagtattgcaagtttggtttcacattattagaaacctaactcttatttgggataaagaaaaaaataggaaatattatgtgagcatgtatcatgctgcacaatgtaattgttgaagacaaacgagatagatacactctgtttgatgttgagaaattcaagttgaagcaaaccaaacttcaaaagtcgatttatcgtattctacatgtatgcctacaaatctcagagattttatgagcattcaaaatcaagtttgtgattgagagatacatctacaattgaaaggtgatttggtgaaatctatatgaaaagaaatgcataacaatcaacagaataactgatcgtttttgtttttttttgttttacatctattttaaaacatttcaaaataatatatttttaatattttatgctttaataattattaagttttataaaataaaataattttatattaaatttttttcttcagagaactactctaagagatcctaccatttaagtatgaaaaataaaaaacaaaaaaaaaacacaaagctctttggttaatttttctgaaatttaattatagaaaaatggagagaacccttagagaggctctcttctttggaggtgctctaatttcggttgagtttagttaaagttttacaaacccaaataaacagaaccgaaccgaaataaaagaaatgccaacccctattctgtaatgaaattacattctacaatttattgacctctcaactacatttactaatcttatcatttaatgcatgctataaataaatagctttatcttgtggtacgtctttctttttatgcatctccttcaaaggttcattttctttcattctgagtttgttccatcggtacttccttatactttctcgtttcattttcgagatttttttgtttttagtgtccttacaagtaacatcatactttgattactaatagtttcatgattcatcattgttgttcatcatctaatgctctcatttcctcacgcagctccaactttcaaacacaagtgcttttgtcttaagaccttttctcttcgggttcgtgagttaaggtaacaacattactgatgattttggtacaattaataaatttccctaagatttttttaggatattataagcttaatttttaatttgtatagctgatgaacaataaatcacatttattgtagccccatgaagcatgtctcaattgacttttcttgctgcgtttataccattagataatagatagcgataagaaaattaaatggccaagaagcattgaataactaccacgttttaaaatggtatgtacattaggtaggcacgcaaactaatgttactacacaatagtccatttttatttgtttagatatgtaaaaatcgtgtcccaaatttcttctattattttgtcgtatagaagaaagaaacctttcacgggatatgattggttggactttaaaatttttttaaagtcattaaaaaaactataacctcaaaattgaaacaattatgatatagcttttctattttttctcacagcctaaataatatttttttaattattttggctgtaagtacaagttattctaaagcacaagtttatggttctttttttcttttcattttatttttatttttgtaaaaacattactataattttcatatatatatatatatatattaaatttagttttatggatataaatagtagataaatatctactttatgacatatatatatataactcacattgtttttaatatatatatatatatatatatatatattaattaaattgatatttgtgaataatattatataacacataaatacattttacaaataatattttttttgtttaaaaatacatacaaccaaaatcttatttctacaaccaatttctttaagtaataatattatattaataaaatctacaatctaatttctaaatcaataaaacctacagctacaaccatcacacctacaacaaaaaatatacaaaaataaatttacagttacagacgaaccaatcacccacatagcttccatttttaaggtatatagtcgtctagattactatcacaacaatttaaaaaatctagctttttttgtttttgatgtaaagaaatctttattatatattatagactaaaaacgcttttttaacacatgtacgaatccaatttcttatttttggaaactagtgttaactatttatctcttcaaaacagctagaatttttggttttatgttttagtgatgcagaattacaacgcaatgttaggtatatattaattactaaaacaatgtcttgatgcataaaacgttggaaatgttatttttaggcacatataggtttgttaaaattagttagctgttttttgttgtactattaattttttttagtatgtgtaaagctttataattgacctcaattttcatctttctttcaatttgcagggttcttcttcttcttcttcttttttctctaaactggaaaataaagaagaaaagaac

SEQ ID NO: 13863 - DNA, 3000 bp, Unknown
  misc_feature (1)..( 3000): cDNA_ID_1813111_gDNA_ID_2214662_Annot_ID_188915 3000 nt of promoter + ATG
atctcataatccttcgtttttcacaaagagtcctcggtactaaaaaaatgaactttatattgtacggacaacatagaagaagaataagctgaaattagttacctttttttctctgacaaaatgaactttataaacaatacataattcatctctcttaaatttccaaaatctaagagatccgttttattctaaactttgatttataatttaagagatttaaagtttgatcaatttttttttgttgcgtctaaaaatctctaaacatcgaaggatggagactgaattgtggtccgttaaaaattggtatttgtaaacaagaaaacaacattacgtaaattgtaattcataaatttgcgtgctttgtgcttgtctacctccacaccggcttacgatgaaccacactctttttaatattcaagacttctatataatcattatatcgtatattcatatatatatatatatatatattatataaataaatattcttttctgttttctgtgttactaacttttattatatagagagagatattcaattatacccaatacaagcctatataattatcaaaattaagtggttttttatttaccaatttgaattctctagatatcttacatacgaggatgtgcttttagtcaaatggacttaaccatttgattccgccttctccaccggaattcgatttcactaagttgcgttatcccgcaatcccgcatagtagggattgagtattgatcgggtcttgtcgatacaaagatgtaaaaaaaaaaattttacatagtcttttttttctgttcttattcttttttttgggggtaaatatctgttattgaacattataattcaaacacttccaaaactttttttaccttgttctgatattgatgcagcgtatcttgaagacaaatgctcctccggtattcatcacgtccgaggagattgtttattgctttacttttgggtttagtttcatatggacttaattaatgtatatttgggctttgaatatttgatattagtttgcttattctttaggctagggtttccattctttttctcttattttaagagatgtaattcattattgtaattagtttttgattattgaataaacgagttttaagagagcttgtctaaagcctagagaggaggactctcaaccctaaaagcttgtgttcaagccctgcaaggaggatttgcaaaacctcatcgatatcgttatcgatctcgaccttatctctattgcttcttcatcaagtttcggcgttctaaacaaaatccgttcgttaatccgagttctcatagagattttgtgttttcgtccgttatttagcttccgctctccatcagatattacttttgttcagtagaccattcataaatacctgccttggatccaaaaataggacaaataaacatcatttgcatcattttattattcttaaaagaaattgcaaatttttgaccaaattgcaaatattttgtttttaggttatacccaatacccacatactgtattatagtcgtaataaaaaaaggaaaagttgcaaaataagtagaggacagtgagaagttggtaactatatatgttttggttaatttagttatgggtatggagtctataacgtatggtttcgatatttccaataattagcaatcgtgtatcttcgttagcatcaacattgttgtattttatttagtgcacaccttctcataatttctaaatcaataaaattttaatatcattttatcttggtatatgtcactatgtatgtggttatttttatgcttccatgtttttattttttttgccatggaaccattagcttaggttgaaaatcatcgattgtaaacctatcatgttttcatttttatgaaatattaggtgatcatccgcgctacaccacggttttttcggatgtttttgtattgtttaatttaaatataatttttatttatcttatcatttactcatgcaataagcaattacatttagtattaaaatatttttttctaaccacattctcaacaatgcatcatacacataatttctaaacaatgtttatcttaaaccaatttaacagagggtagtgttggattctataaacctaagaatttaatgatggagctccttacatattcttcaccctcagttatttattatataaatatcaatttaagagaatataaacatcaatttaagagaatataaacatcaatttaagagaataacttagttaaattattaagtaatatactcatactttgagtttggattaccataaaaatcttcgagtatgagaaaactattaaaatgattttattaaaaaatcatgtgatattaaaataaatttagtaaaagtacaattaaatatgtataataaaataatatgtaaaattaaatataaatatatcattaaactatagatttgaaattgaagagattacattaattatttaataaacacatgtcaaatgctaaagtgatgatgtgtctatcatatgaagagagttggccaactttcatatatataatttacgaaaaaaaaaaaaaaaaacaaatattcaagatctctttcttgatatgggccaatttgatacgaaacattttccagccataacctttcgttttactttatacgggctataggcccattatgggttaacgtgtaggcccaataaggtgttttttcaatttggtttgcatttggtgtgtgtgtgtgtgtcagctacaatttctcaaggagaggcgcgtgtaaatcaaacggataatcctacggttttgatgaaatggcttctcgtagacctcacaatctctaaacatctcttctctttatacgctcttcttctagaaacctctcttacctcactctccttaaacctttaatagggtttttaggttactctttgttcaactactacaaactcttttctctttagagattgagagattgtaaaaaaatctcaaatcttttccttcacaactttcaaatcta

SEQ ID NO: 13864 - DNA, 3000 bp, Unknown
  misc_feature (1)..( 3000): cDNA_ID_3032467_gDNA_ID_2214662_Annot_ID_188913 3000 nt of promoter + ATG
catgtgaaatcaattgcttacccattaacagaccaaatgaagcctaaatctatacttaaacttctaatgtaggtgctaaaacacaataacccaaatctaattggattgaatctcaaaatcctcaaaatatgtaattcaaagcttttgaagctctctccatacctggacttagtagattgatgcagcttgcaggaggagaaaaacgacaatgcggctcgccggaggaagaagcccgaagaagaacgagctcgagctttttctttttctttttccgtttttttttttcaaaatgtttagaaatacaggggtaaattcgtcttaacacaattccttaacacaaaggggatatgaagactctaaagtggttttgcagattagttgtcccacaaaagggacacaagagatgatcattcgattataagagggaggaaggaagaagacgaaggagatgtatatttatttttaattcttttcatcgtttttaaataattatttaaattagattatattattaatattaaataataacattgtatttattttgggttgtgataatcaggttttaattcggtttagtctattgggttttggtttgacatgggtttggcacagtaaatcaaagataaaccgtgaaactcaaatttatggggacctaggattcgaactttcgatttagggagaaattggactttaacttccattttgtggagactgagatagaggttcgaattctgtgtagttatggtgttatatgaaactttgtagggagacacaagtcgtttacccaaataaaaacaattaaaaattacacaaaaatattacgaggatacgcatacccgttaatgtcttctaataaaatcagcaaaacaaactctatgttcaatgcaaagcctcctcgcaaattcccgtccccatctcgtagcactcctcccgccgatgcaagtcatggattacccttagaaacactgtccgtattaagtttagtccagcccacataaggtggagaccgtgcaatcaaccttgttacccacgcaggtttgatcacccttcccatcattacgaagctccattatgtggtaacctacatctttaaggatattcatgaaactcttcgattgaggaataacggcattatgacccgtcttcaaagagcagtggttaccgaaactttctctttcattctctccaaccacatccgactatagttccgtagtcacccttctccttgttgatgagcaaattcaagtagctcttctcgtgccagcgagtatctcggccatggaacctcatcaacgtcacttaatctattgactatgactattgtatcgtctaccgctttacccgtggatgatgtgtcgacaaaccgtgttatcacttgtgccaattagcttcttagagttggcttccaagctttcatggatcctttctcgatttcttctagctatccttttgtagcttttgcttgtcccttgttcttatgttgtttctgccttgttcctagccttataacccttgcatttgtggtagttctggttcttcttatattatgatgaatgaaacaagtattttgacccagaaattttctttcataaaccgtttttattaatatgaattatatttggttatcctaaattatttttggttatattaaaattaacgcgacttgattatatatttgtatgttatatttaaatatggttatattaagtatgttaaacatgaaacttgatgagtatatattaatatcacccataaatttgcaatttgtaccccaaggtggtgcatatatcaaatacttttgattatctttaaactgcacaaactttttcgatttccagactaatacaccaattaataggctattatatgcctcaaaccgaccattttcatggtgcctccaacgttcacatttggataaatcggaaagaaatagaaaaccagaccataaattttagtcaaaccaaaaattagaaaattggcaattgataccagacaaaaaaagatatgttacctctgtgtctaacgctatattctctcctttgttatttatctacttggattgtaaatttggctcctagttctatatatgaaggaacatatccaaggtatgtgttatttgttaacttaatcattcactagttgtttcgtatccaaaacaagagttgttgaaatcttcagacacactaactattcggctccgggttctatcaagatccaaagtatgtggtataaactctgtcattccacactaattatttaatgctataaatagctttgatcttctccatatttctttatttaaagatttggcttttttacctttgctttcacttctattcattgtcttcctctgttccattggtaacttccttgttctttcatctaagtgttcttttatcatagttcttttactgacactttatacttatctagtgctctcatttccttacgcagctccaaattcaaacacaagtgattttgtcttagactgtctcatgcgataaggtaacactactatatattttggtgtatttcatagattgccataagattatatattttaggattaaaagcttaacaatatttgatagaagtacgtgggaattagaatttcaatatccttacgtagattcgtttaaagaataactaattctaggcttttgcatggtgtatttttatttttagtgtgtttgactgtttgttattttgtaaatcaattataataaccaactttggattcagtgttggagctagttatcttcgatgcataattttgttttaaactttctcttaaatttttcaaagtttttaattttcttttcaattaccgaagcacaagttgtaaaaaaagtttatatttttttttctgaatataatttaactttatattaaaaaaaaaaatgattataattaacttttcgccatcatgattttttttcgcagggtttatttcttttgaactctttgctcttaaaccggtggaaaaaaaaatataaagaa

SEQ ID NO: 13865 - DNA, 3000 bp, Unknown; identical to SEQ ID NO: 13862
  misc_feature (1)..( 3000): cDNA_ID_1808564_gDNA_ID_2214662_Annot_ID_188909 3000 nt of promoter + ATG

SEQ ID NO: 13866 - DNA, 3000 bp, Unknown
  misc_feature (1)..( 3000): cDNA_ID_3032493_gDNA_ID_2214662_Annot_ID_188903 3000 nt of promoter + ATG
aatatggtcaaagtttctttttttcgggtactcaggttggtaatacataaacatgtgaattaattaaggccaaagtatgtgggctaaccggagtagcattgaaaacattagaaatagacttaaatatatacattcaaaccaatttatttagatctttcagattaaatcctagttaaaggatttttggagattagtttggctgggtttggaccggcacataaaatatttcaaaagtaaatatatatctatagacttgattgaatggatttatgtataataatattataaataaatttttaaaagctttctatatgatattatatatgatttttacattttacaattcaacaaaatttaaatttaaattttatatttatttatctaccataaagggtttagattgaagtgggaaaatggcttctttttttaccccaacaatttgtttttttttttgtctacacaaattcttcattaaacttaaatgatttcaaaagaaagagtcgcaaacggacccatccgaagtacgaaagcaaacgccaagcaaataatacataagcagaagataaaagataggcaagaacaatcctaacactcaagcaatcaacatcgctgcagattccatgaaccttgataacattagaaacaagaaatggaaagacgccttgtggaacaaagagcacacatagtgatctatcgttcgagcttgaaactacaactagggcagagaaagcaatcttgaaatcggttactgaaacaaaggcaacaaaacaccaaattgctgaacctttgaaaagaacatagaaaaaagcctctgtaaaccatccttcacaaacaggggttgaacttgcaacaccgatgcaatgacataaaagctaaaactttaaggaaggtggtgacgatggaagagttctctcctgcaaagaggaagacggtggaaacgatctctcatggcctcgacataaggaattttaataacaaggcagtggagatgaactagacttgtagatggttgatgatgataacgttctctcttggtcccaacaagcaatatgttgaggagtaattggaggctaataggagaatcagaagatggtttataccatatcaacaaaaatggggtttaaggaaaaccaagatcaatgacatctctttctatataagagtttcgatcaattcgaaggttttgtgatgtaacggatggatcgctgcctatgatttccgtatgcgttaccagtatttcatctgtaaaaagaagatgattcccaagcaagaaagtcacaccaaattgacggaaattatgaagacgattaagtacttgactaagaaagcggagcgtaataaactttatcgtttcttcgttacataaaccattggttatatctgtaatctcgttgataattttgtatacactgatttatataaatgaagtatttttagatgaaaaaaagaaaattatgcatgagatatttaacaatcatacgcaaactgattgacgagtatctacgacagaccaagcttaaaaagaaatacagctaaaaaatacaaatgaagtacaacaaatatgaccagagatgaaaacatcgtcccgtttatatagttttaagaattatttttgttcaacacttctttttgttgttaacgtatatttttgagatatgactgtattttttgaagcgatatgttttgtatgttgtgcaaaatgatatactcattaaggaatactatgcatcactgcatcaagtgttttaaaaagaatattgattactttgtctctttcaatatttcgttttcaccattaggccctaccttccctccctcttttgtcgccacattatcaagatttaataacacccatttttatacaggtaaattagtaaatgtatatcacagttaagtatttcgttttagactttcagtagatatctttagtgtattacacaatcaatcatgacgatcaaatttagatgttttcctaaacgactacgatttgttttgcactttgaaacatgatcaaataggtatgaagttacagtatatagtagatcaaatataagtcttaattaagttttgttgaaaaatttagctttaaattcagtgtttaatggttttggaaaagtttaatttaattatatcgtcaatcaaataaaatgatatattagtgagaagaacaattttcttaatcttgtagtacgtaactttaacattaatactaacttgcaaatttaccatatttgctaattattaacctattcaaacaaaaggaaaatatggtattcagagaaataaagctccaccaaataatagaagatagactgtccgcagatttctattttcgaaatgttccaaaatcatgaaaagaatgaatatttctatttatagttcatgtattaaaatagaagaacttcacaaaattcgaaaatatttttgttatgtcgttaaagtgaacaaggacctattctctgtcttcttggcatggtcttcttctttagtcaactcagaaaaacaaaaacaaaaaaactcataagtcataacaaggagatgaaacgttgatttttacagaagatttaattattttcgatttgcatatgtaaacaaaatcatttcgtttcttttgtaaataagcattatagttttagcgtatgaaaaaataaacagtatagtctgtactaaaatctacacccacagttactttgccctaaaaggactgaaaaaaccaaaactggtaagagagagagagagagtgagagagatggtgaaatggagaaaaaacaacaaaactaacaagcccattgacatcgcagcgactcctttcagttttataagaagacaagattaaacaaagatgatcttactctttagcgataaaggcgactaacctagacagtttcttctaacggctcttactcttcatcctctgctcagctctgccgcaaacttctctccgacgactccttttgttatttctcgtcgccaaaagtgatcgccggtgactctactatg

SEQ ID NO: 13867 - DNA, 3000 bp, Unknown; identical to SEQ ID NO: 13864
  misc_feature (1)..( 3000): cDNA_ID_2704401_gDNA_ID_2214662_Annot_ID_136536 3000 nt of promoter + ATG

SEQ ID NO: 13868 - DNA, 3000 bp, Unknown; identical to SEQ ID NO: 13863
  misc_feature (1)..( 3000): cDNA_ID_1813111_gDNA_ID_2214662_Annot_ID_136537 3000 nt of promoter + ATG

SEQ ID NO: 13869 - DNA, 3000 bp, Unknown
  misc_feature (1)..( 3000): cDNA_ID_2705709_gDNA_ID_2214663_Annot_ID_136538 3000 nt of promoter + ATG
aaatatcaaagagttcttttactctcacttatgacacgctaaattaaaaccactaaaaaccataatattaatttcacggctacaagttgatgcttcctcaaacttactacgttccaatgccgggcactgattaaatatggacttcacatctttttttttttttttagatattcatttccaaacggtctattgacagatgggctaagaatttcacgggttacaaaaaagtggtccaaatcggaacataatagaaacaagatcagtaaaacgacggttcaccggccggagacgcagccttcaccttctatatccgatgcaaatttaacatatttcgaacgaatctatgagatctatatgagaattttgcttcttgggttttatacggttcgggaaagtggatgtatcaagttgtgacaagaagcatcaaagaatatgactttgtccagtcatttttatggtatagtgatgatcgtcaatgatcataattggctaggaagaaagagcacatgtgcattcatatgattatcataattgtgcatatcatatgcttttatgggcatagttgtcgatagaaacaaaacatgcgtcgaggaaaaaacaaaagaatagttaaaacttagaatctttgattctcatgagccatgaggccatgtgctttttctctcccacgttatatgttttaccatccttataatttgctcccccgacttctctcactttcagacgaaaagaactgctgtcgcgatttttgaacaattatggaaaataatttagatgtgaaggaagccgtaaaaatagttattatactttttgtccatatatatagaattcgtgatgattatgttgtggatgacaattggtggtagatagaaacctttactatcgccattgttatgggctaattaatcaagtttggtaacaaatcaacataataggaccaataacaacaactactgcagatcttactattattctttttattaattcatcagtatattttattattttttcttgattgtttatccgattgatcttgtaagagataacttttgattattacataacttacttcaacatgttaaatgacacaataaaatagacaatttatttttgatatccttttgaaaaatattaaataaatatttgtaatgactgtgttgcactaaaaaatcgagataaccccatgagtgataatttggtaacataatctaaacttagagacaattaactaattaagttattatctgagaaataaattagacaatatttttattcgtgtgtgtaatttttgtggtataatattttttcttatattgtttcaattctacggatgttttggataaaaaggttaatcaaatttataaaatgtaaaattttgcttgaacaaatgaaccaaaatgtttactaattggctaattgctggaaaaaaacagttatataatttttgttaacaaaaaaaatgtttgatgtaaataattaattcacagctaaaagtcaatttcctcatttatttttgattaaagaaagtaataaaaaacaattaagtataccattcgctgtacaagagtcgtttagttctgtcggctcgacaaccgactcaagccggctcgagtcgctaagtgaatccactcgctgtctgtcggtggacaaagccggctccaatctgatcactctctctcaccagcacacacacagctctctctcttccctctctctctcccccgctttatactttgttgagtcaaaatcacagacgaagaagaagaagaaacctctctctcactcctctctcctttctctcgtcttattcgcttctcttctacgtaacagattgttcatcttcttctccttgttgcattgaggtgagttcaatttgatctatcaatgtctaaatgcatgctttttgaattatcggatctcttgtgtttgatttcattgatagagatccaattatgatctagatctgaagaatcctgttttttgagttcctattggttaaaaagtttcctcatttagctttagttcgaatctggaatgttaaacgattcggatcgagatttagcagtagtagaattcagttaggtagagtgatatttttatactattagtcttcaattataatataattgcattgagcttttcctacttcactgtatcgttttctattgtaaagattgatcctttttatatattatgcagggggtgttgttgatgttctgacgatctgatttgagtagatctgggtagggggcaaggtctctgggtctacttttgatttgagaattttttaagtgaagtgaagatatgacaagtgctcttggatggagatttccttccactaatggaaatggccttgccccaagtgacacggtaataattacttgattcagtattaacattcatcacacgggtttatggaaaagcttgtttagttgatatactgcaatctttctgagttgcaaagtcagatctggtgtattagcaggatgattaagctgatatgtcccttgcattttgaatctgatttgaaaaaagtacttgagctaagtccattgttaattaatggctttgtaccagtcagttatatctgatagagtgtcatgataaaggttatagtttttccattgcataggagcgaaaaggtcttgttgctcttttaacttattttctgttgtttggtcttgattgcaggagagaaatggggatatgaagatgcatgattcagagcccccaactccacattcaaccacaaagatgagtttgaggtaacgcatatatgtatttggtactgcatgggagctaatcatcgtgataaaattgaggttttatctgtatttgttgcaccaccatcttggtttaacaatgcctgtggaaattaatattatctggattggtttcctatgttatcctttcaaatgagacattttaagcagaaaggcacacctattagcgaattagtatctaactttccccatcccctgcagagaccggacaaccagc

SEQ ID NO: 13870 - DNA, 3000 bp, Unknown
  misc_feature (1)..( 3000): cDNA_ID_2704421_gDNA_ID_2214663_Annot_ID_136539 3000 nt of promoter + ATG
tccattcataatgtgaccacatttgtttctgtaagagctttggagttttaataaagagttttgtcctaccgggaatgatcctctataataaggttctatcgaaataaatgggtagaattatcatcattttgaagaggcatgttagggataatatcccaaaaccaaagtactcttgcattttcagtgatatataagagacatgcatataacaataaactcattgctgatagattttgagttgaaaatctatagtttctcatttggtatcaatagtaaccccaaatatgtataatgaaaaagagggatttgattcgaaatcaagtgtacactgaaccttacgttaccatgtaaacatgcttaatcaaatgacacgtaatatatataatcaaaattaacgcaatgacataattaaatcattttaaaacaatggcatgtccatttaaatttctcgagaaaggaaacatagtaactagaccaaacaacctcgtttcatgaatttggggctttagagtttgcgatttatccgccatatcattcccaaacatcaatgctttcgtcgcatgtgtatatctcctctttgtcaaagaaatcgacttccgtccatagggtttcatgtatttcattcataccttattaattgtgtttgattttatcagtgtgtttgtaatggtgatttcgtttctctttgtgtatgtaatgttgatcttgagatagctttattgtagaaatgagtttaattgaaaggggcattccgaaaacaaattgatgtgatgacattagttgatgaaattttcactagagccaaacaatctttaaccgccttcattcgttgtacttttattatatgaaaaaaaaaacacagattttaaattcattcaacaaaaatatgtaagataattatatgtagaatacatttgacaagtattaaaatagataaatattgtcattcttaataatataaaaatgaagcaaatactcttcaaattggcacttcaatgcaatgagtatttgacagtgcaaatacccttcaatagaaagcgaatgtaaggcatgctcgggaagatgattggccaacataaatcagaaattgtacttacggtttcgcaacattctttcttgatcccatggacatgtccgtggaaaatcctctttatgctctcgagacattcatgtggtgggtgtttaatcgtctgccaacatgcgttaggatctatcggttgagcactagaacatgaccaagttatcaaaaaagcaagaaccatgagcagaaaagttgtcttcactgtcttagatgcgatttgctttatcaaattataaaccaattaaatgaatttagtttgtgacacttatgttgttgatgatgatgctaattatgtcagctttttatggttgttcattaccatatgttttgaatagaatggttagatttttattttattttgttaaatagaatttttggattttgatttacgtaaattagtagttcttcttcttctgcatttcacctagtcagaaaaataagcataattcagtaacatattaattgctacccaatttgaagatcatatagaatataactatataagtgattatgtgtattaaggcatgcatgtttttaattagatatagatatgatcctatatctaggataacatatcttttaatttaattgttgtagatttttttttttgctatgatatattcatattttactcttcttttcaaagtataactctttgtgtatacatttccttatatatttcttcaatcaacatgcacgacatcatttcttcatggaaaatcatcttcaatcaaataattttgcaagatattttatgttgaacttctgatgaataaacatttcacgtaaagaggacattacaatgtccgaactgaggaatgggtaaaaatgaattatattaatagaaaaacacacttaaagaataacttttagctaccgtggtatttacagagatgtcatgctgacgtgttacaaccagacaaattctcaaccaacttaaatcattgtccatcctttattagattattcacaaaattaactattagtattatatacaaatatctttgtttttaatatatagacatgaaaattatatgttaacaaagatattaatatataaactacctttattttttctaatcagatattaccaatacttttgtaaataaaaatatttcaaaatatataaaacaattaaaattaattaaattataaatattcagaagattctaaaaatataatattaattaaatttaatcagaagattccaaaattttccgttaaaattatgaacataagaactaatttatttatagaacttatatacatgtttaaatcaatcaatgtatgaataataataattttaatacaaaaaattgctggttcaaattattttaaataaaatttacattacataataaacaaacaaatttcaaatttcaaataataacatagtaacttttgtaatttactacaatatatttatttaataatttatttcacatataatgcgggttaactatctaataatagaaaccaaaaatttgggcctaccagaaaaaaaaaagaaaccaaaaatttgaacaaatattattagatatatagcatatattttggaaagttctatacttgttttttcaatgaaaaaatgaagaagaatagtgacacaattctccaaaacggttaccaattaaaatttcagtgacttttgttaagtcgtccattgtaggccgcttattgggccataaaagcgataatagtcagcaaaatccagtagccgtatttactaaactcgatatatgatgaagaatgaagatgaacctgtatccaaacactccatattttttgaatacagataaccatgcagccaaacgttgcttaacctctgcgttcgttatcggcgatttcgaaattcgaatcatcatcatcttcctcgatagtcccgcgctcagtcgaaattcaaaactctctcttccatg

SEQ ID NO: 13871 - DNA, 3000 bp, Unknown
  misc_feature (1)..( 3000): cDNA_ID_2704409_gDNA_ID_2214663_Annot_ID_136544 3000 nt of promoter + ATG
aatatttttcatcatgattttagcgcaaaaaaaataaaaaaatcaggaatctgttttaaaattcactaattgtttttaaaggaactgaactgtcctggtaattaattaatggtgcttggttgttctttagaaaaaaaaaattttttctaaagacgacgagaagtaaaatgatagaatccttaaacaaaaagaacaaaaaaaggtaaaatgataatgattaggttatatattcctcatgcacgacatcttcctacatgttttttacgtcgcagttctaagcatttcatttctctattgattattacattattgggtaattcattttgaaattgagaagttccttttctgcaaaccctaattgatgataatgtcacgataaaatttgaacttttttctatctttcgatgaagtggatagtacttgctctatgtctctgtagatatcggtcacgttgtgggtggagacaagtttgattcgttgcacgtgaagtcggtaaccagtacgaatagaatcaattatagattttttagtgtaggcatttgtggattttttaaaaatgttatttttacctatttgctatttttaagatacttaaaaatgtatttatttacgattagtttttacaataatatatattttatactaaatattatatttcaaaaataaatgaaaccgattaaacataaatataacgaataaaatacatattaaatcatatttttatatttttaaaagaagcaaaattcataaattcttttaaaaatcaaaatccactgatgccattaaaaatttgataaatccgtaattgattctttattaaggcaacataaaatttgatgtgcatgcaaatcaagtctaagatatcgtttgagctatcgttcaaaaaacttgaccaacaaaaaaattactaaaacttatttttattattataaaacaagctagcaaaacatttgagattaagttgtaatatctgcatcagaaaaaatggcatatccacacatgcatgtgaacatgtgagatttctctttgtcttctatttaattatacaacatgtaacataatttttccaaaatattatgtgaaacatagtataatctgatttcactgcgaaataaacgaagtgacttgcatatatcaccaccaaaatctttacaatattagttgtgacgaaaaagtaaacaaacattaaaagaaagtagtgtcgacatcatcattcatcatatatgtggataaaaatatctgaagagtcaggatctcgtgatcacgaactcaagaatatgatgcgtttacctcaaatctcaattaatcaaattttttttttccctaacacacaaaaactacattatgagattttttttcaaaaaacactattatgggaatttgcttaattgttttcttttggactaaatgtactagacgctgactgatcagtagaaagctgttaactaccttagccatgtggcgcttattaaactacaacagctagcagtgaaacctaataagaacaaaacgtgttcgattttggtttggcgatactttgtctcattataaaattgcatgttttataaataaagatcaaataaaatatggtgattatatatatatatatatatatatatatattgctgaaacaaatccgtgcataatatatcgcaagtcttaataaacttaaaaaaaaaaaaattgtttatagaataacaaataactaacactaggattgtttttgttttttttaccgtcatagttttatcatactttttccttttgcaaagtttcaataatattaaattgtaaatggttcaaaccaaaaaagtgtaaaaacaaagaagcaagcatgtgaatgtgaattgttgggaaaaaaaaaggagatttatatactcatgtttcaaactcccattaccttgcaccaagatgatataaaagagcactatacaagatttctatcttacaaacatgggcttccgaaatttaatgatattaggaggcagtaatatttttctatatagatctaaagatgctataagtaaagtttctctattttagaattcaccatcttatgtgttgcatgcatgatgcattgcatatagttaaatccattaacgcgtcatagacaataatagatcattggccctcaagttcttctcttcagcagtaaagttcgacttcactttcttacaagaggttagtatatggaccagtggaccaaacaaagaaaacatttgattaattaccaaaaacaaatatctcaatattcttttgtcagcatgatcaaattggaagggaccacgtggcgcttgatgggaacgctccaacgccaaataaccaaaagatatccaaaggaagccaacaaggaagtatagtggaactcgcactcaatggtttcgactcggacacacacaatatctgattttacttttcttttttttttaattgcaagtttgccactataaaatcagtccatacccttagttaacaacccacattcactctcatttccatcaaaattataacttcattttacattttgattaatatcctaaaatgggtaatttcttgtttcttgcaatggtcacttacatatgtctatctttaaaacacacacaaaattatatacgtgttactgatctgttatcatctctgttttaatcttataatttcagttagattcatcgaagaaaatattactaaaatgttggagacaaaggccatctcaaactcggaggttttatatgtcggaggagacgacggagacacgtcaccaacgacgaaagttcttcatgattttcagatcaacagcggaggaggactgataagatcatgggttgattctatgagagcttgttctcctactcgccctaaatccttcaatagccaatcttgttggattgtaatgtcttcttgcttcctctgttttgtttgttttaatcttttatttcaaaaaattattaaacgagagaattacaaattttgcagaaggaacatccatctgctttgaacatg

SEQ ID NO: 13872 - DNA, 3000 bp, Unknown
  misc_feature (1)..( 3000): cDNA_ID_3032585_gDNA_ID_2214663_Annot_ID_136547 3000 nt of promoter + ATG
atgtttacacaaattaagtaataaacccacttcccactttgtggcttttgctttaaccacaatcatcacgcttttggtttgtggtcactgcttcggctgctacagtcactcacaaggtccacaattattcacgatcgactcgactctttgacaacgacgtttctaattataaccctcgtgatttaatgatatcgctaggacaatgttcaccataaaaacttcaacatataaacaagcaagtggttgtgtagtactacgtataagctttcagtctttctatcaatagttgaatcttgcactctagttcaattattcgtttggaggagttatgatccatggtccaaagatatttatagatcactttggtctaaaacttcttggttaaacaaaaaaaaacgttgaaagatatacaataaaacctctataaattaataatattgaaattgcaaaattttattaatttagagaggtattaatttattaatttatcgataaattaatatttattaatttatacagagattttcttaatttagtaacttttttaaaaaatttataagatttttttcattatagaaaataactttctagaaccagttacaagtataacataataataatgactaccaaaaaacaccaaaagttttgatacactaaaatatgaaaactatagtcaaacaaagaacaattatgaatttaagcaaaaaattattagaaaatatattttacagattttttttacatataatatatataaactaaattttatcccgcggtgacaatttatctttttaaagttagtataatttttttttgcaaattgtatctatctataatatatttttattttatagtttacaattgttattaagtaacgtcctgccaaacccgttccgtaaaaaaaccatttatttatattaatgttgatcttatttatgatatgtttataaatcattgtctaaatttttttgtcgatgcgggacgttgaacccacacattttttgctaattggttaatatatgttcatttttaaaattttgaatcataaaatatgacggaaaaaattaagatgttttttaaactctatatattatataatgatgttaaaaaattgtaatatttcaaactatttataagtttaaatattaataatgttttataaattctaaatatataaataataatatttaaaaaattaatatttttgtttataaggtaatgacacaataactcttaaagcaaggatttagaagatttaaatctttaattaaatattttcattaataaataattaatgtcagtgacatgacattataaataagttcaaatacaaaatttatttatttaaacaaaaaacgtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaatttaaagtaaaattaattattttggaaaaaagatttaatgctaatggcagtaaattgtaaataagtcgaagtccaggatttatttgctaaaatgtatatatatatatataatacatttatacaattattaatttatgatattgatgggatcatatatttacatagcactttcaaaaaatttattatcttattaatttatcgatttgtgtcactttttatactggtctcaagttcggaccggaaaaatttattaatttatagaagttattaatttataaagtattaatttatagaggttctactgtatatcatagacgtatacgacatagattagagtataaaaaaaatacacatcgtcacctatgatggaaacttaaactacatgcatcactgatcacttgtaaacatcttcgcaaaagacttcacagcaaataaaaggttttgcaacatattcttcataacaaacaattctacttgaaccataattatagtgaattttttcttacatctacaacacatgtacagaaaaacgaaacacactaattaatatgttagataaattcacgtgtacaatatagcaaattgcattttcttggaattccattagttacaaccttcatcgactatcgaacgattcaaattacattagaatttgttctttgtttcatagatttatgtatcaacgagttgtcatttcacgcaaaattttgattaaatagttcatatagtcccatcgaacttgattttcatattctacctatattaattagtgaaaatttgaaaatatctatcttcacaaaatcacaataccttaaaaacctagttgaattctattgactattttttagtaacgtttatttacattacatgcatctagattttatccaaaccaaagtgcaaaaatggcgaaaaatattttaccatctcctgtggtaaaaaaaaaacatttaccatctccagtacaaagtaagtcaataattattgttgaaggacctacgcactactactaggccctagttcaaaaattggtctctcacgcgccatcacgaaacgtgacaccacatctttgccacgtgtccatacagcttccaaacaacagatcgcgcttggcacccacgcgtttctcagtggccaaacgatgtcgtttaactgcagtgtcccacgacaacaaccgcttcttcttcctcatccctcgggtgtcttcgagtgtgttcacagatttacaaagaaacttgtcttcacgttaatcacgccacgtgtctgaacccaatttccaacgtgtctctcacattctcgaattcgactcttttagtggttctcgtcctctctgggcttttagactgggctcgaaccatctccattccaccgataacatcgaaacccgccacgtgtcctccctcctctgtctctcgtctatatatccacgctcttgttcgtcgattcgagatcacacacacaaccaccaaacacaaagcttttcaaaacccagagaaaatg

SEQ ID NO: 13873 - DNA, 3000 bp, Unknown
  misc_feature (1)..( 3000): cDNA_ID_1808999_gDNA_ID_2214663_Annot_ID_136548 3000 nt of promoter + ATG
ctcatcaccagcaacgatccatgtttcaatgtcaaactttgttgatcctctctgctgcttctctttaacctcttcttagctggtccactgtctcctgttttccctgcaggttcacaccaaacaaaagttggcttgttcctggctatgcaggaaaacactttagcatgactcaaatgtcccattaccttgggaagattcttcatctttctttttcttcaacacaaaatcacgttcacatccaaacgagactgaagcaatttctggagttggaccataaatcttttcatcatctgcatgccaagccacataatcactggcacctttgtatctatttaagagcaagctgttgaatctgcttccaggaagcaccttgtaaatctgacaagacgaaatagaaacgttttagttcaaacaaccactagaacacagggacatagcatagttgttttcaatcttacagcatccagaatctccttgagaggtgggaaatcatcccacgaataggaggtaggtcgatatccactgtacaccaacgcagtcaatccgctacttgcaacataacaagtatctctcggctacaggtggcaaatgcatatgtattagaaggccacaaacacaagttatacaggacttcacatgattgtgacttagatttctgagatacaagttgaatccaagcatggaaatggccctggcaatctttgttcctcacattgcacaatactcaatgtaacccgcgaggagacacaataaagcttcaatggatcatatgtatacaaaaacaaatgacagagaaagaggaagtggggaaacctggaggcaagatcgaccaaagacacgaatagtaggcctggtccaaggaatatgcttgtcgagataatcgaagaaagtccaagattgttgaaatggaagaaacctctgaatgtaaatgaggtcgcttccatggccaagatcaatggtttttctagagggagcgttgctcgatgaaggagactccaccgccacaatcgatgtcaaactcatcctccgctacacagcaaacatacaacatcactcagaaaggaggcctacttctctagaagctcatatttagtgtataagcacaagttgtcttttacgtagtaattgaatgagacaaatacctgatcctgatggtaatggaatcttttcttggtatctgaatcatctttaccattgtcagagaatgtgtcactatcagttacttcttttagcttgtgccctgaacagttcttcctatatgaaacattgaaaaggcttggaaccaaaaaaccattttgtgaagaaaaccacattcaaaagcagactaaatcctaaagcatgcaaatttagtttaagcaacattgcttcttcccaattagtaaatccggaagaaacattcgcatgaaaaagatgaagtcattacttgttaattagtgattcagcttcctcattggtgatttgaccgtcgctgattccatcagaagacggctgagaaaatggataatcagaacggaatcacacttttgtcggaacataatcaaaactgacgatgagttatcgccggaaaacatacctggttagagcgattagcggcggtggaattaagtggattcgtcatgtttcgctcctccttaatctcacctttttctgtgattctaaacaaaaacggtaaccgaataatttaaatcgaactaaaccggaaatgctaaaactagaaaatcgaaacagattaaaaaattcgattggtttcagtaattgaacaaaccgagatattcgtgtattcgatttcgaacccttgttaaaagtttacccgagcaatggagcgaagaggacatggtcgtattcagtctctccagtgtctcaagtccgagagaaaagtctggtcctcttagtgaaccaaaatcaattttatattgttgtcgatttattacggttcaatatttgagatgacggtattaagcacaggttttgtacggttcaatttcggtttaatcctgttttgtaaagttaaaacgtaaaatcccaaaaccgagaaacttgtccttgtctttcttttcttctccaaaagagcttgcttagttacttgctttcctgaatctgatccctggttcgtttctcttctctccttgttaaattaagagttaagtaagtttggcatcgagtgtctgttgttgtgatccttgtttattctcgtagcaatctcactccaaagcttctaagttataatccttattttaggcatttacttgatcccaagattggagtctattaactagattatgcctaatgccttaagaatattaactttttttatagctatagatatatattttcccatatttttaggattaagattagggtttaatgattgaataatatagttatacaagtgtgtgactgataaaatgaaacaaacgaaaaatctttcccggtgacatcatcagccgccggcgactagctttctaactctggtttgcaaattcaaagggttggttggtggctaattttgaacatatataaatgtcattttaaaatatttttaatttcattttcttaacattgttccaccaactcctcccacattctctccgcctctctcgtttacaaatcccacctcaaaggtcgactctttatctctcttctcaccaacccaacttctccaatggcttctcagagttcagtcgccgtcatttcctccgccgccgccagaggtgaatcattcccagattcaaagaaaccaatcgggtcagttcggttccaacaacccctccgtctctccttctcgtgagtttcgtctctattctaatcttcgattcaatttcgtcacttttgagcactcttttgattagaaatctgaatcattgctccaatcactggtcaatgtagttgacttaggtctctgtaatggttaggtactgtaagtcagggaatatgtcatctagaatctgcgctatggccaaaccaaatgatgctgagactctttcatcatcagtagatatg

SEQ ID NO: 13874 - DNA, 3000 bp, Unknown
  misc_feature (1)..( 3000): cDNA_ID_2714125_gDNA_ID_2214663_Annot_ID_136552 3000 nt of promoter + ATG
ttttaaaaagcatttgatttagctgttttatcgtaatttatctaaattgtttttttgtctcgtcaatctagtgacactcccttctgtacggaggcatgtcgagaaaaacagcaggaggctgataaagggaaacataaattagagaagataattgaaaaagaagatgaaattagataaaaagttgaaaagcatactcataacaatgttgattgatttcatatattaacatcatcctaatttttattcttgtcaaaaaattaggaatgacaatagttttttccccctacattttagtagttaatatttcccattttaaaaagtcaaaccccatcatgtatcatatatattgtaagataagatatggtgaaatcttcttgatatatgtactagatttctatgtaagaaaaaatttataaagcacatattttattcttttggtaaaaaatttcaaatgtaaatgtttgagaccaaaaaaaaactttattttgactagttgtagattttttcttctttttccttttttttttttttttttttttttctttttccttttactatcttattctctatcttcttttttaatataaatatgggtgtgacaggtatgaaaaaaataaaaaaaattagaatttttttttcttctctcattttagtttatttctgaaaaaaatgagttaatttgataacaaataaaatttgtgtggattgagaagaatttagacgaaaaaaaattcttcaagagtatataccagtgcacactcgtaaaatcgaacactgttttgaaatagtattaaattaaattaaaaactagtctatagtattaaattaaaaactagtctatagtattctttcgcccaaagaaaaaaaaaaagaaaaaagtttatagtattaaactaaaaactaatctataatggcatgtcggaatttcttttaatcgatatatgaaacattgttcagggtgattttccaaatagataaatagggttcgagctcccgaacttatagcttttgggccttcctcgtcttcagtttggacagctacgtaggattctatataaaatcacaaaactttagaggcaagtgatgttcgtcttgcgttaggactgctccattgcaaacaagtattgtttatggatatttgtgaaatttctgagtgaaacaaacattttccttgttttcaaatttcaaccaagtctcatggtctgttttactaatattagtgtttaaaactctataaaacacatccttagtatttttcggattaccacatgtttgctttttgttgaagaaaatttatctctagtggctagacatacgaacatcgaaaatttagcaaaacgatttcttttaaatttcattattttcaaataaaacaaaaatcttaaaatgcttggatttttaaccatttaaattatcaccttttagttttttttcttttttttttcgtgtgcaaggattttattgattaaatgcgtttgagttatacagagccgaaaatgaaaaaatcttttcggatacaaagccgacgggtacatagaaacccccagagacatgaggccaaaaaaggcgaacaaacaaaacaagccttaaaagaaaatatacaaagataacagttacaagtaataggtaaagcctccaaaacaacaacactgaaaattcttcccaacaagcagccgattaacactttcatggaacaggtaacagctaccgaagtaatagttaaagtctccattttcttctgttttatagaaaatttaggtaatatttcatatatatatatatatcactcagaaattacacaaatattcaaaaaaaatctgaacattgggagcaaactttttgaagcaaatcagatcataaaattagataacccgtagttacaaaaaaaatacttattgttctataatataaactcagctctaatcagattccatttgctaatttaaccgtataaagatatttctaatttacaagattttaaaatacgagaatgacagtaggaattagaaaaaactaatataaagcagaagaatataatcgtcaacacgtgataaaataataacccaatggataatttaatactattacagaaccaaaacaatcaataagcaaaaaaaaaaggcaaagtcccggaacttgcgtcagaagaattttgactagaaagaaaaaaaatcaatttcgacggccatttttttctctcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattaggtgaagtgaaagttttcttctttctgtagtatttgagatatttttgtttgcgtgggtcaaatcaaatctttatccgatctatttggtgtgagtattggtatatagtcatcaaagtttcaatctttatctattggaatctattcaaaagggcatttttatccattattggtgtgagtgatgatttgttcttgttgaaagtatattttatctgaatattcatcacttacttattagtttacttatccaagttgataacgaatctattctaaatcatgttcatcatttttagtgggttactttttacttctttactctttaagtttctatgcataatttatgattgttataggcagctaagaatatcttgggaaatttagtatcgtgtgttggttatactttaattagctgcttcttgtgaggaagttgactttttagctactacatcagaaggtactatagtgtctcttaaaagctttcttgatgaatgatatcttcttagttgtactaatttttgtgtgtcttctgattgcaataattgttgtccacag

SEQ ID NO: 13875 - DNA, 3000 bp, Unknown
  misc_feature (1)..( 3000): cDNA_ID_2714122_gDNA_ID_2214663_Annot_ID_188938 3000 nt of promoter + ATG
ctctgagcagagaaggcgcaaagtttaatgatattaaaagaagcacgtcaccaccagagttagagtgtcgctgctgcaaatcttccaaacccttgacttccttccaatcagtttcctctggaaaacgccacagtattttcccggacataccacatcagaatataataatgcctcaaataaaacccaatcgtttctattttctgggttagacttgatccggttgtcataaagcaacaacgccttgttgagaagaaaaagatttgactattctcatccagcgcgtgaacataatcaaaccaacagaaaaaaaaatccaaaaatccaaaatacccgaatcgaaaatatccaaaatacttgaaacccccttgaaaccatccgaaaatatccaaactttttggttagaactaggcatgggcaaattaatcaaacccaatgtaccaaactgtagcgaacaaaaaaattgaagtataagattaataattatcgagatctatgttagctaaatttgaatccaatcaataacctaatatttcaatgtggcacacgagatttgaaatgtaaaatggtaccagttcataagcgtaagatattacgtatggatgcaaacgtcatggtgtgttcataatagaaacccttcgtaacaactaacaacgtcaagttgttttttttttttttattggtcaaaccgtaacaacatcaagattctcgtgaactttaaagatacaaaatgtttttttgtttttatcctttcatttgaaagatggaacgtgaaaacaagactttccccttttgcgctcttacataaacgataaacatgaatgcatataacaaacattaacatatgtatgtgatcattcagaacatagtcaccaaatacttgtaattaggatagtttaatgatctccccatactaatttaagatacatatctttcttagaattttttttttattaaaaacgaatacattttttgtgtgttttatgtaatttatgataagtaaaacctaatttggccctcatcttaaatagaacccaattttaagagtcaacatatttttgtaaaattatataacagagtatataatatggttgataattcgagtttgctttgatcttttttttttcttaagttattgaaagagatgtcagattccaattcgatatttcttttgttctttggtactaattttgatctttctgatagaacaaataatgctagatctatataatttatcaaaactgaatacaagtacttacaatacatttttctgcgatgagaaaataaaatacttgcattgtgttaattaattcgctctttttatgaaaacaaaacctcttattcttaaactggttgacccaaaaaaaaaagacttcttaaaacgattacaaaagaaaatcaagaacatgggtaaacaaaaagttctcaagaagaagtgttaagaacttaagctgtttgaggtgaacaatcatatgtgacatagattgctcaataaatttcccaaccgaagctctaatgtcacgagtgacagattgtttaaccgctaagccatctaaaactctatcatcatcatcattgtcttgatgatcttcttcttgttcttcttctttaaaatcatcagcaagcaaatggagcggaactacggattcttgaagctcccactcctcaatactaagtccccattcttgataatccactcccgccatcgctaaagcctccatcgaacccataaaattagaaagtgatcttaaaatgtagtttgctttgttaatattttcttggaaccttttgagttctacttcttctctgatgagtaggtacgtgtggctaatgaccttactatatataggcatgtacggacgtgcggttcgctggcttctcctctgaattcattaccaaaagatatcacgtgaaatgttcaaaaatcaaaccgtctggattgaattttaattgtcaaatactttggttgacaaaaaatacattgaacgaaaaacaatatgaacaacaacattctcgtgacgctctctcaaagttgaagagaagaccatttgcagattgaaagtagtagtaatattaatcttctttagcccttactcatcttagtgatctattaaactattcaaattaattacagcgtaactaaacatagtaacatacacacaaattgatctcactcacgcgaatacaagaataaaataaaaatggtatttagccatacatgttcttgattttcttttgtgatcgttttaagaaaaatgtcaaagaataataccgcagaatagcgacatccaaagaataattgacatttcgctctctcttaaaatccctatcacagaattagatagttttaatggtctttgttttttggtcatcttgttttatttagctgtggttatgaaaagtttattattattccataacattacaatccaaaacacttgaagattggtgaaaaaaaaaaaacttgaagacaaaaatatggtttaaaaaaaggtaaaactaagtagataaattaaggttagtcaagtcaatcttaagacttggcattctccaacacatatttttcttgtaatatatatatatatatatatatatgcataattattaacttagagctagatgaaattatatatttcttgaagcattgacatgaaagaaaattgacttttatctaacttccaaatttcaattcattttataaacttcatacaagccaaacttatttaatttcaaaaataaaatgagtttaattcatagttttgatgtaaaaaaatcgctaaatacagaaaaatagaggataatttatttaattatcatattaatctttccttttaaaatagtcaaacacaagttccattaatttattattattcgcgaggaacagaaatttcagtatcgatcttcttcttcttcttcttcgccaatttcaacactttcgaaatctgagaatcttctgtgtgaatcggaacgaaattaacggtgttacggaggctagggctgatg

SEQ ID NO: 13876 - DNA, 3000 bp, Unknown
  misc_feature (1)..( 3000): cDNA_ID_3032569_gDNA_ID_2214663_Annot_ID_188937 3000 nt of promoter + ATG
tcatgtatgatttttaaaatattgtttattcactcaaattggtcaatttaaaataaattttaattaagctctaattttagttatattatggtgaagaaataattatgttttcctttaatttaatcaaaatataaaaggatatggtattcttaagtaattggatagatttttgtaatttctcatccgtaaaagttgtacatataagattaaacttcttcttttgttgggtcaacaaaaatataatacattcttattatattattttcttataaataaatatttaaatctcttaaatcatttaccttactaggaaatgtttgctaaaaattaaacatttacataacttcatgagataaggttgaaaatgatgtattacataagcttgttctattatatatacagatacaatctcatactgaaacatctattttcatatctaacttcaatcaaaaacttaattaggttttatcatgggttatcaagcagatctaaagcaaataagcttcttcacagatcaatgtggtttttgcaagaaaaagatttgtccaaagcttgatgacatctacatgtataagtacgttttttcatttttaaaaagcatttgatttagctgttttatcgtaatttatctaaattgtttttttgtctcgtcaatctagtgacactcccttctgtacggaggcatgtcgagaaaaacagcaggaggctgataaagggaaacataaattagagaagataattgaaaaagaagatgaaattagataaaaagttgaaaagcatactcataacaatgttgattgatttcatatattaacatcatcctaatttttattcttgtcaaaaaattaggaatgacaatagttttttccccctacattttagtagttaatatttcccattttaaaaagtcaaaccccatcatgtatcatatatattgtaagataagatatggtgaaatcttcttgatatatgtactagatttctatgtaagaaaaaatttataaagcacatattttattcttttggtaaaaaatttcaaatgtaaatgtttgagaccaaaaaaaaactttattttgactagttgtagattttttcttctttttccttttttttttttttttttttttttctttttccttttactatcttattctctatcttcttttttaatataaatatgggtgtgacaggtatgaaaaaaataaaaaaaattagaatttttttttcttctctcattttagtttatttctgaaaaaaatgagttaatttgataacaaataaaatttgtgtggattgagaagaatttagacgaaaaaaaattcttcaagagtatataccagtgcacactcgtaaaatcgaacactgttttgaaatagtattaaattaaattaaaaactagtctatagtattaaattaaaaactagtctatagtattctttcgcccaaagaaaaaaaaaaagaaaaaagtttatagtattaaactaaaaactaatctataatggcatgtcggaatttcttttaatcgatatatgaaacattgttcagggtgattttccaaatagataaatagggttcgagctcccgaacttatagcttttgggccttcctcgtcttcagtttggacagctacgtaggattctatataaaatcacaaaactttagaggcaagtgatgttcgtcttgcgttaggactgctccattgcaaacaagtattgtttatggatatttgtgaaatttctgagtgaaacaaacattttccttgttttcaaatttcaaccaagtctcatggtctgttttactaatattagtgtttaaaactctataaaacacatccttagtatttttcggattaccacatgtttgctttttgttgaagaaaatttatctctagtggctagacatacgaacatcgaaaatttagcaaaacgatttcttttaaatttcattattttcaaataaaacaaaaatcttaaaatgcttggatttttaaccatttaaattatcaccttttagttttttttcttttttttttcgtgtgcaaggattttattgattaaatgcgtttgagttatacagagccgaaaatgaaaaaatcttttcggatacaaagccgacgggtacatagaaacccccagagacatgaggccaaaaaaggcgaacaaacaaaacaagccttaaaagaaaatatacaaagataacagttacaagtaataggtaaagcctccaaaacaacaacactgaaaattcttcccaacaagcagccgattaacactttcatggaacaggtaacagctaccgaagtaatagttaaagtctccattttcttctgttttatagaaaatttaggtaatatttcatatatatatatatatcactcagaaattacacaaatattcaaaaaaaatctgaacattgggagcaaactttttgaagcaaatcagatcataaaattagataacccgtagttacaaaaaaaatacttattgttctataatataaactcagctctaatcagattccatttgctaatttaaccgtataaagatatttctaatttacaagattttaaaatacgagaatgacagtaggaattagaaaaaactaatataaagcagaagaatataatcgtcaacacgtgataaaataataacccaatggataatttaatactattacagaaccaaaacaatcaataagcaaaaaaaaaaggcaaagtcccggaacttgcgtcagaagaattttgactagaaagaaaaaaaatcaatttcgacggccatttttttctctcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatct

SEQ ID NO: 13877 - DNA, 3000 bp, Unknown
  misc_feature (1)..( 3000): cDNA_ID_3032585_gDNA_ID_2214663_Annot_ID_188931 3000 nt of promoter + ATG
cacaccgatttttttttgtagtacattcatttattgtaaacatttttagtccaaaaaacatgttttttaaatcaaattttgtaatcgttaggtgaattaaaagtaatcataaacaaacaaacaaaaaatgtgtgtccagcaagaattgatattaaatcacggccaaattatactaactgaccctagaaacgtctcaaattattcaatcagatcatttttcataaagtaaacagtgaaagcaagtaaataaaaacaaaagaaaacaagaagaatatgaaaagaggacaaagctcgttgtgtggcttgaaatgtatacggctataagaagaggccatgaaaaggggaaaaaaaattgttggtagggtgcacaagaaaaaaaaaatctgttggttgaaaaatttaatttgttatcaaaacgaacgaatggtcactgctttatcaaaaaatatgtttttttttaactacatcataaattgacatgcatgcatgcagatccgtgatagtatgaagtatgaactcagacatgaaaacatccaactacaaaaaaattagaatttgtttggtcatttctaatatataggaccactcatgcatgtttacacaaattaagtaataaacccacttcccactttgtggcttttgctttaaccacaatcatcacgcttttggtttgtggtcactgcttcggctgctacagtcactcacaaggtccacaattattcacgatcgactcgactctttgacaacgacgtttctaattataaccctcgtgatttaatgatatcgctaggacaatgttcaccataaaaacttcaacatataaacaagcaagtggttgtgtagtactacgtataagctttcagtctttctatcaatagttgaatcttgcactctagttcaattattcgtttggaggagttatgatccatggtccaaagatatttatagatcactttggtctaaaacttcttggttaaacaaaaaaaaacgttgaaagatatacaataaaacctctataaattaataatattgaaattgcaaaattttattaatttagagaggtattaatttattaatttatcgataaattaatatttattaatttatacagagattttcttaatttagtaacttttttaaaaaatttataagatttttttcattatagaaaataactttctagaaccagttacaagtataacataataataatgactaccaaaaaacaccaaaagttttgatacactaaaatatgaaaactatagtcaaacaaagaacaattatgaatttaagcaaaaaattattagaaaatatattttacagattttttttacatataatatatataaactaaattttatcccgcggtgacaatttatctttttaaagttagtataatttttttttgcaaattgtatctatctataatatatttttattttatagtttacaattgttattaagtaacgtcctgccaaacccgttccgtaaaaaaaccatttatttatattaatgttgatcttatttatgatatgtttataaatcattgtctaaatttttttgtcgatgcgggacgttgaacccacacattttttgctaattggttaatatatgttcatttttaaaattttgaatcataaaatatgacggaaaaaattaagatgttttttaaactctatatattatataatgatgttaaaaaattgtaatatttcaaactatttataagtttaaatattaataatgttttataaattctaaatatataaataataatatttaaaaaattaatatttttgtttataaggtaatgacacaataactcttaaagcaaggatttagaagatttaaatctttaattaaatattttcattaataaataattaatgtcagtgacatgacattataaataagttcaaatacaaaatttatttatttaaacaaaaaacgtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaatttaaagtaaaattaattattttggaaaaaagatttaatgctaatggcagtaaattgtaaataagtcgaagtccaggatttatttgctaaaatgtatatatatatatataatacatttatacaattattaatttatgatattgatgggatcatatatttacatagcactttcaaaaaatttattatcttattaatttatcgatttgtgtcactttttatactggtctcaagttcggaccggaaaaatttattaatttatagaagttattaatttataaagtattaatttatagaggttctactgtatatcatagacgtatacgacatagattagagtataaaaaaaatacacatcgtcacctatgatggaaacttaaactacatgcatcactgatcacttgtaaacatcttcgcaaaagacttcacagcaaataaaaggttttgcaacatattcttcataacaaacaattctacttgaaccataattatagtgaattttttcttacatctacaacacatgtacagaaaaacgaaacacactaattaatatgttagataaattcacgtgtacaatatagcaaattgcattttcttggaattccattagttacaaccttcatcgactatcgaacgattcaaattacattagaatttgttctttgtttcatagatttatgtatcaacgagttgtcatttcacgcaaaattttgattaaatagttcatatagtcccatcgaacttgattttcatattctacctatattaattagtgaaaatttgaaaatatctatcttcacaaaatcacaataccttaaaaacctagttgaattctattgactattttttagtaacgtttatttacattacatgcatctagattttatccaaaccaaagtgcaaaaatg

SEQ ID NO: 13878 - DNA, 3000 bp, Unknown
  misc_feature (1)..( 3000): cDNA_ID_3032538_gDNA_ID_2214663_Annot_ID_188922 3000 nt of promoter + ATG
ctattttgaagtttttaatttttgaatttcgccaaaacgtttaccaaatttgtgagacttgcataaaacacgagtggtctattcagcctataaattagttgaatgctacaagcctacaagcttaaaataaatcgaaaattttatatattaattaaaacttataatttgtttagttctgttttctttctcagtgactgttgattttatatataattgtgtctgacctaaattgtattgcgtatgattgaaacttgtatgatttgtagaaaagagagagaggaggagtgtctatatgtttttatttctttttgtcttggatccattaccatatctataggtctcagattctatgtttacaacctaaactgttttcattatctatgaaatatttacaatttagcaaaaaaaacaatgacaatctactcatcaagaggactagatgatgactttcaaatcttttttttttggttttttttttttttggcaaagatgactttcaaatctttgcaaacaaaatcaaaatgtaaaaaatgagagagagaaaccaaaaataataatgagaaaatagtctattaagaaaagatgtacgtaagaattaagttaaaatgtaacactaaaataaaagaaaaaatcaaatgtatgataagaccctcatcaaaccattatattgaagtaaattatatatgtatgaaaatgaaatatcaaagagttcttttactctcacttatgacacgctaaattaaaaccactaaaaaccataatattaatttcacggctacaagttgatgcttcctcaaacttactacgttccaatgccgggcactgattaaatatggacttcacatctttttttttttttttagatattcatttccaaacggtctattgacagatgggctaagaatttcacgggttacaaaaaagtggtccaaatcggaacataatagaaacaagatcagtaaaacgacggttcaccggccggagacgcagccttcaccttctatatccgatgcaaatttaacatatttcgaacgaatctatgagatctatatgagaattttgcttcttgggttttatacggttcgggaaagtggatgtatcaagttgtgacaagaagcatcaaagaatatgactttgtccagtcatttttatggtatagtgatgatcgtcaatgatcataattggctaggaagaaagagcacatgtgcattcatatgattatcataattgtgcatatcatatgcttttatgggcatagttgtcgatagaaacaaaacatgcgtcgaggaaaaaacaaaagaatagttaaaacttagaatctttgattctcatgagccatgaggccatgtgctttttctctcccacgttatatgttttaccatccttataatttgctcccccgacttctctcactttcagacgaaaagaactgctgtcgcgatttttgaacaattatggaaaataatttagatgtgaaggaagccgtaaaaatagttattatactttttgtccatatatatagaattcgtgatgattatgttgtggatgacaattggtggtagatagaaacctttactatcgccattgttatgggctaattaatcaagtttggtaacaaatcaacataataggaccaataacaacaactactgcagatcttactattattctttttattaattcatcagtatattttattattttttcttgattgtttatccgattgatcttgtaagagataacttttgattattacataacttacttcaacatgttaaatgacacaataaaatagacaatttatttttgatatccttttgaaaaatattaaataaatatttgtaatgactgtgttgcactaaaaaatcgagataaccccatgagtgataatttggtaacataatctaaacttagagacaattaactaattaagttattatctgagaaataaattagacaatatttttattcgtgtgtgtaatttttgtggtataatattttttcttatattgtttcaattctacggatgttttggataaaaaggttaatcaaatttataaaatgtaaaattttgcttgaacaaatgaaccaaaatgtttactaattggctaattgctggaaaaaaacagttatataatttttgttaacaaaaaaaatgtttgatgtaaataattaattcacagctaaaagtcaatttcctcatttatttttgattaaagaaagtaataaaaaacaattaagtataccattcgctgtacaagagtcgtttagttctgtcggctcgacaaccgactcaagccggctcgagtcgctaagtgaatccactcgctgtctgtcggtggacaaagccggctccaatctgatcactctctctcaccagcacacacacagctctctctcttccctctctctctcccccgctttatactttgttgagtcaaaatcacagacgaagaagaagaagaaacctctctctcactcctctctcctttctctcgtcttattcgcttctcttctacgtaacagattgttcatcttcttctccttgttgcattgaggtgagttcaatttgatctatcaatgtctaaatgcatgctttttgaattatcggatctcttgtgtttgatttcattgatagagatccaattatgatctagatctgaagaatcctgttttttgagttcctattggttaaaaagtttcctcatttagctttagttcgaatctggaatgttaaacgattcggatcgagatttagcagtagtagaattcagttaggtagagtgatatttttatactattagtcttcaattataatataattgcattgagcttttcctacttcactgtatcgttttctattgtaaagattgatcctttttatatattatgcagggggtgttgttgatgttctgacgatctgatttgagtagatctgggtagggggcaaggtctctgggtctacttttgatttgagaattttttaagtgaagtgaagat

SEQ ID NO: 13879 - DNA, 3000 bp, Unknown; identical to SEQ ID NO: 13875
  misc_feature (1)..( 3000): cDNA_ID_2714122_gDNA_ID_2214663_Annot_ID_136553 3000 nt of promoter + ATG

SEQ ID NO: 13880 - DNA, 3000 bp, Unknown
  misc_feature (1)..( 3000): cDNA_ID_2704455_gDNA_ID_2214664_Annot_ID_136557 3000 nt of promoter + ATG
aaagaatgatgaagatgaagaagaagaagattcgtataagacagctcagttatggcatctgcctgaaccgcgaggaatattagtgcaaccgttccgaccagaaccacggaccggtcctctttgcaacgcctgaaacagaagccggatctcatctacgggatctgggaaaggcctcatggcttcaacttgcgtagcgtccaagaaaacaacgaacataacaactaacataactacgaccaccaattgttttttcatcatgtttagaattttagtttttcgaatgagaaacaaaaacaaaattgagcttttttattggtgaatgtagagttttttttgtttttgttttgtatgtgtaataaattcgataatgactcatatatatagggtttttgagatgtcattgtttgacttgtgctagtttggtctcactatcttatgtttatgtatacacacacatacatgaaatttgactttgactttactacaaaagaattcgttttcaacattttgaaccaaatttgaaggattttgaaatataaaattcacttagacacggtttgtccaagtccacacaggcttttgctaaaaatatacaagacctggccctagcagcctcattctaaaccgaattctggtttcggttcagattggtttcatttggcttcgtagtcagatacaactttctcttttcgtgacagagtgtggaaatggattctcttttgctaattgaaagatattaatagacactcaactaaaatatatatcatctcttacaaaagcaaagtgttttctttttttaataagttggatagcttttggtgaagctttgttctgaaagagagtaagagatcattgttaataatatggtagtacttacgatactagagatcttatgataaaataatgcgaaaataaagatacaagcatgcatgcgtcaaaaagtgttatgatgacaaatgaatgtactctaattttcatatctaaatttttactaatattctgaaggtattaattttcgagttattaaatcgctgtaatatgtttatattttgtaagagaaaaatttggggtactaataaatttgtctttagccctttttcgtctaaatgtacgaaattaaatgatctatggacgataatttctagtttgattcatcgtatatactagtccaaattgtaaaccaaggcataagattcgtcgagaatgacaaccagaagagatgaggagtgctaattagaggtgataaatcataaatataccgccactcttggtttgagtttctcttgtacgtagctacaacttgacaactatgccgccacttttttttattgatccgtaccatttgtattgtatgcaactttggtatcattttgttgttgacaaagttggtaatccatattgtatatcacattggtaaaaagttgctaaaaaagagtctatgcttattcatcaaaattttcaaaggattgatttatcaaagtttataaacacgtggaccatatatcaaatcaaaattccaattcaattcggtaagttatactgtagttattaacgaaatttatgtttgaaattagttaaatatgattatttgtttacgtttgcattgaacatgtaagaataccacacatattttaagatggtaaacacaatatgtataaaactcaaacgaaactttaaagtcgccttattttatgatacacctgatcagtaaataccacaatactattacgttcataaatatacatgtgtttcactttcattaggagcagtaaagtaaacaatatgcgtggagattagagatttttcttttatttttatatttagcttgattataacttaataaaaatgtgtatgtgtttatagataaaatcagggtttgtttgtttatttgactcgggaattttggtctcttaggaatttcatgagatatgacttttatttgggaagaaactcggcttgaaaacatttgaacaacacaattaatattggaattaatcaaacacccgactcggttcgcctttacaccacgagttctttattcacacgcaaaaaaattctgaaaaccggatcataatcccggtttagttggccgagcatattcctaggtaggtccttacgatttatgctcttaaacaaggcttatcacttatgttaattgttacatacttgcatgcgtgtataggactataggtccacctaacgaaatactacaattgagaaaacaagttttctttaatatacaagtttaattacatatatgctcgcgtcatgtcatcgatcatgtgagttcatgtttcttcttctttttctttaatttattttatagtataaagcatgcatgattcatgttgtaacttatttcaaaacattgattatataataatctcttataagattaaaaggataattctcttacttttctgaaacgttctccgacattgctttctatagtaaaatcaggtgaatgtaaaaaaattgaacattactaaatcatcaagtcaatttgaattttaaaattacatgaaaaagtgccttttgtcggcaaagtttaaataatatgatcaaatcttgtatttaagcacaacaattaagttcattttcattcctaccataaaaaaacaatattaagtttcattttcattaaaaaaaatttgaaataaatcaaaagtttaattaaattaaaattttgatgcacattttgtagtcgtgaaaacacgtcttacctaaattcagagatgcctcgctgtttaatattttggtttagtattcggcaccacttgtcccggtccggttcgttccggtttaggatgttctaggaggcgacacattgctctctctctgtacggcttcttcttcttctcgctgacgctctttctccgtcaattctcttcgaagatcgttttgatccaagagagaattctctgagagattgagaggggaagagaaattcttcgatccatagagagataattctctttgaacatcgatccatagagagat

SEQ ID NO: 13881 - DNA, 3000 bp, Unknown
  misc_feature (1)..( 3000): cDNA_ID_3032632_gDNA_ID_2214664_Annot_ID_188959 3000 nt of promoter + ATG
caaaagcatttaactttaaccggaaaaatcttacatttttttcctcctggatctctctctctatatctgcagattcacactacagctgatttagatctatttcgtaagtgggtctttcaaagtcgtctcctttgatctactttgattcagggttaggattaaaaacttctcctttttctatagttgcttcactgtttctattccatggagaaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacacagcttaacgggtgccttggcctacagggtattggcgttttggtacgtagaagaaaccttttggtaaggtcattgaagataaacatttgggtaagcccaaagaaacagagttccgtgcattgcaaatatgcaatgcactgcaattattagttgtttggatttgatatagagactgagtctcgaaaccatagtatgtaaaaatataatcacgttcaaaagctgttaatttgttataatcttataacaattgtgttttaagatacaaacctactttgtgttatgatatttgttcactattggttttggtatatatccaaatcatttttcagggaattaaatactgactttattctctaaaagaaagaaggaaggccacaagatgtcaagattagtccacacaaatgccaacaaacttgtattgatgttaaagaaaattaatgtctcctccaatgtgtaatacagaccgcaaaaacatttcagccgacgaaattgttgtgcaacattgtccacaagattttacggctacactgtatacagactcacgaaaaagaaaacattaatagtcttttcagtttccataagatcgctttacaataatatcaaaataaaagtgaaaaagacagagaagaagagaaacaacgagagccgcagaagttgaagaaatgaggacctacaaggcattgatgtaagaagcaaggatgtggttccttttgattcccaaaatcctcttaaaatctcataaagcccttcttatcttcttctcttctcctcaacttgaatacacagaaacaaaactgcttttgtctctcaagtcatttgtcttataaaaaggttctgttcttgaacaagggaaagaaacaaaaggctgataactcctgttttgtagattcctctgatattcagattcttacttctcaggaaaaccctaaagaaaatttctgtttttttttgagaaat

SEQ ID NO: 13882 - DNA, 3000 bp, Unknown
  misc_feature (1)..( 3000): cDNA_ID_3032628_gDNA_ID_2214664_Annot_ID_188964 3000 nt of promoter + ATG
caattgaaatactcctaagaacagctaaaatcaccgcatttcaaacaagaggaacggagaacaaactcatgggatcaaccctttatatggttgtcactttattgagaacatatcagaacatagctatcgaaatgaaaccattaatcaaagtcaaacaccaagatccttatcaagaagcagagccagatatagcaatggacacactacatataactaatgtgcgacagattcaagtcaattacacaatgataatcaaaatccaatttctcaatggagtgaaattgaaactgcaaacaaaagatgggttcttatctgttgaagcaaaacacagtttctcactattaaactttcataacatttagttcttagctgcagattgttaactaaacaacatcgaataaacctcatgaggaaatacaaaaaactgaaaacacttgcctttaaagagaaggaacaaaaaaccactaattcgtgatactcttcttgctaccaccactcaacatctcgtcaggaattttcttaagctgcttcctctgcttcttagacatagaaattttcttcaaagtcttgggatttgtaatcttctgcaacttagtaccagttctcaaaacattctccttcttccgcttctctctctcttccttcttcttcctcttctcaaccttattactcctaatctcttccttcagctcattcaccctctccttatacgctttcttaatctccctttgcctcttcatctcctccagatctggtttcctgttcttcacaaacctccctgaagatctatgagttcgcggctgtttccagttccgtccggagactttcccggcgattacaccgtcgtaggttggtctctcgacagctagagcaataggtttgtctggattttcagaggaagcgacggcgctacgtttcgcggcaggaggagcaccatcgatgtccatggaagcttcatcggcgattgcttcggcggcggcttgttcttgagattcgcgtttgcgtttgtaggttttgccgccgaatccttcgtcaaggcaccggaaatctacggtgcaagccatttcttctcttctttgtgtggctgtgaggttttggcagaaatttagggtttctcgactatttatatgagtgaggatggagacagggttaaaattccggttttttagccgaccacataattataaccgaaccgaaccggaaattatgtgattcatcaattactctgttttagtgcaaacaccttctcttttaaattgtagaaaaccaaatcaaatcttttaggttgtgaatttggatagaattgggaataaatccatgttcgtgataaaatattgattcaagctattaacacaagttagtaccgcaacaataaatccaaagtaatcttttagaaaaaaattgttaataaatctacattattaccaagtcaatttaaaataaataaataaattcagaaaaataaggtcattggacaaacatccaacctctctagttgactcaagggagaaaatatccaatctctctacaaaaaaaaatcaataaaccataaaaaataatgaaaaacaaattcctaaagttacttgggtctcaagcaacattgtgacattatgaggaatgaccagagctgcttctaccacaacgggttggagaagagagagcaaagcaaagttttccacttccatctcgaaaggaccagatttcaatcacgtcattgactttgaagatttttttatcaatcacattgttccaaccatgacttaacacatatttccaaactgtattaccattccacttctttaaataaacgacatgcttatccgattcaggatccaccaaaaacactttcaaaccatcccttttagcctttaaaaagtcttcatctaagaatctggtttcgtcctctgtcaaaaaatctgacttctctaatttgctgagatgcattgagagacacccctggtttttacggagatcagtcgtacacagcaccctcctctttatgatcagctttggatcgtatccattctcttttctcatcactttcacgagccagtctggtatcgaagaattgcatgtttcgggactatcagcaggacataacgaaacgatgtcgcttttgttctgctgagaggggctcgggatgtcgaggatgattttcttttttcctttgagaactatttgagaaaattcttccaacatatccagcttccaaaacttacaaatatcataagcctccattgtgcggccagagaactacaagaaattaaggaagaggtttaataacaagcttaagagagagatagagaatattatataacagaatttttaattacgttcttactaaggatttgctcttgtttttttcccaatcttccttaaataagttatatatatatatatatatatatattctagtaataaattcttattttaataattttctagtgataaatttttattttagttctcactattttaatttttaattttaataattaggtgaaatccagttaattaacgttttttaatcaaatttttgttttatttcatttatttttcccctaacataaataggttttagtttccaaaagtaaaaaaaaattggattagtttatttgtttatcttgatgaattttatttttttgtgaaagattagtttctttatttcccaaagcaaaacatgtttatcttttgtcatccatgacccaagagaaaaaaagttttgtgtacaaaaattaaaattaggagataatggaatggtctagtggaaaccgaaacattaaactgccattagtattttcatggttattaatgattgttaattactattttgatgaactaccgttcaaagtctttgactttcctaaaaatttcaggaatctcattctcatccgtatattatcatcacctattttagctttgaatttaactataaataaaatgtttgaaacacaacaacggaaacaaaattaattaagaaagaccttctttgttcacaat

SEQ ID NO: 13883 - DNA, 3000 bp, Unknown
  misc_feature (1)..( 3000): cDNA_ID_2704443_gDNA_ID_2214664_Annot_ID_188961 3000 nt of promoter + ATG
gaatggtaatacagtttggaaatatgtgttaagtcatggttggaacaatgtgattgataaaaaaatcttcaaagtcaatgacgtgattgaaatctggtcctttcgagatggaagtggaaaactttgctttgctctctcttctccaacccgttgtggtagaagcagctctggtcattcctcataatgtcacaatgttgcttgagacccaagtaactttaggaatttgtttttcattattttttatggtttattgatttttttttgtagagagattggatattttctcccttgagtcaactagagaggttggatgtttgtccaatgaccttatttttctgaatttatttatttattttaaattgacttggtaataatgtagatttattaacaatttttttctaaaagattactttggatttattgttgcggtactaacttgtgttaatagcttgaatcaatattttatcacgaacatggatttattcccaattctatccaaattcacaacctaaaagatttgatttggttttctacaatttaaaagagaaggtgtttgcactaaaacagagtaattgatgaatcacataatttccggttcggttcggttataattatgtggtcggctaaaaaaccggaattttaaccctgtctccatcctcactcatataaatagtcgagaaaccctaaatttctgccaaaacctcacagccacacaaagaagagaagaaatggcttgcaccgtagatttccggtgccttgacgaaggattcggcggcaaaacctacaaacgcaaacgcgaatctcaagaacaagccgccgccgaagcaatcgccgatgaagcttccatggacatcgatggtgctcctcctgccgcgaaacgtagcgccgtcgcttcctctgaaaatccagacaaacctattgctctagctgtcgagagaccaacctacgacggtgtaatcgccgggaaagtctccggacggaactggaaacagccgcgaactcatagatcttcagggaggtttgtgaagaacaggaaaccagatctggaggagatgaagaggcaaagggagattaagaaagcgtataaggagagggtgaatgagctgaaggaagagattaggagtaataaggttgagaagaggaagaagaaggaagagagagagaagcggaagaaggagaatgttttgagaactggtactaagttgcagaagattacaaatcccaagactttgaagaaaatttctatgtctaagaagcagaggaagcagcttaagaaaattcctgacgagatgttgagtggtggtagcaagaagagtatcacgaattagtggttttttgttccttctctttaaaggcaagtgttttcagttttttgtatttcctcatgaggtttattcgatgttgtttagttaacaatctgcagctaagaactaaatgttatgaaagtttaatagtgagaaactgtgttttgcttcaacagataagaacccatcttttgtttgcagtttcaatttcactccattgagaaattggattttgattatcattgtgtaattgacttgaatctgtcgcacattagttatatgtagtgtgtccattgctatatctggctctgcttcttgataaggatcttggtgtttgactttgattaatggtttcatttcgatagctatgttctgatatgttctcaataaagtgacaaccatataaagggttgatcccatgagtttgttctccgttcctcttgtttgaaatgcggtgattttagctgttcttaggagtatttcaattgtagtcctatcctgtgaaagttctttgtaatgtcttgaattttgattatgattgtgttgaatttatcacgccttagttatatgtagttgttcattgctatttctggctctccctcttgataaggatcttggtgtttctctaatgctgcctcttgctgtttggtgcgatatagataggcattcgggtctgaaatctaacctatacattgacttcgatcttcgatttatggtttcatttcaatagcttttctcgggttttagttttactgaaatataacaattgaatgatcccatgagttttgcttgttgtgtgatgtgttctcggttccttttgtttgtaatttcaattgtatttatgtcttgtgaaagagctttataatggtttaattggatgagagacaaataatatacattctctatggcagccagtaactgttgatcttatattacacatgtaagataatgttggaccagaaatgtcaacatctttcgagaagttttgtgtggcagtaattcagatatatgttcactctgtgacgcaagcgtttaatatcttggcactgaaatcgttgtcggaatactgagagtttgacatctggaacattaggattcctttggagttcgaaaattctggttcctacatttatataaaaacaagacagtgatatcagagtttttagattgtttcagctttctacattacttttttgctatattaggtggaacaatgactcgtgcaacatccaaatgttctttctactcgtcaataggtaggtggttgattacataatttggtgagagttggtcgcataaagcttaaccaataccatatctttccccagatctcctctcagaaagtctgataaacaaattatttaacagaacagatacacaattggaaaacaaatatgtgacaattattgcaaaaacaaataagaatgaaagaaacagacgaaagttaagtaaccatgactttagtgaaattaatcaatttcgtaagcaaaataataaaaaatcatttttctaggaagcagaggaggagagtcctaccaattcatcttctctctctctctatcggctcatatctccaaaagacctatccaaaaaaaaaaagtttgagtctttacgaattccaaagaagcaatgaaaaaccctatccatatgtagctcttttcgattccgtaatcaccacaaactcttcctttcaatg

SEQ ID NO: 13884 - DNA, 3000 bp, Unknown
  misc_feature (1)..( 3000): cDNA_ID_2704467_gDNA_ID_2214664_Annot_ID_188965 3000 nt of promoter + ATG
atcaataaaccataaaaaataatgaaaaacaaattcctaaagttacttgggtctcaagcaacattgtgacattatgaggaatgaccagagctgcttctaccacaacgggttggagaagagagagcaaagcaaagttttccacttccatctcgaaaggaccagatttcaatcacgtcattgactttgaagatttttttatcaatcacattgttccaaccatgacttaacacatatttccaaactgtattaccattccacttctttaaataaacgacatgcttatccgattcaggatccaccaaaaacactttcaaaccatcccttttagcctttaaaaagtcttcatctaagaatctggtttcgtcctctgtcaaaaaatctgacttctctaatttgctgagatgcattgagagacacccctggtttttacggagatcagtcgtacacagcaccctcctctttatgatcagctttggatcgtatccattctcttttctcatcactttcacgagccagtctggtatcgaagaattgcatgtttcgggactatcagcaggacataacgaaacgatgtcgcttttgttctgctgagaggggctcgggatgtcgaggatgattttcttttttcctttgagaactatttgagaaaattcttccaacatatccagcttccaaaacttacaaatatcataagcctccattgtgcggccagagaactacaagaaattaaggaagaggtttaataacaagcttaagagagagatagagaatattatataacagaatttttaattacgttcttactaaggatttgctcttgtttttttcccaatcttccttaaataagttatatatatatatatatatatatattctagtaataaattcttattttaataattttctagtgataaatttttattttagttctcactattttaatttttaattttaataattaggtgaaatccagttaattaacgttttttaatcaaatttttgttttatttcatttatttttcccctaacataaataggttttagtttccaaaagtaaaaaaaaattggattagtttatttgtttatcttgatgaattttatttttttgtgaaagattagtttctttatttcccaaagcaaaacatgtttatcttttgtcatccatgacccaagagaaaaaaagttttgtgtacaaaaattaaaattaggagataatggaatggtctagtggaaaccgaaacattaaactgccattagtattttcatggttattaatgattgttaattactattttgatgaactaccgttcaaagtctttgactttcctaaaaatttcaggaatctcattctcatccgtatattatcatcacctattttagctttgaatttaactataaataaaatgtttgaaacacaacaacggaaacaaaattaattaagaaagaccttctttgttcacaatatggccaaaatgacaataacacacatgaagtttcttcaactgttgttatctttagtgctctttgtattctcaatgtcaaatgcaatgccaatctcagacgtacataatttttgcaaggaaacgtttgaagtagaattctgcatgaaatacattgggtcggaccaacgtctcgtagccgcacgcgacttcagtgacatgcttttaattccggtaacgttatttaatgtgacaattttgattagtgatatgtcagattagttgatcacatatattaccaaaaaaggcaagatatttgttcagtgttggtaaaattagggataatagtatagattagttgaaaattttcaccacaccagttcttgtaagattacatggcctccaaaatactaaatagaagttatagaaatctgtggtttattcatattctacaaaagaagtattatttttggtttgtgattgagaccttcttatcagatatctgagactcaaattcaagtgaccaatgcaatcacacaaatcaacaatatccgccaaaggtttaatgacacgcttggaaagaatcggatcgctctatgcgaggaaaaatacgagagcgcgggcactagttttcacaaggcttgggaagtcggacagaaaaagtcaaattcatcgacggaccatatggaaataacccgaaacacgcaagctggctttgatgctgtgtgcgagtgcgaagacgaatgggcaaagcatggtccgaaacaagagtctcctctcactttctattaccataacgttctgaaactatgccaaattactcgtcttattatcagcaagctttaggcttaagtacgtcgtattggaatttgatttatttacgatattaactggtttagcttattcactcacacgtttattaacaccgattgttctctgcttctagttgtaaacccgatttttgaaactatatgtatttattggtttaaatgaataaaacctttgtgatgtttttgataatttatcatcattccgtgaaaaacatgacgttttaaaatctcgagtttcgacgcaatttgtggtatacacctgaatgagagtttcaagcaaaaactaagtccggaaaaatgctaaagatgtatgctaaattagcacaaattcgaaagcaaaaatagttgtctatgatgtctttttggagatgcatgatgcaaatatagagtattctagatttagtaaggaatctcttgaagagattctcttccatacattatcaagagtttccttttttatatatgaggaaaagaaagcatgaagacagaggacaatttcctatccataaaaaaaggaaattatctattgctattagtacgagaataggaaattggcttattgtatagccacaacctatttagtataaatatggtgctaaagttttggaaaagtttagcacaaaagaataagaaaattctaatacattaaggttataaagtttcttgtaagaaagaataacgcttaacagggctaagaaaaaaacacaagaaaacacttcttgtttctcaaa

SEQ ID NO: 13885 - DNA, 3000 bp, Unknown
  misc_feature (1)..( 3000): cDNA_ID_3032638_gDNA_ID_2214664_Annot_ID_188956 3000 nt of promoter + ATG
aattaattttgctctcttaatttttaaacgtattttgttattatttagattatctgttcccgatctttactctgtttttttttcgttatgatatgaagctgcttacctataatgaaagtaacttcactatgtctactattcttgtagggcactttcaattcttgtactcatattattttaattttcatattttttgtcgtcttacgtttccggagttcgcgaggctcttttttttttttttcctcgcgaggctctctcatcgccactatagtgttttgaataactaaagttttctttttcaagatctagaaaaccgaggatctaggaaattctgggacatttattcagatgtgatgatttagtaagttgtttgtttatttttattttatacatataagaaagtggctgatcacttacagtcacaacaagattgtttgaattgtctatacgaaattacaagttagagcacatgcttatgtctacgtatcggatcttaacatgtgaaagtttacgatcttatatttgtcttttgatccaacatattctttatatcattagaggtatggtttcaaattaagttttagttacttaaagcattaaatgtgtgtgggcaacatggcattaggccccaaagtttataaaaatatcgctcatcataatatttttttaaacaaagatacttgaatatttgagatttgagagcgatatcattatagggtgcataagaagatatcatcatatcgtacactgaataattaaatatattatttcatagtcagatttttttcgagtaatgtactttagtgtttaaagtaatagtaatagagacgtgtatgcatcgatgatcaatcttgcaaccctaaaatgattagtttaagaggaaaaaagcctaagaatacatgtactctagtacttgatatctaaactttaaacgaattgataaaatactgtacggcttttatttaaacctcaaatttgactattcattattcaaataatattacacaaatacatacgaacgtaatacctaacctaatgaaaaatatttacatataccccaaaaatttagaaatgatagtcaagaaatacaagaactctagaaaaatacatacattttctatttatttgttcatttacattcttaatttttacaaagatccaaatgctatatatttttcttcggtctacaaatcttgtttagacaaatccgtaccccaccggaaatgaatcatatctattaaaaccggaaaaacggtctatttccccacaagaaataccgcatcatgccagatagagcccaaacttcaaccccggtctacatgtccatgaaaacaaagttttaaacctatttctctccgaaacgtaagttctatagctaaatctccccaaattaatacttcgagatctattagcacatatatctggtttttgtcggtttaatgtacaccaattcagtcttaaccatttgaaaacaaactttaaccaaaactaaaccaaaattatcaaaaagtaacccgaacccgccgacctattaatgatccgatccaacgcttcttcttcacctgaaattttgcttggattatcttcgtttaaaaacaatactagactaactttttcctgatgaaatcaatgatcgatcttggatgcaagtataaagagactttcctcatcatgtggggtattaagtatacttgcaccaaattaataggtcggcgggttcgggttaatttttgataattttggtttagttttggttaaaatttgttttcaaatggttaagactgaattggtgtacattaaaccgacaaaaaccagatatatgtgttaatagatctcgaagtattaatttggggagatttagctatagaacttacgtttcggggagaaataggtttaaaactttgttttcatggacatgtagaccggggttgaagtttgagctctatttggcatgatacggtacttctcgtgaggaaatagaccgtttttccactaaaacccaaactagaagaaaataaataaatagtttatttttatttttatatgccaatagtttttttctttcttttacatcttaataataaatattcaatcaacaaagttagatcgaacactttgagccagatctgttatttttggggtcaaactttaaaaattttaaaataagaatataaaaatatatgcttttcttagagatcttttcttttctttttgcatattaaaaggaaaggtgttaaaatcacatcttttttatgagctggatagtcaaatttatatactattccattttttggtcaactattaatggtactatttgatttatttctattaaataaataaaattaattaattgaattgatgttataaaaaaataaaaatttggatttatttcttgtatatattgtaaaataaataaatgtattgtattaacattaggagttggtgtatattgacacttgggtcctttagtttgtatatatattgtccataaattattgataagataggactaaaaacagtatatgcttgggtacaagccagtgggtaattccaatttttattttaaaagaaacagaaaaaaaactctggaattttgataacagttttccagctacccgaacgtgatttttgcctgtaatcacgtacatccataaagcatgtatatcaaaacagtagaataagtcaaaactaaatttcgagccctgtgacacttttcctctttacgttggcatctatatttaaccttcttcttttttttttactggttacacaaaatatactttcactattgcatgtagtagatacacctcaacccttacgtgcccatccgcaacaacaaatatcatgatatttattatttactgattccttatgatactttgttgcagtaaattaaaatcactataaattagaagagaagcatcacttttattcttctccattaacaaaaaagagagagagaacctaaaaagaagagaagagaaagagagatccgaaatg

SEQ ID NO: 13886 - DNA, 3000 bp, Unknown; identical to SEQ ID NO: 13881
  misc_feature (1)..( 3000): cDNA_ID_2704461_gDNA_ID_2214664_Annot_ID_136560 3000 nt of promoter + ATG

SEQ ID NO: 13887 - DNA, 3000 bp, Unknown; identical to SEQ ID NO: 13883
  misc_feature (1)..( 3000): cDNA_ID_2704443_gDNA_ID_2214664_Annot_ID_136562 3000 nt of promoter + ATG

SEQ ID NO: 13888 - DNA, 3000 bp, Unknown; identical to SEQ ID NO: 13880
  misc_feature (1)..( 3000): cDNA_ID_2704455_gDNA_ID_2214664_Annot_ID_188955 3000 nt of promoter + ATG

SEQ ID NO: 13889 - DNA, 3000 bp, Unknown; identical to SEQ ID NO: 13884
  misc_feature (1)..( 3000): cDNA_ID_2704467_gDNA_ID_2214664_Annot_ID_136565 3000 nt of promoter + ATG

SEQ ID NO: 13890 - DNA, 3000 bp, Unknown
  misc_feature (1)..( 3000): cDNA_ID_2704475_gDNA_ID_2214664_Annot_ID_136567 3000 nt of promoter + ATG
taaaattcagctgattgatttttcccaagttctcctcaaaacagaattagttgggtgacaatagccttgagatcaaagttgttctttgttttaccttaccagaaaagaaaccaacgatcatagcatcactgaagaataaactggtcttagccacatggcccacatctacttttagcaaaaccctaattatgatctatgtggtttttgctgtgacttggagtgaactcaatcctctcagaacaacaaatctgttttattagatgtacgtagcaagtgttttctatcattcatgaacagagtacatcgtaagcaaatcttgataaacaaatctggtttgactcaaactcagaatagtacaaaccaaagcagattaaccagttttagctaaaaacccatcaagaatttaagtataggcattctaaacacaatgagagaacaatcattcctcaacgaaattgacttaagcaaactaaacaaaagactatacaagtatgaaaactcatacgtgtcagtcaagaaacaaaataccaaaagtgtaactgaagcatcatcttcactggtagtgaccggaatcacgaatcgagccatcatcgttgaagccaaagtcttcatcttcgtcgggaagatagccttgactgtcttcttgatcaaagaacaggtggtttaactcgtaagactcgtcgaaaaaagagctaggttcaacagaatcttgaggaagattgtcgttgtggccgtcgtgaccagaatcttgaggaagattgccgtcgtgaacagaaacttttgcaggaaccagaacaaaacagagactaccttgctccaaaccgtcaacaacagagtcggcgtggccacccgaaagattgacgccgtcgtgaacagggttcactcctccgcaacggaaaacccagagagagaaaacgtcgcccaccttgaacgttttgtcgttcttatcaaccaccttattccaacctttaacaaaggcatagctcttggtccacttatgtaactcaagcacgtactgttgcgattcaggatctataaaagctactctcaaaccagccgtccgtcgtttcttcatcttttgtgcctctatggttcgtttttcatcttccgttaagaagcctgaattttccatatgcatggaagaaacttggagtcgtgactgtttgtcatcgagatcacacttgaagagagtcttctttggaatgattagttgtggatgatacccattcaatttattcatggatttcagcagtaactccggctgttgcatctctgcagaatctgacattaaatctagagcacagcaaaagagatagaatgatcgtgtttttttcttgcgtttcaagaaattatgtaaagagaagaaagatagaatgagagtgtgatgtatatatatactgtatgttctaactacacccatttagaaaacaatatttactttgaataaactttgaattaattacaggtttcttgacccttttctttatttaaacttgatctccattggaagtatctcaatgagatacccaacaaaaaaaaaataattaaaaaagaaaaagtatgagagaggtgagaaaaagtaggagagaaggagagttaagtttctcggaagagaaactttgagaaactattttcatccaatttggacaggtgtcatcatataattagttcaactattaaataataattaatatatctgttttgattaaaatattaatatattttttttttagaaactttccttatttttattgaggagatggtcttaacatttaaaaaaaaaaaaaaaaaaaaaaacgttttgtggtttcaatttatgggggagaaaacgatttcaattcatataatttgatgaagctttaataataacaatgttgcaaattaatatattttcggcaaaataaaaaacaaatgttgcaatttccttgaatgattcttctggttaacggaggagccgctacttcaatccatcccaacgccgctcgattttatcgaattgggaccatgagtcgccaaattcacggagctgtatcttcttctaagcacatctccttaaaaacccaacaccccctctcagattccaactcaggttcttttctctctctcgctctgtctgttcaaattccttggagattgtgtgttgctattagcgtgactagtatgtttcactagaactagcctatggagcttctgggtcggagactcgagtgtatacccggaaaaaaaggctaaagcaggaaccttttgagcctctggagaaatattccggcaaaggagtcaatacccacaaagtaagtttcctcaattgagcgtttagcattttgtagaactgggttctggagatttatctctcaagtgtgataatttctctaaagtgtgttcttacttggctcagattttgtcttatttgtccaaatgtcttgagttttaagttaatctgactcagccctatgggttgttagtgatcctagtgtttttaaatttgttcgccctgtgcttcagcaaatgagagaaaaccttgattagtgttgccatttgttccatgaccatatatgaccttgtgttagtattttactatttagagtcttatgtgttgcttaatgtaatgtcttccatcttttcatgtctaatgatgcatcagctgtgtggtttacccgatatagaagattttgcttacaaaaagactattggatctccttcatctagtaagtctccttttataaactcacaactttcacattcccaaccattcattaaacttaatatcaatcaccaggttgaaaaaatagccaaagaacctgactactttctaaactagttgcatgatatgttcttgtcacttgaatgtctcaacagatttaatctgaatagaagttggtaggaaaagttctatcatcaagaagattctttaaacggtcaagagatattaattatctagcttttgcaggcaggtcaacggaaactagcatcactgtgacttcagtcaaaacagcaggtatg

SEQ ID NO: 13891 - DNA, 3000 bp, Unknown
  misc_feature (1)..( 3000): cDNA_ID_3032673_gDNA_ID_2214665_Annot_ID_136571 3000 nt of promoter + ATG
gtttgtcgcaacgttgatcgtcacttagctgttgatgttgttgatcatcttgtaacaaggggaatggattggagttataagttggggacgactggtatcatcatggagaagtgaaatcagtatctgattgtagaaagaacgcaagtcagtggaaccaagagattttagggttgttcaaagctgctgagtttatagatgaaaagctggttagtcaaggtgatgttgatgaggctgatgataaggaagaagttgagttttcagcaaagctagctgatgcagaaacacctctctatccaggttgcacaaatcacagtaagctctctgcgattgtttcactctttagcctaaagactcaaggtggttggtctgatagaagttttgatctgcaactcgagtccttgtcaaatatgctacccaagggtaatgtcttgcacacatccttgtacgaggtgaagaagtttcttaaaacctttgatatgggttatgaaaagatacacgcttgtgtaaatgactgctgtttattcagaaatcagtttgagaagctcgacagttgtcctaaatgcaattactcacgatggaagattaacacgcgaactggtgaggtgaagaaaggtaatccacagaaagtacttaggtactttccgatcattccacgtctcaagaggatgttcagatcagaggacatggcgaaagacttacggtggcatttcagtaacaaaagcaccgatggaaaaatgcgtcatccggtagattctgtgacatgggatcaaatgaattagaagtatccatcatttgctgcagaagaaaggaatgttaggcttggactctccacagatgggtttaatcctttcaacatgaagaatgttaactatagtgcatggcctgttttgctagtcaactacaacatgccacctaacaagtgtatgaaagaggagaacataatgttgacattgctgattcctggtccaactcaacctggaaacaatatagatgtgtatctagaaccgctaatagatgatctcaaccatctgtgggaaaagggagagttaacttatgatgcattcagtcacacaacattcacgttaaaagcaatgcttctgtggaccatccaggattttcatgcatatggaaatctagcaggctgcaaagtaaaaggcaaaatgggttgtccagtatgcgggaagcacacagatagcttgtggttgagtaattgcagaaagtacgtgtatatgtctcatcggaagtctctgtcacccacacatctttataggcgaaagaaagcatggtttgatggtaaagctgagaatggaagaagaggtaggattctgactggtcataacatatatcaactcctaaaaaaatacaagaatgattttggaaatgtaaaagtaaaagaaagaaagatgaagatgaacgattgtactggatcaacttctggtactgatgatgaatccattgcatcagaagaagaggaagaacaattagatgaaggtgagctttcaagatggaagaagcgctcaatcttattcaagttagagtattggaaggtatgatttattatcaaagttattcaagttcagattatttggagtaagttttgaaaaataaatgtcttagccatttaagttattatctgttactattttgtctaggaaatgccggttagacataacttagacgtgatgcacgtggagagaaatgttgctgctagccttgtctctacaatgctgcattgtgggaagtcaaaggatggtattaaagctcgaaaagatctgcaactgcttggtattaggaaggatttacatccccaagcccgtggaaaaagaacctaccttcctccagctccttggtctttgtccaaaacagagaagaaagtattctgtaagcggttatttgacttcagaggtccagatggccattgttctaatatttccagatgtgtgaagatagaagattctactgttaaaggacttaaatcacatgattatcatgtgttgatgcaacaacttcttccagttgcaatcagaggtataagatgaattcttttagctgaaattcttgcataatttgatgtgttgtttttaatcttcaatgttatccatttataggtttgttacctaaaggtgttaggatagctattggacgcttgtgtgcgtttttcaacaaactgtgtcagcgagttattgacagagagacagtttctacaatggagaatgaaattgtggaaactatctgcatgtttgagaggttctttcctccaagtttcttcgatataatggtgcatttgacagtccacttaggcagggaagctcgtttatgtggaccagttcatttccgttggatgtacccatttgagaggtacaatccagtagcttataaggttttttcttttacagaatacttttatgcttaaaggtagctgttttatcttcaggtacatgaaagttctgaaggattttgtcagaaacactgcaagaccagagggttgtattgctgaagcatatcttgctgaggaatgtatgcggttctgcagtgatttcctgaaaaagacaacaaatgcagaagaggaaattgaaagaaatactgattatgagaactgctctatattggagggtcgacctatatcagcagccacttcaattactcttactgagaatgagaagaacatagcacatcttgcagtgattcataatatggcgcaacttgatccttatgtggagtaagctattctcttaacttactctttattatttttttaggatattcacaatggtttagatgatgttttgctttctttcaattttagcatgcacctagaacatctacaagattctaatgaaaggtgtagacgggattcaggatttttatggaatactcattctcagaaatttgcttcttggttaaaagaacaggtaaattttctggttttgtattgttttattctctgagatgctatctatatagtaaatgacacttgttttttttaaatagatacctatg

SEQ ID NO: 13892 - DNA, 3000 bp, Unknown
  misc_feature (1)..( 3000): cDNA_ID_2704499_gDNA_ID_2214665_Annot_ID_188988 3000 nt of promoter + ATG
ttgagacttatttacagtggctgccaccggcatttaataattgtttttgataattagaaagtaaatcttcgaattaaatatttgcatttaactacctttccaaaatctctctgcattaactatacgattaattactaaaataaaatttccaaaatatttaatatcatttaaatactacaaaattatcatttttgatattgctttttttttatgactataacaattcgattataagcagcaaaccgtaaagatatttgatagcaattaattactacaaaattataaaatatttagacaatgattcataaacatatcataaataagatcaacattaataaaataaatagttttttttacgagacgggttggcgggacgggtttggcaggaagctacttaataacaattgtaaactataaaataaaaatattttatagatagataaaatttgtaaacttttatatatactaactttaaggaaataaattgtctccgcggtataccgcgggttaaaatctagttaattagtgttatcgactcatgattaaatatatagaattgatataaactgaacaagatttcaaaagtattcatatgaaaagaattaaaaaaaaaagcataaattaaagcagtatttaagtcaatacttttagatcttctctcattgcatatatcaatataagagaaatgatcgtgtattaaattatttggtaagtctaacgttttaaaggtttattatttgaaaaaacttgagtgtcaatgttatcaaagactcaaaataaaattactaaactaataagaggttaggtaacgaacaagtacaacacaaaaaaattagtaaaataaaaagagtataataaaagtagtgcttaatttattaacataattttttattttatttttatcttgaaaaaatcaattaagagtaggattgatgatacatttaatttgcttatttaatatgattaatattttaatttaaaaaatatagaatgacacatgtcatttttttgtgtgatgatgtgtcattcatatggaaagagttggccaactttcatatatatgattagatttctaaatgatcattgccgtaatattagtaaagatgtgtccagtgttttagcaatttttaccaaactaattttgatttacatctttaattaaatatttcatttattaataattaatgtcaatagcatgacattgtaaataagttcaagtacaagatttatttgttaaagtagctgaaaaatgtatatgtagattttagatctctaaataagattaacataagaaatctgtatcggtctaactaatgatgaatcgcgaaggacaacgttagaaaactaatgacgaaaatatgttcatgagaataatatatactaaactaataagaggtttggtagcaaacaactacaacacaaaaaaaagtcattatctagtagtgattattgataataaaaatttaataaaataaagagtataatgaaagtagtgcttaatttattaacataatttttttttattttattttgaatcaattaagaataggattaatcatacatttaattttagagtatttataataaatgactatagatttgaaaagaatgtacaaactaaccttgagtcacagtatcttgtcggaaacatgttggagaacacttgttattttctcttattacatagtatttataaaaagcacatgctattttttggaaaaaacattgtattcagtttaatatatctttttatcatgatattttgtagtaatacacgttttttattgagatcacacgtgatttctttaaaaatattcttattttttagtaatacatggtttttattaaaatcacatataatttttgttttaagattctgttcatgtaaaagaatttcataataatgttttaaaaaaaaaaattcataacgtattatgaaatagcatgtttttaaactaaatataacatgtgaaattttaatgttacatgatattttgaaaaattacacggatgtgtttcgtttacttttcatcttacaacaaataaaggatagctttattatttcctttcttccgacaacgtgggtccatggttattttgtaacaaaaaactttatctctgctagtttcttaatttgtatgttttatttggttatctactaatattacctttaattttattattttttaaatttaaaaatatagaatgatatatgtcaaacttttgtgtgatgcttttgtgtgatggtgtgtcattcatatggagagtgttgaccaattttcatatatatatgattatatattaagaaactatatattacgttgtctttttcaaacaggtaaaaatgttatgagatttatttgatttttaagtaattatttaaattaaaataaataaaaatatatattattttaataataggggctaaatagaaattatgtggaggagaggggctgcgtagattaaaatccaaaaaataccgtaaacaaaaaaaaatattcccttgcgagagagggaagattgacttattggcacgcagccctaggcattttcgtttcgtctccacacgcctctctctctctctcgcttcttcaatcattcatcactccgacgtcagattcaaaatcctccatgatcgatcccaattgatcaatcaataaccttatcttcttcatcttctctgtcagtatctgaatctgcatctggaagcgtgatttcatcatcatgtatttaaccgcttcatcttccgcttcttcctccatcatccgagctgcttcttctcgctcttcttctcttttctctttccgatcggttttatctccctccgtttcatctacttctccgtcgtctcttctcgctcgtagatcttttggtaccatttcccctgctttccgtcgctggagccattcctttcactcgaaaccatctccgtttcgcttcacctctcagatcagagctgtttctccagtcttagatcgtctccagagaaccttctcttcc

SEQ ID NO: 13893 - DNA, 3000 bp, Unknown
  misc_feature (1)..( 3000): cDNA_ID_3032667_gDNA_ID_2214665_Annot_ID_188984 3000 nt of promoter + ATG
tacatgagaaacgctcccatacgctattattgaaaactttaatccagccacgttctccgatgttggtgaagcttttcctcaccggcgtcagaacttctccactaccgatactgaatgtgttctttacctctctagtttttcagttttttctcctctttcagtatatactagattttgacccgcagtacaccgcggggctattgttatttttttttttgaatatgtaatttgtttaaaagataatctatatacataacctattttttttgtattttataaatatacaatcctaagtttttatatattatttggtgtacaatccctagatttgaccctatagtacaccgtgaatcgatttttgtaactaaaaagtttaaattttaattaatataggttgtgtaaaaaatattcgtttagtttattgttttagattatatcatttattttaattgttactttatgatttcaccggtggtataccgttttcttttcatattgacctaaacccgccctgtgaatttaaacattattttggtattgtttttttaataatacttttattcaaaagatataaatttaaattaattttaatagttcttttttaattttataaatgaaaataaaagttatatggctttgtaattgtttgtttatttattatttgtgcaaagaaaataaaaccgtatatatgccgacctatatgtaagaaaaactttagttttgaatatcttacattttacacatatatattgatatatatataaatgtatggtttttattataaatttataatgagtttgtataaatatgtgtatattttaattttagttttaagaatttcataatttttaatactccaacttattgatattagaattacccaaacccatataaagaaaataggtcctaacataattcgccaaaccaatcaaaatatttaatactagattgataacccgtgcttcgcctggatgttaagttttgataaataaatacaaaactttggatttttgaaagatattgtaccatgaaattttaattatattatcgagtaaattttttttgtttgttaatattatggttttgtcaaatttttaatatcaatatattataatatatgtgtgttgttaagtgctatagcaaacggttaaaatgttagatttattgattgtactatttaagtatatgtttttaaaatgtgcatttattgattgaaaacatgtcaaaactaacatgtggtttggcaacccgcatatacgtgcgagattttatattttaaaatatgtattgtataaaatatatattcaagttttaaattttaagaagtatttaagaaatcatttttctgtttttgttttgggaattagagaatagaatttataccatgatattagtaattaaataaattgatacctggttgtatgggtggtatgtttatatacgtttttgtttgcataaaaatgtattaatatattattttgttgtattactgaattatataatagtgtatatatcataatatttgagaaattatgttttgtgcctaaaacatactttggtacataattttgtattttatgtttaattagttataaattaagaattgaatttatagtttaaaaataatttagcgtaagccaaaaataatttttatgtgtttattaaaatatgtagtttggtgcataacaaataatttgatatgttggagaagttaggtgtgtaaaagttataacttaaaatagtatggaatttaataaagagaattgtaaattaaatatttggtaatgcaacataatatattctttataaattaatatttggatattgaaaacatggttttgcaaataaatgttattcaccggcccattagtgttggtgactgaattgttttgggccaaattagaggttaataatgacgcaaatatacattatccttaacccatttatatttctgtttcattgaatattaacaaagtatatattttttattttttggacattcttttcattgtagaaccattgttgtcttatcttaaaaaaacatacaccgaacaaatttaagagcatcgctcgactttagtataattggataatctcatgtagattttctataccgtgtccgtttataaaaaggtaaccttgctcatgaaatcccaatatgtgatttttttttttttgaatagtgttttcaagaagcttgatcttctctatgggtaattattgtcaattgaatttgcatcatattattttcactttgcattggttttgtactttgcatgctttgatttgtttgaatcggttgctgacttcgaattgatacattgcatgcttcgatatccagattccgggccgaagtaagcaattacgattttgattttttatccagcgttttcaactaatatctgtctcgagtttgattttcttcagtttatgcaagattcataatctgtaaattatattgatggctcatcgattcatatattgatatggttatgaatgtcaactaacgaagttatcatcacatacttaagtttaccagttaatcttactatttgcaagtgtttcaaggtttatcagagaaatatttctcgacacattccacaaatttgtgttgctgtttcgaatttggtttcgagagaatgacgatatgctcctcctctatttgatattgatgatgacattcatagttttgaaaatctctttccaattgcattctctagctatccattaaaattgattttgcaatgggactttacgattaaaattgataataaacttgtctaacttctaagtcttagtgctacgattatgaatagaaaaacatctcttgatcaatgcactctcttatggttgaagaaaaagtaaataatgagtagaaatgaatattgcttagtttttttcaaagttgaagacgtatactaaagatttgattgttcatttttgtaaaatcacataagcactgtttcaagttttttttttgaatatacagaaaccatcaca

SEQ ID NO: 13894 - DNA, 3000 bp, Unknown
  misc_feature (1)..( 3000): cDNA_ID_3032673_gDNA_ID_2214665_Annot_ID_188982 3000 nt of promoter + ATG
acgtatataaacataccacccatacaaccaggtatcaatttatttaattactaatatcatggtataaattctattctctaattcccaaaacaaaaacagaaaaatgatttcttaaatacttcttaaaatttaaaacttgaatatatattttatacaatacatattttaaaatataaaatctcgcacgtatatgcgggttgccaaaccacatgttagttttgacatgttttcaatcaataaatgcacattttaaaaacatatacttaaatagtacaatcaataaatctaacattttaaccgtttgctatagcacttaacaacacacatatattataatatattgatattaaaaatttgacaaaaccataatattaacaaacaaaaaaaatttactcgataatataattaaaatttcatggtacaatatctttcaaaaatccaaagttttgtatttatttatcaaaacttaacatccaggcgaagcacgggttatcaatctagtattaaatattttgattggtttggcgaattatgttaggacctattttctttatatgggtttgggtaattctaatatcaataagttggagtattaaaaattatgaaattcttaaaactaaaattaaaatatacacatatttatacaaactcattataaatttataataaaaaccatacatttatatatatatcaatatatatgtgtaaaatgtaagatattcaaaactaaagtttttcttacatataggtcggcatatatacggttttattttctttgcacaaataataaataaacaaacaattacaaagccatataacttttattttcatttataaaattaaaaaagaactattaaaattaatttaaatttatatcttttgaataaaagtattattaaaaaaacaataccaaaataatgtttaaattcacagggcgggtttaggtcaatatgaaaagaaaacggtataccaccggtgaaatcataaagtaacaattaaaataaatgatataatctaaaacaataaactaaacgaatattttttacacaacctatattaattaaaatttaaactttttagttacaaaaatcgattcacggtgtactatagggtcaaatctagggattgtacaccaaataatatataaaaacttaggattgtatatttataaaatacaaaaaaaataggttatgtatatagattatcttttaaacaaattacatattcaaaaaaaaaaataacaatagccccgcggtgtactgcgggtcaaaatctagtatatactgaaagaggagaaaaaactgaaaaactagagaggtaaagaacacattcagtatcggtagtggagaagttctgacgccggtgaggaaaagcttcaccaacatcggagaacgtggctggattaaagttttcaataatagcgtatgggagcgtttctcatgtatgtctaattctaatctcctaatcttctaactaatcttcttaattatgcaattgatatccatatgactttacaatcatcaaggtatcaagcatcctttaaacttcaaaacatttcttttcaacaatttgatgcaacactcgtctcttttgatttaatagaagactcttcaaataaaacttgtttctaaaaaatcacccaatctggttttgtgataccagattatatcgaatatcttagttataaatagatacaacgatcttatagttcttgtgatttcaacatcatcccttgcgaatatcttggactatacaacatcatcatgtgcacttgcagtagtcgtgttatcttttgaggtaaaataccaaagcgaaataaaacatgcatcactgttagtaatactggtagccaacgttgtaaatgttgtttgaagaatcatagggatgagagccacatcgcgaagttcctaagatgatcgtctgcagcgtgttgttccaatctggagtagtatgcattcaaagaagaggagtgcatagatctgaccaaatgtagaatgtatacggacaagcaaagaaaatgtggtctctagtctcatcacgttcaccacaaaatgattgctcttgtccccaacgtcacattcactgacctgtagagagcctatctttaatggccagccaaatgactgctcttgtccccaacgtcgcatttgctgacctgtagagagcctatctataatagccagccaagctatataaatgacactttaggggaagaggtacgtatgatgtcccaagtgcattttgaggagaaaagtggctgaaactctccttctttatgcttccaaagaattttatcttgtcaagccaactgacatggaaggaaaatggcattgattctatcgataactactctgtaaatttgcccccgagctcgacgtagatgccatctttcattttgtacatcatctgcaacatatgcttgcttgtcaataccaagatgaagtggtccccagtcacctgttgtatcaataaaacgcactgcaccagtccaattatcccaccaaagcattgttgatttcccattgtttaagtctacttgcataagtgaagctgctagttgcctcatcttaaggagtttccgccatatccacgatcccacactactctcccaaacactctaatacacattttgacgacaccatgctacccaaagtgatacagatagtgtgaaaagtctctagatgagactgagcgcaaaaacacaagacgagtcttgcatcctttggtttacacacttcctcccaagtaactttcgtttttgtgtcatcggttgtgtgaccataagaaaacattgcacaaactaccaatgatttcaaagcaacgcttcgggtaaccgaaaaatagaacaccaaatttttataatgctcatgatgagggattatgatataaccctattattaatgtttttggctatgttttagatacaagttttagagtctttttgttatttctagtccttttagagtcttttcaagtattctatgtattgagacaagaatg

SEQ ID NO: 13895 - DNA, 3000 bp, Unknown
  misc_feature (1)..( 3000): cDNA_ID_3032680_gDNA_ID_2214665_Annot_ID_188980 3000 nt of promoter + ATG
cctcttaaatcgtgaagtatatatatatatatatatactacgagaaaacatggtattagcgactacactattcatagctaaacagtcgcttaatcgaaatttacgactatttggcgactaaaacacgtagttggcaatacaagcgtcgctatattgatatgtagccaaacagtcgccaaatggtgaataactagcgactacataagtagtcgccattgggtcgccacccagtcgccaattagcgactgtttggctacatttatgccactatatagcgattagttggcgactgattagccactaccgggcgattgttgtaaaaacatggtaaaaacatataattaatatccaaaaactatttttcttcctcgattctcattacctttagaccggttttagttagctttaaacttcggaacttcgacgacggtcgtggctagtcccccaaccagcaacgcctgtatgaagtacccagtaagcagttcttctttcacaaccttgcaattacagcttgaggaagccaacctcaagatagatgaacaagctactctacaagcacatcgtgaggcagaggctttgcgggttgcagctgagcaagcagagatcaagcgggttgcaaatgagcaacaagcagagatcaagcacttgaggatggtgaagaagtacttgaccacaacagacccaaattttctcgccttcctcaaatcttctactgtttcagaagatccaacagaagagttcctttagctatcccttcttctcttctccgtcctttaaaacttgaaaacatgaacttgttgcgtcggaggaggatagtctctgacagtggcacccgtcgaaggctgtgcaattagatttctatcagggtattgaactggcggttgacgatccgccggcgtgaactcgtactggctggaaagtagtgggtcgatttgggggaatcttcgatacccttccttttcctctcttgccttttccaccacgagtcctcatcacttgaagctaagaaacgagagattgagaagattgaagatggattgatgaagaattgggatcgaatggctaaaagggattagggttagggttcgtcgagagtgaagaaaaggggattagggttagggttatgcgataaaatcgtttatatattctgggtaatgggctcttgttactggatcaagccggtaaaagcccaattaattgcctaaatagaatatatgagtcgataaatggtaactgtaactagcgacctattagcgactaaattaatcagtctcacattcaagattgattagagactaatgtataatataaactaattagtcgctaatacgtcactatttagttgccaaagttaacgactacttaatccgtcgccgaataagtcgctaataccgtgttttcttgtagtatataacacaactcaatgttgataaggacatttgcttcttaaggaaggctggttgggaagcactttcatagatcgtcctccgtttcagagtttttactcagtttttgaagttggtagttaaatttcagctaaaaccaaaaagatattggattgcttgcaacattagtttgtgtgtgttacattaagtttaagattaattatttagcatcctaattacttgttacataaaatattttttgttatcaaatagctactaaatttgtttatgttcgtatttatttattttttaggatctcaaactgctctctcttccagcaccaccaaagcataaactttgtcattcgtcatgtcgttagtaaagaatatgtgagatgtgagagcataatcacctacgccaatttttattgaaatatttattttaatgtgattaatattatttattgaaatgttgaatttcttttttttagttgtctatttattgtttttttgtcaatcatttgtctatttattgttaataatttaaatttcttcaattttaaaattactatggtagttcattcaatttaaatacacagctaaaaaaactctaatacgacttttaggattttataacatttatcaaaagaacatcctttttgtttaatagcttttcctctacttttagatatttggacccggtctttttatgtacgacattttaattaaatttcatgaaataaattattgtatgaagattaacttcaacaactttctcattttggtatgcgcaaattcactattgttttatgtgtctctccactgcactagttagtatagctattgtaaagataagattatttacaaaattatatccataacttataagattatctatattttttttaacaacttatattttttctttgaaagaaaaaaactcattttttttcttacattctttcgatatgtatatgaatttccgtcctcacatttttttttaggagctatcatttttttatgtctttttgcaagcactcattgtctttgttttaatctcttttccaattaacacatcttcacaaaacgcaatcagacgctctcatcagaacaagaaaaactactattagtctcacatgattacatgataaacaacctaacaaacataagcatatatattaggttggggtaaaaattctggaagtaacaaagatgctgatttccacgggatatagcatgtgggaaggaggaaagtcatagtgatccattagatggatgtaatgcaagagtgagcaacatacaagaaaaaacgatctaataacgagagttgttttcaaatacatgtgtccccaaactatctctcccgaagcttttcttgtgtgagaaacctaacttcatcgcatcttgccactttagtgtccgtttaagaccagcgatgctagagggctttaggttaccttggtcttgattctacttgtgcacttgaagattctagagagttatgtcggctctgtttctcgtggcgtgtgtcgaaggaccgccatgcgcgtgggctctttctgatggctgaaatctcttgtttttttgcctccactacctgtagccggtgatggatg

SEQ ID NO: 13896 - DNA, 3000 bp, Unknown; identical to SEQ ID NO: 13892
  misc_feature (1)..( 3000): cDNA_ID_2704499_gDNA_ID_2214665_Annot_ID_136572 3000 nt of promoter + ATG

SEQ ID NO: 13897 - DNA, 1441 bp, Unknown
  misc_feature (1)..( 1441): cDNA_ID_3020316_gDNA_ID_2214666_Annot_ID_136574 3000 nt of promoter + ATG
aattctattagtattatatatatatatataaatagttgttagctttatttacgatccatatatattaaaaacgtctcatttttctattcgtgttagtttagtcctcagaatctctaggaatggtcatgaagcgagagtatataaaagacgacgaggtacgtatccaatattgataatgcatttagcaggttcatgtgtgttaagaaaaataaaataaaaataacatattctaatccctaggaattttagctagaaaaataaaataaagtataagatgataaaattaaactaaaaaagaaataattacaatacagaaatttgatattttctaattatctattaaattactatagctgaaaatcataaatagtttaactatatgttatttctcttttaaatatatggtttgttaaacaaatacatttaaatatgtgtatatgtatatatgtatatacaggaaataaaatttatttcttaattgatgtttgttatcattttcttgtcttctactagccagttagtatattagttctgaccatttataattcccctctctaacctttattttattaatttaaaaaacaataaatatagtatctaaacactaatatgtatcataaattttgtaaatcaagtctcctggcacgaccctgaccgagatgttcaaagacaaagaggtataaatactatttggtcctattatctgcattttagtgttatatttcttgattataaattttattttatagattaaaaatagtgttaattacctctattaattttaaaaataaaacattgaactttatttacgatgcatatgttatccgaaataatattaacgtttcatttttttatttgccttagcaccacaaatctctcggcaccgccctgggtgagatattgaaacacaatgaggtatgcatgtattcaatattgataacacatttagcagattcaattgggttataaattttattggaaaatattatatttttatccctaagaatttcagctagaaaaaaaatatgatgataaacttggactataagagaaataattacagcatacagatttgatattttctaatcatttattaaaatattatagctgtacatcatagaaagttgtactatatgttatttctcttttggttatatgactattgtttttgttttggtagtttatatgactattgtttgtaaaacaattacatttatttagttttatccaaaaaaattaatcgttttttttttttggcattagccctccacatctctaagcacagttctgggcgagatgtttaaaaacaacgaggtacgtatttagtaggttccggtgtgtgtgtgttagtgtgtatgtgttttttttttatcaattgttgttatactattacttgtaggagaaggaacatattttttcggatctagaacgaggaacaatg

SEQ ID NO: 13898 - DNA, 3000 bp, Unknown
  misc_feature (1)..( 3000): cDNA_ID_2704510_gDNA_ID_2214666_Annot_ID_189003 3000 nt of promoter + ATG
agaagcatgaagcgaaggtgaagaagtatgtggcgaagtttgaggagattgtttggggagagatgatgacgtcactttctgatgatgtgacgatgactgcggaggaagggattaagcggtttagtgatgggtttgaggaagcgtataagagacaaaccggttggattgtaccggattcgaaattgagagatgagattaaacggtctgttgggatgatgattataccgagatattccgggttttgtgaaaggaaccgggtcaggttattggagaatgtcggatttgaccctgaggatattgggaattatctttcggatttgtattttgggtctggtggatcagggagtggttcgtcagttcattcttcgggttcttctgtttaacacgtttgtgatgatttaatttatattgataagtaaataatattggtatttgatatcttgtcccaaaaatagaaagtaaatatattgatgtaattattttggaagctatggtatttttattagtctttatgaatagttttgtgattgtaaaggaacaaaaggaaactaaagtttaaacttactacatacttctgttttaggaaaaaaaaaattagtgataaaatacatacgaattagaaacttagaggacactggtcaatttatttatcactatcacaattcgatacattgtccaaatatacgaattagaaactttggcctttcaggttgaacattgtccattttgttaagtttgatttcggttaaatccaattagagtcaataaaccagtttactggttaagagttggctcttgtacgaagacacttttgcatttctaggtcgaatgaattaatttcttaactctcacggcttgtcttcctcaatagtcatcttgtagactgagattagccattgtattaacatgataagtaaagactaaagacttacgtctattcaaaaatatttagtgtattataacgataatctatgtaagaaagatgaattcaatcaattcagaaatctacataatatatatcttaacatttattttcaagatactataaacactaaatatacatgtagcatgaaattagacacaaattttcgaatcttaaaagcagctcaaaatatagttagcattttttttgggttcacaaatatatatttcatttatattaatctcaatcccatgcgtaggcaatttttagcgactatatatggcaaagtatttgtttgtatattttccacatttgcaaattaaacacaaatggctttcaggtttcctctcatggccttcctcgtattcgtctctctctatttaacttccggatattctctttcaacaatatatgatgtctcgaagtaagaacacctcatactcctatatttcacttgtttcattttggttgcaactaaatacatacatattgtattcttttctttttgtttagacatgaagatgaatcttatgttatggctacgagtgatcatggatcgcctatgaccgttgttgaagctgaagtaagaactccaaatcctcaagctctacttgatggctcaaaagtggttacgaatactgtagtttctaagagatcatcaagcaaaagtaaaaaaggttctcttaactaaagaaaattgctttggtttaatttacgttgataagagattctcttaagcttttagtatatactaaatttgatattaaaaaaaacttcaaaaaatttcaggttggaagaagaaacataagagcaagaaagtaggatcagtggatgttgaaatctgtgtcggaatcatcgtagcaattgtggttatcattattttgatttgtgttgtatactttttttgtctgagaccaagaacaaaaagggctcaaagtatatagtccacaatgtaacttgctacattctatatgtctttgtaactcaacttaattattacattctctatagattagttatttattaatgaaatgctagtaaactttatttaaacatctatagatcatcgaaaatttagactcccaaaacagaggatcgtgtcttaacacataatcgttaccatgagttggggagagctaaattgtttctcttctttttttgctaaaagttttttctcttcttatgtgcgtgatttgttttagtttttactaattaattatatattatggcttccgtgaattattgttctcgttatttttataattaatatacttctattgaattattgatcttgttatgaatcttgattttaaatagagtatcaaactccataatgaaattgttttaatgagtatcaatattgagtttgattatgaaattgattacaatggaactagtttaaagagtatcaatttcaataaatatatagatataatcatatgaaatttaaaagtatccaacacaacaagcatacactaccatattgaattagatatatatatttaattttcagaacaaaacaaaactaaaattcaaattgtctgttggtatttttgaagcctcggaccccaaagtatagtttttccaaacttgatactcttacaattagattctctaaatctagattgtttaaagatatactatgtcgaaataaataagaaattaagattttcatatataacgtttctccttttttcttaagtaattgtaagattaactctatttttacattctacatttagacatcactctcaagtctcgtaaatagactgacgtatccaaatccattgattttcgtcttttttataagtagaaaatctaaaattgttagactacaataaaatcaaatccactttttaaattttttataaagcaaatggaggataaccacatgctttaaggaactcgaatcaaagacctcaaacataaaaatagtcaaatcaaaaatcaaaacatacttcctttgaacctccaaaacaaaacaaaaatcaaactttaaacatcttttcttcacgttctatcataatttacaaaactaagaaaactaaaacacaacaacacaaaacaaaaacaaaatg

SEQ ID NO: 13899 - DNA, 3000 bp, Unknown
  misc_feature (1)..( 3000): cDNA_ID_2704518_gDNA_ID_2214666_Annot_ID_189008 3000 nt of promoter + ATG
tgaaagcaaaagctaatgaagaaacaaaacttcaccaagaagaagtgaagaatcttcttcatcttctcaaacttgctcgtcaagaaagagacgaagctaaagatcaattacaaaaacttctcacaatcaaaacaaattcaagcataaccgagtcaaactctcacggttcttcaccggttgactcgttcttcgaaccggtctcatcctcggaattctccaatttcaacatggtacctgaaccgattaaccaagtcaaattcaagaaccgacaacaactcgttaaccggaacttgaagaagattgatcctgtggatgctctaatggatgagatcataaaaggtaaagctttaccggagaaagggaagcttcttcaaactgtgatggaatctggaccgttgcttcaaacacttcttgttgctggtccacttccacggtggcgtaatcctcccccgcttcaacagagctttagagtccctccgatctctaactcttacggttgtttaccggcgacgacaacgacttcaatgctgaattttagaggttgctctgttcctagaattgctaccggaattgaagttgcaactaaacgacaacgatttcattagtgtttttgttgttacaattatttttcttttattgctctgttttttttttggttatttacttagttatttggaattatattattgtaaagatttaaaaatcgtttttggagggtttaagagtttgtgtgtatattggagtataaacgatttgagattctggagtttaggtattcatgaattatacttatatcatcattgatcctgattccatatagtataccatgttcgattaagtagctaatttttggataatttgatgacataaaatgagttctagaccttaatttatgtggttatgcttaaataaaatatttctaagttttctcataattatgttttaaattgtaacatttaaacgcagaaacaaacaaacaatgaagacctaaaccaaacaagaatttctgatggaaatttgagttgttttcatcaacttttattaaaactatagagataaaatacatgtatttttggcctggagatcactggtgtgcctaactctcacagttgtagagtataaagatcaaagaccctaaagtagagacaaatcaagacagaggacttggtcttgtttctaaaaaaatattcaattaaagacaatacagttttatgggttggattgtgaccagtgtttgtggtggctttcggtcatgttcttgtacaaagttaggcgcaaaacatgttctgtttccttagttgcaactgctatgaacggccatcaacttcaactagtttcaaagaagttgcattgttgtgtcctcaaatcactgttacataagttgaaaaattaaaattgtttggcttttgaagatggagaaaataaggttgttccttgaagttttggtcatttcacagaacttatcgatgttatcaaaatgaccatcatctttttctccttagagaaaaaaaggattaattaaaactgagttttgggctttgtggagaactagactggactccactacagtagtcacaaaaactcaagtgggctttgtaagcttattacaaaaacaaatttccatcacaacgcaaactaatatatacattttaaaaaaaattattaaaaaataaaaagtgttacatgtaagtgaacatctttagggcctgaatgtggagcaagtttactatctaaattatttatttatttattaaataattgtttttttttgtcgacttatttattaaaatattttaaaaatggctctcttgattagaatatataatagggttcttagccgttgcaccattcttgacaaaaaaaaaaaaaaaaaaagccctcgcaccactagccctcccttacgaacagtttgattatgattattaaaacatcatttattatttaataaaacaatctatagaatataaatcgtcaaaactaagaaaaaatacttttacattagaagttgaaacattatccaatttaaaacaatttttttccttgaaacggaaggagtaaaacaactaaaacatcattaaatagaacgagtagtattcccaaatggataattgttgtagattcttgggaagaaataattcttcaaacatatataaaaaaaaaactcagtcatttactcatttgcaattccgtaaccgacgttaataatttctaaggataaataagaattaaattagtaaatataataatatccatacatagatgattataatccgaattcaaatattttttcctacattcccgattttgtttttctcttaatctttcctctttgcattatccattgatgatagaatataaacagatactattttataatttacatacttgtcgatcaatctaataaataaaaaaataattatttccttcaaaccttaaaggcttatacggttataccacctctgcctcgtataattttgtttcctcctcaacaaacaaaattaattactaagcaaatgataatatcatttgtactcaagatcgtcaataatataaatactatttctatacaagtaaggaaattggtttaatataataggagttttattaaatttaactcatatctatgatgttatgtcttaatatataagttgtatacatgatttattaatatgattttatctattatggagttataaatgaaatgatttagtaatacgtaatattgaaatagatacttgttgaagaaaatatgaattagttaattaaggtattatccataatttatccatattggccatcgtaattatccataaattggtccaagtaattatccaagtcaaagatacgtttccgaaaatctctcattaaataaccggatatgaattctcaatactataaatacgtgctctctcttcctattcgatatttttaacaaactttctcaaatattttcttacttttgatactctcataatcgtttagatcaagtgtttaacaatg

SEQ ID NO: 13900 - DNA, 3000 bp, Unknown
  misc_feature (1)..( 3000): cDNA_ID_2704529_gDNA_ID_2214666_Annot_ID_188995 3000 nt of promoter + ATG
aaaacttataaatggtccatcaaaaatcagaaatttttaatatttggtcagctttatgtgttgtttagtcgtacctcttaaagcaataagagttttgtaagatggattatgctctaaacatggccttatagaaaataacaaccacaccagtttttatgtccgtcaattcttcatacataagcttcctttccaattccatcaactccaaaaataatcttagaatgacaacatttaaccattttgactctccacaatgtaaatcaattcacgtgaactttgtgatttatcttttaaaagacacaacatagaaaaaaatctcttccaaaatttggatatattaccactcgaagtggttaaccatgccttaatcaaatggatagacctggtttcgtcccattagaaatgatcttcatcttccatcgttataagatacatgccatcaaaagctacatgatcctcctgatgatgaagtgtcgacgatatggttcatgaaacgcttccaagacattcaagcaatgaagaatgggcgtgatagatacatgaggactctctagtcctttgacaacgtatatcttctcataatttcgtgattggtgagctttaagaaagattagctaattttatgacaaatatcttgacatacaaaaaagttttgacctagcagctcccacaaagtcacatctcactttgacttactccacaagacccaaatttaactacacgcaccttattggtcactattaataacccttataatacaccttcccgtagacaataacttacgtttcttcttcttcttcctttaaaaaagttcaaattaagcatctcttctctcactttaccctcttctctctctctgtctctctttctttttccgtaactcttcatcttcttttcccagatttttccgttttccaattctctgtgtctaattccaaacttcctaggggttttttctccaacgtgagaaaaaagcttctagctttagcgatgggatgtttcggacgcactccgaaatcgaacaaacgatcagataccaaaaccacgaagaacaacgatttcaccccaaaaaaactcaccgtcaatgcaaatcgagataagctgacacaacccagctcaggtatcgacttgatttcgcataaaaaatcgatttttatttcgaaatttagaatcttgcgataattaggttttgtgttcttaatgttgcatttatggattcgttctgatgtgtttgttgttatgtctttgttgcgtagattgtttaaaagttagtatatgtggagatgtaagcaaggagatagttactaagaaggatcaattagctttggatgctaaagatactaatgttgaagatgaagttatagtgaagaaagcacagacttttacatttgaagaactctctgtttctactggaaactttaagtcggattgttttctaggagaaggaggttttggaaaagtttacaaaggtttcattgagaaaatcaatcaggtttagtatttgtatcttgatctaatgagttacagtgtattgtggctagtttggttagaggttttaagagtttgtgaatggtgtttcgataggttgttgcaattaagcaacttgatcggaatggtgctcaaggaatcagggagtttgttgttgaagtgttgacattaagtctcgctgatcatccaaatctcgtcaagcttataggattttgcgctgagggtgttcagagactgttggtttacgagtatatgcctctaggatctctggataatcaccttcatggtatgttatattggtattgcatcacattgctttattgattatgttaacttgttttcgtgtattctgtttggttttagatcttccttctggtaaaaacccgcttgcttggaacactcgaatgaaaatagcggctggtgcagcaagaggactagagtatctccacgatacaatgaaacctcctgtgatataccgtgatcttaagtgttcgaatatcttgatcgatgaaggatatcacgcaaaactctcagactttggattagctaaagtaggaccaagaggaagtgaaactcatgtttccacaagagttatgggaacatacggttactgtgctcctgattacgcattaactggacaactcacattcaaatcagatgtatacagtttcggagttgttcttttggagcttattactggaaggaaagcttacgataacacgagaacacgtaatcaccagagtcttgttgaatgggtaaagactaaaaacatctctttctcctttttctaattgagcatcataattcacagttttgactgtaatgttacaggcaaatcccttgtttaaagataggaagaatttcaagaaaatggttgatccgttactcgaaggagattatccggttagaggattgtatcaagcacttgcaatagctgcaatgtgtgttcaagaacagcctagtatgagaccggtgatagctgatgtagtaatggctttggatcacttagcttcttctaaatatgatcgtagtcaccgtcaaaagcaggataatgtgaccgagactaaagtcgatgaagagaaaacacttaccacagaatctaatgtttgtgtggaggagaaacaagagatcaagatatgctcagatcaagcaacttaatcatcaatgaggattcttaaaattttgatattttcttgatttgtagaatgcttcgtttacgtaagcaacagttttgttcgaatttcgactcatacttatatagtaaactgtagcaaaagttcggtttatcagaatcttaaaccattacgtatgggaaagtccggtttatcaccaaaccagtttatggaaacgaatttgtatgatgttctaaataacgattttaacctcaaagcttctgttaaattacgattgtgccataactatataaaggagagacccgaacaaacaatccggaagcggaagctaaagttaagcaacggccgccgcgaagctaacctccaaagaaggggaaaa

SEQ ID NO: 13901 - DNA, 3000 bp, Unknown; identical to SEQ ID NO: 13900
  misc_feature (1)..( 3000): cDNA_ID_2704529_gDNA_ID_2214666_Annot_ID_136576 3000 nt of promoter + ATG

SEQ ID NO: 13902 - DNA, 3000 bp, Unknown
  misc_feature (1)..( 3000): cDNA_ID_2704537_gDNA_ID_2214666_Annot_ID_136578 3000 nt of promoter + ATG
aactaaaacataatttactacttacacaaaatttgatatagagcttttattttctttttttttggttcaactaaatagatatactgtacagctaaatcaatatattgtcccttcaagaaaatcaaaagagatacaattggaaaaattcacaaacatatcttttatagcatgaatgatgtgttttaggttgctagaatcgaagttactggatcgggcacaagatacaatggtatgttaagtctgaaagaggaagaatgacagctaacaaaggcaaccacaacatctctgtagaatccactcgaagctgcaagaagaaaccaagaaattaaaatcctaagaactaaatgtaagtgaagagataaagagagaaagagtagatttacacatggtggagacaagaacatggtctatctctaggaaacatgagactgctgttgctattatggtccaacgagaaaacaaaagaaagattgttttcaagaacgtgactcttgttgcttgaaccttcaggagaaaatggttgagacagagaagaaacagaggaagagaagtcatatttttcacagtcaactccgtagctcacaggaagagaagatgaagaagacgacgatgaaccaactctctcctcttcgttcatttttccattgatctttctctctctttctctctctgctttgtgttttgaatctttcttgtctcccgggaaaattttgaaacttaggtgttaaacctaacggtcatcaactaactgttacaacaccaactagcttttattacttcccctactacatgcttaatctacttacgtgagtgacgtcaattcttcggttagaaaaaaaatacacgagtttcagagaaatgggcctcttaaaggtttatcttgggcctataatgtgaaattaatgactgggcctattaaaggtttctctttgacaactcatgcaattacatttatcgtcttaagtgaatcaatattgtacatgtaaataaaaattgaatctaccttaattatattcgctttatttagttatacacacataaaaacaaatgtcaaaagacaatatcaatcaaagttaacattatattttttttttaaaacttaacagcattcaaattttctatttaactaggacaaatctaatagggaaacgaaaaacccaaaaacaaaaactataatccaaaaactaaaatttgaggcaccaagtaaaattaagtcacgtgtgtgtgtgctttcacatctacgtacttgcgtgtgttattccctcgacgtgaggccaagttttttttcatttgacatttacaaattgattaagattatagtactagtattttttttgttaagaagattatagtaatatattattggtatgttttgtttttgtttttgttcaatccttcaaacatatatgactgactccaaaacctcgagactagatttgtgttcaaaaggttttgaagtattgtaaaacgatcgttaacttattgcattataattctaagaaattagtctgattaacattaaaaccaatgtttacaaaattggtaggtgctaattaaacagtcggtgatcaaatgcatgccgtctaaaacatttaattggagactaaccaatttttaggtggtttagacattcacaatatacaatattataaatataatttaatgtatcatagatgaaaattggataaaacttatgttattaaaaaaataaaaatattcaatcaaaaaataaaaattaaagaaaatatttatttgattcatatcaaacaaaatattaaatgataattatttaccgatatttaggaccatatatcgctttttaaaccactgattaaaacgaaaagaaaataatcttttgtcataaactcataatatagcaataaagtcatatatatattagattcaacatgttatcgacgaaaactgatttatttacttgaaaattaaagtttaataaaatcacaggttggattgaagtagtaggaaattaaaaaaaggctaatcacatattataataagaattaaggggttaaaacaaaaaaaaaacttcctagatcaaaattcgaaagttttcaaatcaccttttctttatttgcgtgtttgtcctttttcacaacggtcggatcacggattttacaacataacggttcaaaaatttaacgccgttagcatcctaccgtctcacaagtcaaacgccagcgcctgccgtaacggctcatttatttttatttttttaatcctcccaatttcatatatttttgctcttcgtttttaatttaaacctttttattagaaagaaactctttgcttcttatatttcattcatcaatctctcttcttcatcggaaatataaatctaccatcgccagaaaatttcaatatcaaattcgagttctccgagattgcttcgaggaatcggaatctaaactccgacgttcgttgtttgttcggtacattttcgactcatgtttcaattccccagaatttctggagattcggtgacgcattgaatcttccatttccgaatctaatcgcggtttctaggtttaatttggaatacgaattcgatttttgttaaatgtttaggacgtgattcaatgtattcttagaaatttgttgattagattgatgttttcgttagattaagaccatctccaatgcgcaactctatatttcctctattttacagttgactctataaaatatagttgattttactgcattgtatgcctctaaaatagaggaaaaatgtagagattgctcttttattagctcaactatatattctctaaactctaaaatagaggaaaatatagagttgggcatttgagatgctctaatggagtttaaattttattgattgtgattttaagcttgttttgtgtggatccattgacttattgtggtgattgatagagatttgtttctccgttgattgcagagagagagataagatagttttgttgcttacgaaactgtaagaaggtagagaagataatg

SEQ ID NO: 13903 - DNA, 3000 bp, Unknown; identical to SEQ ID NO: 13898
  misc_feature (1)..( 3000): cDNA_ID_2704510_gDNA_ID_2214666_Annot_ID_136580 3000 nt of promoter + ATG

SEQ ID NO: 13904 - DNA, 3000 bp, Unknown; identical to SEQ ID NO: 13899
  misc_feature (1)..( 3000): cDNA_ID_2704518_gDNA_ID_2214666_Annot_ID_136584 3000 nt of promoter + ATG

SEQ ID NO: 13905 - DNA, 3000 bp, Unknown
  misc_feature (1)..( 3000): cDNA_ID_2705502_gDNA_ID_2214667_Annot_ID_136591 3000 nt of promoter + ATG
accatcgatgtctattgtcttgttgtcgatatgtcacatcaaaagtatagtgtatttcttcacacaagcaatgtatatatgttcaaatgtgtctgcttttacataaacaaatctaaatcaattacatattcatgcacaaaataatttattttatgtttagtggtggatcacacccatcataactaagactgatggggaactaaacagaaggtaaaattcgttgttcttgttttgctattgtgttgaagttgacttaagcatctcaatgtatggttgttttaagtcttcctcaatcaccggttctatgactacaattctatgactatacatatatctttgcttgcatacgtcaactttactaaaattaaaatgaaaaatgaaaaatataagaaggttctatagatatcaacgtgtttgattcaataaagagaatggtaaacaattttagatatattcacaaagtcagaagttttagccacaatctggaaactgaagcaccaatgaagataaggcaatcaattatttgaatcatagtcattctggattttatagaggaaatgatgagacgtttcaacttacaatttaagtggagaaagaaaacatttatggaggagaaataacgcaaatgcgtgaaaaactaatgcatcaaaaattttggatgactgatgtggcaagatttaagagaaactcttatttgctgaagtggatactttgacaggtctcaaagagttatttttattagtagtagattatagagtaatattagtagataaccaaataaaacatacaaattaagaaactagcagagagaaagttttttgttacaaaataaccatggatccacattgtctgaagaaaggaaataacaaagctacccttcatttgttgtaagatgaacagtaaacgaaacacatccgtgtaatttttcaaaatagtatgtaacattaaaatttcacatgttatatttagtttaaaaacatgctatttcaaaaaacgttatgaatttttaagaaaaaacattattatgaaattcttttacatgaacagaatctttaaaaaaaaaattatatgtgattttaataaaaaccatgtattactaaaaaataagaatatatttttaaagaaatcacgtgtgatcttaataaaaaatgtgtattactacaaaatatcatgataaaaagagatattaaactgaatagaatgttttttccaaaaaataccatgtgctttttataaatattatgtaataagagaaaataacaaaataaaaagaggatattatgttatcgtatgtatttcggaaaaataacatgttacaaaggacatttacgtaattacacgtgttctccaacatgttttcgacaagatactgtgactcaaggttagtttgtacattcttttcaaatctatagtcatttattataaatactctagattatttctgtttaataaaataaattagtgatagaggatatatgttatatacgttttataaactattcagcttttttttttgcgtcaacaagtatattagattgactcaagcaaatcaatgttgagtaagattgtttacataagtgataatatgtggttcggtacgaactttcgtgctatgtaatctatcttgacattctgtttcaaaaaatcaaagaaaaaaaatcaaactattctttgtcactaaatcgcccccaaatatgtaaaacaaatttcccattcttgtcagaaagatatcatctacactgtaaagaaagtttttctcgtttgtcttggttgataatacatttcatcgtccaaacacttttatctctgcatgtagtgtggttaactttttttgaaggtttacaactccaatatcatgtgttccattattcagataagtacaaaaccatcctagcctttaataatatgtttaatggaagattcaatgttatttttgtttgaattttagtctttttagagagccgtggaaaaatccaatattgaatttatggtccattaaattaaattatttatacatgatttttagtgaatttatctatattaaagcatttaaatatatgagtggtgggtatttcaaattatcaattatggttgaaacattgaaatgatatttattgtgtaggtcagtaagatattttaatataactattattatggtggagaacatcacaatacaagttctatttggaaattaaatttgagtgcttagattatttttttcagtttacaataacatttttttttttttttcagaaatagtgtcaagtatgtttagattattatatgatagcctaaatattggaaacttttgaaaaatgtctaaatttttaatattgaaaattcaaatttgcagtgtcatataataattttttcttctttcacatgtagttaagaatattattaaaattttcaattgatgcttcctttttaatttgttttaccataatccatatagttgtgtttgttgatgcaatatatgtataatttttcgttttttcgatgttagattaagggtttgaaaatactgatacaactatataataaaagtattattagtataataattataatattattaaataattttaggattaaaatttatttattaaaataaataaccttaatatatcttaacatttatttttaagctattaacattataaaatagtaattatgttgtaaatactctctattaataaagcaaatataaatcttacaaataattaaattacaaattttagaagattttaaaaaatattaactatgaaaagaatatatatatatatataaaactaaaataacgaatataaccatgcaaaattgattgtatatatacaattatgtatgaatataattcacgcaacacgtgtcagattttttctagtatattataatgatgtctctgttttctgttctttgaagtcgtgcattctcatctcacacgttccaaggtcaagaaaggatcgttgacaagaactaaagatctccaagaagataatg

SEQ ID NO: 13906 - DNA, 3000 bp, Unknown
  misc_feature (1)..( 3000): cDNA_ID_3020341_gDNA_ID_2214667_Annot_ID_189041 3000 nt of promoter + ATG
atcaaaggagttaaataagggatatcatatcaatcataaatggattttagacaatataatatttataaaatgatattgaaaatagatgcaactattcaaaactggaatgctaaaacattaatacatgtttgcatcacccaccaccgggctatgaatagttacaaaattagttatataattataaaattggtaatttatatattcaatattgtaatagtaaatcacaaaaattaacaattaacaagcatgattctcttctttaacgattttctttgtagaatcattgaatcatacgatagtaattatagaaacaaatgataagcatgattctcttctttattgaatcattgaaaacatgcttttaccgatctatactataatcatcgatcggctcatattgttttgtttcaataatagaaaataagtactatgaaccatgagtcgataagtaaacatggttcttaaaaaaaaagtaagaatctctatatctaccttttagagcgtgctgataacgtgttataaacagagaaagaggtagaggaaatgagtgtgttattccattgagataaagggttctttatataggagtacaaggaaagggtaaaaccctagaaacatctagatgatgggcttagatgatgggccttataatgggcatccatctttattcataacaaaacattcttttttctttcttggacaaaatttgatattccaactaaaaccaaaatcttatcaaaccaaccacagatcggttatcattctagtggtctttttttgcggtcttagatttattatttattagaaagttatccacgcatcgcgtggattatatattcggttttagttttgaatatataataacatttatattaaattttatctataattgttaatatatcgttcaaaaataatttaaaatattaattttgatgtttacaaattatgatgtgtttaaaaagaccttaattaaaagattttaatgcactattttgtttttgtgaaaacggtatattttactattaaaaaaaaagaaacttaaatgaaataaaattcccaaattttatcttcaattatttagaattttaacttcaaataatgaaaaagtaggtccataatatgtatgttatataaatattataagttgttacatcttgaaaccagagtttattatataagtaattttaagattatttttaaatttgttttatttatttttgtgatatcgatatgtgtcaatcaaatgaactaataataacaaacacaaatgtcattttataaaaattgtatatataaagatcatgagcgtataaattatttatttgtaatgtgatggcaacaattatagctatattttgtgtaacatttagaagaaaaaaaacttaagaatgttcaaaatatattaacccaaatggttcaaaacatatatgtccatttatgtaaaatattacgtgaaataaatgttgccataactgtcaaaatatgaaagtaaaagatgacatgtgtcgccaaaaaatagcaccgtattgtttacagaataattgcgaagaatgtcatttcaacactatcccttatcaattatgcctcgtcctctttgctattttcatttataccttttaatgaccattttatcctatttggaaaatgttataagttaacaaaatgaaatattgatttttcctcttatttaagatgactttcaatagaaaaccctctaatttgactaaacatctcagaatgtctgctaaatatactgaaagatgtcaccctattttcaaatgatcaacaatactttatgtaaatggaagataaattaaaataaataaaatattctctttaagaacttaagagcatgtccattggttagtttctttaaatgaatccttaacattttataatactaacttttgataattttttagtttaggattgttgatgaatccttagagtttttaatgtccaatggtagaatctttaaatgagtttcttaaaaattttaaaaatatttttgatataattataatttgatataactgttatgaatattagatggatgcccattataaggcccatcttctagatccttctagaatagaatattctagaattatcctgtagatgctttgtgaaaccctaaccttatactcctttataaaggacctctcattcattggaataatacacacaaatcttcctcttcttcttcttttctaacacgttatcagcacgagctgcctaagctaatagatactaaaaaaaaatttctgataaaaaaccatatttattatcgactcatgattcataatatcaatctcatatcatttttcgatttaaaaccatgatggcttgaatccgattcatacgttaatcggttgatgatggcttgagtttcttctttattatttctatgccgccgtgtgcttcgtcaataatttaatacacccatacgtttgccgttcaaatcagtttttgataaatcgtatattatttattattattttcatcacgtcctgattttgataaattgtacaccacatgtttaatcgttatatatcatggtcgtcatctcgtttatcttgttgttatgataagtaaatatttttcatttttattaaatatgctatcttaaagaaaagtcaaacatgaatatacggttcatttcatttgccatcacatgtctaatattatatgaaaattaatttaataatctgatcaagttacacgatcgatgatgacttatgctcatttgataaatttattgcttcatatttttttatattattttattgactggtttagttggtacaattgtttgatttggtttgataaattgaaatcacaatctgttatttattgataatataaatatgacatcgttattcatttatttttatatacaattattgtaaaaatatatatatatatatatatatatatatatatattaattgtatcatttatgaaatttaattaaatttcttaatatttcagtgaatcatg

SEQ ID NO: 13907 - DNA, 3000 bp, Unknown
  misc_feature (1)..( 3000): cDNA_ID_3020335_gDNA_ID_2214667_Annot_ID_189043 3000 nt of promoter + ATG
atctagtatatcaagtagtataaaatcttattaaaagactctagaagagcatatacattgttttctatgggaatacaaaattaaaatcatcgatgcggtatagttctccaaatctcaaagttaatatgatgagatataaatacattatgattctagagtggaatttaatacgagatggatgaacttgaagtttcatcatctcgagaaggagaagtaatgaatggataataagtgacatatccagaagattatgttcaatctttgactactaaagatctaaaagttgtataaagcaattcttatatgaatgtgttattagataaaataaattataattagttattactaaaacttcaagacttgaagtctctttttgaatataactcacattgttaagagaatatttctgatgcgcagatggtaaaacagaagattaaacttttacgcaagtatcgttgtcctgtagacacaatatttgaaagaaatttaagaactattatgaacttaaatcgagtgtttttcaaaggctaaaaaaaatatatgagttattgatgataagtaatactcatattctgaagtgaatataagatcttacatagctagtcaaattaaatttaatatcgtttatattagaatctaaaattttaattattatctcgttattgttttattaacatatgattgattattaaaatacatggaagtaattttgattataagatctcattaagggagtaactgataagcaatgaaaagtaaattagaagttttgaaagaactagaagtttcaaaagaattaaaagtttcaagagtatatttggcttaaccggattggtcatcctggtttaatgatgatgtgaaagtattgagaatgctccagaatataatgagtgtcctgtaaggaccaatttcaaactgctatcgagtcttaagatcgcatgaagcgtaatagaccttggttccaaatataaatattctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgatattatagacaaaaaggaggatcatgaaagaaagtctattgaaaagtgtacacaaagtaatgattagccaaaaaatggaaaagaagaaatggacatataattataatttctaatagagatatttggactagtagtctatgcacatgatgtgtaaaaccagtggaaaataaatgagtctttatgtgaaagaatagtgaaattcatgagattttcacaaagataagaaatgtattatgaagagatatattctcttgtggtggatgtaatattttttaagtatctaaagtctggcaataagagacggaacactggatatgacatttatatgaaattcttgaaagatataatttctgaaggattaattatatgagaattatgttctctagaactctactcgatcgaataaaaaaaaaaaaaaaaaaaaaatatgtaacatgacatataatcatataaatgtatatttatgttgagtttgtcaaaatctattgatcaaactaatatttgttttgaaaatcattaaaactcctacagagttatcataagtaattcgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccctttttccttatgatagtttttatcccacatgatttttctatgacaaggtttttaacgagacattaaagaacacgcaaataatacacttgatgaatattaggaaattctatcaatcatccaatgaatattatacactaatgatatttagagaaataaataagatggtcaagatgaatcatctaaaagattcatgagcagcagaagaatggcgttgtactttatccagaaatttgttcaagagaagaattggcagacttattctcaaatactgtttaatcatgtagagattttaccaattcatgaagctagccgcgagtgtgtatggctaagatccatagttcaccatatacaagaagactgtggtatgtatgcagaaaaaagactccaacaattatgtacgaagacaatgcagcatgcatcgcacaactcaaagacggatacatcaaaggcgatagaacaaagcacatcctaccaaaattcttcttcacacacgatctacaaaagagcggcgatgtacgagttctacagatccgttcgaatgataatctgtctgacttattcaccaaggcgctacctactgctacttttaagaagttagtctatcgtatcggattacgccgtctcaaagatctcgacgaatatactcataagggggagtaattgtatgttgcactctttttcccttaaccatggtttttcccattgggttttcctggtaaggtttttaatgaggcagcatttcaaatactttacgaattatgatactataatggtcatcagggggagtgttatgaataaagatggatgcccattataaggcccatcatctaagcccatcatctaaatgtttctagggttttaccctttccttgtactcttatataaagaaccctttatctcaatggaatatcacactcatttcctctatctctttctctatttataacatgtttccttttttttgtatacttactaggatataaaaaagaaattttgttttctctaaaaacattaccattcgttgataataaaccctaagaaaaaaatcacgcaagttcaag

SEQ ID NO: 13908 - DNA, 3000 bp, Unknown
  misc_feature (1)..( 3000): cDNA_ID_3020331_gDNA_ID_2214667_Annot_ID_189044 3000 nt of promoter + ATG
tcatatgttatcgtaaccctcgaacctatggttcaactctactcagtcatcgacctcgaacccatagttcgacataaacctgtcatcatgctacatgcttgatcatcgggatgtttagacatgttatacgtatagtataaacctgagctgaattgattcacataacctaaattacatgtgtgttaagagatttgtctgaggtgagaatttgcaaacatgtattatttttgaattattaaatatgaagataaatatacctaaatattatctaatctgtataataataacaatcagaataaatatattttatgtttgtgtcttttcatataaaagtttataaaatgtattttttatgtccaatctgaataaatcttttcctttcaagcaattttacaatagaaaaatatgtttgattgctaaaaaaaaaaaaaaaaaaaaaaaacctttttagtgtagtacttgtctaatattattagtctatcaatataatactactagtataccaacactaatacttttctcaattttcttgtcaaactagattttaacccgtgatataccgtggaaacaatttattttcttaaagttagtatatataaaagtttgcaaattatatctatctataaaataattttattttatagtttacaattcttattaagtaacgtcctgccaaacccgtcctctaaaaaaacttctttattttaataatgttgattttatttatgatatgtttatgaatcattatctaaatattttgtaattttgtaataattaattgctatcaaatatctctacggtttgctgcttataatcgaattgttatagtcataaaaaaagcaatatcaaaaatgataattttgtagtgtttaaatcatattaaatattttgcaatatcaaaaatgataattttgtactatttagtaactaatcgtatagttaatgcaaagagattttgagaaagtagttaaatgcaaacatttaattcaaagatttactttctaattatcaaaaaaaattattaaatgtcagtgacagccactgtaaataagtctcaacttgaagatttattttacaaagtggctgcaaaaatgtatatgtagaaactaatactttgctgaattaacggagacaaatataatattatgttaaatagtttgccatttaggacgtttctacttattagtcttccattacttttttttttttgaacaactattagtcttccattatttaaatacgtttttcttttatcaaagtcatacttaatacgtttttccttttttttgtcaaagctaatactttttcttttcaggatttgacttaaatttgatcgtaaatttttagcagaaaataaatttactctagctaaattaatagttatatatttaaaaataatattaaaccaaaacaaaatcagaaaaacttaagtttaaacttaaaacacatcaaaatataaatagctttgtaaaaccgttaaaaaggaaagaaaatcagaaaaaccaatgtgaaaccaatatgtaatttggtattagttagatttatatttatatagcaattcaactcttaaataacattttagttagtaatgtttttttgcaatgtttgaaaaaaaaaaaaaatgttttgcagtgtttgaaaatctagaaggtcccaagcaaaacaatttttatcaaatcgctgagaaaaattggaaactcagtctagccggtccaaatcagacaaaatctctcaaatcggttaatttctgatttaaaattttatattttctaatgcttaagagacgtatactgtagtacttgggattttggatttaattcatcatcttttcgaccttcaagcttgtcgtttatttttgacaattttcagtttgaactctatgaaattttgattttcttctaactcaaaatcaaattaattaattacattgctagtttttttagttttcaaagtgaatggaatataattagtaatacatatgactaaacatatcaaaactaatttaataagtttataaaacctaagttccaactagtcgttttacgcgctttgatatctatcaaactttgagttatcgcctagcaatattttgaaaatgacttaccctagaacaactaatatctttactcatctaattttccaaattttccttgtaacttgatgctgtaatcctctattttaacgtatctatcgttgtgacatttccctattttcttatactactcagaagatgtatcaattgaatacaattttctgacgaaaaaatattttcttttatatcggctctttgaagttctaatttatatcgattgacaaaaaaaaaaaaaaaaaaaaattttatacatagtttttcctctctaagtatatagaagacaatgataagattaggaccaacaaacaggtcataaattatcagtttttctgccaaatatagcatcaatagaaactccattattgggacgcaatgtgaccacttgagcatcttatcatttttatttcaaaaccaccttattacactgagcttcccttttttcagcaacaaattaatgtcaaatcaattattaaaaatacaatataaattctgggagaataacaagtatttattagtcattacacataaaaaaccgtattttggtgtttcgtagaaagtgatatcatactagtctataatgtgtttcacaaaaaaaaaaaaaaaacttatatcaaaatcaaaatttcatgttcttgaaaagatttcaatatattttttttttttgtcaatcgatattaatatagactcaaacgaccctaccccaaaagatattgtaatttcaatattttattaacataaaagatcgcacacggtacaaccaaaatagttttcgaaaccaataaaaaaggaaataaaaaccgattctttttttttgcaatcccattataaaggagcaacgcacaagccacaagtaaaaagtgaaagtccaacaaagatacaaagaagaagagagaagaagaagaagaatg

SEQ ID NO: 13909 - DNA, 3000 bp, Unknown
  misc_feature (1)..( 3000): cDNA_ID_2991074_gDNA_ID_2214667_Annot_ID_189039 3000 nt of promoter + ATG
tatgtctctaagttacctataataagcttttaccttaagtttttttatataagtaatttaagaatatgtaacaagtgttattattaaaactccaaacaaataagccaatgaaataaagttcccaaattttttgtttaattatttagcatttttaacttcaaataatgaaaagtagggtccaaaatacagcttctctgtttatatatacaaatttatacatttttattcttacaacttatttagtgtacatttccatatgaatatatgaataaaaatatgtatatttctgtatatatgtacattaaatatgttgtacgaattttaatgtgcgaagcaaatagtgaaaaattacttatttttcaaattgtaaatagtaaagtgattacttttcaaattatgtttggaaaagtgactactttgcaaaactcactcataaagatatggtattattatttaaaattttgaaacaacatacaaagatatcaaatgaactcatgtcttctttcaacattttgctgtatattctaacagcaaattattaactcataggtttagtatataaaaatcgaaacaaataaaaaacattagttatgcttatctcatccagttacgtacatgtcccgacggtttattacgatctcttctaaaccaaattccatcaggcttagcagtccatgagcgatactgattacatcgttcagttgcagctgctctgtatacttgaagattaaaatgaaactccattttatccccatggttcaacatacatgtccacactgtcctttctcttctgttggaaacatccgaaaacacaatggtaaaattttgattgacttttaaatattggacacctttatcttgctcgttaatactaccacgacaatgatgcttgagaagtttaccgggagcgagttggttatgaatttctacaacatttggtgtgttgcaagcttcattgaacgaaaaatgaatggcaataactaacgtaaaaattatgaggtgattcatttttcttagatctaagataactgttttgagtaatgaggccatgagtttgagatatttataattattttgtgtagaaaatattataataattatcaaataatctatttgtggccttagctaaatttaaacacaaacgtgaagcaattaaacttttgaccaaaagagagtttcttgtcgaaaagtatggttgaccaataacattgaaccaaagaaattaagttttctaaattatagctcggccctgaaattaacaaaaatctaaggttatagatgaaatttacttgcctattcatttactacaaatttaataattaatttcaaattttacctatttattttttggtttattggaaaataatttttattcgaacaattatagtgtttcgatcaataaatttcttttcaagtagctcaaatattctcatttttatttgagtaatatttccaaaaatttggtataccacttggtttaattggttcacgtttgtgttcaaatatagtgaaggttctaaggccataattaaataaatacttcaatagacatacacaaaaaaaagtaaaaccacaaaaaagagacatataaaatcaatatcataatgcaaaatatcaacatgttttatttatttatcaacacatcaagagggtttatagtccatagatcaactgtaatatatagaaaatgaatggttacttagatcaatcagcccattaacatataaaaagtttgattacctagatcagtcacacagagtttatagatatgggattattaacaatattctttgtcttaattatttttaatgcatgatatatgattgatcacatagtctttgatcttaagttaaagtgttaaattatactcatcaaaattgttgctaggacatagataagcaagtgtctttatcacaataatagttggtgataaatcactctctgaaatctgaatatatcaaacttgatttttaatgtgtgtttaatctcctgatttaaaacgaaagcatagaatattaggtgattgtttatatctcatccacagtgaactatccttagatgaaaatttgttgaaaagtttgactatctacatatacattttttcagccattttaacaaataaatcttagagttggacttatttacaacccactgccattagcattaaatcttttttccaaaataattaattttactttaaattcttaatttaaattgttaattgcattatcaatcaaatttaatccaaacaaacttcacatcatcccttaaaattagcataaacgtatttgttaacaatattttaaaacaaagttttttgtttaaataaatattattcttactaaacattttttgtttaaataaataaatcttgtatttaaacttatttacaatgtcatgctaccgtattaattatttaggaatgaaaatatttaattaacgatttaaatcttctaaatcctcgcttttagagttattatgtcattacctaaaaggcaaaaaatattattatttttaaatattattatttatacatttaaacttataaaaagtttaatatatcaaataatttaacatcattatacaatatatagagtttaaaaaaatctcaaaaaaatttccgtcatattttgtgattcgaaattttaaaaatgaacatatattaaccaattggcgaaaaatgtgtgggttcaccatcctgcatcgattaaatatttagacaatgattcataaacatatcataaataagatccacattaataaaataaattttttttttttgcaggacgagttttgctggacgggtttggcaggacgttacttaataacagttgtaaactataaaataaaatattttttataaatagataaaatttgcaaatttttatatatactaactttaaaaaataaattatctccgcggtgtaccgcgggttaaaatctagtttatgtatacaaatagagactaataaaataaattatttactcacaaattagatg

SEQ ID NO: 13910 - DNA, 3000 bp, Unknown
  misc_feature (1)..( 3000): cDNA_ID_3020440_gDNA_ID_2214668_Annot_ID_136595 3000 nt of promoter + ATG
tgtcccatctgagactgcggcaaggcctgctggtgaagattgtatgactggattctgtgtcgacgttgccccgacgtcaactggaggtgaaggagattgctggccagaagcttcctgcgaattctggacgcttgggcttgcgacaccctgaaagttgagtcgcgttcgagctccagtagtccgcgccgttcctgcagaaagagaatcaacccgctcggcgtatgcattgtgcgctgatctgatctcggaatggtttgctgctaaagctgcgagctggccattgcaatgttcttagaaaaacacgaacttatcggagagtgtcgttactgcgagctgttgccggtcggttttctctgacaactgctgaagcagctgcttgatgtcgtcgagggtggaggtttagtcgccggaactctgaccgtcggtgttgctcatggtgaattgatcgttgctctgaagttaaagacttaacttaccctccttctagcgccaaattgtggatgccagaatccgcaattagaattttgtggttgtttttgtgaggatcttaagtcttgtcggtcgaacaatgatcaaatgataaacggatttgtgtatttcagtatagtttcagtatagtttcagtacaaggtgttttcgtcccctttacaaatgacaattgactcttatttatactaatacaacgaatcaaatgacttaaatgattagctggtttcacgccgcagacctcgcccctattaacttcgtacgttgcggatcaacagctcgggcctttgaatgcttatcattcaagtcgatatccagccgttactaaattaattccgtatcaactttttgaaccactgggctttcattgggctctaaggccgggcccaatccttgtctggaagcccacaaattgcgggtcgagtcgagcacaagatccgacatccacaaaccattactttttgctggtctcgggttttgagccgggatccacaaatcctcccaaacggagatggaagcccctgaaccgacttttttaataagtcctttacaaaccagagatctaactgaacaaatacttctccagccataagacggagagtatgattttatattttccagaggattggatttcctaaaatatcttcgtttaaaaaccttggcaaagagagagtccggaaacgaaactagacgccataactgtttcgctaataatgcagagtttaaatcatctacatcccgaaaaccttagtcacttcccaatttactagtacacagtttgttccaagtcatccagtgtatacctctagattcaccattcgagctccaccaaaatcctgcgaccgcacttgttagtttggaagtaattgttttcgggagcctaaagcaatacatcacataagttggtaatgttgcggctactgatttaatcatcacttttttccctccttttgataggaatttagttgaccacccatttattcgactgtaatcgatctttaacaacggaaaagatctttgtcttagatccccctaaactctcaggtagtccgagataggaacccatgcctccgatattatgtatacccaagatcgattttatttctgcctttatagcttcatctactttatgcccgaactgaatcgatgattttacaaaatttatcatatgtcctgataccgcttcatattgttttagaatacccaatagttaatagacttattatacccacattagtcttaatttctttgaatgtcactatatttattttttaaatttatatttgtaattatgtttatcgcacataaatttttcatatagtattaagttttcttgattttactacttctaaaaaaataaaatgagattttcaaattatattataccaaataaattaaattgtgaaaattgaaccacagatttaaaacataatgtacaactatttcatataaaacaacattcttttctttaggatagttacagtaatataccaaaaatcaaatttaaaataaattaaaattttaataatgttctgtaataaagagaaaaatatataataaaacacgtactaatgcatcataaaatacacattttatgtactaataagtataataaacatgttatcttaactaaacataaccaagtaaaaaaaacatactactatatcaataaaagtaaatacatataccaagtaagttgaaaaaataaaactattgctcagttatttatatatagattatattaaattgaaacaacaattaactttctaacgcaaataatcaactcgctgtgtaccgcgggtcaatatctaatgatgtcataattctcgtagacaaatagacaatttttccatatgagtacatttgatgcaaaagtagacatttgaactgaaacctatttttgtttacaaacattcatatcaacaactaaacaaaaatcgaaactaacttgaatcaattaatcaagtattaaattaatatgaaaagtggactcaaatttaactgaatcgatttaaacctaatcaaaccagataatttttgattctaaaccggtttacctatgtcacaaaaaggaccatccatgtcatattttttttttaatttttaaaaagtcaagttgttttaaatatacttgagatgcaaagaaagatccgaatcatatatccgaagattccgaaaccaaaggcggatccgacggctccaagctgccatattcccttgttactctaccactaaattaagccccacataaaacaataaagacacgaaatataaatacctaagcaaaactataggaaccgaaaaaaaaaaaaaagaataattccagcatcattcctcaagtaatttaaaaacaattattaaaagaagcaacttggtcttccattttttttgctacaaaaaatttaaaaccccaaaagaacttaaaatcttttacataaagatcaccaaccagccacatagaaaacacaaccatcggtcttcttattattctttcttcaacaccaaatagtcatg

SEQ ID NO: 13911 - DNA, 918 bp, Unknown
  misc_feature (1)..( 918): cDNA_ID_3020430_gDNA_ID_2214668_Annot_ID_189070 3000 nt of promoter + ATG
ttggctttggtagattgtttcttaaaccttgctccgctatgttttatcaacgacttttgagattaggaagtggtagagttatgggagtctctgtcacgacagtggattgacctagtttttgaatctatcgtcaagggtatctacctttcacctattagccatctgatgaaccctagagttgcccttatcaatgaattcatccttaggacttctattatatttatttgtatctcctgttgattgcacttttatttacctgttatttgtatcccctgttgattgcattttagttacttaaattcgtcacctgttggttttactagacctaatgatcgagtagggctcttaaattctcatttttacttgtttgaatcctgacctaggattgttactagaaacccaccatcattataatctggcttgacttagttgcttctgtacacgtcttgattgctagcaataacagtggactggattgacatcccctaaagctacatcgacatcccctatagctgcatcgacatgttagtgtttgtaggggaatggaactgaacctctcacacattccgcataaataagtaggcctaaaaaacctacttatcaatttggcgccgttgccaattcctttttgcattgttacattcaagatatcagaaacttttaagatcaagttcttttccatttatcaagttactaactcatcttttcgtctacttgtttttatggtataggtactaatctttgtgcatgcaaactcgatccaaaggttctgcaaacctactaccattcagagacagaatagatagaatagctcgtgagttacaagaaaccaatagctcgtgagttaatagatagaatagctcgtggctgcaaacctactaccattcagcctgtgatcagcaaagaccagctgctatg

SEQ ID NO: 13912 - DNA, 3000 bp, Unknown
  misc_feature (1)..( 3000): cDNA_ID_3020440_gDNA_ID_2214668_Annot_ID_189066 3000 nt of promoter + ATG
tattgtcccatctgagactgcggcaaggcctgctggtgaagattgtatgactggattctgtgtcgacgttgccccgacgtcaactggaggtgaaggagattgctggccagaagcttcctgcgaattctggacgcttgggcttgcgacaccctgaaagttgagtcgcgttcgagctccagtagtccgcgccgttcctgcagaaagagaatcaacccgctcggcgtatgcattgtgcgctgatctgatctcggaatggtttgctgctaaagctgcgagctggccattgcaatgttcttagaaaaacacgaacttatcggagagtgtcgttactgcgagctgttgccggtcggttttctctgacaactgctgaagcagctgcttgatgtcgtcgagggtggaggtttagtcgccggaactctgaccgtcggtgttgctcatggtgaattgatcgttgctctgaagttaaagacttaacttaccctccttctagcgccaaattgtggatgccagaatccgcaattagaattttgtggttgtttttgtgaggatcttaagtcttgtcggtcgaacaatgatcaaatgataaacggatttgtgtatttcagtatagtttcagtatagtttcagtacaaggtgttttcgtcccctttacaaatgacaattgactcttatttatactaatacaacgaatcaaatgacttaaatgattagctggtttcacgccgcagacctcgcccctattaacttcgtacgttgcggatcaacagctcgggcctttgaatgcttatcattcaagtcgatatccagccgttactaaattaattccgtatcaactttttgaaccactgggctttcattgggctctaaggccgggcccaatccttgtctggaagcccacaaattgcgggtcgagtcgagcacaagatccgacatccacaaaccattactttttgctggtctcgggttttgagccgggatccacaaatcctcccaaacggagatggaagcccctgaaccgacttttttaataagtcctttacaaaccagagatctaactgaacaaatacttctccagccataagacggagagtatgattttatattttccagaggattggatttcctaaaatatcttcgtttaaaaaccttggcaaagagagagtccggaaacgaaactagacgccataactgtttcgctaataatgcagagtttaaatcatctacatcccgaaaaccttagtcacttcccaatttactagtacacagtttgttccaagtcatccagtgtatacctctagattcaccattcgagctccaccaaaatcctgcgaccgcacttgttagtttggaagtaattgttttcgggagcctaaagcaatacatcacataagttggtaatgttgcggctactgatttaatcatcacttttttccctccttttgataggaatttagttgaccacccatttattcgactgtaatcgatctttaacaacggaaaagatctttgtcttagatccccctaaactctcaggtagtccgagataggaacccatgcctccgatattatgtatacccaagatcgattttatttctgcctttatagcttcatctactttatgcccgaactgaatcgatgattttacaaaatttatcatatgtcctgataccgcttcatattgttttagaatacccaatagttaatagacttattatacccacattagtcttaatttctttgaatgtcactatatttattttttaaatttatatttgtaattatgtttatcgcacataaatttttcatatagtattaagttttcttgattttactacttctaaaaaaataaaatgagattttcaaattatattataccaaataaattaaattgtgaaaattgaaccacagatttaaaacataatgtacaactatttcatataaaacaacattcttttctttaggatagttacagtaatataccaaaaatcaaatttaaaataaattaaaattttaataatgttctgtaataaagagaaaaatatataataaaacacgtactaatgcatcataaaatacacattttatgtactaataagtataataaacatgttatcttaactaaacataaccaagtaaaaaaaacatactactatatcaataaaagtaaatacatataccaagtaagttgaaaaaataaaactattgctcagttatttatatatagattatattaaattgaaacaacaattaactttctaacgcaaataatcaactcgctgtgtaccgcgggtcaatatctaatgatgtcataattctcgtagacaaatagacaatttttccatatgagtacatttgatgcaaaagtagacatttgaactgaaacctatttttgtttacaaacattcatatcaacaactaaacaaaaatcgaaactaacttgaatcaattaatcaagtattaaattaatatgaaaagtggactcaaatttaactgaatcgatttaaacctaatcaaaccagataatttttgattctaaaccggtttacctatgtcacaaaaaggaccatccatgtcatattttttttttaatttttaaaaagtcaagttgttttaaatatacttgagatgcaaagaaagatccgaatcatatatccgaagattccgaaaccaaaggcggatccgacggctccaagctgccatattcccttgttactctaccactaaattaagccccacataaaacaataaagacacgaaatataaatacctaagcaaaactataggaaccgaaaaaaaaaaaaaagaataattccagcatcattcctcaagtaatttaaaaacaattattaaaagaagcaacttggtcttccattttttttgctacaaaaaatttaaaaccccaaaagaacttaaaatcttttacataaagatcaccaaccagccacatagaaaacacaaccatcggtcttcttattattctttcttcaacaccaaatagtc

SEQ ID NO: 13913 - DNA, 3000 bp, Unknown
  misc_feature (1)..( 3000): cDNA_ID_3020444_gDNA_ID_2214668_Annot_ID_189065 3000 nt of promoter + ATG
gtggattaaactgattttaagtacttagtatatatagaagtaatgtcatcttaccatgtacggtggcaagtgtttagatcagtgatgaccgtaacgaaaataactttcttgtgaagtccttgccatttcattacccacaatggtatgtgttgcatcagaggatgcacgctaataataatgtccggtttgtactccattaaaccggcctctatttctctgttcaccaaaagaagaaataatctccattatattgctaattcgtaacactaagggatgataacgaaaaaagaagaaggttaacatataagtacttggcataataagcggcaagagcacttagatagcttttgtggatccatttgggagaagtaccatgaaacgcaacagaccaaagaccaacatgtttcaccatgaacttgtactgtctctccatgtcgttcaatggccatccagtgtattctttccaaacatcttttatgattatctatagttataaaaaaaatgacattagttcctagagagaatattgtaacatcaaagagtcagagctagagaaataaataatgcaaatttttaatcattattgacaaacaaaataaatggaacgtgggacaggttttaagacatagattgttgacgtcagctcgtatctccgacaccctggcaaactccaagattcatactaggctacaaaacttccaagtagatatttgtttcttttcgttttcaaattcaagacgactactgcgacaactttaatattgacggctgagatttcattagaatcagaaactcctctatgatatattataacataatctattggaaaattttgtcataatataaatacatattattcgaggtatatatttacaagctttgaaattttcaaaatgaatatttcaaaatattgttgttgttttacacagaaactaaaagataaaagtatgattaagttttgttgcttatgcaatattttttcgtttttttgtacgttatatatatggttaaggaagcatattattggctcaaccctatgcgttggattcaaggcaaagagaatgaaaatgaagatataaataaaaatattaatatttttacccgatagtcatctccgaattcgatcttgaaagcgtcgcggatggcctcggctgaagcacggtggccaccgccggtatcactcatgagaataagaacagttttgatcctctctgctcccatctgctccatctccataacttcttctttgtcttctaaccctctcttccttagacgactctccttctcataatcacttgatctctgacgatggatatactcatcttctactgttgagatgttaaaattgctatagactcgtcgaaacaccttctcagtgattgaatccgaccgtgtacgaggtgacaccactttcatcatgactatttggtgttgaagaaagaataataagaagaccgatggttgtgttttctatgtggctggttggtgatctttatgtaaaagattttaagttcttttggggttttaaattttttgtagcaaaaaaaatggaagaccaagttgcttcttttaataattgtttttaaattacttgaggaatgatgctggaattattcttttttttttttttcggttcctatagttttgcttaggtatttatatttcgtgtctttattgttttatgtggggcttaatttagtggtagagtaacaagggaatatggcagcttggagccgtcggatccgcctttggtttcggaatcttcggatatatgattcggatctttctttgcatctcaagtatatttaaaacaacttgactttttaaaaattaaaaaaaaaatatgacatggatggtcctttttgtgacataggtaaaccggtttagaatcaaaaattatctggtttgattaggtttaaatcgattcagttaaatttgagtccacttttcatattaatttaatacttgattaattgattcaagttagtttcgatttttgtttagttgttgatatgaatgtttgtaaacaaaaataggtttcagttcaaatgtctacttttgcatcaaatgtactcatatggaaaaattgtctatttgtctacgagaattatgacatcattagatattgacccgcggtacacagcgagttgattatttgcgttagaaagttaattgttgtttcaatttaatataatctatatataaataactgagcaatagttttattttttcaacttacttggtatatgtatttacttttattgatatagtagtatgttttttttacttggttatgtttagttaagataacatgtttattatacttattagtacataaaatgtgtattttatgatgcattagtacgtgttttattatatatttttctctttattacagaacattattaaaattttaatttattttaaatttgatttttggtatattactgtaactatcctaaagaaaagaatgttgttttatatgaaatagttgtacattatgttttaaatctgtggttcaattttcacaatttaatttatttggtataatataatttgaaaatctcattttatttttttagaagtagtaaaatcaagaaaacttaatactatatgaaaaatttatgtgcgataaacataattacaaatataaatttaaaaaataaatatagtgacattcaaagaaattaagactaatgtgggtataataagtctattaactattgggtattctaaaacaatatgaagcggtatcaggacatatgataaattttgtaaaatcatcgattcagttcgggcataaagtagatgaagctataaaggcagaaataaaatcgatcttgggtatacataatatcggaggcatgggttcctatctcggactacctgagagtttagggggatctaagacaaagatcttttccgttgttaaagatcgattacagtcgaataaatgggtggtcaactaaattcctatcaaaaggagggaaaaaagtgatg

SEQ ID NO: 13914 - DNA, 3000 bp, Unknown
  misc_feature (1)..( 3000): cDNA_ID_3020490_gDNA_ID_2214668_Annot_ID_189053 3000 nt of promoter + ATG
atgtcacgaaggagtttaccgatggattgcgaggtttcatgtaccaagcaacaaatgtaagtgtttcaacgataaatatttggaatttaataagtgaagaagcatctatataatagaggatttatgccaaactcttttttatggttgcgtcatggggaaggttgtagagatagtgcggaccgtagtaatatgaattatggtgttgttgaacctattgattattataaaaattatggtcatcatcaagaatttgatcaagggtataaccatgaaaatagatttcatgatatggttacagatgcatttcacgaaagtactgctgcatttagtgaaaatattattgtagaaaccaacgtagatgcacaacgcttttatgatatgttagatgctgctaatcaacccatctacgagagatgtagagaagggcaatctaagttatctttggcatctaggatgatgacaattacagctgataataacttaagtgaaaattgcaaggattcttgggctgaacttattaaagaatatttacaagcagataatatatcggctgagagttactatgaaatacagaagttggtttcaagtcttgggttaccatcagaaatgattgatgtatgcattgactgttgcatgattttctggaaagatgatgaaaatctgcaagaatgtcagttttgtgagaagccgagatatcagcctactggaggaaggacgcgagtaccatataaacgtatgtggtacttgtcaataacagatagattgaaacgcttataccaatcagaaagaactgcagcgaaaatgagatggcatgctgaacattcaacagtaaatggtgaagttactcacccatctgatgcataggcgtggaaacactttcaaacgatatattcaaactttgctagtgagtgtagaaatgtgtatgtctgggaggcaatattttttatggccggttatcgtgacaccatacaatcttcctccagatatgtgtatgcaaagcgaatttctgttcttaagtattctagtgccaggccctaagcatccgaagcgagcactcgatgtcttcttgcaaccgttgattcatgagctgaagaatttgtggtacgaagatgtcctgatgtttgattactcgagtaagcagaatttcaatatgctagcaatgctaatgtcgacgattagtgactttcctgcatatggaatgttatttgggtggacaacacatggaagattatcgtgtccatgttgtatggatcggactgaagcgtttaagctaaagcatgggcggaaatcatgttggtttgattgtcatcgtcagtatctttccatgcatcatccgtatcggaaaaacaaaaaattaattaggaagaataaaattgtgcgtcttcccccaccagtttatctttctagaaatgatttgtttgaaaatatcgattattatggtgcttaggaaacatgtaaacgtgggtgtaactggcacactccggcgaatatgcctgacagatatagaagtgcccacaattggcacaaacagagtatcttctggcaactcccatattgaaaaaatctcctcttgcgccatcaccttgatgtgatgcacatcgagaaaaatttcttcgataatttcatgattacgcttctgaatgtgcagggaaaaactaaagatagcatgataacaaggttcgatttggtagagatatgcaacagatcggacttgcatataacacgagatggaaaattaccggttccgaagtttcgattgactccagagggaaaaaagcgttgttcaaatgggttacatctgaagtgaagttttcagatagatatgtgtcaagaaaattaagatgtgtagagcaacgccaaaagttctcgggtatgaagagccatgatatgtctataatttgcatgttttacacattcttttatcaccattttgagtctagtttcatccatctttcataacattcatcattatttttgtacattttgcatctttagtcgagtctaggactagatcaccagtaacagagagggaagcagtcagctcagcagtccatcaagacacttttactcgatcgcagaggagaggaagcagtccattcctgacaattctactcgatcgcagaggcgaccaggcaatccactttgctagtccaccagtatactcgatcgcggaggagaagaaccagtccatcctgatagctcacacacatcctcgatcacaaaggccaagaagcagcccagaccattctgtctaccaacctactcgaccaccacctcgaccctttgatcaatccgcattcaaccagacaacctgaggaagaaaaaagaagagaagagaaggcccaatcgaagcccactttgaagcccattaggaagcctgctttgagccgacactcttgatcatatcgtccatgggccgtttagtgggctcgaagcccgctttcttatccttatcgttttttagtataaataagcctctaagggttttgccctagacacccggagacttacaaacccttttacagagattttctgcaacttattcagagtcgcttttgattccttcaactttgtattttgatttttcttctaagttattcagattttgctttcatttgcttgttcatctttgtttcattccctttaatcttttaggtatgcaatcttcagtcgtttctatattattgtctttaagcatgttgtctgaggagtgattaggatttctgaggatgggatagagtagttgtggaacccttggtcgaatctgttggttaagtgtagatttattgaatcccttatggattagttgtgtttacagcttattcctttctgatcaactggaatccgatcccagacattccagcgctcaaaaggcgtttaatggaacgttggatctactaattccattgataatcgtctttatcccaagggattgaccgtttagaacagttattggctttaacagtcagttcttattgcctgcttagttagagatcgcta

SEQ ID NO: 13915 - DNA, 3000 bp, Unknown
  misc_feature (1)..( 3000): cDNA_ID_3020536_gDNA_ID_2214669_Annot_ID_189083 3000 nt of promoter + ATG
ttagtatctttttaggttgagccagaaggatgcttgagtatcaaactaagtccaaaaaggggagattgaggatgcagattctgacatcaacgaactaatggacatcaaggagctgttggacatcagagagctgttggatatcaggacggtgcatcaaatctacatcaaacgtctgagttgctgacatggacgcgtgagctgacatggcggtgctggagtggttgatgtgacgtgccaagaagctttgctgaattggcatggtgatcaaacacgaaagttggttgagaagatttggtgaatattcttctcaacaagttaaggaaagagataggcttgaatatcaaggagtatctcgaacaaggaaaagggataggcttgaagatcaaggaagatcccaacaaggaaagggataggcttgacgattcaagaaagatctcgctcattgattctcagagatcctaggaattagggttagcgagaatagcataaatattctaggattaggcattgagccgcctaagcactctagaatattgccatacgtttaaagctttcgaagcctagtaaaagcttagaaagtgggtgtttgtaatccctcctcttcacaagcgtgtgataagaaacagaggagtgattaggcttagatttgttcttagtcggggttgatcattcgggtagaatatgtcaagtaattgccgaggtaatagaatccttgtaaaagatttattatcaataagaacaagtaaaaaacatttgtttgacgcgtttcaaacaaaattgtgtatcgtctataccctcttacttagaacttttcactattatatcagttgagatcagttatttagtttcttaatccaattaagttctattttggatgacatgatggttgacgacatctaccatttccttggagaaagttgttcatatgttagagagaagacgatcatggtatctacattatatatcaattaaatgtagggtaaaacttgacaattatttattgttttatttatattttagattttaatattttatcaattaagattatattttgagttttcatattttttttattaatagctttacttgtgttattttgaaaattagtaaacgagctttgcaaagctttttaatatttgttttcagtagaattaacaaaatctcaacgagtttaaggaagtttggttaatttcggatttctaagattaacaagtaaccatgcaatgatcatatttttgttattccaaaagtgaacaaatcactagtcgatggaagtccctactacgtgtggttatgcataatggtaatggacaattaaatcctcaaatgtctttgtttttaagaccagatttaaacttgaaatgcacattgaaacaacaaatcgagtgagagcaaacaatgcaggaaaatatgcagaaagttgccgtagcgaatgattttggagaaatagaaactataaactttttctttggattaaatttcattactactattaccaagcatgaaagattcacctccggatatattaaacttttaagaattttatatggaaacagaaaaaagatatacgtgcacattttatctctttagcaatcataagtcatttgtgttgggatcaatcactatacaacctcgaacaaaaaaaattcctttctagaacaaacaacattaatcctataactatccatatgaattctgatttaacccaaatgtttttgggaaattgattagtttaagaataatgtgacttaacataactagcagacgacattcataaagccattagtgtaatgtatctatccaaccccatgaacatgacttgtcatattaaaatagattttttatatttgatagaaaccagaggttatatggatgtgagcctaaaagaaaaaggggtgatgcaactataattgactcatcatttcagattattattttcctcatttgatagaaccattgttgatacacactaaaaatatgtgtagcaaaaattgtactctttcctagacttaaaataatttgctatgccttcggttggttaaaatctagtgataaggcaataatttgttttattatgtcaactttgttaatactagtttgttgttttaagccaatccacgttaagtggtatttctttaaaaaatttttattgtatgaacatttgcactaggtgtgggttttacgttaatagtattcttttgtcatattgctttctatttgtatgtgagtttcgttgctgtcaaacatgtttatatataaactcacaataaaatagcgaaattaattgaatttctattgtaattaaaaatttaaatgttatttaggtaggcatgtcttgacccataccaattaaactctacaatgcggataacaatattagttttgaatggtaatttattattaaagcaatacagtttttgacagttttcatttataaattttttatcaaaagctttacaaacagttttactttcagcttttgtaaaagtgtgattcaaacttctgatttagtttgatgttgatttggtttagctggttatttgttggatcatggttcagtgccggtttagtattggtttaagaagaagaagaaatcagtttcagaataacagaaggatcagaagactcttctggaattatagggtttggctttccttgctctgttataaatagtcttcatctttttcaattgttcgttgaaacagaaaattcttatctcaattcttctctcttgaaaacgatcttgagctctgggttttgagcttgagtaaacattgattagtagtgaattgctggattgattctggccccagacgtaggttcatcacatcggtgatccgaactgggtaaacaatcgtgtgttcattttgttctttgtttgtttgcgttctttgatcgatctcttgagtttatgcgaattgaaacttgttcgagttgtgttgaatcgagcttagagtcataggattgtaacagattggtatcagagcctaaggttcttta

SEQ ID NO: 13916 - DNA, 3000 bp, Unknown
  misc_feature (1)..( 3000): cDNA_ID_3020516_gDNA_ID_2214669_Annot_ID_189091 3000 nt of promoter + ATG
ttcgagatttttttgacatttttcccaattaccaggccacaagcccaaagtttttaaaagcatgttatagaaaaaagaccaaaaaagagaagaacactatacaagttctctgaataaatttacagtgtcttaaccactaggacaagggaaatcttttactaaagatccgatttattgtatttgtatatataatctacagccgcacgcaaataagtttaatcgagttgttcttcttctttgtctcggagaaggatttgtgtttgtatcatctcattttagcacggagagattaattgatttgaatgagaaagatgaagagaatctttggtgcaaagaataacaaagagctagcctcctccgtctattcaggatgcctctgatcgggttcctctctctctctctctctctctctctctctctctctctctctctctctctctctctctctctctctctctctcttttctttcaatttcattgttttcctcagctttatttgagaagtaaggattagtatagtgttcttcgagagccgtcgatttctgggttttatcgtaaaattagcgatttagcttttgagtacggtgatcatacttgtattacgtattacgtataagcatttgatgttgcattatctattgcatatcatattctcttgaatttaactttttagtcactaatcacaagaccgatttgctatgtttaaaatgttcgaaaaaataacataaagacggatttgctaatttggaaaatgcgcaagagaatattgatttttttttcttaatggtaagtatgtttgttattcttgattgtatttgatgtgataattctggataatttaataataaagtgtctttgtggcataaaaaaatttaaagggtaaatttgtttctttactaggttattaacccccgcgtatgctaattgatatcaaattaactacctgactgtttaatataatccccgagttaatataatcctcaagacatcagcaaatattaagagcatctacattgcacaacataagagaatgtctttaattacaaatgaaataaaagaaaaaaataagaaccaatgacattgtgccacataagctaagatgtctcaaaagaaatgtctttgatgtctccccagagacacaattctcttttcagcattaatttaaagacatttacctttttattttattcattaaaatctaaagacactcacaatttgttgggcaatggaggtggcctaaagaaactcttctttgatttcagttttcccatagaccttaagtatccgtgttttgaggattgagattatgtcactggtaagtttttagtcaatctatgttcttatcattttaagaatgaaattttattagtagtttatgttcttatttttttatatctactctattaacatctaattctatatttagatgcaatgagtgtggtgtcaaatatctcggctattaagaaattcccatttgtttgtcgccaaggtgaaaccgactatgaatcgagataattctcttttgatattttggacaatatttaagttttagtatttataagtatatttaataatttatctgccgtctgaaaattgaacttagatgtattgattagtgtatttttgtatcatattggttaggggagagaaaataaaatgctttgctgttggaagatgctgtgaaatcttggttacaaagtggtctaaatgtatcggtttagatgcatataactatgaaccaattgttgcaattgttcggttttggagaatcgctgagattgagggttagtttttttcaatactattgcaatcctatttacttatgatttttatatttattatctaattctaatcatgattttgtaacaggtggaaatgtcttgatgagtgaatttggatattcaaggctttacatcaatccaaccactttccatgagatagatattcgaagctacatgtaagactttaaacatttttctattgcattaattaaccataacatcaattaatcaatacaattttttctttttgttttttacagccgcagtttcaaagattatgatgaagttccagagaacccaatgatggaattgattgaagagaattaggagtttgacctagcagctcctattcttttttaaattacattttgaacttctgtttattttactccaaactttgtcattttaagttgttttttttgttgaactatgcttatgttttgaacctatataattattgtattcccgttgcctttattatctagcttactttttgttaaactcctaacaaagtttgcaattatgacattaaaaactcctaacaaactcctaacaaagtttgcaacgatgacataaaaatatagttatagttcttcatatttttgttaaactcctatgcttatgatttgttatttccgaccatgtttagcataaatataattactgatgattaattttaacattttaaaaataatttttttggtaccaaaaataaagcattaaaaactttgagacaaaccattcttggaaaaattcaggatcattatttattaagttcattttttcaactcaatgtcattgtcttatcaaaaacaaaaaacaaatatatatgtactctttagatttaaaaccctacaaaagaattatcttccaatgtcctttctatcatttaagagaaattttttttgtggaaacccgtgtactctttttaaagtttctttttggatagatatcattatcttttatgacttaaaaagaaatcaatacatatatcatagttaaaatttaacttcttttaaatgtaatatatctataggatttcagtctattatatatatatatatatatatatatatatatatatatatatattgtgctcttatacatactaggttattaaccccaatgatgctgagaatgtcgtggatgaagatgaagatggtgatgatgatgggagcgagacgaagagaacaagaaagagaaggacccgaaaggaatg

SEQ ID NO: 13917 - DNA, 3000 bp, Unknown
  misc_feature (1)..( 3000): cDNA_ID_2990903_gDNA_ID_2214670_Annot_ID_189100 3000 nt of promoter + ATG
caacaacttgttacatgcgactaaacaaattatattgaatccatatacagatttgccaaatactatttctatttggtcccaattagtgatgtttatatggatttaatagcccatttagttatatgggtctgttgttaaaaaatagcccatgtagacccgtttatggaaaaagataaatgggctttaatttcgacccggcccaaaattacaacgtgttcaacaacaactctattatacaaacagactacgtcgttctcttccactcatctgaaaacaaaatccaattctctctctctccctccagattcaaacgatccgatccaaaactttgagatccgagaagatgtctacgttcagcggcgatgaaactgctccgttcttcggcttccttggcgccgccgccgctctcgtcttctcctgtacgccatttccttctcctctcactcgattctcttccaattcgtatcattccctttgatctgatccagatgattgcttctagagactttttatgagaatcgttggcctactaattgatcgatgtattagtgttcttagatcagaatctggattttaggtattgatttgtgattgtgattgggtcgggcgtaaaatgagatgttgttactggattttggttttaggtatgggagctgcttatggaacagcaaagagtggtgttggtgtggcttcaatgggagtgatgagacctgagttggttatgaagtctattgtccctgtggttatggctggtgttttgggtatttatggacttattattgctgttatcattagtaccggcatcaatcctaaggctaagtcttactacctatttgacggatacgctcacctttcgtctggtcttgcttgtggtcttgctggactctcagctggtatggctattggaattgttggtgatgcgggtgttaggtttgttcctcacagagaatgtttgaatggaaaacgttaacgtcatctgtatcttgacttgtttttggttttgcgattctctcagggcaaatgctcagcagcctaagctatttgttgggatgattcttatccttatctttgcggaagcgctcgctctatacggcctaattgtaggcatcattttatcttctcgagctggtcagtccagagcagaatgagagcacaaacaaatgttaaaatttccaggtacttccttatcgatcaacttataagtgcggtatgtagtatcgggagccgatattttgtggattcttggtttgggaagcagatgttgccacctcgctttccttggttggtggttacttgagtgtaggatgttatttggttggtacggtaataaaaaaaagagcttggcatttgttttgtattcttgtattgtctgcatctgtcttgatgaacttgataatattttgtttgtaaagaagtttgcttctgataccatctttgaatgttatgagattaatgctagcttttctactgaacaaaacattatattttcggagggtgttaagcaaagtaatgaaaatattaatcgttcctagggttcctcctaagccaattatctccgaaatcctttactgcagctagatcttcttatggaatctaatcgttcttgtttttatagcatcgcatcgaatcttcttcgtcttggaatggaatcctttcttgttttcgtctgtttggtgagatttgctatcgattgtaactcgtgtattgtgttgtacaagtaattcatcgctggcgtttagttaatcgaatctcatatctaactatgttctaaccttgattgggagagttgcttgcctgaaacaacagaagatcttagtcaattcatttctttcttaagcacttagcttggaaggcagcttagtcggatccaagttagggtaaaggcagttccactccaattcaaaatggagggaggacttgaagtagtcctagattaccacttcaacaacatgatgagtatcctccaattatgggaatctgataccttcttatctctcttaccccataatgaatccgaatcaaaggaaccccacaacacttttggaaagaagaaaccgtttcaagtatctaacaaacgttaaagccatggttagaggaaacgtgtatgaaatggtttcacttttctacttaaaaacaatgaagacaaagagtgtcgtatatcaaagaaaaaatgtttcaacatacaatcttcaatctatatagtatttttgcaaggattttgtgcggacggggcaaaatacattcgggtctatttggtacccgcctatttagtaattttgttctttataactttgttgggttcggttcaaataaaactcgtacctaaacccgtttttaaaactcttacaacggatatttcgataattaacaattagatatttagaagatttggttaagatttaaaattatgaatctccgataatctttgtttaattttttaactattttaaatcatcgtataatatattaagttttttaaaaaatctcaagcttttttcttctacatattttgtgattcgaaattttaaaaacggacattacccaattgacgaaaataggtgggttaacgtcctctagatcgtttaaaatattatagacaatgattcaaaatcatatcataaaaatatcaacattaataaaagaaagatttgacgggacagatttttgaatcaacattaataacaattaaaatatcattaatttcttgcttcaatacggcttaaatccttaaaaaaaatttttacaccttcaatattagatatatcaaataagtctgatttaaaaaagattgtataaaaccaaaaaatgttatgtggtataatgttacttataataacaattgtaaaccatacaatataaatatctcagagaatgatacaatttacaaactttaatctatgataaatgataatttaaatttaaaaatcactattttaaaaaaaagaaatcatgggacagattaagaagttacggaacatgttatatcggaaggggattatg

SEQ ID NO: 13918 - DNA, 1307 bp, Unknown
  misc_feature (1)..( 1307): cDNA_ID_2710647_gDNA_ID_2214671_Annot_ID_136611 3000 nt of promoter + ATG
ggagagagcatttaaagaagaaagagattttggttatctctttgtctctctgtgttcatatttattgcagagatagtgattttttaaattgacctttgaacatcccttttacatgttttcgagatttgtttttcttattaaacagccaaaaagtatctggcttttttctcctctctcaaagttttgatttttaagtgatttagggttttttcatcccctggaggaagaagtttgagtctttgtatctactttgatcaagtaaggtttgttacttcactgttctatgagaagattcttcttaaagtcttgaccttttgattcatttggattctacttattagatctgtttatattctccatagtcttgtttctattagtttatttgttggtggtactagatccaattttgtgtttttaacctttatttttctgttgtagattcttctttctctgcaaattccaattgtttattgatgttcttatccaaaattttttatttgatagaaaaaaaatgattgatttgattgcattgcagctttgtgagaaaagaagtttaaagctttttttcttttttgtcttctttcttatgacagtgagctaaagattcttcattctttgcttaagagataaaaactttgctacatttgtgtaaccatgattgcaaatttgctaacaaatgattcttacaattgttacaagtaatctagattaagccatgtttttgcaattttttcttgcgtattgttatggtattacagcttttatctaaatgtctttttctttaaattagtaaaaagttggaaagtggtcattgtagtggttgattgcatctttttgctcatgatgatttgtttttggacttgagaaaataaagaatcttttcgttcacatgtgtgactgaccataagttaagttatgtatcctttagaatattttgtgccttaaggtttgtttctgtcacaatcttcctggcccattgcttcgttgaacaactcttcatatggaggttgcttctgtatctaactttgagatttgctgatagatagattgattctatcctctagatagaagtttgcttatacttgtcttcttattcttgttatctgtttctttcttatgagtcctgcttgaaactgtttgatagagattgtctctttgatgtgtagattgttggtcgcgactggtgcttgaagatatagctttggttctttatgcaaggtttactctcttagaagaatgagagcaggtataaagtcttaagcttttgaacattttgcttttgctttgatggtctttgaattgttatg

SEQ ID NO: 13919 - DNA, 3000 bp, Unknown
  misc_feature (1)..( 3000): cDNA_ID_3020630_gDNA_ID_2214671_Annot_ID_189118 3000 nt of promoter + ATG
tgcagaaccgctacataccacatatgtaaacaatttttttcaagattggttcatctgagtcataaataatatttaatgacaaaaaaaacaatattttaaagtatttgatttgttgttgaattatttagattattaagatttgttttgtattttaaggagaaaattgaaaagatatggaagttgtaaaaatttgcattgaccatttgaccaatctgggtcaacaacaaacgaagaaacaaattaaaaaaacacaccagcttatctattgttagttttttttttttctgttttcaggtgttttcttaaatcacaagctacaaaccctatatttatcttctgcaacaagtcagcatcgaactctcagatcatttatcaattcatcttcttaatttacttgaccctttctctttacacgataatggcgagagataaagaagatcaaaacaatgagaatccttcaattgtccagaacatgtcatttccattcaacaccattttcttgatctcaagcgcaatcttcctcgtcacagccgctttctggttcgtagccgtcatgacattacattacaggaccgatgaatgtaaccggttcgtcacaactcccggaatattcataagcttctcattgcttgctatgtccctcactggattctacgcagcttacttcaaatccgattgtctctttcgaatccacttctttatcttcttcttgtggatgttcgttgtcgtgtctaaagcaatctttgtcatctttctacataaggagaccaatcctagattgtttcctgggaccaagatttatgagtttaggtacgaggattactcaggatgggttagtagattggtcatcaaagacgatgaatggtatcgtacaaggagatgtcttgttaaggacaatgtttgtaacaggctaaaccataagatgccagcttctgagttttatcagatgaatctaactcctatacaggtaatataacctaagctacacattaactaaatcaaaccgaatctagttttgattccggtttaatgtttttttttatttcattctaattttgtttctttttttatgacagtcgggttgttgcaaaccaccactttcatgtggattgaattacgagaaaccaaataattggacagtttcaagatattataacaatttagaagttgattgcaagagatggaacaattctgcagatacattatgcttcgattgtgattcatgtaaagctgtgattattgctgatgtacataatacttcattttccataacagttaacattattcatatcatctttagtctttgtatcggcatgaccggttggtttgcctggttaaggatccttcgagaaagtcagaaatagatttgtacacatatgtaagacacatataaataaattgtttctttttattatttcttataatttatatcccttgctcaaaaatcgctaggcgctagttgggcggtaagggtgagcctaacgcctagtaggaaaatcggagattatacgggattaatcggatattagttttagggttatttcatatttttaaaatatattaatccattataattaagaaaattatataatattgttttttaaattgtattaaacacatgaaaacaagattttctattcaaatttataatttttatacaaattacgaacataagttggatattttaaattttaaattttaaaatgaaaaaaaagaaaaaataaaaataaaaaaattgggctagccatcctctagacagatttaggcgggtctaaaccgacaaaaatcggatcaacgattaattttcccaatttagacaaaatcgttgcagactccatctgatctctatgcggccgattttttgaacaaggcttatatgtatacaatcaatttaaaccgattgaaagagtaaacaaaaggttataattttagtaactgtttgtttacttggttggattggactgtccgtcacctgccatttctgtctttgcacttaggaattagaaagtttatatgtatatttttcctggacggccactgaatttgtggatgtaatatatgagtttgtgtatcactgtattgtggataaaaagatttagggctaagcgttctttagaaacacagactgaaaatgtgaaatgaaagcatgtttgttgatgatttttgtgaattacaaaaagaacttagagaggatataatgtaaaaagacccccttcttcataattgggccttagttataattcccttggaattttatggtatgagttttttttgtttgacgagatccaacgccaacaaatacgaagctaacaaactctctcatctaacaaactatttctaaagttacttttttatttgtttcaatatatcaatcaatgaatataaatataaaaataaagaaaaccaaactattgtgatatcatataacaaccaaaataataaaattttatccaacctcttctactatatatgtatttaatctatatatagtccaattatagaaacacgagaccggcatgtacgcatttctgtttcccttctatctcaaaccccaaacgttccaatttctaaatacagttctctactttagtaatgtttaataatgtttctttcaacatttcagttttctatacccgttgtgacaagacactcaaattttccaggacttatgtttgactattttttaggcaaggtaaaaaattgcataagtctcgaaacttttgggtgttcgggcggattggttagttagaaactaatgcacgtcagcctctgaggttccgtgtaatagattctcatgttgtcctttaaaaatgaaactcttccctttgattctttttgttcccaaaacacatttttctacatcttagagtcttagagaagaaaggcaagataatcaatctcatggcgatgtcgatctccggagctgtgtttaatggtttgggttcttcgttcttgatcagtcgaggcaagagaagcggcgttggacttggcgtagtagct

SEQ ID NO: 13920 - DNA, 3000 bp, Unknown
  misc_feature (1)..( 3000): cDNA_ID_2705559_gDNA_ID_2214671_Annot_ID_189117 3000 nt of promoter + ATG
aataacttgaacttaaatctttgaaatatttggtctattaaagtcaagaaaattttctatatatataaaaaggaacatcaactattaagctatttcaagggaaaaaaaaaatttatataaaaaaaaaacactttataaaaaatacacaaatttaccaacgtgatgttggtctagtggtaaatctccctggaagtgctgggttcgagacatgttgggaagaaactattctccaaaaaatatgaatttaacctggtatgcatcccacttctaagagatgtaagatttttgggtttgaatttccagatattcaaataaaaaataaaataaaaaacacaaaattaggactcatagttgtgcttgcggatgttaacacaatttgcttcgacaagatatatacacaaattaggtttggttaattcactatccttatgatattcatctagcatctgatcaataggctgtgatcatctcagattaaacatagtataaccgatcgacttctaaaacatcaagacaacttacataaatagtaaaggatttctaacttctaagagattattctatattggttctctctaaaatcttgattaagatgataatttatgggaaacttttcacaaaatgttaatggaaaataatggtagataaagaacgtgggaaataagagaagagagacaaaaaaagacagaaaggcaaagactcgacaaattgggtttgatgaagtgtgatgccaaacttgtgtttgtcccaagacaaacaaccccgagaacgagcctcaatggcgtgaaccccttttctataccttgacataataaattcatatatttttaataaatagtatcttcaaccttttttgaaactctcacttttgtgtttcgtgcacttatctcacatagtcacattaagatattatatacaaatataataggtatatagatagatagatacatatatatgtgttagctccttttagttgatataaaagaagagaagaagaagaaaaagaaagatagcacaaaaaagcttctcatatagctaaaaatcactttgaagaatatgaagctaattagagtcaccctctttctttgtgcactagccattttattgcttgtaactccaacatcttctctacaacttaaacatccctactcatctcctagccaaggtaattaagttcactttttttgtcttaaacttttaaggtttgaatatgaagtggtaactgactttacttacaacaatacaggtttaagcaaaaagattgttacgaaaatggcgacgcgaaagctcatgatcatctctagtgaatatgtaagagattgttgtatgtatttatctcatattgaagctccagtttgatttctatgaaaagtttctaatcaaaccttctctattgcaaataataggtgatgacatcaacatctcatgaaggttcaagcgaacaacttcgagtcacttcttcaggtaaatcaatcatttgagaaattataagctgtttcttaatattatataaagtatttagacctttcttcttctttttcttccttaaagaaatcgataattagcaaactcacataacttaagcacacttctatagtagtcaaacgaagttcaaacaaatagatataaaagtcaaacatacgaatcattgaccatgtcagaagaaaatctttatcaatgtttcttttgctttcttcttcagaattttgttattatctttctaagtataatatataaaactaaacgaaaagattcgaaacctttctgggactttcaaactgagaagtataatatgagatgattttgtattaagtctagtttatgttttgatttcacaggaaaatctaaggatgaagagaagaaactaagtgaagaagaagaagagaaaaaagctctagcgaaatatctatcgatggattatcgtacgtttagaagaagaagaccagttcacaacaaggctttacctcttgatccatgaaaacattatattatttcaaaataactaataaaagttctagctagattaatatttgttattaggatggttattggttaattggttgtagtaacgtagtttagtttctttggaccattgaggaacaagttttggcgatattattgtaattaaaggaacatgttcgtgttatttttcttatattaatgataatggccgacaaaacactaaaactctggtttggggtttgagcttatttgctcttcgtttcacgcactgtaacatggtggttgagttggttacaataagtcaataatatatttatcaaattgatgatgcttacatatactaaagacgagtccacgtatgacaattagtatttacagtttatagttatgacaatatcaattatcaagagtcaagacgatttgttcatagttatgacaattactagtatttactgtttcgaaaaaagaaaatcagcgtaaagaacaagtaaatatttaacataattaccaaattactctggctcatattttcatctatttttcttaatttttataatattatttaggtttaaaattcgtaatacaaatattaatacatataatttggcacgaaaaattcgtgcagaaccgctacataccacatatgtaaacaatttttttcaagattggttcatctgagtcataaataatatttaatgacaaaaaaaacaatattttaaagtatttgatttgttgttgaattatttagattattaagatttgttttgtattttaaggagaaaattgaaaagatatggaagttgtaaaaatttgcattgaccatttgaccaatctgggtcaacaacaaacgaagaaacaaattaaaaaaacacaccagcttatctattgttagttttttttttttctgttttcaggtgttttcttaaatcacaagctacaaaccctatatttatcttctgcaacaagtcagcatcgaactctcagatcatttatcaattcatcttcttaatttacttgaccctttctctttacacgata

SEQ ID NO: 13921 - DNA, 3000 bp, Unknown
  misc_feature (1)..( 3000): cDNA_ID_2710639_gDNA_ID_2214671_Annot_ID_136613 3000 nt of promoter + ATG
gtctttatttgaagaccaagagtcgacgatcgtcttcaaaccgatcgcttatggaatcctctcgaaggagtttccggttatcatccatgatgttaatctactctcttattactttcatgtttccccttcctttatttttctattttaaactttcaacaagtgagttatgtggcaaagcttcaagttgttataatcgcaagttaacttaatatcagttgtttgacaaaaaaaaaactgtaaaacgataaaaacttggcatcggtaaaactttatctccttttaaaatgtcccagcgaagcaaactaaacaaaatttgctttaaaatctacttaaacattataacatagttctcaattcttaaatatgctaaagtctaaagactatgtatcgtaagctcacaacaatgtgtatgaaatacactagcaaatcacgatctagattaccaaactgtggaagaaaaaattccacactcacaaaaattaacaaaatttttaaaaacaaattccacactcattcatgaacatatatagttctaaactaatcgccagtgactagtaattgcgaccagcgagtgcgatcaacgaattgttctgttattcgtttgacagttgctactttgttagtttggtagtcactatgatttggtcgctccatccaacgactggtcgtttgatagttgttgatcgaagtcacagtcattagtctctaacgtgcctttaatataaggaatcttaaacttaataataaagaacacaaaactggactaatacaagatgccctaaggagcaacattaattgtttcgttaaatccataatttaatttatagtacagtttgttacttataaaaaacttacacgtattagttttgttatagtacaatttattaacttaatttgattcaaagtttccagtatttcccacaattcaatgtcatatggtcaaacatttcagcgacttgggtcaacctcttttccatgttccaagacatgtgtctcgactctcagcgatttcaagatcattgtctcaatcttgttgctattttattttacgtatataggggtataaattatatatgattaagcttttcttttaaatttatgtacatcttttatagagttgtattttaaaacgagcctttatcaagttttagatttgaattagtggttatttatccattggtcacacgagggtgatgattgtgattagaaatgtcatgatggaataatccaacctaatccaatcctagctagtagatcttgctgattggtctcatacagttttataaaatgcaagctcaacgtttgtagtcatgcaagccagttcaattagtgacaagtaacaagacagattttgcagattttacttagtacggtctagttggagcatatctgatcttgatttgttttcaaaacataattgtgagctggtcttgacaacctagttttttttttcttaatatatatagctaaagtatattttgaaccgaaatccaaactaatctcttagacctgtaaaacattgattcatattttgtcatttaaagccttacatgtcaagaaagaactgtaaacggtatttgtaaaaagagtaaaactcgatcattggccttgacccataaaattcaccttaaacaaaccgttggaccacacgttcttagtaaattgactagtacatggagttgaaaccttttaagacgtgataagatcaatgatgccattagcaaatgtgttttgtaacaaactagaaagtgatggtctcatcttcacccattttggtagcacttttaagtaagtaacttaggcgtgtgaatgtccataaagtgagagaaaagagccaagggtttttggcaagttttggcaaatatgatgtgatagtcccaacaactttgtttatacctacctactcgcaaagagaagcacgcataaataatataaccttatgtcaataacttgaacttaaatctttgaaatatttggtctattaaagtcaagaaaattttctatatatataaaaaggaacatcaactattaagctatttcaagggaaaaaaaaaatttatataaaaaaaaaacactttataaaaaatacacaaatttaccaacgtgatgttggtctagtggtaaatctccctggaagtgctgggttcgagacatgttgggaagaaactattctccaaaaaatatgaatttaacctggtatgcatcccacttctaagagatgtaagatttttgggtttgaatttccagatattcaaataaaaaataaaataaaaaacacaaaattaggactcatagttgtgcttgcggatgttaacacaatttgcttcgacaagatatatacacaaattaggtttggttaattcactatccttatgatattcatctagcatctgatcaataggctgtgatcatctcagattaaacatagtataaccgatcgacttctaaaacatcaagacaacttacataaatagtaaaggatttctaacttctaagagattattctatattggttctctctaaaatcttgattaagatgataatttatgggaaacttttcacaaaatgttaatggaaaataatggtagataaagaacgtgggaaataagagaagagagacaaaaaaagacagaaaggcaaagactcgacaaattgggtttgatgaagtgtgatgccaaacttgtgtttgtcccaagacaaacaaccccgagaacgagcctcaatggcgtgaaccccttttctataccttgacataataaattcatatatttttaataaatagtatcttcaaccttttttgaaactctcacttttgtgtttcgtgcacttatctcacatagtcacattaagatattatatacaaatataataggtatatagatagatagatacatatatatgtgttagctccttttagttgatataaaagaagagaagaagaagaaaaagaaagatagcacaaaaaagcttctcatatagctaaaaatcactttgaagaat

SEQ ID NO: 13922 - DNA, 3000 bp, Unknown
  misc_feature (1)..( 3000): cDNA_ID_3020634_gDNA_ID_2214671_Annot_ID_189115 3000 nt of promoter + ATG
cttctcttatttcccacgttctttatctaccattattttccattaacattttgtgaaaagtttcccataaattatcatcttaatcaagattttagagagaaccaatatagaataatctcttagaagttagaaatcctttactatttatgtaagttgtcttgatgttttagaagtcgatcggttatactatgtttaatctgagatgatcacagcctattgatcagatgctagatgaatatcataaggatagtgaattaaccaaacctaatttgtgtatatatcttgtcgaagcaaattgtgttaacatccgcaagcacaactatgagtcctaattttgtgttttttattttattttttatttgaatatctggaaattcaaacccaaaaatcttacatctcttagaagtgggatgcataccaggttaaattcatattttttggagaatagtttcttcccaacatgtctcgaacccagcacttccagggagatttaccactagaccaacatcacgttggtaaatttgtgtattttttataaagtgttttttttttatataaattttttttttcccttgaaatagcttaatagttgatgttcctttttatatatatagaaaattttcttgactttaatagaccaaatatttcaaagatttaagttcaagttattgacataaggttatattatttatgcgtgcttctctttgcgagtaggtaggtataaacaaagttgttgggactatcacatcatatttgccaaaacttgccaaaaacccttggctcttttctctcactttatggacattcacacgcctaagttacttacttaaaagtgctaccaaaatgggtgaagatgagaccatcactttctagtttgttacaaaacacatttgctaatggcatcattgatcttatcacgtcttaaaaggtttcaactccatgtactagtcaatttactaagaacgtgtggtccaacggtttgtttaaggtgaattttatgggtcaaggccaatgatcgagttttactctttttacaaataccgtttacagttctttcttgacatgtaaggctttaaatgacaaaatatgaatcaatgttttacaggtctaagagattagtttggatttcggttcaaaatatactttagctatatatattaagaaaaaaaaaactaggttgtcaagaccagctcacaattatgttttgaaaacaaatcaagatcagatatgctccaactagaccgtactaagtaaaatctgcaaaatctgtcttgttacttgtcactaattgaactggcttgcatgactacaaacgttgagcttgcattttataaaactgtatgagaccaatcagcaagatctactagctaggattggattaggttggattattccatcatgacatttctaatcacaatcatcaccctcgtgtgaccaatggataaataaccactaattcaaatctaaaacttgataaaggctcgttttaaaatacaactctataaaagatgtacataaatttaaaagaaaagcttaatcatatataatttatacccctatatacgtaaaataaaatagcaacaagattgagacaatgatcttgaaatcgctgagagtcgagacacatgtcttggaacatggaaaagaggttgacccaagtcgctgaaatgtttgaccatatgacattgaattgtgggaaatactggaaactttgaatcaaattaagttaataaattgtactataacaaaactaatacgtgtaagttttttataagtaacaaactgtactataaattaaattatggatttaacgaaacaattaatgttgctccttagggcatcttgtattagtccagttttgtgttctttattattaagtttaagattccttatattaaaggcacgttagagactaatgactgtgacttcgatcaacaactatcaaacgaccagtcgttggatggagcgaccaaatcatagtgactaccaaactaacaaagtagcaactgtcaaacgaataacagaacaattcgttgatcgcactcgctggtcgcaattactagtcactggcgattagtttagaactatatatgttcatgaatgagtgtggaatttgtttttaaaaattttgttaatttttgtgagtgtggaattttttcttccacagtttggtaatctagatcgtgatttgctagtgtatttcatacacattgttgtgagcttacgatacatagtctttagactttagcatatttaagaattgagaactatgttataatgtttaagtagattttaaagcaaattttgtttagtttgcttcgctgggacattttaaaaggagataaagttttaccgatgccaagtttttatcgttttacagttttttttttgtcaaacaactgatattaagttaacttgcgattataacaacttgaagctttgccacataactcacttgttgaaagtttaaaatagaaaaataaaggaaggggaaacatgaaagtaataagagagtagattaacatcatggatgataaccggaaactccttcgagaggattccataagcgatcggtttgaagacgatcgtcgactcttggtcttcaaataaagacgagagtgctggtagttcttctgccatcgaaggctgacgaacaacaataaagcttgatgccactagggttaagcgtttagaaacattttccctaaaggagaggattgatgaaaaaagtctctccttcgaagaggaggaaagaagaattggtctctcaatatatgaggaagaacatctcatatatgaggaaagtttctccaaaaaaggagaaaaatctctccaaattgtaggaaagtaacaaagaagactcgttaaaatcacaaagataaccggtaaaagtaatagaagcaaagagcaaacgttaccatgacatgactcatggtccaaatataatgggtctcgaggtacaaaggaagccataaacattggcccagctcaaaaatcatg

SEQ ID NO: 13923 - DNA, 3000 bp, Unknown; identical to SEQ ID NO: 13920
  misc_feature (1)..( 3000): cDNA_ID_2705559_gDNA_ID_2214671_Annot_ID_136614 3000 nt of promoter + ATG

SEQ ID NO: 13924 - DNA, 3000 bp, Unknown; identical to SEQ ID NO: 13921
  misc_feature (1)..( 3000): cDNA_ID_2710639_gDNA_ID_2214671_Annot_ID_189116 3000 nt of promoter + ATG

SEQ ID NO: 13925 - DNA, 1221 bp, Unknown
  misc_feature (1)..( 1221): cDNA_ID_2710651_gDNA_ID_2214672_Annot_ID_136619 3000 nt of promoter + ATG
ggtaaaacaatttttgctaggtatttatgtgaaggtacaatatctttctaaattttatatgacgtattccaagttctttataattcgtactaagcaatgatttctcacccactacaatgccaatgataatctagattcctgtaacgtcgtattcatgactttattaaatttggtttgttttttccacaactccattagatttgagtgaatagaaaggggtcgtctaatggataattgatcaaattctttaccaaacgtgtcaaatggtccaaatttagatagtaacaatttcattgaataaaagtcttctagatcgtggaaaaagcatataaataattaaccaaattcagatccaaaccggaaaaatgtgtattgtaaaaatttaaaatctccaaaccggctttccttcggtttaccgttaaatgatctaattttagtttttaaaatataatttcagaactcatacgttttgttacgttagtactatgtgttgatcctcgagtttacaatcttcgtttctataatccaaacgtcaagtttaaaaataaagttaacgacgggataagtattaaatggtattctaaaaagcgatttaggcggtcgactaggcgctcacggctcacgcgacgtatagacaactgtctaatctgcctaaaatcctatatacctcgttttactatatttttctagttttcaactaattttatatttctataaatagttataaatgtttatatagtatttgatatagttaaaagaatattttgtataatttttgtttacgattgaacatatatatatatatatatgtatttttttaatagacattttatataatatttatgtaaaaaatcatatttataatgtctttattataaacgcttaaccgtctaaaattatctatgtcctaactaagcgttctaggcgctaggcattggatcactgtccgtttaacgcctaacgttttcttgaatactattaattaaagtttttttcaaaaaaaaaacatttttttaaaaaaattcatttcgaaactaaagaaaatatccaagaaatttccaaaaatggtggaacctacacgatatggttcacatattttccatgaaaggataactattttgacttttctcatcacgctcaataatagcgtgttgttaatcctttactctatctctcttcaaagctctattgatcttacatcttctctctattgtagtaatg

SEQ ID NO: 13926 - DNA, 3000 bp, Unknown
  misc_feature (1)..( 3000): cDNA_ID_2705593_gDNA_ID_2214672_Annot_ID_136620 3000 nt of promoter + ATG
tctgtggcctacgagatcttcaagacgcatgacgtgaacatctcatcccacggccaccctccgattgacgagtgtctcttttttgggtcttcaagctttgtaatggctccttatggagattactggaagttcatgaagaagctcatggtcacaaagctgttcggacctcaggcactcgagcagtcacgaggcgcccgtgcagatgaactagaacggtttcacgcaaacctgcttagtaaggaaatgaaaagcgagactgtcgagattgctaaggaagcaataaagctgactaacaatagcatctgcaagatgattatgggtaggggttgtttagaggagaacggtgaggcagagagagttaggggattggtcaccgagacatttgccttgtttaagaaacttttcttgacacaagtgttacgcaggctgtttgagatactcagaatctcaccgttcaaaaaagagacactggatgtttcccgcaaattcgacgagcttcttgaaaggattattgtggaacacgaagagaaaacggactatgatcatggtatggacctgatggatgtgctgttggctgtttatcgagatggaaaggcagagtataagatcactagggaccacctcaagtccttgttcgtggtaaattctcctttcacttggtggattcattgagaaatccaatacaacaacattaattgtcctgtgtttttttttattacaggagcttatccttggaggcactgacacctcagcgcaaacaatcgagtggacaatggcaaagatcattaagaagcctaacattcttgagagattgagaaaagaaatcgattctgttgtaggcaaaacaaggttgattcaagagaaggatctaccgaacctcccttatttgcaagcggtcatcaaggaagggctaagattacacccaccagcacctctcttgggaaggaaagtcacagatggatgtacgattggaggctgttacgtaccaaagaacacaacacttgttgttaatgcttatgccgtgatgagagatcccgattcttgggaagatcctgatgagtttaagccagagaggtttctagcttcttcaagaggaaaagaagaggagagagagcaagaacttaagtacattccttttggcagcggaagaagaggatgtcctggagtaaatctaggttatatatttgtaggaaccgcaataggaatgatggtgcattgctttgactggagaaccaatggagataaggtcaacatggaagagactgttgctggaattaccttaaacatggctcatcctcttaggtgtactcctgtttctcgaatgcaactgcagaaatcgcagttcgtgagttcatgaattttgattagtaaacaaagaagctttgcattttatgtttccatgtctaagttttttccggtctagttggttacttttggtttattgtgaaaacctataaacagttgtgtattgttcttctgttgagttgtggatcggtttcatatttaatgactttcaattttattttatttttttgtcatccaatttttattagagctcaaacaagtcaaacctgaggaatgttgtttacataagtgacatgaagcggttcagtgcaaactttccgcgcaaattatccgtttttacatttgcacattacgagaaattaaagataaagagaaggttgtgaattcttcattgtcgctctgtagttcctctagataaactaagaccgccgaccttttcggttgaagaagataccatcttcaccaaatctaaaaagtctgtaaaaaatgctacatcttagttgtcgaaaccaattatacacttcattgccaagagtatagctgactttcaatattatgttccttaatttaggtttatgtccagaaaggaagaaaatgtcaatttatttaatttttattttaaaaaaatctttgaagaagatgctgaaaattatttattctaatatggaaggaaacaatatttccaatttacaatatgaaattttttaaagaaggtttcctatttaattcaattgctttttgaagtaaattctgtttcaaatttaagtctaaatttgtacttctcaattaatacaagtaagttatatatagactatagagtatagaggaaaagatataaagacaacctcatttcttggcgtgttcaacctctttagtctttccaaagcgttactacacataaaagccttttatcttaagcatacgcttaaccaatatcacacataaactgaatacattaatgtaaatatgcatgtatatattaaagttgttcttatgattttttcaacaaagttgatttcataaaacggattgatgatgtatctaagtcggagaatgcagagcggaggttttgcggtgtatcgacagggccttgcggaagtcttacaaatatataacaaagttgagaggaaaacatctatgaatccatgtccggcgattattcgatttggaagagactatcataaccaaatatgtccacaaggtctcaagttatcaaatccgcttaatgccgggagatactttagtaatgtttccaatgactccaagatgcaaccttctcctccaaaccagtggtttaattttccctcttggtactcctctttatctctctgtctcaatccctctaatatacgtcgaataaaacaatatgtaccatgcaaggttatgatatacgtacacaccaagttgcattagataattcaattcataaactaaagtttggagaataaatggcaggggaagatgggttataggttctgcgatatccttagtgttatctttctggaacaacgaaaggttacaaaaactgaaacgaatagaaggtaataaaattttaacatctttcatttgcattggctaaaaagaacttgaatcacattatatgttaatgtcatgtgtggtaatcttaaaacattcttcgaaagagcactaatcttgtctttgccatagtactttataaattggaatgatgtgatg

SEQ ID NO: 13927 - DNA, 3000 bp, Unknown
  misc_feature (1)..( 3000): cDNA_ID_2705589_gDNA_ID_2214672_Annot_ID_136621 3000 nt of promoter + ATG
acttcatcccaataatacttgtgaaaggaaggaacaaaaagaatgaataggcttcaaaaaggaggaaaatggaagtgggtgaagatccaccaccacaagcccaccagaaatcagaacgcaaattaaagccaacacgctactatttaagaaacagttccatagaaatgtgttatgaatgaaatcaaacctccttgtatgtctttgaaacaacaaaatctccattgtggaagggacgtctactttgtgttcatgttaaattaacattgttaattatgtaacccatcatctaatcatgtttcttaattcattatgcaatttctgtctaaggcatatatttagtgtttgaaacctgtcaacaataagatctattactccgttttttttttttttttttgtaaattccaagattaaaataaaacatgatactaaaaatgtgttaacgatgcaaatccactcaatgtactcttcaagttttgttaatatttccgcgcatccagtttaggatagttacatttggtgtatcaaaatcattttttccaaaatatttttttcagaaaacgaattcatttaagttgctaaaacataaataatctttggaaaacaaataacagtatgcagaacaatatcatgaaaaatgtaaacttcctaatattttcttagctgaatgtttgacccgacggacagaataaatactagtacataaataaaaaagaagccaacaattagatagttgttatatgatattaaatatgatttatgataattatagaacaactagagtgattaaaaagagtgagtgtaatagtggggttgattggcgatagactttcaagtttcaaggctttgagagtgttctaaagtcttcacagtcttattttgccaatcatgtttttttttttactttaattttttttataagttctcaaagccttattattattattattttatttatttttttgggcaaaaagtcttttttttttgttctttatttatcttatttttacagcttcgaatacatagtttttaaacaaataaatttaaaagctttctttcttcttcttcccatgataattaaaactctccacaagtttacgtatatttttttcaccaatcatttttaataaattaattattattaattttctatctttcttttaaaatctattttactaataattattttatttttatcatcaacattaatgtaggtgtaagagagtttacataattaacatttttcaaaaaccatatatggttcatataggccattcaaaatctgaataacaacaaaaaggatttaagtgctattcataaagaaagaaatcttcagaagtaatttgtgttggaaacatgggaaaaatcagttggataatttgatgaagcaaaacaacatttatcataataatcccgaattttctcagtttatcgcacttcttaatgcaatttttggttattgaaagaagaaatgaatgagtaatacatatccattttgtttgtcgagaatatttatttagtcatttattttaaaaagtttgtattttattttttattattaataaaatatttgttttgtcactatgttacaacatgatttaattttaatatcactttatatttataatatatatttaataataataaatataattaaataacaaacacagcttctatagctttttgttatcaataagatcttaaaggccaaagcttctaccgtcaatggcgctgccatataccactcatagcccggcagtcccgcaatatgtgtaaaatggtctcctcccctcccttatacacttgacatattgtagaatcacagagatggcgtcgatatctttcagcatttgacataatagcttggtttcctaccagccacaagaagattttcaccctctctggacccaaactactccacacacatgtccagaacctttccatgttaggtcgtgactcacaattgcaggttaatagtgagtatgcagatttgacggtgaaggctccatcaacactcactccccatgacaaatgatctcttgctaaccttatcaaccaccaaaacccccaatcttaaacttgcattttctgtgatatatggcagaatacgccccagctcccagcctctaccatcccaccacaaatcactaaaatggggcaaagtgctttcacttcatgtggatttataattacttttagccaaacacataattatctctatctccggttacttttgttaatatgttttggaaaaccaagaatttctagacttgtttatagtattaccatgttagtatttgatatacactaaaacctgagtaaattaataatgtagagacagtgaaactttattaatttatagaagtattgcggttgcggatggtggtgccgactgccgagaatggcaaggattgagtctgatgaacaagtatttcatatttggctgtttacataacaaaccaatctggttcaataacattagacttctttttaattcttgaggtcttgcttcagttcagttatataaacgtcttgaacgaggaggaacagaagcaagaaaatctagcacttttgggagaaggtattcaaaagaagagtaaagacggttcgagtgacgcttgggacgaaactaatattacatgctgtggtttcgggtctgggaagatcacgggcttcggactagaatctcctggtattcaaaaaaaaaaaaaaaaaaaaaaagaaagaagagcaaagaagaacattgtgtacattgtgagtcaatcttaaatctctcgattcctcacatcacattagctgtcaccttgggcggtgaacgctaattatttagttattgatattattaatttgttcctcgactctctcacaacgctttcacgttcgttcagtcagataacattttttaatgtaatgaacaaagcatgcttggtcttatactatataacatattcatggattattcagtagttctgtatctgccccctttgtttttgagaaacaatg

SEQ ID NO: 13928 - DNA, 3000 bp, Unknown
  misc_feature (1)..( 3000): cDNA_ID_2705581_gDNA_ID_2214672_Annot_ID_136623 3000 nt of promoter + ATG
attgtaaaacatttcctttcaaatagcttttaaagaacatttacaattacctctggttgtctttctactccttcatcttcttgttttctttcttcatcttcctcagatctctgattattcttttcctccattctaatgtccaaaatcctctcaatcatctcgactctcttgttaagatcttcaaggattgtcaaaatcctgtcaagcttctcgctatcagatattttgttattgattttgttttgacctacttcttcaagggcagcacaaacatcaacgcatcttgtattccattcagttttcttcaatctgtagcccatattaacaagtcccaaaatatgttggaattctatgtcgtctgtgtggaaatcaggaactaaagacttgaattcttctgggtttccaataattgtattcacctccatctgcgaagatacaataacattacaaatcttgagaaagcagaacttcaaatctaaaaaccatttaaagaattctgtaaatagacaaaagcttacctcagaaacatcatttacaaggtttacgatcttgaaaaactctggagtagtagtgcttttccacttcaatatcaatggatattcagattggaattctttatctttaactccatatgctgcaccaaatgctggaactgcgctcaacacccatattgttagcgctagtccaaatcctctcaaatcatatttctcttttgcccaagttttctcgtccattctcagaattgaatttgatagaacactgaatgcttctttaccccacggttgggctgtgtacatctcaaaatcagaagcatgctgcaatcttggcaaaggtatcttctcttttccatatggtgtcaaaagaattccttcagtcaacactactgcagcaagacacaacttttcttcatcttcaacagcaggttcaccttccttaggttttaaaaacaatcgatcttcgagatcaccaagagtataggatcctttactagcccaaaagtatggttcttttacaggatcttttccctttcgtcgaagttccctatgaacaggttcacattgaattcctgtatgaacaaaagacagtgtagagactattattacaggttttatagtaaatactttaaaaacgattgtaaatcatgtttaacacttttaaaagcttttaaaagcttttaaaatcccttataaatcattcaatgccacttacttatgctttaaaaacgattgtaaaccatgcagacacttttaaaatcccttgtaaatcattatatgacacttacttatgctttaaaaacgattgtaaatcatgtttaacccttctaaaagcttttaaaattccttgtaaatcattctattcaacttacttatgcttaaaaaacgattgctaatcatgtttaacccttagaaaaggttttaaaatcccttgtaaatattctatgccacttacttatgttttaaaatcgattgtaaactatgcaaacacttctaaaatcccttgtaaatcgttttaagacacttacttatgcttttaaaatcccttgtaaacgtgtttaacacttctttaagcttttaaaatcccttgtaaattattctatgctagttacttatgcctaaaaacggttgtaaaccatgcataccctttttaaaatcccttgtaaatcattatatgctactaacttatgcttcttaaacgattgttaatgaagtaaaccccttttaaaagcttttaaaatcccttgtaaattatctatgacacttacttatgttttaaaaacgattgtaaactacgcaaacagttatgcaaatgccttgtaaatcattctacgacagttaattaagctttaaaaacgattgtaaaactttattacctgttgtgagatagaactctctcaaggagaaacggataggttgagaatcaactctaaaccaaagagttgatccttttgttttcactctctgctgcatgagatagtgaaagatttttccagaaaatctgattcccttcttagccttcatttttggtcccaattcaactagaggaccaagaaacgaacttctaatcttctgaaataaatactcgcctaaagcttcctctactttactaactaaattccaatccgagtattgttgaacggttcccagtgtaatagattcctcaccttctctgtagatttgttcaggcaatgcaaggatttcactctctgaatccatctgcaaaacatgttatgaaacagcgtcagatctactataaaatcgactataaaatcgactataaaatcgattataaaaacggttaccgtcggatctatcgatatctctggggattgtttgcgtcgtagagaaatgatctgaatccttcagcgaagaacatgtttatcggagaggaaattcgtcggcgattttggggtttctcagagagaaaattcgtcggcgattgtgagtgaaatcggagaggaaattcgttggcgattttgagtgaaatcggagaggaaattcgtcggcgattttgagtgaaatcggagagaaaattcgccggcgattttgagtgaaatcggagaggaaaacgaagaagtttgtgccaaaacgaagaagtttgtgaaacgaacgtgaaacctaatcattcagagggtaagacagtcatttgccatattaaaaggggcagtttttaaaatggccttcaggaaaggacatttttacaaaaggttattagaataaggatagttttgcaaatctcccatctcccttaaaaaaatagtgcaatctacatctcaaataagatgatatattatcctttaaaaaataacataaaattacataatttctcaaaaagaaataactccgaaaattacacaaatatttagagatattattaactctgatttactttaatcggcgcgtgatcgagaaagatcttctttaacctctttgcaacaaatctactcaaaaccctaacccctttttcaaattacttccatctttagatcgaatcaaatcaatg

SEQ ID NO: 13929 - DNA, 3000 bp, Unknown
  misc_feature (1)..( 3000): cDNA_ID_2705565_gDNA_ID_2214672_Annot_ID_189137 3000 nt of promoter + ATG
tgtggtcctcattagtgcttggctcaacacctccaaagatcttgttgtatccaatgaggaaaaaacaacaacatcctagcaccacatagcaacctactttttcgcaagtcccaagctaacagagatggaaaagagagacctttaatgctgtaaaaagagatgggaaaagatcaatgagggttgttgcaagtttgtaggaagctatgtggctgtaaccaaagagaaaaccagtgggcagaacgataatgatgtggtgaacttggctcactagatcttctacaatgattacaatacaaagttcacccttgagcacaattggagagaggttaggtttgatcagaagtggtgcgtccaatatgctacatacggtaaagagaagcgacaaaaatgtgatgaacactcttccccatcctatgtgcaacttggccttgaagaggatcaacctcgccccttggggtaaaggcagccaaaggcaaagtgaaacccaaagccaaaactaatttggaaggtgatgaaaacaagactatgacagagatgcaaaatatttggtctaattaaggagaaagatttagctttcaaagagaagctacttaatggtaacaagaagctactcatgttaaagagaagctaagtgaagagaagttactagataggctacaaaccaaaactgagcttctatctgacatcgagttggctcttaagcacaagttaataactgatatgttgtcctaagtttaagtttctaattgaagttgtatatttgagtttatgttctttttttagtgtatgtttaatgcttttgtttcagttgtcttctatgcttttgtttcagttgtgttatatgtttaaatttcagttgtattatatgctttaattgcagttgtgtttgatgcttttgtatccaatgtcacatgaatgaaatgagtttattaattgtgtcctaagtttaagtttaagttgtgttctaagtttcagtttcggttatgtttggtctaattatttctattactatgctaactgtctaattatgttgattctaaataattttgcaggatctagaagacacaactagtgccaacatcacttgtacaagacaccacaagttttcaaagccaccacttagtttgtttgtttttttgtgcattggtttgaataattgtacatcacaaaactatattccgatattacaccacttgtattcattgttcgttacactttgtgtttatatatatagtacataatctttattacaacaaacaatacaattctctctattattctctaaaacaatcttccttttctccaaaaaaatatttcttttctccaaaacaatcttccttttcaccaaacaatcttctttttctccaaacatttatcttcatagttcatcaaacatgagatcttcttcatcttataatcttgacgataagtttgatcaatttttcaatgaaacattatagagatatgttgatcgtcaaccaaccaagtcaacaaaaatgagcatatattgcaagagatcgtgaactaggacacatccagttgtagaacgattatttcaaagaagatgcgacattccctcctcatatattgtgacaccgatttagaatgaacaagccattgtttatacgtattgttgacggactctccaatgaaatttcatgctttgaacaaagaagagatgttatcggcaggttaggtttatcggcactacgaagtgtacaacaacaattcatatgattgcatatggttgttcagtggatgcggttgacgaatacctacagattgtgaaagcacttcgatatcatgtatgatacattttgttgaatgaattatatatttgtttgggaaagagtatctaagtagacctacacgacaagatcttaaacgactactccgtattggagaggtacatgaattttttgggatgataggaagcatcgattgtatgcactggaagtggaagaattgccccaccttttggaaaggataatatacacgtgtatctggcaaaccggcaatagtgttaaaggctattgctttccaagatctttggatatgacatactttttttggacctccagatttcttaaatgatatatatacttgattgcttaccagtttttgatgataaattacaaggtcgagctccaaaagtgaaatatatcgtcaactggacctactatcatttggtttattatctcactgatagaatttatcctaaatgggctacatttatccaatctatttcaattccacaaggtcacaaagattctttatttgttacaaattaagaagcttgttgtcaaaatggttaacgtgctttgggagttttgcaaacttggtttgtaattgtcaatccagctcttatttgggataagaaaaaaataggaatgatcatgcgagcatgcataatacttcccaatatgatagtagaggatgaacaagataagtacattcagtttgatgcagctgaattcacacaaccaaaatcaaccagctctttacaaatggatttcaactattttacagatatgctttcaaatctcggcaatattatggccgctcgagcccgagttcgtgatctggctatacatccacaattgaaagctaatttggttaagcatatataacaaacatttggcgggaattaagctaacaattaatcgttattctgattttcgattttcgtattttatatatgcttttatgtcatgtatctttaaaattggtgtatttgcaataactattcagttttataaaataaaatatttataatttttattttaataataatttttttttaaaagcccacttttttcattagacaaaaaaaatttaacaatctatccaaaactcttaaatttgaatttgataaaatttataattaaaagatttggaagagccccataaaaagctcttggacttgcttttagttttaaaattgttaaggctaaatatcttttttttttttgtcaaccatgtacatatatcttggtgatg

SEQ ID NO: 13930 - DNA, 3000 bp, Unknown
  misc_feature (1)..( 3000): cDNA_ID_3020668_gDNA_ID_2214672_Annot_ID_189136 3000 nt of promoter + ATG
taataaaacgttaattgtatacaaaatcataccttagatcttcaaaatctgtcaatatggactggtaatggcagaattgcttttcttctgagctcaaccttttcgttaaacttgcgtattaatgcattgttttgtttaaaggctggaatgcatatatacgcaagagcagcagcaaaaggaaaacgtattcaggtaaagtcttgcatcttttcccatttaaaagtcttccttgctatttcgaaacgacactatgtcaaattgcttataatatattgactcagtcaaatatgggggcgaaaaatcatggacttgtcttgcctgatgccaacatcgatgcaactttaaatgcgctacttgctgctgggtttggtgccgctggacagagatgcatggcactgagtacagtggtttttgttggcgatgcaaaatcatggtactgcttactttatatattcaaattactccagtttctcgaatatcttatatttcttgtgataaacacattttcctgtaatctttttctctcgtacggtttccagaaccacgcctttagggtgcttaagccatatataggatagttaagataacaccattttctttaatttagattgactattgttgtgtcctaatactaaatgtaactgaagaatatgtatgaggcctgttgattttcatttgacagtcatgaaagattagctttaacttgtctaatactaaccagggaggataaactcgttgagcgagctaaggcccttaaagtcacatgtgggtcagaaccagatgcagacctgggtcctgtgattagtaaacaggtattttcgcgcacaaacctctgaacttacatgtgtaaaaattatgtttagttttgcattctgtctgttgttcaatatgtatacgttattgttaaattttgatatgactaggcgaaagaacggatatgccggttgattcagtctggtgtagatgatggtgctaaattgctgcttgacggaagagatattgtggtattttcccattctccatatttactgctattgcaacagactcatgccttaaatatagcactaccctccacattcttatcaaatagtaatcatcaagaaccgcagaaatatcttgatttaataatctttgtgtaatcttgaaaacaacgcaaagatcaactggtccgagaagtttatatgttttctcttataacaaacaggttccaggatatgagaaagggaattttatcggtcctaccattctatctggtgttaccccagacatggagtgttacaaggtattttctgacattaaggcaaatgatccgtactctacttgaatcttaaaaattcatttttcttcgcaggaggaaatatttggccctgttcttgtgtgcatgcaggtcagattggaaaactagtcttatatcattcatttattcgtgaattgtgagattaatgccctctgatgcttttgtgacatattcatttacaggcaaacagttttgatgaggccatatctataataaataaaaacaagtaaaacaccctgttctatcatcatcttaatactaaaatttaatcgtctcatcatcttcaacaatttgctacttacgccgtcaacaggtatgggaacggtgctgcgattttcacgtcgtccggggcagcagcaagaaagttccagatggacatagaagcaggacaggtatgaagaactttgggccctataaaatacaacattacttgtatgcatttgattacatgtttgatatcttcttttgttgttgttaatgtttgcccagatcggtattaatgttccaatcccggttccattaccgttcttttccttcaccgggaacaaggcctcattcgcaggagatcttaacttctatggtaaaattcttgtcacaactaaacaaaagaagatccattctcctttctctttgcttatatatatactttgagtgaactatttttgcaggcaaagcaggagtggactttttcactcagatcaaaactgttacacaacagtggaaagatattccaacttcagtatctctggcaatgccaacgtctcaaaagcaataatgagaccttaacttcaaatactttttttacttttggattatcgaatcagcttcaagaagaaccctttgtttatttttcagctctctagtattttctcatgcttagtttccttcttttaatcactatggtgactagaactctagaagtaaccatgggaataagaaaaagtaaaaatctcaaatttgcctaatttgtcaaataaaacccctaaatgacattctttgagtcgtaaactcataaaagtcaaagtgaaacttatatatacaagttattatgtgtcttcattcccaattgaaacccaaaaatccctgaattcaataaactcgaattacgaaattttgagttttattttgactgttttttaattatcatgtaaacaactcaatctacatggaccatgaccaaagaaaactgaaaccttaaacctataaagtagtatcattatttagtgaaaactagttcccaaaaaaaatcactagtttaaaccttattgtattttttgaactttaagatgttgtagactcatcaaagtcaaagttaacgatctttaatttattgtgttttttcttttccaattaaaacccaaaattcaataatctttggatcgaaaatttgagttttgttttgactgtttttctaattatcatctaaacaaactatacacgaccatgaccaaaaaacataaacttttcgccttccactataaaagtatcatcatttagtgtaaactagttccaagaaaaaaatacacttgtttcaaaccatattagagttaatagcatttatcgatatcatcacatgcatttaccgctaacctttttctataaattgactaaagtgtctctcattttatgtcactcataaaattgctatgttttctacttagaaatcactacttgtttttgaactctcttactctttcaaaatg

SEQ ID NO: 13931 - DNA, 3000 bp, Unknown; identical to SEQ ID NO: 13928
  misc_feature (1)..( 3000): cDNA_ID_3020680_gDNA_ID_2214672_Annot_ID_189133 3000 nt of promoter + ATG

SEQ ID NO: 13932 - DNA, 3000 bp, Unknown
  misc_feature (1)..( 3000): cDNA_ID_2991029_gDNA_ID_2214672_Annot_ID_189132 3000 nt of promoter + ATG
tattacaaatgtgaaaactgaaaaaaagaaggaaatttgtattatcatttttagtttaatacttttaaaatcgaggtaaatattacaaatgtgaaagttcaaaaaaattatatgtattatagtattttgtttaacattttttaaaagttgagataaatattaaaaaaaaagtttaaaaggggaacttatatcgtcgtacattagtttaaatcttttaaatatcttttcttccgttttttattaaaaacatattgcaccgaatatttcaaatatgttaaaatacccgaatatgtttagtgagcttatcttcggaaaaaaacaaattggcccggtataatttacaccgtcatatgtaaaaccctaaaactatatgttacaaatctctataaatataggttgtcattcatgaaaaacaaacataacagtttattttatgcatattcgttatgatttatagttttgatttgtaccataaagttggttctttctatgatgcatcatctcatagatctttgcttattgttgatcgacgacctcttaaacgaggattatagcctttttatttgattcacccataaatattgaacctaatttgtggtatattttaagcaaatgaatatttttttaactttttagtttttttttaattactaattagtttaagttatattttgatctgataaaaagtatttgtgggtcttcccacgcgtcagacccaaaaagtattaaaggggtcagctgacccctctaaaattctatatttgcattgtagccctttaaaattattttgttttttccctttttaaattacaaattagtatgtaaaccttttaagttttatagtatttttcttctactttgtcttttgacactatttcttactttttttttttttttttgattcatccataaacattgaacctaatttctggtatttttttaaagagatgaagttttttttttaggtttttagttgtttttaattacttattattttaagttatattttgattctataagaagtatttatgggtccaccgcataggcagacccaaagaagattaacatttgcattataaccctttaaagtttatgatatcatttatattttaagttatattttaatcttcttaaaattacaaattcgtatgtaatccttttacgttttatcgtatttttcttctactttgtgttttgacactatttcttacatgtttttaaatttttttgtttgtttcacccataaacatttaacctaatttctggtattttttttaaagagatgaagatttttttttgagttttttagttgtttttaattacttattattttaaattatattttgattctgtaaaaagtatttatgggtccgccgcataggtagacccaaagaagattaaaggaggtcaattggtccccaaagttcaacatttgcattataaccctttaaagtcttttaaaatattattttatatttcttctattttgatcttcttgaaattacaaattcgtttgtaaatccttttttttttttttgggcatttgttaaccctttaaattacaaatttgtatgtaaaatccttaaatacttcaaaagatgatcaaagttaaagttattttaaaatttatttgcattatttcgttgaatgatgtggtagaattagtctttgatcttaaagatttggtcttgaagaatacacatatataatttgcaagtttatatgggattattttgtagatatatttatgtaaatataaaaaaatgttggaaacttattttttcctatgattccagtcggatgattgagtggttatggatagcgccaccaaaatatttcataactttgatgtttttatgagttacaattgatgtataaatcatttataataagtacgttatgtttcatcgtttgtaataaattaggcacacattaaattctctaagctatgtctaatattagtaaattacttttcgttttgaaaatcgtgaattagatgattgagttgttatggagatcgaaagtgttgagctattttggtgttttaagtgtaataatttatggataaaatgtttgtaataagtttggcaacttttaactatgtctaagattggtgattttactagcagtataaataagcgagatattatcataaaaaatcgctctagcggtttgcatagtataagcgagcttcatctggcttatttacctttgcaatatcctcttttgtttccgtacggggaggatggtttctggttagtgatggaaatcggatttgttgatacgagaggaaggaagagaaaaatggtcactatgagagagttttgatgaatagagacgatgcagattttatgctaaaatattcacaaaaagtgtgtgatgatgatataatttagttgctctagtttctaactttatttgttgaatattttgtgactatacgatctattgtattactgctccaacttagccaatttaaattcgtttgtactgattgccaagagaaggtattttagtattaaaaattttcatatgtgattagtaataatgtaatatcttcgtaaaaatactcttttcatattgatttctttaccattttgaatttcttgatttcattttaatatacgctaaaaaccgatttcggttttgtattactaatcaaacacgaaatacaaggcataaactaaacgtgaatattttgttacggagtcaacaacaaaattggagttaattcagttttgacgacttaccaaaaccaggattaaattgttcaatacgcaaacgtcattcttaaaactctcatactaaataaatagtgggcgtttttgtaaacccgaaaaagtagaggggttcttttccgaagtcttgtaatttcccagaccgtcgacgacaaaactctacacatgtccattaacgtctggatttcgattgtcaagaagttttgtaaaacgcaaactccgataatctttctctaatctccgatcgtgttttcttagtgag

SEQ ID NO: 13933 - DNA, 3000 bp, Unknown
  misc_feature (1)..( 3000): cDNA_ID_3020693_gDNA_ID_2214672_Annot_ID_189127 3000 nt of promoter + ATG
cggtttcatatttaatgactttcaattttattttatttttttgtcatccaatttttattagagctcaaacaagtcaaacctgaggaatgttgtttacataagtgacatgaagcggttcagtgcaaactttccgcgcaaattatccgtttttacatttgcacattacgagaaattaaagataaagagaaggttgtgaattcttcattgtcgctctgtagttcctctagataaactaagaccgccgaccttttcggttgaagaagataccatcttcaccaaatctaaaaagtctgtaaaaaatgctacatcttagttgtcgaaaccaattatacacttcattgccaagagtatagctgactttcaatattatgttccttaatttaggtttatgtccagaaaggaagaaaatgtcaatttatttaatttttattttaaaaaaatctttgaagaagatgctgaaaattatttattctaatatggaaggaaacaatatttccaatttacaatatgaaattttttaaagaaggtttcctatttaattcaattgctttttgaagtaaattctgtttcaaatttaagtctaaatttgtacttctcaattaatacaagtaagttatatatagactatagagtatagaggaaaagatataaagacaacctcatttcttggcgtgttcaacctctttagtctttccaaagcgttactacacataaaagccttttatcttaagcatacgcttaaccaatatcacacataaactgaatacattaatgtaaatatgcatgtatatattaaagttgttcttatgattttttcaacaaagttgatttcataaaacggattgatgatgtatctaagtcggagaatgcagagcggaggttttgcggtgtatcgacagggccttgcggaagtcttacaaatatataacaaagttgagaggaaaacatctatgaatccatgtccggcgattattcgatttggaagagactatcataaccaaatatgtccacaaggtctcaagttatcaaatccgcttaatgccgggagatactttagtaatgtttccaatgactccaagatgcaaccttctcctccaaaccagtggtttaattttccctcttggtactcctctttatctctctgtctcaatccctctaatatacgtcgaataaaacaatatgtaccatgcaaggttatgatatacgtacacaccaagttgcattagataattcaattcataaactaaagtttggagaataaatggcaggggaagatgggttataggttctgcgatatccttagtgttatctttctggaacaacgaaaggttacaaaaactgaaacgaatagaaggtaataaaattttaacatctttcatttgcattggctaaaaagaacttgaatcacattatatgttaatgtcatgtgtggtaatcttaaaacattcttcgaaagagcactaatcttgtctttgccatagtactttataaattggaatgatgtgatgtatgcaggagaggcggagttggttgtggaaggggtagaggctgtagcagaaatggtggagaaagtagcgacggcgactgacgaaatggctgaagaaatggcagagaaactgcctgagaaaaataaactaaaacaagtggctttggttctagaacacatttcagaggttgctgcccatgaagcacatctaacccaagatttccttcacaaggtacaccacaacactttatcattagaaaaattgatctatgaaatatacataaaaatcttactaaaatctaacactaacaaaggctaatgtaaaagattacattttgaaaatatgatctatgtttttgggtatcttttattggtttatcatttgggggatgttttggaaccaaataataatcaaacatatatatacttttgattgtgattgactaagtcaaaacttacaaattgcaggtggaaaaagtcacacaagatatagatgacttggaggcaatgataaagcctttgatagacaaaaaagtggcaaatgctgaaacaaagcaacaaactaaagaagaagaagcaaaccatgagtcgccttcacgccactaatctcttcatatatctcatctaatttggttgtaacaaaaaaaatcttcttcgaaactgtctcttaatttattttttcattctttcaaaagatactgtatatttttcattctatagaaacaaaaatataagacttatttaatgatttgctgtatagaaaatccaataactgaagaaacactagaaccacacaaaaaaaacgccactttaaaactagaattttgtgcaaaaaactctggaagtagataatttttgctactttaccttcaaaaaatgtagaaaaattttgtaaaatccaaaataatacgcaatctaaccttttttttttcacaattgtcaaatttttaaaaggttgatatataacaatagcaaatcaaagctctcaaaatgagtagttcaattatacatttagaattacaataaacaaatatatgtaatcgtgaaaacatttacaatatatgtataaggactagattgtgtattatttggaatttcatatgattatttttattttttggaagtgaaaagtaaaattgtaaatttcggcattttttttttctttcttaaattttatcatacaacaaaaaattaaaaattgcttttgtaacacagagaaattaataagataaaaaaaaaaagatcacccgacgtcgttttagaggtaataaacctatcagaaattcctaatttgctcttctttcacttcctctctcacacaatcaaccactgaatccggctgttcaaaattcgcaacatttgagctccctcatttctttctctgtattgtcaaattcttatttctctctaccaattttcttttgtgggctctcgtcttttggggttaagcttctgaagttctcttaaaaatcttcccttttaggtttcaactgttgttgagatctgtcactatg

SEQ ID NO: 13934 - DNA, 1221 bp, Unknown; identical to SEQ ID NO: 13925
  misc_feature (1)..( 1221): cDNA_ID_2710651_gDNA_ID_2214672_Annot_ID_189126 3000 nt of promoter + ATG

SEQ ID NO: 13935 - DNA, 3000 bp, Unknown; identical to SEQ ID NO: 13929
  misc_feature (1)..( 3000): cDNA_ID_2705565_gDNA_ID_2214672_Annot_ID_136627 3000 nt of promoter + ATG

SEQ ID NO: 13936 - DNA, 3000 bp, Unknown
  misc_feature (1)..( 3000): cDNA_ID_2710655_gDNA_ID_2214673_Annot_ID_136629 3000 nt of promoter + ATG
aatctgtagaggagtaagtagaagagttagtgaggataatcatattcgtcaacatgcaaaagaagaataccaagttaaccagttccaaaccattatatcagtcacgccaatcatgtcatacacataattcataccgatcatatcatttacgttggtcacatcattcgcatcgatacaacgaaacatgcatagattcccaatacataacactcaaactaataattttcaagattaaattacaaacgatatatattgatgcaacttaaataacaaacgtaaaaaaaaaacctatacacctattttgctacaaccgaatttcacatttgatgacaaaaataaaagatccgtcatctttagaaatatctctactgtctttgaccgacgcttttatctccggaatgcgaagcttcacttttctttgaaggattatggattcatcacttttcttatcatttttaaagacaagtttcgcttcatgtttttgggtatgtcgatggtctcatcaaaacaagaatctcctcttacatggtcttagttattaaggagtatcatgattcatggcttgctttcacataaaggattttggggtcttgaagttttttcttggcatttacgtaggtaaaatttctttaggaatttatctatattaacatattatgctcttgacatcaccctcgagagggccttctagctgccaagtcgacagtttgttctctggattcgcattgatccaacaaaacatgcatattcttggtcataggttgagggttatgactttcattgatcatgtttgttttagacaccttattgctactttgctaggttgattttatctcagtgtggaaacactaaaacaaaatgattccatatacttttatttgcatttaaatatctccaatgttgagtaataaagagttgtattctaacttgtttttctaaccaatttttttatgcaaaagaaattcaaacatcctaatcgtatggccaaatatagtttgtattttacaaagtctccatattctatacattcaatagatattcacctaaatatagtttgaattatgtgtcgtctagtgcaataataatcctaaacataaaacaagagagcgagagatagtgaagaagtgccccgaggattcggcgtttggtcgtgtggtctttgttgcaaaaacaggttgtgtggctctctcccttttatctccttatctctcctcttcccttttccacctcttatctttcttactttcttatattacaatatccctccctaattccattatatattttgttttatccccaaaccttttcaaagtcaactccgtctcccaccccactctctcattatataaatatatattttgccaaaaaattcgtgatggatcctaatcttcgtggatcagaatagtaacgtgcagttcaactgcggataaagtacaatgcagttctaatagtaacgaaaatatctacatacactgcaccgcacaatgcggttcgatcaccgttcggaaccttttttggaaacaactttcctactaagtggattcgaatcaaaattctcatctttcaaattaactattagaccaagaacctcttggtttatccaactatcatccttttttcattctgaattttacagaaaaaaatgtggtggctaagtaaacataggttgcatgtatgcatgacttactaatactattatcatggttccaatttttttattttatttcgactaatgtttttaagtgctttcatctttaaacaaaatctgagccttgtaattgaactcaattatatagttttggtaagaaattaactatgaaagatgatgtctagtcaaaggataccaagcttttaggagatgtattggaaaatgatctgagttttagttgagtttttatatgattttgatgattttaggaaagttgatacgaatttttataaaatcttttcaaatttcatctaaaaccgtataatttggatttctatatttttaactaaaatgtttttctcaaatcttctccaatctttcaaaattaataagaatcaaattgacaaaccgttttcaataacaataaatttttaaattattagtttaataacactaaattttattattaaaattattaaaatccataattagataacataaaatttgtaaattttacacaaatcacttaaaatactagattaaatacactcttcgtcaataaacaaatttagtaagcgggttatacggcgggtacactcaccaagagtttttaagaagattagtcagtggtaagagagtcttgatctctgattaaaaaaaaagagtgatttgattattattattttgaacacgacaaaacaaactaatgtggaaaaactgaaaaatataagagagaagaagggcaaatatgcaaaggtaacacaaatgcattgtgagccatacgtaagctcaaagatttttcacgttgctcttatctgccacgcggccaagattccaataaggcaagctacttgattgggataaactaaataacaaaataaactacttacaaaaacatcatgtaatttaaaataaataaataaaataaaaaaaagaaaaagaagaagatatattaaagaggtttgtgaagacgaaggagtccaaaacctccctcaggagcttccgccttattcagaggttaaacttctctcttccttgcaaatttacttcttcgttttctccgcttgtttgtgtctatgatcttgcctatgaaacatctttttatagtacacatatatgttgtcttattggaaatatgatcggctaacatatttgttattgttattaacaaaaaaaataacatttgttattgttcaccggagttgatagtagcaatagtacatattacatggtcatatatgcatatggctacatgtttgagttatattcgattatctggtgaaagatgagattgtgagtttgtaagtttttgacagtgtagaggaggatccaaaagaaaagaggaaaaaatg

SEQ ID NO: 13937 - DNA, 3000 bp, Unknown
  misc_feature (1)..( 3000): cDNA_ID_2705601_gDNA_ID_2214673_Annot_ID_136630 3000 nt of promoter + ATG
ttacaaagaatgtcatcacattaaagtaatttttttttattattttttaatattgttgatatatttttaactttataaaacattattattatttaaaattttaaaaaaaatatcatgagaccggacagatttggattgatatgaaatatttcgggacgggtttagactaatataacactggttaaatatttattttattattttatcattaccaatttttttagttacaacattaatataaaattatataactttaatactaaattaaaaactttaaaatttaatattattatatatatgaataaaacattaacccgtggtataatgatgttgggaatttaatgaaaaaaaacctcaactttggccagatccatttttaaaccctgaactatgtttttagtaaaacaaaccctgaactaaaacctgttaataaacttaaccccacagtaataaacttaaacctgttaataaacttaacattgatataattatggtaaaatagagaacaatgaattatgtttgacaagatcttccttttcaaattatttaatttaatctttgcatatttagacttgcagcaactgtcaacaagtcggacacaacaaacgttcatgcaagcgtaaagcagtgccaaaaccacccaagaaacctcaaggacgaccaaggaaaaaacagaaaacaatggatgaagagaaccctatcactcaaccaatacaatcttctcttcaaagttaatgcttgacaagtctttactttagaatatcttgtccctctgaaacgattgtttttttttgtgacaaatattgttgtgttgcaacagcttcgatagttatgttggttggatttatttaagcatgactctttggattattttaagttgttgtgtctttctttcagcttctaaaatccaaactaattaagcaattcaaaatcatttagaacactaaacgttttttttgtaataaattcaaaacagttttaaagaacatcatgtggtttttgcgctaaatacaaatgtctcgttgttgttttttttggaaattaatatcccattaatatttaatactgtggggttaagtttattaacaggttttagttcagggtttgttttactaaaaacatagtttagggtttaaaaatggatctggccaaagttgagggtttttttcattaaattcccaatgatgtttactaaactaactaaaacaagtaataacaaataaactttaatcactatcttctgatctcattgatgacacgtcactatcaatatcttctaattcttctttattatctcgaaggaattctggttgcttatatccggctctggtccaatcataagacatgcttgagcttcaggagaatctgggttcattcttgatcgagtttcatctagtatttgacctccaatgccaaaagctcgctcgctcttccatccatgaatgatttgaaagtattacctgcatctgcatcactaaactcaaaatttgtagataaataattttcaaagagcttttggactaacatagatatgccatgagttgtccataataaactgaaacatgtagtgaagaaccctaatcttgatcactttggatgcttcttcatcaaaaagaattagtgatccttgtaaactataaaataaaaatatcattaatacaatttacaaacttttatatatattacataattataaaattttaaaatccactaattttagaaaacatattatcctgtaatatatcgctgatcaattcctagttgtttataatttttggtgtgatcatatatattttcagttggtatatgtcaccatgcaacctaatttgtttctttcaaataattatattctaattcatatagttttatctttttgtggtctggaaattcaaaagtttaaccctaaccctaagtaaaatatctcatgcctacccttaaaaaaataaaaaataagcagcagtccataattccattatagagaaaaccaaaaccaaaaccacaatctcatcaaccaaatattattaatcgtccgataacccaatctctcttttctccaaacgcttttttttttctctcacttcaaaatctccccgagacctctcgccttctctcgcagccgacgatcccatccaaaaccaacgctctccggtgatcgtctttcctttacctcgccgaccttctccgtcttctcaattacgatctatcatcaccagaatccgttttctctcttttaactccgatacaaaacttccgataatcccaaataaacgttacgaatttcagactcttttttccagtttctgtttgaattcgatttcgaaggattagattctccggtgagatttttagaagcgtgtttgatttttcaaatcaaagtttgtcaaaactcttagcgtgaattttctccagagtttatcatctcttatgtgactgtgttttaatagcttcttctctatagctcttcctttgtgcttcttctctgggaaacttctctattcgtatacctaattctagggttcgtttatcctaacaattcgagatttagagggctttaggattcgatttcgtgttttaatcgtgtggatctgctttcaattcgtttatcgtttcgttccactgaattgagtttgttgattgcttagacttttatcctcgtcttgttgtttgctcaattgaagagcagagtagcttccgttagatctgctttgttgtggcattgatggagaggagaaatcaattcatgttacgtgctcctggaattctggaataatcttaattttcagttgaaacaatgctttgcttctcttattttcctgttaatcaataactaagtgtgaagtgtggtttttatcgaatttttttagtatcattttgatgcaggttattaactcattcgtcttcttctttttcttagttctactgagacgttagaagaattgtggctgttgtcgactgcaaggagagcgcttactttaattgctgatttcatgagacgagatg

SEQ ID NO: 13938 - DNA, 3000 bp, Unknown; identical to SEQ ID NO: 13936
  misc_feature (1)..( 3000): cDNA_ID_3020724_gDNA_ID_2214673_Annot_ID_189150 3000 nt of promoter + ATG

SEQ ID NO: 13939 - DNA, 3000 bp, Unknown
  misc_feature (1)..( 3000): cDNA_ID_2705609_gDNA_ID_2214673_Annot_ID_136632 3000 nt of promoter + ATG
aagagaaaaagctaaagacttttatggccgtccagattttttctggctttgcctgccaatagggattatcatctggcaactaccagctctttccggtgttggccagctcttgtctggcatcattcgactttcatagcgatgatatctggttttgctgtcggcacttctttgctgctttttgtttttttataaattagttttttttgaataaaagttgcggttaaacctcatcggatatgcgtagtagtggtggtgtttgtggcaattctccactcaaaagggtcttacctatccttgggtttacggtttatggaaaataattaggcgatttgcaatttagttgaagattcaatgcaatttctcaacttattactattgcttttagctgtttcgttttattaaagcttcgattgatttagttaacagaagtagaatagttggatatcttatctcttttacgttgttttgcgatgaatctcaaaaaaaaaaaaatgatgattcaagcaagtgattgagattaatggttccatattagatctttacttctgttttgtagttatcggagaattacagaagaatttatactcgattcattcgatgttagtttcaagctccggtggaatcgatggcttcaacggcgaaagaggatgacgaaaatcttttgtctcctcattttccacgcgttatcgatgtcgtgtcttgagatcttttatttcgatccaatctttttcttaagcgatgcaaatggttgggctcgtattgggccttattagtttcgtttttacaattaaacgagattaaatgtcggtttaaggttaaaccttaaagaatatgtacctaataaaaataaaatactaatattatctatgaaaaaaacgttaaagtgattattaaaataaaatttatgataatatattattagtgtttatatgtcggtttgagtttattaaaacgaggttacgatttaatgttacaattataaacaatttaatgttaataagcaaatgttagagtttagatttttacaattaaatgaggttaaatgttggtttctggtattaaggaataatttagattttccaattaaacaaggttatatgtcacatgactagggtttagattttacaattaaacaaagtaatatttcagattgagtttataaaggaggattaagctttagattttacaattaaccgagattatatatttatttaggtttaataaaaagtggttagtctttatattttacaattaaatatggttaaatgattgttttcgttttataaaagtgattttttttgtcaaacataaagagtgattaagtattatattttatctacatgtacatttgtggtagattttttggtcaaaaatcctaatactatttactaataacatacaagtcctcacaaatcctatctcaaccaaatattttattcctaagaacttacaattcgttagtttgcattacataatttaattaactatttcctttattacatattagtccctacaaaatctatctaaaaaagatttttgtctaaatttatatctttaattaaatcttatctttattaaactacattcaattaattactaatttctttaaatctgtttatctacattaaatacaaatatatgacttttctttcacttttatttgttcttatatctaatttcttaaattttataaaaagaaatatagttaataaaatattagattttttccagcatatgatgtaattaaaaaaatttaaaacagacttatattactcaatcgatgaagaaaaaaaaataagtgaaaaaggtcccacattgcttaagatattgcgaaaatggttcagactcttactataaaaagaaccaaaatgattttgaatatgaatgaactagaagcatgatttattaggcatccaaaattaaaagtattatccggcatactctgattctttattttagaaaaacttgaatctttaaaaaaggtcaaatttttattaatatttaaactttattaaaagttaaatattacaagttttaaaactttcaaaatttaaactttataaaacgtttaattatttataacttaaaacttttatgaagttaatattataaatatatatataaatatattaatacaagacggtatactacatgtgaaatcctagagataacaatcacaattataacgtttggatagaaattattttttttgaaatttcaaaaattacaaattatttaaaatttataaaaaaatgacaaaatgatgtataatttcacgggacggtgttatatagtggaacgagtttggatcgatattcatatgagatggcatactatgggtcaaatcctagaattaacaattaaaatataattttaaaaattaaacaaaactaacaatattaacaaaacaaatataacttaaaatttcaaaatttatagttataaaaatcatcccaaggtgtatcacacataaaaaaacaatagcatataactatagatcatcttaacaacaaaaattcaatcttttgataaaaatataggttgtggaccccaacatttcttttaaagggatcaattagcattaattgtggatgtcggattcagacactcaagtatttatttatttagtgggaaggattattcttgaggacaaatatactataaaatagataaatgattatagaaaaaactatgagtattgtaaaagaatgtgtatagctaatttacaccaagaaatgcgtgtgtctttacatggtcttagacccacaatttatacccaaagaatacatttaatacctatttactcacaatcattctactttaaatatatctgtttttagtctttgaattaactatttgaacgtttaaaccgagtccactccgagccttctggacctcagctctcgccccattcggtttctccaatttgagtaatcctgacttcgatgctgccttcatctcgcaaaccaacatctcgcccatactctcacctcgaggatg

SEQ ID NO: 13940 - DNA, 3000 bp, Unknown
  misc_feature (1)..( 3000): cDNA_ID_3020713_gDNA_ID_2214673_Annot_ID_189153 3000 nt of promoter + ATG
cgtttagtgttctaaatgattttgaattgcttaattagtttggattttagaagctgaaagaaagacacaacaacttaaaataatccaaagagtcatgcttaaataaatccaaccaacataactatcgaagctgttgcaacacaacaatatttgtcacaaaaaaaaacaatcgtttcagagggacaagatattctaaagtaaagacttgtcaagcattaactttgaagagaagattgtattggttgagtgatagggttctcttcatccattgttttctgttttttccttggtcgtccttgaggtttcttgggtggttttggcactgctttacgcttgcatgaacgtttgttgtgtccgacttgttgacagttgctgcaagtctaaatatgcaaagattaaattaaataatttgaaaaggaagatcttgtcaaacataattcattgttctctattttaccataattatatcaatgttaagtttattaacaggtttaagtttattactgtggggttaagtttattaacaggttttagttcagggtttgttttactaaaaacatagttcagggtttaaaaatggatctggccaaagttgaggttttttttcattaaattcccaacatcattataccacgggttaatgttttattcatatatataataatattaaattttaaagtttttaatttagtattaaagttatataattttatattaatgttgtaactaaaaaaattggtaatgataaaataataaaataaatatttaaccagtgttatattagtctaaacccgtcccgaaatatttcatatcaatccaaatctgtccggtctcatgatattttttttaaaattttaaataataataatgttttataaagttaaaaatatatcaacaatattaaaaaataataaaaaaaaattactttaatgtgatgacattctttgtaaattcttactttactaacacaaaagtactataaaaaggtacttcaaaaaatttaatatatataatgctattttttgtaaaacaactattatatataaatacgtagtttaatcataattctagattgatatacttgtgttttttactaactttattattatttcaatagcctaaatttgggcattttgttaatattatttgagtcagcaatattagcttaatacgtgcacagtttatttttgctagaaaaaaaaaattttaataaaaatcagaaaagaaagttttaggaagtgataattattttgtacaattgcaaatttaaaacagaaaatgtggattgggaaataattagggtttcaaatttttaaaatgttacgtaattaaaaatttttaataaaaatattgaagcatatattgtaatataagatttgattcattttattaactgaaaataaatatttaaaacaaaaattcagggtgattaatgttggtgtcggatcccgcaccatggattcggatccagccaaagattgcggcacaagtagaagaagcccataagagggagggcccataagcatcctcgaggtgagagtatgggcgagatgttggtttgcgaggtgaaggcagcatcgaagtcaggattactcgaattggagaaaccgaatgggccgagaggtgaggtccagaaggcccggagtggactcggtttaaacgttcaaatagttaattcaaagactaaaaacggatatatttaaagtataatgattgtgagtaaataggtattaaatgtattctttgggtataaattgtgggtcaaagaccatgtaaagacacacgcatttcttggtgcaaattagctatacacattcttttacaatactcatagttttctctatgatcatttatctattttctagtatatttgtcctcaagaataatcctacccactaaataaataaatacttgagtgtgtgaatccgacattcacattttgtcgccgtctgtggggacggatgattcttgagtcatcagcttttttctgtgtgttacatacccgaagtgatccgcaatgtcaggagaggatactaccaacgcttcgatagccgaaaccctcaagaccatgcaacaaactatggccgatatggcgcagaagttttcaaacgtggaaaaaactgtcgaaacactgcaaacaacccaggtatcgcttagccaaaatgttagtactatttagtctcgtgtccgttctttaaatacaggaaattctagagttcgaagaactatcttcggatccccaaattcccttccgcgaaatgcaaaaagtgatcaaacgaccccggagggtacaaacgcggagaatcaaccagaagacggagaaacgcatcccgaggacgatgaccagttcggtgatcaacacgagcaggaaaacttcgaccagctcgaaaccatgaaagaagtaagtcgagagttgaaagaaatgaggtcgaaattccaccaagctacaagctcggagccggatatcaaccgggttatcgaggaggctaggcgaacaccgttcaccctgcgaattgcgagtttgagaatcagagattctcgaaaactcaacttagaaccatataatggtttggaagatccgaaaggctatctcgcagcttttctaatagccgctggtcgagttgatctaaacgcaggatattaaaaacttttctctgaaaatctgtctgggcaagccctgatgtggttcacttagttggaactaggatcgatcagtaatttcaacgaactatcggcagtatttttaaaacaatactcaattctgatggataagagcatttcggataccgatctctggaatttgtctcaaaggccgaatgagacacttcgggctttcatcaccaaatttaaaacgtgctttcaaagctcccaaggatctcacaacagtcggctctgtcggctttgcgaaagggattattgcattatttgaggtttaaggaagatctaatacttcacaaacgtgatactattcaagacgcactatttcgagcgaataattgg

SEQ ID NO: 13941 - DNA, 1251 bp, Unknown
  misc_feature (1)..( 1251): cDNA_ID_2710687_gDNA_ID_2214675_Annot_ID_136634 3000 nt of promoter + ATG
aatgtagtattaatcactacaattttccatttgttcttttgtaaggaaaaacaaaaaaacaaaaaaaaaaaaaaaatcgaatttttaaaaaattattacctaaagtcgaaagtgtctagatgatcagtggttgttcaacaaattgaccttgacaattctccttttcattaaacattttcttacaaacgtactcaagttcttaaacaaaagtagtcctaaaaaaagatatacatccacttgtgtaagaatcaatacttttgttttcttcctcgtagttaagtaatttacatgtatttgcaaaatcgatccccaaagtttgatattactcacactttgtaaccaagaaacaacaatactaatgagacacacgagattattatgcactgggttctctgggtcccactgcttctgcttttgtcggcttgcgttttgtgggtggagaatatatgtcatgagaaacgtatcatctaaccgttagatcaacgacgtctacatatctttcaatacaccgcgtaacactgaaacaaaacctctcttccccactttcttcttcttcttctttctccatagtcatttctaagtccaaccatctgattcttcgacatgaccttttgttcttcttctcttttctctctctcttaaacccaatttgagattgttcgatttcgatctacgagattcttacaagaacataagcagcttcggttttttgggattatcttatttggtcggatgatgatcttctcgatgtctgtgctaggtaaattctttattttattttgtttttgaagttgtattaaattctttaatttagtattaaatgttgaatctttatgcgaatcttgttactgggtcgtctcttaactccgtagtaaatggaacaaatttgccgactttttatgtaatttggttataagattttagcaaatgctttaattttggggttttgtttgtttcaaagtaaagtacttgagtctaaagatcgttggtgaagcataggactaatcaattttgagtctttactaagattgtaattgatatagaaatttcccaaaagtggagacttttagtggttattctgcaacattttattcctaattgttgtttctgtggaatttagtgtgaattcactgtaatgatttggtttttgtttgttttgatttctccttcaggctttgggaattagatatatttggggttaagctcgagtctctccggttttgagtttacttgagtttgttagtatttatg

SEQ ID NO: 13942 - DNA, 3000 bp, Unknown
  misc_feature (1)..( 3000): cDNA_ID_1018268_gDNA_ID_2214675_Annot_ID_136636 3000 nt of promoter + ATG
tcaaacttttggtttcattcttcgctgctcacgttctttctccatttgatgttttatgtattaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatctattacttccagttctgtcttttgcattacattcttggagacgtttattctttcacttccatgcacaagatgagaccaagattcggtccatccaaccaaggtacagagcaccatctctttcttcaatcgcatacccgttgctgtaatctctcaagagggctctaatggtggctgaaatgattgagctcaaggggtatggctcaaaacccgccatggaaaaccttgacttccatttcccgagaagctcgtgtctttcgatcctctcggctccttcacaagctatgatgttgacgacatcccttgccatgcagtgctgctcgatattgatcctttccttgtgatttctcggaagcataacatcgatagattcgaacattgccgtgtaataacttaatgtctcaaggaacctaggaaggaaaggggaagtgttcgtgttgcattcttgttccacaagagtgactactttaggtgatagactcttcaccatcctcagcaaccggtccctgtggttttccatgcttacactctcatctggcaaatgatgcagcatgtaagcaaagttcactccaagggcttcgccatctcggacatcaagattttccacttcaacttcacaacttggccttgaaaccgcattgaacctgaatggaacatcaaacttctttgcaagtttctctagtctcttcttgactgtaaccaagacagatccatcaccaactccggtaattcgaatatttggagccccaccaggcctagctgcaaaagcctggataagtgctatccactggctcccttgtccaatttggaagtcaataatgtgaatcctctcttcatccttcattgcttctgcaatcgcaccattcgctgacatgtatccaaacttgaaatatggacaaacctcatgcagaacatacacataagataaaaattcataactctctggttctctggactggagagacttatatatcgaactaccagaagcagcaagcctagcaacaagcccttctaacatataagctcccaatctctggattggctcaccagaaatcgaaaccataccgcgcaactcacccatacaccatcgtgccattagaagattattctcagaaacagcttttgcacaagcaacaagtaccaacttcaagtctccccttgatattgcctccactatcaataacaaatctttagcatcatcaggccacatggagagttcatggcagatagcatcatcgatactctcagctatctctggcagtggctgcaacattattgaacctcttacattgtccatcacaaataagcaagtaagaatctttgaacatcaaccattatcctcaaatgaccttttatttatctgatcttcataacaaacacctgtagaattcatagacaaagtcattaatcagagactgaattagatatcaatattgaacaataatatccatggagatcaaaactctaacaagaactctagtatcattgaaatcaactcatgactctatgaatctacgtcagccatgaactacttcatcaataaacaaggcatacaagagttccaatcctaaacaaactaatttgacaatttctcttcacactttagagtaaagcttgctagaaagagcaatcatttacaacaaaccaacatcaaacttatcaaagaagaaatgttttcatgttttgtggataagaagaagcagagcatcaaaatcatcaagaaaagagaataaaggtttgatttttatgagaaaaacaaaccttgtgtaggttaagaagtgatctttcggtggaagtcgataagggatttggttttgcaagtgagagatccaaccaaagctcgcagctgaagcaaaaggaagaatctttttagttgctgtagtgaagaaaataacacatcacatacgacgtcgttttaggcttaaaccgaataagacccgatcaccgacttgacacatctcgcttaaagtctctggtcaaatgggaaatagtgtaagaagcaatctaagagacatcagaggacgacgatcgatggatcctcggatgtggcacaaagtcgccgctatttccggtgagatttaagataaagtaatgatcttttgattttgatcttgtgaggaaaggtactgattcggatagaattggtttaggt

SEQ ID NO: 13943 - DNA, 3000 bp, Unknown
  misc_feature (1)..( 3000): cDNA_ID_2705634_gDNA_ID_2214675_Annot_ID_136641 3000 nt of promoter + ATG
ctgtaagatcgccgcggagattgaaaccggatcggagaagagaagagagtgagcgtctagagaggtagatcatgattcgcaactttgtagaaacgtcggaagtttttttttttaccgatcaattcgccggcggctataaataatgatgagcaaaacggtcgctttgtttcccctgtgggagccgaagttttacaatttggaagttctaaagtgcaatttcgtaattacgtgaatatgttaggcaatgtttacaattaaattttgtagttacaaactatcttaggcaatttgaaagttatcggaaaaatggtcaaaatcaacataaaatgtgaaggctcacctcttatgccactattcgaaaataaaaaattagtagtaccactcttatgtttgagttccagtcaagaatgcacctgaaccagaaatttgaatttggagtgccattttttaatctgtatgctattctatatgtgttattcttatttcaccattaatgaatgactttttatttaattttaaaaaataaaataaaaaaataagaaaaacataaatattctgtatatggaccctacaaaaacgctggatttaatttagtggttatatttactcaacatgtgaaccccactaaaaaatattttgtctttttgcggcagaaaatactcatagttgtactgttgtaccatcgtgttcatagttgaacttttcacagttttcataatttacagttgaactagacggtaaataattaattataagttgaactcacactttgtctctattattttgcatttccaaagttttcataatattacatcggtaaaagcttagttttcacctattttacttcatataaggtgatcatatactaaatgttccttgtattagaaggggtgtattatatgaaaacaacattgttttttagaaaatattaaattttattgcattgatataaaattatttatttatagctttagatattcgtatataattttacgtgtataataaattatcaatttaaaaaatttaaacattttagcgttactaaatcgaactagttgaactaattatattaaatgttactacgaaaaccaaagaatagacatttgaactagttcaactaattaaattaaaaattatcacggaaacaaatacatacatgtttttaatctaatccaataagttgaaccaagttaaactagttgaattgttcatataaatccgagaaatataaattcaaaacacacaaattaatttttgaataattcactctaatgcccttttctcaatgcccttttgcaactctacccttttttgccattttcatttctaccctttctaatacttttctccccaaattacccttaatgagctacccacagacctaattcatttcttcactctctctcttcttcttccatcggaaattgtgaatgtcgttgaatcccatgccgtcggaaatagtgagtttactcgccgtgaaaacccatcttcgccgtcgtaagtagagctgtgtgtcgccgtcgaatctcttacgtttcccaggtttgattttataatgttagcttaaatcttcgttttcgaattggtttattcgatttttgttgttgattatgtgaattcgttatttgaatcctgattcaatcgacagtttgacatttgcttcagcttcgaatttgaattttgtttgagatttgatgattgaatttgtttctaaaatccttgtacattcgttatactgttctaaaatccttttgaattcgttatactgtttcgtgatagatttgcttatgtgaattcgttatactatttcgtaatagattttgattctgatttagtgtttacctcttttgcatatgctttcgtgatagatctatgccacttacgctttaaaacgatttgtaaaccatgttaaccacttttcaaagcttttaaaatcccttgtaaattattctatgctacttacttacgctttaaaacgatttgtaaaccatgttaaccacttttcaaagcttttaaaatcccttgtaaattattctatgctacttacttactctttaaaacgatttgtaaaccatgttaaccacttttcaaagcttttaaaatcccttgtaaattattctatgctacttacttactctttaaaacgatttgtaaacctttcttctctttgtagtgacagtgtttttgtggctgttgattttgttgttatttatcttatcaggttataatgctagaattgtattctgtttgtgccttgtggaagttgacaaacaatatgacttgggaatttgaattagacattgaattaggagcttctttagtgctcattgatgagcacattacctatcacgcgttggttgatattcttgtagaggattttcaaatagatagttcaaccaattctttgaagcttagttacaagttagtctccacgtctacaaccatacaatctcatcctctttatattaggaacgatagactgcttgcaacttttatgcacaaattctcacagagtggaggattgcttcagttatgtttgactgtagagcaaatttctgtgacagttgagcaggtttttcaataaccttcttgtgttataattttaaaaatccttgtaaaatcattattaagtcagtgattgtgcttattacaggctgagcctacttcaaatccttttgtttctcattctatccctaatgctcaggtactaatcgttttaaaaatccttgtaaaatcattattaacgtttttaaaccccttttaaaaatccttgtaaaatcattattaacgtttttaaaccccttttaaaaatccttgtaaaatcattattaagtcagtgattgagtttattacaggctgagacgacttcatatccttttgcttctcattctgcatctactactcaggtaataatccttttaaaaaatcttgtaaaatcattattaacgtttttaaaccccttttaaaaatccttgtaaaatcattatttaagaaagattg

SEQ ID NO: 13944 - DNA, 3000 bp, Unknown
  misc_feature (1)..( 3000): cDNA_ID_2710675_gDNA_ID_2214675_Annot_ID_136643 3000 nt of promoter + ATG
gttttgttgttgtaggccactatcaatcgcgggaaatattgtagatacaaagtggtttacaaccctagagacgccagggaaagcaataacaacaacggtatgtccaaaaatccttgtaaaattggtaacccatgaattacatatagtttttaaagcatcattaagttatttacgaaagggattttaaaaagggttacatggtttataaacaattttaaaagattagaaagtggtaaagaatgatttacaaggtattttaaaaaggatttacatgacttgcaatcgtttttaacggattagaatgatttacaagggattttaaaagctattaaaaagggtttaattgattaacaatcgttttagaagcagaacttagtggcatagaatgatttacaagggattttaaaagcttttaaaagtgtttaacttgatttacaatcgttaaaaagcataagtatgtggcgtagaatgatttacaaggtattttaaaaagggtttgcattttttacaatcgtttttaaaggggttttctaatatgataatttttatttttgttgtgtttagcatgttgatgcagctttggagttgatgaaaacgaggaaggaaagcaatccagaattattcaaaaacaaatcagttgtatttgttggatcgtctttcttaaatgtgattgatgagtcatacatggagtttttggataacaaagagggatttcagtttcagtctgaagaaatcagtaagctgataatagaggaagaaaccaagtgcatattggctcctttctgtatcaaaggaaaatgctgggttgccttgctcatccacttagaacagaagacagtttgtatatgggaatgtgcagcttcttatttaacagaagaagtcaagaaaaaatataattgttgcctactctatagttatgccatacattgtttggaacatcctcaaaaaaaaagacatggatgtctctccatttagcatcaaagtcctgaccacttttcatatatcatagtcttagaaatgaatattccgtaagtcctgacttctataacttctttgcttaagtaattcttttggtttttggttgtaggctcctagaaatgaagagtctggtatctatatgctgaagtttatggaatgctactcaatgtataccagccattcaaaccttgaagggaacataattcaaaacgttaggaataaattggctgctgacatcttcaccgaattagggtcagtcactttgtagaagtagcagacttctaatcaaaaagtagtggagtataagatagatttatcagcttttgtttctgatttcataaaactttgtcatttgaatatttcatgaacatctgtatggaacaagatttatgaagtttatttagttcaactcctgttttacaaaattactgtataatggttgtttgggttaacaggtgctttgatttgaatggaaaaggactttaaacatgcttttaaacagggtttttaaacgatttacaagctgctttataaggattttaaaagtgttgaaaaagctgcagtagcggttattatgaaaaaaatttacaatcgtttttaaaatgatttacaaccgtttttaaaagagatttacaaacgatttataagctgttttaaaagcgttttaaaagtgttgaaaaagctgcagtaactgttattatgaaaagatttacaaccgtttttaaaatgatttacaaccgtttttaaaagaaaatttcaaccgttgaaaaagttacagtaatgttaaacactgtatttgttactagttgggcctaggcctgttatttagaaaaacaaactgttttagtttaaaaaaaactaaaagccccaaaaacactaaagcccaaaaattcactataacctaaaaacaaattaaacagggattggctgctgacatcttcaccgaattagggtcagtcactttgaaaagatctacaaccgtttttaaaatgatttacaaccgtttttaaaagagaatatcaaccgttgaaaaagttacagtaatgttaaacactgtatctattactaattgggcctaggcctgttatttagaaaaacaaactgttttagtaaaaaaacactaaaagcccaaaaaacactaaagcccaaaaattcactataacccaaaaacaaaaaaggaagggaaccgtgaaaagacaacaaaaacgtaaccaagaaaaaaaaatataaaaaaatacaaactgtcgtcttcgtcttcttcctttcaacaatctgaagaaaatctgattatccagcaaaaaggaagcaattgaaggtaactaatttacgaaactgaagtttaacatttgggtttattcgatttttgccgaatctcttttttgttctagcatttctaggtttttcggttgaaaacgaaacaagtaaaatagattgatatttgggattttgaaggagtgttggaagttgttatataattttgatagatttatgttttaaagtttgatgtttgggtttcaaaaaccttcaaagaagatttcaaatgccgattaacttctctgttgtagcaatttcaaagttttttcgtttggaaacttcaacagtaaatagattgatgtttgggtttgtgttttaatttatagatcctcacttaatttatgggttaccagttgattggagttggtttggaaaaggtttttttttttctattttcagcggctatgttctttgaaaaggattaaaattttgtttttggaatggtttcaaaacggtctttaaaaaggattatggagtaatgactgtgttttacaagggtttttaaagtcttaaaacgacttgtaatgactttgaaaaatggttttacaagggtttttaaagttctttaaacgacttgtaatgactatgtttatgtttcaaaaactacaaatgcataatagattttcaaaaatggtttttaaaaccatttcaaaactgtgttaatttaatgactgtgttaatgtatttaatcaggttttgagaaatatg

SEQ ID NO: 13945 - DNA, 3000 bp, Unknown
  misc_feature (1)..( 3000): cDNA_ID_1808156_gDNA_ID_2214675_Annot_ID_189190 3000 nt of promoter + ATG
ctttactttgttttttgaattcattgttactttgattcttcgattagctttagtttacggctttgtgttgctttgcttgctttgtgttgcttttgattcttcgattagctttagtttacggctttgtgttgctttggttgctttgtgttgcttttgattcttcgattagctttagtttacggctttgtgttccttatattgctttgtgttgctttgtgttgcttttgattcttcgcttagctatagtttacggctttgttttgcttatattgatttgtgttgctttgattattctattagctttagttgtgttgctttgattataggtcttttgtgtgttttgatgcagaaagctaggatctagatttggctatttgagcatatagatttaaggattgaaagaagaatcactgtaagtcatcatcatatattcttttgatctacacgttttttgctatgaatttgttgacattgaactttgtgtttactttgtgtctttcgtttatgaattgtttagtgtgttattgttttaaggagtttaactggtgatgatatgtaactgttaagtgaatgagtttaagaagctttgtctactatctttattgtcaatgatagtttgatttaagaagctctctgttatcctgtgacctctacttttggctggtctctaagcttggtttgtcataattgttaaaatggaaaacagtttaagaaacacgtgagtattggttggtctctaagcttggtttatcataatgattgtgtcttttgtcaaaagtctttaacatgagtttgctttagtgttttggtttagtaatggtatagagtaatagtaatggtattgagtaatggtatagactatagagtaaaggaaatcgatgaagtttgtttgtttctttcctgacattagctttgaaattggagttaagacgctatttagtaaatgagaaatcgagttttggagttaagattcattgaggttaagtaatagccaatatggatggttacttgatatattttggtaagaccatactctggtttctgtttcatattttgtgtcatgattgaatcacttttgagaatgtgtcatggttgaatcgttaggtagtactagccaatatgcatgcttgctcttattggagaattggtgatgattcatagaggaacattacttactgacattagcacaatttaagatctaacaaagtatcttttttgcttcataatctaatgccaatgtgtttttttctttacaggtttagtaatctgaaattgaagtttgaaaatgggaatgatcaacaacgaaaaaatttgaagatcaaagccaaactctctttttcaaactctactttgattaatatgagaatgtagctatagattatttgttacttaacataaggcattttagtcatttatatattgatgagaatgtgaattatccatccaaatgatcaaacaaacaaagctccatctaaatgatgcatttagatgaactagcaaatgatcaaacaaacatcattaagatgaatcatccaaatggattatttggatggatcatttggatacaaattccaaatgatcaaacaaacatgacctaataataataattttaataaatgtttgttgcaattgtgttttatttgttacaatcttttaaacaatctttttaaactaaaatatatatatttgtcgtttgtcattttcagaaaactgcaatctgaataaaaaatttctacggtttttttttttattgtatcacctcataatcattcgcaagttgcaactatttagttgaactattgcaatatttagtttattataaattattgcaatttttgttttgtttaatgagtcgttgtaatttttaatttatttgatgaaccattacaatttttgatatatttaatatatacgatcgcacctcttggtataatttttcatatatatttttaaaattttaattacttaaaattaaaattaaaaaaaactattacaaccgtttaattgaaccattgcaatatttagtttatttgacgaaccattaaaattattggtttattttatgaactcttgtaatattttatatataaatagtagcgatctgactaaatgacttatacgtttgggtttctcaattttgtaactgtgtttgcattgtaatggctcatgacctaagcctaatttgggaggcccatatatataaaaactctgtaagaaacaaggttcgaatttgtagcaaatgtaatctttctctaccattatgtgactcttgtaagagccatagccaaggaaaattacttaagttaggtaatgttctgtgaaatatatttttcctcctctgtaaataaagtgtgtttttctatttacttgcagtttgacttcttgatctggtaagtgttggcttttaatatatgatttagtgtgacatagcgaatcatgcaagaaataatatgtagtgaagaaacaaagcatctctaatagcaactaagaatcatagacctctggatcctccagtacatatcatcgtatagtttaatttaaaccaatccataatacatgcatttttgttttgtaattaaagttttaaaacccacggtttgaaattttatgttcaaaccggtctggtcgagtagtcatcacggtttaagataaaagataaagaaacgcaatcgaagataggattattgatatatcatcacaaagaatagccaaaaaacaatccaataaaataagtgttaaacactatcctctcactgaagcacaagatcttccattgccagatggcaccaccacaaccattaccaatctcctcataggaccaatgaaatctaaactaaactctttcaacgaatcagaaccctctgacgtgtacatttgataatcccctaacatgaaaatcactctgttataaaacccaattggtttcaccatcccatcataactcacactctctcttcaatcctttcctttcattgtagttaaacaaagattacgattatg

SEQ ID NO: 13946 - DNA, 3000 bp, Unknown
  misc_feature (1)..( 3000): cDNA_ID_3020759_gDNA_ID_2214675_Annot_ID_189188 3000 nt of promoter + ATG
gaaaagggagaattacgatggtcactacaagacttaacaaaaatataacgtaaattcaacataataactaaaagataagcactctttcaattattatgatcataaaatgacgccaactcacatatgtacatatgtcaccttcttctaactctcactataattcattgtttactagataaattttctttttctttttttgtttccttgtaaggagtaaaagtatattaaagttttcttacaatccatgaatgtaagaataatgctaaataaaacagtatttcatcttaaacattccactcaaaaccatgcataattaagaccaaaattcgatggatactgaatattgaatatgcatacgtttttcttattaaattggtactgaatattgaatattgaatatgcatatgtatatttaaatgttgatatacaatagaaaccttgtgttttatttatacgtttactgaatattgaatatagttaggaaaaatttggactaacgatacagaaaagaaacgcaaaacatattgggagacagttatcttattaagttattattccgtctgacccaaacaaaactataagaaaaattaacatcatctgatagcttctttacttgattagggagatgtggattagagttttttttttttgaaaacactttatattagatttaactatgaaaataattttcagaagcaatgtgagatgtgaccgtgagattcccgaatgataccatgatggccaacggttttataagtaccataaattgagaacataatacaaacactaaaaacgaatacacacagttgatccatttcctactttttagtctctagacaccaaatatacttactttaacatgtacatgcttcctccacattcagctaaatgtggtttagatgtcttgatagttcgacaagatgctttcatatgtatggcggaagttagaggctttgttcaggttctcaatccttatatcatggtgttggatgctatgcaaattgatcgtatgcaacttttatttgactattagaatctaaaatggtagttctcccttgcaaaaaaaaaaatcattagattctgataagcaagaaaacccaatccctcatcaaaacatgatatagattcataagaagaattttattgtccattttaacttaacattggcgtcggtgttttgctttctcgtccatcaacgaaaaaacaaaaaagagaattatatttgttttgacttcacatctaacatcactggtttatatatgtgtaattatcttcagctcggacaaaaaaatatctaagactagatgacacatatcaaaaagaaaaaatataattaaattgaataaatatagaaaatagtttattttaattttagaggaatgacacatatcgaaataatagagcgccacttgtcatttcttaaagcatgagtttgagaaaaccttactttattatattagactagatgaatacccacactacgcgtgggtttgtttcaaaaattgttaagaacaaattatgttgattgttcttgttgctaatttttgtttacttttttatatgttattgtttagttaataaagttaatcttatgtagttacaatttgtctgattggatttttttacttaaaatatcgatttatacatttatatatatatatatatataattatttatatttctaagatcctaatattttttcactatcatgaatacatacatcgataatataagatttttttatacaattatatgtaattatgttatttgtgtgatgtgaaactcgcctaacatgattataaatataatttcttgttttgtgtactctcctgatctagtacttccatcacatcgtgatagactcattattatatacaggatagacatatattgaataagatctcaagagttttcatatgaaaataagaaaaagaaagcaaaaactaaaatgtcatttaagtcaacatttttatatcgtctactattgcatatagtcatataagagaaaagtcgtgtcttgaattctttggtatgtccaacgtctcaaaggttcatcacttgaaaaaattacagaacttaccaatattaccaacttaccataagacacaaaataaaaaagatagaaagtcatatgttgagtcatatatgaacaacaaaacataataaggagaaagactcaaagtaaaattactaaactaataagtatttatacggtagcaaacaactaaattacaacaataataaaatggttactattgataaaaactttttagtaaaaataagaagaatataaagaaagtagtgctttttattaacataattttgtattttttaaaaaacattttgattaaatcacttaagagaataaccgatggaaaatttaatgttataaagaacttttattttttctcatttaatttggctaatttttaatttaaataatgtagaatgacatatgttatttttttgtataatgatatgacactcatatagagaaaattggccttcgatatatatgatatgatgtttcaaaataagtaagtatatatctatgtacatttaatttgtctcttacttttcaaattttagtaaagatatgatgtaattgctacattcaactaaagatataggcatcatcgtactaaattgttgttactcgtccaaaaaaaaaagggaatgttacactattaggcacttttagaaaatctttttacgtttgaggcactttctaagattcaggcacttttccttgtttctggaagataaaaggacaattatatcctttcaaaattaaaacataaattgcttaaccagttcaattggttttgttttctgtgttatctaataaaacacacgtgtaatacatgttctttctatttcgtgccggttgagatctcgacatgagaaagggagtaatctcacaattacagcaaataaatggatattttttaaaaataaataatatatagtgtcgctcttcatctctaaaaccaaattctt

SEQ ID NO: 13947 - DNA, 3000 bp, Unknown
  misc_feature (1)..( 3000): cDNA_ID_1018268_gDNA_ID_2214675_Annot_ID_189169 3000 nt of promoter + ATG
attgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggtagtgactgcttacatgtttgaaatataatgtcaaacttttggtttcattcttcgctgctcacgttctttctccatttgatgttttatgtattaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatctattacttccagttctgtcttttgcattacattcttggagacgtttattctttcacttccatgcacaagatgagaccaagattcggtccatccaaccaaggtacagagcaccatctctttcttcaatcgcatacccgttgctgtaatctctcaagagggctctaatggtggctgaaatgattgagctcaaggggtatggctcaaaacccgccatggaaaaccttgacttccatttcccgagaagctcgtgtctttcgatcctctcggctccttcacaagctatgatgttgacgacatcccttgccatgcagtgctgctcgatattgatcctttccttgtgatttctcggaagcataacatcgatagattcgaacattgccgtgtaataacttaatgtctcaaggaacctaggaaggaaaggggaagtgttcgtgttgcattcttgttccacaagagtgactactttaggtgatagactcttcaccatcctcagcaaccggtccctgtggttttccatgcttacactctcatctggcaaatgatgcagcatgtaagcaaagttcactccaagggcttcgccatctcggacatcaagattttccacttcaacttcacaacttggccttgaaaccgcattgaacctgaatggaacatcaaacttctttgcaagtttctctagtctcttcttgactgtaaccaagacagatccatcaccaactccggtaattcgaatatttggagccccaccaggcctagctgcaaaagcctggataagtgctatccactggctcccttgtccaatttggaagtcaataatgtgaatcctctcttcatccttcattgcttctgcaatcgcaccattcgctgacatgtatccaaacttgaaatatggacaaacctcatgcagaacatacacataagataaaaattcataactctctggttctctggactggagagacttatatatcgaactaccagaagcagcaagcctagcaacaagcccttctaacatataagctcccaatctctggattggctcaccagaaatcgaaaccataccgcgcaactcacccatacaccatcgtgccattagaagattattctcagaaacagcttttgcacaagcaacaagtaccaacttcaagtctccccttgatattgcctccactatcaataacaaatctttagcatcatcaggccacatggagagttcatggcagatagcatcatcgatactctcagctatctctggcagtggctgcaacattattgaacctcttacattgtccatcacaaataagcaagtaagaatctttgaacatcaaccattatcctcaaatgaccttttatttatctgatcttcataacaaacacctgtagaattcatagacaaagtcattaatcagagactgaattagatatcaatattgaacaataatatccatggagatcaaaactctaacaagaactctagtatcattgaaatcaactcatgactctatgaatctacgtcagccatgaactacttcatcaataaacaaggcatacaagagttccaatcctaaacaaactaatttgacaatttctcttcacactttagagtaaagcttgctagaaagagcaatcatttacaacaaaccaacatcaaacttatcaaagaagaaatgttttcatgttttgtggataagaagaagcagagcatcaaaatcatcaagaaaagagaataaaggtttgatttttatgagaaaaacaaaccttgtgtaggttaagaagtgatctttcggtggaagtcgataagggatttggttttgcaagtgagagatccaaccaaagctcgcagctgaagcaaaaggaagaatctttttagttgctgtagtgaagaaaataacacatcacatacgacgtcgttttaggcttaaaccgaataagacccgatcaccgacttgacacatctcgcttaaagtctctggtcaa

SEQ ID NO: 13948 - DNA, 3000 bp, Unknown; identical to SEQ ID NO: 13945
  misc_feature (1)..( 3000): cDNA_ID_1808156_gDNA_ID_2214675_Annot_ID_136651 3000 nt of promoter + ATG

SEQ ID NO: 13949 - DNA, 780 bp, Unknown
  misc_feature (1)..( 780): cDNA_ID_2994313_gDNA_ID_2214676_Annot_ID_136653 3000 nt of promoter + ATG
aataatatgcaagaaacgtacatgtgtgattgtgtggttactgttttttgagaattcaaaaaaaaaaaaaaaatcatcttaaacaatcgaacttgattaattcataagccaacaaaattggaaaaaaatattttagtttattttaagtgttataaaaaatttgataattattttagttattatatttgaaaataggtaaaataggttcttaatatgtaacatgtacatttttgcatatttctaattcggtgtcatccatacaaaaaacaaatggcaaaaatcagaatggatagagaattaatccgctaaaatgtaaatgttaggcccaaattcggcccattacacaaaaatctcagagggttaaatacatcaccttctcgacgctaattcctccactacgtctctctctcttgctctccctcttcaagtcggctcctttattgctacaggtttgttgcttcttcgattcaattcttctttcgcctccaattagggtttgtttcgacctcaaattatgcaactttgggattatgtgattagaatttaaatttcggtgtttgtgaatctaaatctagttgattagcattcttattgttgttcatacgttttaacccaatggttcgtcttttagatcttctgttgtcatgatctggttttatgaaatagaaagtttcgtttttgatgaatcgttggtgggtttttccttacttgatctgatctgatctgatctgatctctctgctttatatcagtgaaaaagtttcgagctttagaaacaatg

SEQ ID NO: 13950 - DNA, 3000 bp, Unknown
  misc_feature (1)..( 3000): cDNA_ID_2705655_gDNA_ID_2214676_Annot_ID_189204 3000 nt of promoter + ATG
atctctatcgaaagaggcgaagagatcctcgatactttcgaggagtcggaggtgaaatggagttatgttcaatcggagaacgagaaaggagataaagtgaaacgttactacgagctcacattcgagaagaagcttagagacaaagtcttgaactcttatttaacccacgttgtagccgaatccgaggagatcaagaggaatctgagagtggtgaagctttatagcagagatgtgtatgctagtgatgatgatgatggaatggctggtgggaattggggatgtatcaatctcgagcatccgtctacgttcgatacgttggcgatggatccgaatgcgaagaagaagatcatcgatgatttggagaggtttttgaagaggaaggagttttacaaaagagttggtaaagcttggaaacgaggttacttgttgtatgggccaccaggaactggtaaatctagtttgattgctgcgatggcgaattatcttaagtttgatgtgtttgatcttgagcttagtagtatttatgacaatggtgagttgaagagggttttgttatctacgacgaatcgttcgattttggttattgaggatattgattgtaatgctgaagtgagagatagggaagctgagaatcaagaagatgaacaaattaagggaaaggtgagatatcttttggatttgagtttgagagaatctattggtttttagttctgattatgatattgtctttgagcaggtgactctatcagggattctgaatttcattgatggtttatggtcgagtttcggagatgagagaatcattgtgttcacgacgaatcacaaagaacggcttgatcctgctctgctacgtcctggaagaatggatgtgcatatcaacatgtcttattgtacaggtttaggatttaggacattggtctctaactaccttggtttagatggcttaaaccatcctctttgcgaggaaatcgaggcgctggtcgattctactgaagttactccagctgagttagctgaagagctgatgcaagacgatgatactgacgttgttcttcgtggagtaataagctttgttgagaagaggaaggttgagagaagcaagactaagaaggaggtttctatttgtaaagcaactgatgatgacgaaaaacagaatggttctttgggttgtgtaaagaagaagaagaaagggggtaaacagaaaggtaaagggaaaggtaaaggaaaggccaaaacttatttgatataagagataactttgaacaatatgatctgttgtgttgtgttgtgtaacatggtaaatcaaacctgtgttcaacattatgccaaataaataaagctttgtatggttctaaacattctacttttgactgaagcttccgagaaaatagattttacgtctctggaactatttttaccaaaattatctcaaattagtctttttttttttggcatactaaacagtctcgactttaataaagaaaccaaaccaaacaaaacataaggaagaaacagaggtgcataaagaatggatgtgcatatcaactcaatctattaaagcttgtaggatcaacgtttttaatttcgggtgggttaggagtagtgatctcttaatcacgaattcaaatacctaatcgggtttaccattcaaagtagacaatcttaaccgttcaacaatattggtatctctacttcattttggtatctaaatatgagcatattccatctcaaaaagaattataatcacaataaaatatttcaaaaaacacttataatcacaaaaagaattacaccacttttactattttacatttttgttactactttacttatatttaaattacatacacatttactaattaatatacatatttaaacacattaaaacatattattataatcactaaataacgaccaaccaataaaaatcccaatcagtatttataaaattttaaaataaaagaaatattttataaatttacaatataaaatataatcaaatacttaattaaaaaccatataaaaccgaagcccgcgataaaccgtgggttaaatcctagtatattagtaaaagcccaacaattttcttattattactctaacacatccacattctcataaggccacatccttcttatataacaaacacaaacttgcacctcaagtttctccaatcacacataagacatatttctaaattctatattgtcaatttgcttttctcttcaagcaaatttcccttttgcttatatgattctttttgtcttcaaacaaagataatttttcctttttcttgacttaacagactctcctaaatccaagtaatcatcatccttccttccagaatcttcagaattcatgtactactaacgactagtacagaattactgaaaaattgcatcttcagttgtttctcgctaacctcttcatagttcttttttttttgcttatttttaatactttctatttatttattttcattttaatacaaatggcaaaaaaacgttttaagatctttctactcaaaatttggatcattttaggtttcttatacatttgagtgttaatcgaattatttttgtttacatatatcaaattaggaaactctcagtattttatatttaaagattataaacgcttggattcttggttatgttttgtgcttgaacgaacaacacaccctaatgacatcaccgccttactaattgacgtttccttgtgacgcaagctccttcctccgcaagtctcttactgtttgttcacttgtttgcttccctagaaaatacttttgttattttcctattggtctactttaagaaaaaaaaaaataataataacttaaaaggaaaaataaagataaaattaaagaatagtattttttcatttgagtctatatatgaagttataaaaccccaattttaactcatcccatcacttctaaccctagctaggtcaaaggaaattccgcaagataattgtggatttcgattaacagagatg

SEQ ID NO: 13951 - DNA, 780 bp, Unknown; identical to SEQ ID NO: 13949
  misc_feature (1)..( 780): cDNA_ID_3020832_gDNA_ID_2214676_Annot_ID_189196 3000 nt of promoter + ATG

SEQ ID NO: 13952 - DNA, 3000 bp, Unknown
  misc_feature (1)..( 3000): cDNA_ID_2705651_gDNA_ID_2214676_Annot_ID_136660 3000 nt of promoter + ATG
cacataagacatatttctaaattctatattgtcaatttgcttttctcttcaagcaaatttcccttttgcttatatgattctttttgtcttcaaacaaagataatttttcctttttcttgacttaacagactctcctaaatccaagtaatcatcatccttccttccagaatcttcagaattcatgtactactaacgactagtacagaattactgaaaaattgcatcttcagttgtttctcgctaacctcttcatagttcttttttttttgcttatttttaatactttctatttatttattttcattttaatacaaatggcaaaaaaacgttttaagatctttctactcaaaatttggatcattttaggtttcttatacatttgagtgttaatcgaattatttttgtttacatatatcaaattaggaaactctcagtattttatatttaaagattataaacgcttggattcttggttatgttttgtgcttgaacgaacaacacaccctaatgacatcaccgccttactaattgacgtttccttgtgacgcaagctccttcctccgcaagtctcttactgtttgttcacttgtttgcttccctagaaaatacttttgttattttcctattggtctactttaagaaaaaaaaaaataataataacttaaaaggaaaaataaagataaaattaaagaatagtattttttcatttgagtctatatatgaagttataaaaccccaattttaactcatcccatcacttctaaccctagctaggtcaaaggaaattccgcaagataattgtggatttcgattaacagagatgtttccttcaatatccaatatctctttatcaccatcgtcgctgtttacagcgtacgcgtccttaaccggattcttgatgctctttagatcactgttcaatgatgaagtaccggagaggctccgatcatacatcaccgacttactcaaccggtttttcactccgaaatcaaagaatttgactatggttatcgacgagatcatcggatttaagaggaaccaagtgttcgacgcggcagaggtgtacctccggaacaaaatcggacccgagacagcccgtttacgagtaggtaaactccctaagcagaagcacttcacaatctatatcgagaaaggagaagagatcttggatactttcgagaatagcgagctgagatggacttatgttgaatcagagaacgaggcaagccaaaaagagaaacgttactacgagctcacgttcgagaagaagcttagagataaagtcatgaactcttatttgagccacgttgtagctgaatctgaggagactaagagggatctgagagcggtgaagctttatagccgagatgtgcgtgcgagcaaagatgatgacggaatggctggtgccggttggggatgtatcaatcttgagcatccatcgacattcgaaacattggcaatggacccgggtgcgaagaagaagataatcgatgatatggagaggtttttgaagagaagagagttttacaaaagagttggtaaagcttggaaacgaggttacttgttgtatgggccaccaggaactggtaaatctagtttgattgctgccatggcgaattatcttaagtttgatgtgtttgatcttgagcttagtagtatttatgaaaatgctcaactaaagagcatcttgttatcaaccacgaaccgttcgattttggttattgaggatatcgattgtagtagtgccgaggtggtagacagggaagctgatgagtatcaagaatacgaagaaggttattatggaagggtgagatgttttgaatttttgtacagttttgagagaatctattggttcttagttttgactatggtattgtctttgccatgcaggtgactctatcagggcttttgaatttcgttgatgggttgtggtcaagttttggggatgagagaatcattgtgttcacgacgaatcacaaagaacggcttgaccctgctctgttacgtcctggaagaatggatatgcatatcaacatgtcttactgtacaggtttagggtttaggacattggtctctaattacctcggtttaggtggcttaaaccatcctctttgcgaggaaatcgaggcgctgatcgattccactgaggtgactccggctgagttagctgaagagttgatgcaagaagatgatactgatgttgtccttcgtggagtagttagctttgttgagaatagaaaggtcgagataagcaaaaccaaggagctggaaggttctacttgtagaaaacttgatggtgacgataaacacaatgtttcttctaccaatgatttgaagaagacgaagaagaagaagaaaggtggaaaaggaaaagcgaaaggaaactaggaaaggcattaaagtttatcagttagattttggttcgggttaatcagtttggtttgatttgttactttagaaacataggtctatggttaaagtttatcacttttttgttctttaaataaattttgaatttttggttcggatacgttcacatatagacgtgacattttctgatatggtcgtattctagcaatagcatggtatttctcttccctccgtttctatggggaatgtacaaagaacaaaaaaagtgagagaaagagaaatggagaagagaatcaatggttggtcaaagagaaaacaaaaacatgtggtgtgtagctttcaaagaaaagattacgagatatttttggatagatttcattctcacttttctctctcaccaatctctcattcagaggtaattttatccttttttttgttcttctatatccatcatcatgatcaatactcttacgtgtttgctttcgatatattatcgaatggagaatttggttaaagattgtgtttatgattggaatgtgttttgagtcttgcaggcaattggaaaggactttggttattataagaacactcttttgtagagtgctcttctcgcctatataacacatcatg

SEQ ID NO: 13953 - DNA, 3000 bp, Unknown
  misc_feature (1)..( 3000): cDNA_ID_2705655_gDNA_ID_2214676_Annot_ID_136661 3000 nt of promoter + ATG
cacctcaaccattaccacaccatgccaatggctcgtccactttctttacaggtattctctttcctttttatgtatctatatagtataatcgaccataattttcatgtatctatgtagttttagtctcaaattgactctatgatcatgatattagtttttcattaaaatagaataaattttggtaacaattatctttcaaaccgttattattctgatacatgcctaattgaacgaagagtgcaaatgatttttgtttttagagaaaggtatgactttgttaggtttgtgatgatggtagctagagcgaattaagttgctttttttttttagctaaacataaagatcaaagttcaaactatagttagctgatctcctctaattttgtaaataagttggcaaaacagattctcgatcgcaaaaagaatattaaagtactcattgtgctcatttttttttttctcttttgttagttaaaaaatgtcttttcaatttttattgattcgtttaggggaatcggacaaaactgaaacggaatgtcataagtttgtctcactagtggatgttactatatgtgattataatatcctttggctgattcagcagagagttggtcatttaaataattattcttctaattaattacctttttctttatggacatatatcacatattaatactaattgtttttgaagcagtcatattagttctaattagtttgtaatatatgaatggtgctaattaacagacgatagacctgaaagtaaggatgtgttgcagtggatgtgagagggttgtcaagcatgccatttacaagctgagaggtaatgttataattcagagtgttttcgaaaataactaatttcttttcttccataaaatattttcgttaaattaacgaatattaaattttatattataaattatggttatagaataataactttatatttttcataaaaaattgtaatatgttttttgttttgctaaaacactcctatatagaaaagggtaatattgtgaatatatcaaactagtaactaaacgggcgttgttttggtggtgaaggggtggactcggtggaggtgaacctagagatggagagagtaacggtggttgggtacgtagagaggaagaaggtgctcaaggcggtgagaagagccggtaaacgagccgagttctggccctacccggacatgcctcgctacttcacttcctctgaccattacttcaaagataccacccgcgagtttagggagagctacaactactatcgccatggctacaaccttagtgaccgtcacggtaacattcacgtcaccaaccgtggtgacgacaaaatgagcaactttttcaacgacgacaacgtccacgcatgtagccttatgtaatttcctcacttctttttaggtatctatgtgtttatatttgttgtatcatttatagggttgattgaatagcttttatgcataagcgtaagtgagacaagtaaaaaggaacacaatgctttattagtcttgggcattcgttttttttaggttcggtttatctgttattcggttatccaaaaatattaccggctgaaccgtaaaacaattctgttcggttcggtttggaattagtaaactgtacatggtatcaaagtttggtccttttcctataaaactatacataaacatgctataagccagatggtatatactaaatttgtggccactgttgaaattgctaatggtctaatgagataatatgcattgtttgtttatgaccgatcctctttcattttacatgaaaatgtccatagttcaaccatttgtttttgcctctaggcctctgaaacagaaaaaatccgaacaaacaacgtctatcttgaacaaaccgaacctatcgcaatctgtctctctgtttgtctatcttgcattctcttacgatcagattgtgttgaatgaagctttgaaaattgaaagcttcaaacttcttctattgtctatagtgcatatggggaaaaaaaatgcttgggctcttgtgttttattttgggcctgaacgaacaacatacactaataataccaccgccccactaagagagaggcaaattttcaatactattattctagaatgatacaccattttatatcaaaaatctagattctcttctttctttttttaataaagtttaaataaacctaacatgttttttcatatattttttgttaaaaatgattttttcatattgatctcttttttcttaattgaagaaatcggatggtcgaatcttagagcatcattattggtaagttcttagattagttcttaaaatttttttttgtgattgattattaagaacgcctcactttaactcttatataagagttaaagtgaggcgttcttatcctaagaaataatttaaaagcttaccaataaagatgctcttagtacactaaagacgataaaaatgattcgtcaaaaaggttttgattggaaaacactgaaatgtaaagaaatgtaaataattaatattccactcgttttttttaacaaagtaaactaaattatccattttgaaaataaagatattccaaaagagtaaaataacaaaaataatattttgagtcgatgttatttgacgtattcgtcgaatatgttcttcatcgaacggaacaaatcaaacaaaaaaagaagcaagtggatccgtcacgtgtcactttactattgacctctgacgtgtacacggacgtcaagtaatttccttgcaccgcacgcttccttcctctgcaagtctcttactttttttcgcttccctcaaaatgtctcttattaattttctatccttaaatgtgaaacagacaaaagtgtttgccatgtgcttctataaagcctatcttctatttctcacatttttaactcatcacttctaaaaccttttctcaaatctctctcactctctttcaccggaataaaattctctaggtcatcggaaattttttacttcagccgacaatg

SEQ ID NO: 13954 - DNA, 3000 bp, Unknown
  misc_feature (1)..( 3000): cDNA_ID_2705659_gDNA_ID_2214677_Annot_ID_136663 3000 nt of promoter + ATG
tttgttgagcagagccattcaagaagcctgtatcggtaagtaatacgctagattctgcaagcagggaatccactttctcagataatgtattcatagaacaattactagcatattccttggtcacatttccatccccagtctcagatttttcgatgtctttactatgctgctcttgatcttgaagaggaacaaaattctccgatgctgacgttgttgcatttgacaaatttgttggagatgacacaaacttctcaggggtgctggctgcctgatttctctgttgttgtttacagagcagtgaaccttctatctcagaattagtatttccttctggacttctccgtgcaaacacatcgctaatgtcaacagcaggaatcaatgcaccgcaactgtgttgatctggtatgcctttcttttcagaaactggtggcctgtcatcgctagtgtcaacagcagggctcaatgcaccactactgcattgatctggcaagcctttcttttcttgaactggtgttctattatcatcgctagtgtcaacggcagggttcaatgcaccactactgcattgatctggtatgcctttctcttctggaactggtgttttattatcatcgctagtgtcaacagcatggctcaatgcaccactaatacattgatctggtatgcctttctcttctggaactggtgttctattatcatcgctagtgtcaacagcatggctcaatgcaccactaatgcatttatctggcatgcttttctcttcagaaattggtgttctattatcatgtttagataacaaagcctccaagttggtaatgggtatatccgcatgcttatccctgagtacacctatttcttccctcccaattgatggggtagtcagaaaacggtgtccggataattgaagctttgatttctcaattctttgagaaagagcagaaccaggtgacggtggaatcaaaccaagtctggatttgcttttctgaatggttgacaagctctcaactagtgcccgagtctccctgctcataaagcttccaccctgtgtaggggaaggagtaacacaagataaagactgaggcaacataccaactaaaaacgcactttgccttctaatagttgacgaggaaagggaagcctcttttgtgtaacgttggcttcctgattcctgcagacctatgggaatgcatccatttggaagggacgaggaaaaatcatcgataggtgatcttgcttccacagtattgtcttcaggaagcaattccttgctttcatctcccattagagctgctagtgtaggagatagatacccgtaatcatatctccgagaattttcaccgacgatactcatatcattcgagtctctaccaccacttcctttatcaactggtacaggtgattttggaaatagcttcttaggttctgttaacaccattgcacttcctgtatcagatctggaagtaacctcagttggtgttttctcttctactagaagatggctactcgtaggggtccttacatctccagactctgacctagcaagactccgaaaatgcatcgaaaacgccgtagaatccatcgtcatttcatggtgttcttcagagataggagtatccaacaatcttccaggattaataaaatgggaagacacaggaccgaagaaattatcctctggtaacgaaaacaaaatcgattcagctaaaaattcaaagaacaaaaccctaaattcacagagcaattgaagcgtaccgttatcacttgtagcggaaccaacagtgctacctcctgaagatggagaatatttcggcctcaagaatgatttatccaagataggttcgtattcaccatcaccatctccgtcagtatcttcgcggtcagataattcaccgaaaaacctaattactttattatcctcatcaggctctgatgtatcaccaccgttttggggtttcgcggcggaggtattgggcggcgtctcgtaatcttcgtcccggttgaaaatgtgaacggaagtaatttcccggtcggcgaagctcactcgtcttagccgcttccgccgttgcgctatagattcctcgtctgttcctattccggcggtgttgttcatcggatcttctggcttttccgatgccattgggggaattttcgaatttttagggtttgaaattgaattattaatgtgcgggaaatgcagacattttaagttttaatttgaacagtactgagaaggaagaacattttgattttgattgaattgattaaatcgggtaaatgaaatttcaaacatagttaggcctaaccatttgattaattagattaaccggtcgattaatatttattctataatacttttttctttgtacgattgggccttacttataaagggccgaataaaaaagcccatttaaagaaagacttctttttcgttttgcatgtgaatgtgttgttgggattagattcgattcttaaccatcggtctcgttcatttcgacttcacttttcgtcctctttcttcttcagatcatgtatgtatgtcgctagtagacatggatccatcaaatctctgagacacctgagcttgatgaatagccatagacaaagctcttcgatgcaaattctcttcaacagcaatcaacttcctctgtgaacgattcattctcttgcttctggatcaatctcctccacttctgataacaacatctttcttcttcatgcagattactctgttacccattattcacaaaaccctgaattttgcccaaagtgattccatcattgcttagctttagccgggttcttgtttggagctgttccttatgcaaaaaaaatctgaaagtttcttagcgaattgttacctctattaatttcaatggaacagaaattgtaagtatctttggttcgtttatgtttttcttagctgttataaagatccaaccctaactctttgaaccctaactttttttttttcctttgatttttgacagcaaaaccgattctatg

SEQ ID NO: 13955 - DNA, 3000 bp, Unknown
  misc_feature (1)..( 3000): cDNA_ID_3020861_gDNA_ID_2214677_Annot_ID_189216 3000 nt of promoter + ATG
agataattgtaaatattcggttccggttcagtttggatatatctggattcggatcggtttggctaataagtctgagaaactgtaaatacccaaaaatctggattctctcggattcaagtctaaattggtaaaaattatccattatcccaaaatgtgtctccaatacccaaactttcaaaccaatttacatgcacaaaacaacaaaaaaataataatagaactttaaacttgacatccaaaatctaatccaaagtcataaagattaatacttagagttaagagtagagaaatatgaatatgaaaacaataaattcgattatccaaaaataaaaaacatagaactaaaacgagaagtaggattgtagtcttgatggaagttgatgaatgggtaattcaatcaagcatgcaaaaggtaagctagtgttaaccctataaatgtttaaaactatatctatatatcgtataaatacacatgtcttatatcgggtttatcggtaccatgtttgagtatcgagtaatctccgacccgaaccgatatccacaggtttaccaaaaccatacctaataaggtaacttcctattcgtctaatccgcttcaacccgattatttttatccgggtatcgatttcgatattgggtctgggttttttttgcagccctaattatttcattacaagtaaattaaaaatatatccacatccatctttgaaacaatatctcaatttcttaaacttaagcaactacatcaagatccaccgtgtttaaattgactttatattaaaaacaaaaagtttggtaaaattagtcttcagctaggataacaacaaaaatatatacttagggtacaagtgatagtttttgttagatggattaatatggtaaaccaaaatatttatatgcaatttgctaaaatttccctttttgcattgaaaatataaaaagaaatagcctttaattacctgaaaatggatttatttaaaagagaagtttttctgtgttgtgttgtatacaaatgaatcaaatcaaattattcagtaagtttccatatttcattcatctttattccattcatttttttcatattaaaagagaatacagtctctgtaatggtttccgatttttttccttaactaggttcttaatttgtttgaatcttattgtacttccaaaattaacaaaaacaattatatttgattttgtgtttctatgtttttgtttttggtctttaaaatctccaatattatttattggcctttttcatggtacgtagttgataacttgatacttaaatagactactaaagcaaaaatataatccctattttattggtttttagtttactttcgcttaaaaactgagacatatattggatacgaaaacaaaaggtaaaatattttcaaatattaaataaaaaatttagctgaaaatttacaaactataaataacataatatacctgaagccaaccatatgctaagaatatttacataaaataccttaaatcgaatataatctatatgggtaattatatccaaaaatatcacgaaatattatttcgttgatgatagactttaaaaattgcatattatgtacagaaatacaattaccgaacaggaataattttttgattacattgaccacataatataacaaaacactaatattgttttgataaatatttgatgttttaggaacaaaatacatgatgttttcaactttcaatataaaattaattaatatacttttttgggtttagaggtttctattctgtaaattgtatttttttttcctgtagattgtattactattggtcgattaaatggataataaattaattttagtttggaaataaaaacaaataaatgaatccttaaacatcaactataaaaagacagaggagtatctttaaagaaacttggattgtgatattgcactgtaaatagaacataaaatgttgcagtgtaactttattttaatcaaataaacaaatgttagtaaaaaaaaatatatatgttgcaaacaaggattaaattcactagtaaattctcattaacaaacaaacaaaaacaaaaacaaaaacaaagatagtgccaagcattacatatataaacaataaaaagaccctacttattaatatctttccttaaagaaacatggattattatcattttggcagtgtatgaagtaataaatataaacaaaatgaaataagaaaatgcaagcaagtacaattgatgatataaagtaaccatggttaatcaaaaaaacctgaaagactgaaatagagttaaccatagttaagcttctctggttaaaagataattgctttgctatatattaaacaacaattggaacctcctcttttatcaaaaccaactctctctacacactttttcagattccatcatcacttgttcttttcacacccaataaaaacttgcatctttcttctaaattgttgatgatcgcttctcatatttgaccctagaggttcgtacttttctctcttttcactaaagtttcgatttttttccccaatttttagccccagaattgattcagagtgaagagatttcaaattggtttcataaagtttgcatcttttagaggttttgatctgtgtttcttgatttagagtcagattttgtgtttggtacgaatcaaaggcttgagcttttggtttgatggttgtagaaattgaataaagatctgttcttgaatccttttgatactgattagtgttaatttgaattaaagctttgtgctttggtttcgatttgctaagctttagagttaatttctgtttctggatcataatatgagaccttcaagtctcttgcttgctcatactaatcatagattgtcattgaaatctatgtgctttggttggaatgtcttgaagttttcatatgttgtgagctaatagcccttaatggtgtttttcagacaacatcatttctaccgacaaagatttgatatcgaatccaacaagtgaaagatg

SEQ ID NO: 13956 - DNA, 3000 bp, Unknown
  misc_feature (1)..( 3000): cDNA_ID_3020841_gDNA_ID_2214677_Annot_ID_189222 3000 nt of promoter + ATG
ccgtttaggaacacatggatctccttgccagctagttttactcactccataagtattttggatattcttgatagcaataactagaaataagttcataaacatgcatgatatataagaaatcagcacaaaacaaaaccaataattcatatagataatattttgaaatgacataccatcatcttgatttgtttccaattcggggaaatcgatcacggtgaaaacctcgagggcactacaaagcggaggaagagtagactttgacgtttttaataactctatgatgcattgccctccttcacatatttgtggtttaataaagtatatagttcctgtggcgaacgttttaggtctataccgttccaaggcaaggtttccattcaacatcatgtcgaattctcgggtttcattggcctgtagagtctgaatatcggcgaagtgcatgtaactataaaatttggccgtagaaggaatcaatgaccaggtgaagttgaagggcgcatttttacttatgggtgttgaggctgaagccattacaaattttggtggatcataaccatttgaactgttaacattgagatttgtagtcaattctgtccacgcatcctcatcaaagaacggataccaatgacgatcgttgacatcattcgggtacctgacacattaatttatgtattagaaacagatattacttattatgtacattgtaaccaaaactgaacttgattaatataaagacatgattgataccgtattattctccttgaagtgctgaaataattccgaaataagtatttcagcgagccactttgagtattgtaagtatcgtttataagtggtcgcagctctaagctattaataataggtatactctcgcctgtcttaataagacaaacctggagtaccttagatttggtactgtggatgatttcttctgtggtcactccgttcattaaatatacagctgtgttcacgtttgcccatagattaggaccaaggtaaaggtcaaactcgagttctttattaagaccatcgtagttaccatacacgaaactggctctgatcaggtagtttgtgccgagcgtgacgttcaaggtataacagtttcggactccttcggggaagtacctaagctgtaaaattggtttgttgtaggttgactccaattccttatcgattgtaccagttttaccgctctgcacgaaatcattgtccgttgtgtatgttaagtcggttgcagcatcgacgtaaggaggttcattgggggataacccacaatctaaactgatgaatcctagtaagaaatatgaattgtaacgtacataacaacgtaattaaatgtattaaaaacaaacaaaaaaatgtgtatgtagctagtagatatataccttcttgatttccagcttcaacgacatgtaaaagaccaaacgtgatgaagaataacacacataagagaattgcttgaggatgtgttttcatttttcttctttggtacaaccgtacaaaggagattgacatgtataaatacgtgtaacgcttttgagatttatatgcaatggacattagaggaaacaagttagcacgatgttatatttgcacgttcaacttgtgcaaaaaatagaactccatgaaaatgtacaaaccgtacatttaaaggaaattgacatgtacaaatacatagaaaactattgagagatatatatgcaatggacaatgggaaacaagttagcacgacgttatatttgcaagtttaacttgtgaaaaaaatagagtcagcgagctctcaaaccaatataagtaataataagtgtgttttgattaaaatttataacaaatacaaacatctaataatcgctccttgctcttttaaatgactagcttattgttgtggtcctgattctcgaatgccaactagcagagacggattagatagccaatcacctggtttagtgaattaaattcagaattaaccacaataaattttctcttacaatatgccttatacaatatttgaaaagtcagagagcgagaaaattatacttttcatatgtgtcaacgctaaatcattcttacaacatgtcagaaattacatcagctgccattactaaaaataaagtatttattactaaaataaatatatttcagagacttattacttatatagtaactaaagaaaatcttctacaattgtttcataaatcatactaaatatatttagtcagtgtcgatttcagatgttttgaatagttgattcggaatgcaagggtcgagaatgaaatttggtatcgtctgatttggaagggttatgagattatgagggatggtttgtgcttgaagataaatttatgaaattatgtgtcttcagattgtttggtttattgttctgctaattttactttgttatctaaaaattgtggatgcccatttgaacatggacggactaaatcataacccattgaaaaaatttcagtacggacagtccatatggatgcaagcagtcctaattggtagctctattaaaatgaacaagtattgaaagagaaacgcatttcctgagacctaggtcaaactatagacaccccttatttttgtataaataaaaggggggttattaacaaaatcgtgaaaccttcatttaacgtaaatggtgatacaaagcaagcttaaatactaagagagatagccaactatacacaagatatataaccgaagataaccgaactacattcaacatttaaaccggagagatataatctctagtatgatttatgggtttacattggccctagaatcgtatattgcttatcagatcgaaagttaggttgaaacgctaaacatatcagcgtattatgtgagatgagtaaggacattcatattgatgtaaaaaaactcttttctacttgctcattcttgaaaaaaaagatatagaataattgcttattcaatgtgacatgtaaaattgttcttcatggaaaaagtttcttgaatagaaaataagacatg

SEQ ID NO: 13957 - DNA, 3000 bp, Unknown
  misc_feature (1)..( 3000): cDNA_ID_2710703_gDNA_ID_2214677_Annot_ID_136665 3000 nt of promoter + ATG
gcacttgcaagtaaatgtgttttacacttcactaaagcttcccttaccactagaccacaaatgattgggcgtgagtcatgtttctgaaacctatatcatgtcttgattgtacaaataacgcatgattaagctgtagattctgaaaatagaatatattgaagctttccacagttagggccggctcattgggggtgaaaggggagcaatatttctggatctaaattattttgggtaaatttaaaggtccaatttttttagtatgaaaaagtgtcattttgaaagatttataagaattttttagcatgaaaataggtccaaatatttttttagtatgaagaaaggccaatttaaaagagttttaagatttattagcataaaaagggcacaattttttcttttagtatgaaaaagaccaatgtttaagatttgtacatggactctgaattcattgagctgccatagtgagtaaaatttggaaacaaaactaaaaaaacataacaaaatatctcgttgaattcaatacaaaaagcatatacaaacacaacaatgtaacaatttcaaaatatttgctcttaagaaataaaaatcttcaaccttgaagagcatatgttagaaccaagctccttctaccaaaactatataaaacaatcgaaatagagaagcatatgtaccaacaatgtggctagcgggtaactactcgtcaatacattaccaatataaaaacaaagtctgtcagaaacacactatattctggttagtatctaacaaactttgatgatgttagaaaatcaaatgatagactccatattacaaagggactacactgttattatggctattcttctttcagaggcccatactatgcaatgaaccatgtgacatattctcttcattcccatacatggctacttaaatgttttaccaatcagaaatttgtcgttctaatcacgtaataacctttattagtattcacccgtttttttaaaactccaacattcgcattctcatccgctgcgtttaagtctgtcgagcctataaccccctaaaaatgccataatcttcttaccaatcacaattgatatcatcattttgaacatttcaaaattctcccgttgggcttagaccttaattaatgggtctaaagtagaccacatatctaactatgagttgttgttgggctttggaaaactacacacgtgtgagacaatatctaccgcacgtgtcagtgcaaggcgccaaagccaccattatccttccgttatcgtctatcttctccaccttcccggaatccaattcaccaattcctaagcattcttcagaaatccgagctgctttttgccacatctattcgcttcgaatctcttttcaccagctcaaaaactgtcgctttcaattccgctcgtttcgtcccaccgctccgtgtattgctgaacttcttcatagcaactcaataccatggatgttactgaagttccatggcgtcgtcttcctcaattttccgtttcttcacgcgcctcgtggctcgtttcttctgggtttccgctttcttcgtaagttctttcattgaggcattttatcatacactttgtctgtgggattctaattcctgttcttatcttctttcgatttttgaatctattgtggaagtgggtttcttaggttctgaacgggattgaaacatttgtttgtactcagtttcttgagttcatatctcacagtgctctcccctgaaactcattttatagaccagggaaaaatatatgcatgaatccaaaggaaatgatactttggactaacttggaatctctgttgttcaacagatatatgttctctcatgttgagcgtggaaagacgtttaggcttaccttgtgctttggggtctctcgtttacgtccaaggtctgctattgtaagtgcacaacaaggtaattgggagtacaaaacttaaaagttttcagagaatatcatggtttaactttcctgtggtgttctcagtttgtcttttcatggaatttcagttgagtcatgcctcaacttgtgaagtttctttgtttgcattttcagccactgagatttttgttatctgtattctcagaacagccacctagtcgtctcaaaggattatgcgaggtcgtttggattgtggaagctgatctggcagccaatgaacatctctacgttactggagatccttctacattaggtagctgggagccagactgcgcaatctcaatgtatcctacggaaaatgataatgaatgggaagctaaagtcaaggtaatctattcttttgtttcacttaagccgtagcgaacataagtagagatgtatcttaatttacataaaacgtttgaacgtttagtcgtagtaacaaaaggaaccaacctcaattcttgaaagtgagttcagatgtcgtgtttgcttttaacttaatatgcttggcagattgcttctggtgtaaatttcaggtataattatctgttaaaagctggatatggatcttcatcggatgtcatctggagaccagggccacaattttcgttatcagttccttcctctgtcaatcaagacagaaaaataattataagggattcatggatgagtatgagtatttcctcaaaatcacaagaatcctacggatgggggtcttggattgatgatgcttacctttttccaaactgtgttaccccagctcaaagcgaaggtaaaatctcggtggttcctccttgttcagtctcttttcatcctttgcaaaatgttttaaaacttaaatgcttccagtggtttggcagatgaatgcacttccgccgatagtgctatagaagtcccgagaacacatctgaatgataagcaagtaggagctgaatctttcttatgtgatgagcttgcagccttttcgtcagagaactcaaacttaagtgcgttattttctgacaactatcagcctatcgaggaaccgtggttgattcaagaatctattaccttacaacatgaaaggaat

SEQ ID NO: 13958 - DNA, 3000 bp, Unknown
  misc_feature (1)..( 3000): cDNA_ID_3020864_gDNA_ID_2214677_Annot_ID_189215 3000 nt of promoter + ATG
ttgacaaatgataacatcatagtcctgacttcaaacaacaatgtcatgtcgcaggaaactattttttgtttgaatctaatgttaaattatattcaaagaaaaaacaaaagtttacacatgtttaatgcaaaaaatttcgtaacttttagtttaaatctatccttagcattgccttgtcgcaaaccaagtttggatgcactccgcgagcgatgagtttcctccccttgtgccgtagaactatttgtaatgctctgtagtatttgaacccaagtatttttcattttaaccttctttgcaaccaaatgaaataaattatatagcctcataagattgagccaacgaatctcttgaagcactttagcattgagagaaactcttctagttgatgcaagatattcaaaaaatagatattcggatggcaacaaatctaaactttatactatataaaaagattttaacccgcaatataccgcggattattatctagtatagaagtaataatcttctgatactcttcctcaaaaggtcaccaaacatttagcatctaacatatatggtagagcagccaagtaaacatttcccaatggccaacaaaatacaagtctaagatattaagtagattcgaacacaaggtgacatgaatttgaatcccagagcacaatagccaactcgttgagcatctcacgcctcttctcaaaatcttcgagcttttcccttccgatgcgttttgtggagaaagttgctttcttcaaccgtcttgcgttttctaggatgtatgtggcaacttctttctcatcacctcgttgccattcatatcctatccacaagaatgtctcaagatggaacaacaaacattccggtgcacattttggtggattccattttcgttcgtccggatttgttttgttgtcatgcagatatacctgggaacaatgcagtttatgtcatctaaatcaacaaattacctgaaagtggagttgtggaaacaaacaactagtgaaattgcttacatccgtgagcttgaggatttgtagtttaggagaactatcaagcatgatcgaaagcagattccaccactctctttcgtgtgtaagtagctctagacagcctagttgatcgaagattttaccagtaggaactttaacctaagtacatttccacaaaacagtgtaacattgttacatacattttagatacacaaaaacagtgttagcccaatttgcagagaaaataaccaagcgaaaatgttcaatcttaagcttacctcaaggggtgataagtgtaagataagacgtttggctgaagttagagactccagaatgttctcattggttataccagaaacgttactgatttttgcctcctctaactctagtgccttgtcaatcaaacaagactcaatatcaataaccccgttgatgttcaagtatttcaaaccaggggcatttatcacatagcttccatttccataacctccttcttgtctaagatcttctatggtcaatctttgtaatgacggcgacgcaattgtgaaagtcgccacatcggcattgctatatctatgcacgaccaaatcttgaagactagggcagccacataaaagattgcaaacagattcttcgtctttgaaatgtacttggtcaaggtatagctttctaagagacttcaaacaaacccgagaaggaaagtctaaatcgatagcacacttgagtttcaagatctcaagtgaatcattatagctaaacaaaacactaggaagcgtgacagtttgatcctcttgatagaaactatccaataccaatttacgcacaccgcgagcaaatgctgttgcaatccatattccaacatgcaaacaatctgttctaccttcaaatgacaaatgcaaactctctagaaccggagctttatgtaaagacaaagtcttgtaaacattctctgaaaacatagtgggatctatgttatcatcatcaaacacaggattgaaattggaatcaaacttgagttttggcaacatagtccaaagagatctccaacgtttagacaaaacactcgtggctatggcgttttctgtcggaagtgaagacaatatctgtagaagcaaagcatcaggcaagtcactgattctgtcctcattcatagaatcggttttgctgtcaaaaatcaaaggaaaaaaaaaaagttagggttcaaagagttagggttggatctttataacagctaagaaaaacataaacgaaccaaagatacttacaatttctgttccattgaaattaatagaggtaacaattcgctaagaaactttcagattttttttgcataaggaacagctccaaacaagaacccggctaaagctaagcaatgatggaatcactttgggcaaaattcagggttttgtgaataatgggtaacagagtaatctgcatgaagaagaaagatgttgttatcagaagtggaggagattgatccagaagcaagagaatgaatcgttcacagaggaagttgattgctgttgaagagaatttgcatcgaagagctttgtctatggctattcatcaagctcaggtgtctcagagatttgatggatccatgtctactagcgacatacatacatgatctgaagaagaaagaggacgaaaagtgaagtcgaaatgaacgagaccgatggttaagaatcgaatctaatcccaacaacacattcacatgcaaaacgaaaaagaagtctttctttaaatgggcttttttattcggccctttataagtaaggcccaatcgtacaaagaaaaaagtattatagaataaatattaatcgaccggttaatctaattaatcaaatggttaggcctaactatgtttgaaatttcatttacccgatttaatcaattcaatcaaaatcaaaatgttcttccttctcagtactgttcaaattaaaacttaaaatgtctgcatttcccgcacattaataattcaatttcaaaccctaaaaattcgaaaattccccca

SEQ ID NO: 13959 - DNA, 3000 bp, Unknown
  misc_feature (1)..( 3000): cDNA_ID_2705681_gDNA_ID_2214678_Annot_ID_136669 3000 nt of promoter + ATG
ttaaaattggtggtgggttgtctaagcacagagatcagcaatgctcatcctctgttcattcttgatacgtttatatcaagaccttttcactagaaactggttagtctaaatgtcaaatgtcacatgtgtatatggaagctaaccgtttagccaacgagttagctaactatgcttttctttgcctttaaggtttcattgttttgagatgtgtcatgaggaagttcatttgtttttggttgaagacgctaacggaagattgttccctaaagcagttttgatgtaattgttcgtagtttttctttaataaaatcgggttgacaatttcacccctcagcctaccaaaaacaatcttgacgttagttattacactaactatatttgaattttgaacaaagatatttgtctatgcaaaatataaaattaaagaaaaacaaaacgaccattatcgcaaagtgtttcacacaaaagaaatgtggttgcagatacgcacagcaaagtcactaatagagaactacaacggaatctggttcaagtactcgactccgaagtattcactcatcgtatggctagttcggaaaaacagagtagctacgggtgacaagctgatcaaatggaacccgcaaactattttacactgcattctctgttaacacattttggagacaagggatcatttgttttttatgtgtccctatttactactcatgtatttttaaccttatttatttttaatttgctaaataaattatttaatggatcgtcataaccgattcataatctaattcctacaccgtctataagagataacttgatttagtatagtcgaatgtaggtgggatatgtcgcagaggtaaaccaaccacttgactacaaacacttcccataccttcacaatattagacctgaaatcttcaaaatagaatccctaccatcttaaaccgaaattctaattttgttcaatgatatagacattacatggaataagttacgttgtggcatggagaagagtatgtaacacataaaagcatatgagctgatcaatgagaaataactaaacaatgcataaaagtaaatgcttcttgaatacattttatattgaccagttcgtctataagcttacacttgtgatcataatgcccataatcaaaaattgattcatctttgcacgtttttctaaacattttcagatgggaattctgaataatcaatcaactcggtgccgattcaattggatgcacaagcgacaaacaactgattaaacagctaaaagggttattgtccaagtcatttccaatgtatatatatggtaatttatcaaagaacattgctatgtatatggattttgtttgcttagctaactgcagaatacatatagtttaatttttagattcctcttttgatagtgatgacatgagttaaacaaatttggttaaactattttgttaaaccagttttctgatggtgcaacaaaacactatcaatcagaaacaactaaacaattatgaaactcacaatgaatatttgtcattgtggccacaataccagaccactcgatcgtcccgcgaatcccttctccatcttcgtttgatcaatctcactccacaaaatcgctagctttccatcgtactccgccatcacagagacatcaaacttgacattaagtgtcttcaaaccaaccactttaacccataccttgcgctttacgtcaaaacccatcaacccctgctgaaaataacaagcatagagcacatcattaacaacacacatacaccatacgatatcacttgggattgtcaatgtctcctttcttttaccttctctcggatcatacacaccgattctcccaacttccacagtgtaaaccttccaatccagcgacaccgcacttaaccgagtcatcaatccgcgctgcgttttctcctcaggatctttcgtagttttccaactccgcgacttcggatcataaacttctacttgtatcttgtcttcacaacctcctatcacgtatatctttccattgattactcccacggatgcttcatccgtgcgagcaaccttcatgcttggtccttgtctaaacattccagttcgagtatcaagaatccagagttccgacatcggttcgaaggatccacctacgaagtagatttctgacccaaccgcggaagagttgtacatagaatgatgagaagggaacggaatcggaatcttgaccaatttatacctaaacgtcttcatagccgtcttcatcgtcttcttcttaagagtgaaccaacggtagatcgtatctggtggaacattgattatgttttggctgaaggagacgtagacagaattctttgggaggagagttcgcaaacgggagagctcaggtgaccgaacaagggaccttagggttttggagactcgacagaggtttaggtaatagcttcttgggacacgttgcaagcagtccaaaacgatttcgtcgggcaatgaagtaaacgatggcaaggacggatcgttatcttctagcggtggcttaactgatttggaggaagattgtttcttaaacttcttcgaagaaggagacatatcgttttggcttcagattttattattaggagaaccaaacatattaacataagaatactaagagtttttatttatataggattataatttagaatattgacttggatttagataaactgatacttttttttgttttgcctttttttgtccttttctcagcaatttaaaatttctttttttttccttttcacttttttaggaaaaatatcttaaatacgaaggaataaaaaatatatatatataaaattgaagcatatttaagataattaatatatttgaccaaaaaagggaaagataatgaatagtgtattttaatataataaaggtttgtttttggtctgaaattcagcataaatccccaaattgtcagaaaaaaaaaaaaaaacgtttgcgaaaccctagtcttcttctgttgaagaaataatg

SEQ ID NO: 13960 - DNA, 3000 bp, Unknown
  misc_feature (1)..( 3000): cDNA_ID_3020887_gDNA_ID_2214678_Annot_ID_189236 3000 nt of promoter + ATG
aataatgaatagcagatgttgacgcctggtaagctcgttttattgcaggaaggtttcgcgtttgcgcactgcacaacttgcaaggctccatattatctgagagttcacagtgctggagataggaaatggcggacattgaagtttcgcttctttgttactcgagacattttatccatatttcttgctgttcagcttgtaagtattcatttttcatgtgtgcttctgtttcttacagtagtttttctttcatttggtaatatatctaactcatgccttttaaatgacttcatctgctcacaggtgattgctgcattggcctacatggtctatttcatagatagttaccagcaatcatggcttcgtcatatatggggttttgacagtgaggtcacgttttattacatgtgtggtatgatcccaaactttaatatctaaataaattcccctctagataagataatattttttagtaagacctctgccaagtgtagttggtaagacgggaatgctaagtttattattgtacatatgtcctacagtccttgttaaagctttgcttcaatcagaatcttagattccaatgtaaggagtttgctattagatgatttcattgcctctacgtagtaggaagtgaagcaagggttttgtgatcagttagatttagatcaaaagttaaggggttggctacgttacgaatatacagttagagttctggacctcgtagaatttttaactaaataagaattttcaaagcaagtgtattagaatttagtaattaaaattttgtgttttacacagctcttcatgaaaatttgttactaaagaaatttataccaagtgattctaaaattttacatgtgtgtatgagctactggtgtttatttacatgaggattttgttgtgtgcaggagctttattattctttgctctgctgggtctatctggatgcgtcataacctgctatgatcgaagggttcgcaatgacttagcacagccttgccgtgaattgtgtctctgttgttgccagcctgggtacaatttccatacttcttcctttgtttttgttttcagtcattggcgttttcctgattataagtgttcctcatttggtcacatgatagactttcgtaaaaaatagtttgctgaatatgtgggcttttgctttacctggttcctgggtgatttatgtttgaataagcgacatcagagactagaaatggtgagacaagccagaggaattctgttacacaatagttagtgaaaaattagaatactaactagatcctcttcttttgtctgctaaactctatctatattatctgccaaactactatgatcgagtttattatctgccaaactacaacacaacaaaagtacatacactattgaaaatattttgtcagctcccatttaataaacatatatatcatcaatatgcaggatatgcacagactgccatctaccaggaactatttgtatgtgggcagattgcaccgcatgtactgaaggctgtgcaagtgcagttagtgagtgtggaggttgccttggaggtgcaggggaagccggattgccattactcttcataacggcattagtaattctcggtctatttacagttatcggtatattctatagcgtattggttgcaaccatggttggacagcgcatttggcagcgccattaccacattctcgccaaaagaatgctaacaaaggtaagatttttatttaccttctacggtttctaattgtttatcattcaatgtttctttataccttctttatttggtgtttgtaggagtatgtggtcgaggatgtagatggcgaaatgacggggtcagaatggtctcccccggctttaccaactgagcatgtccagcagctgaagacgcttggccttctgtgaaactatatggcttttgattaaaactatgggagatttttaactgcacgcagggaaatgcatttgacaagtggtgagagagagaactcacagaacgatgaaatctaatagatcttttgtatttgtaaagaaaagactccaacttattaaagagtccgtgatctctcccattgagtcagagacctctccaattcacgaactgagcttgtgttgaatgtttgtttctaatataggtaaatatccgaaataactattttactttcggattattttaactcgaagcaagtttttacaatggcgattacagtttaagacggtgggattagttgaaatggcagcatgtaagaagcttagacggcgtttttaagcagtttaaacagtccgtaagctatctagagtccgtatgctttttgtggttatcatattttaagttaaaagtgttaacttcaaagttaaaacttttaaccgtagtgatcaaaaacatttggttccaaactttcaatgagtatcatcgatttcgaagggtagaatatctttttttgtgcaaagggtagaatatctagaagttgaaattgaaaaataaatgatatactattacaaacccaacaaagttaacaaaattttgttttcttatccaattaaagaaattcgaattccttagaaaataaatataaaattaaatgcttcttaattttattgttcatgacacaaaaaaatggatagagaatataatgtgataatgttaatgtattagttatttgtttgaactaatacactttttaagtatggaaatggatagagataacacgtatctatgaactacaaatgaaaaacacatgggaaaaaattaagttaattgctataactttaacatggtgagaagatgcatatagtaatcaatgtagtcaaccctatattttttttacattcattcactttctatttatttttatttatgcttagatgtatacccgtatatatataaacataaacattacatagccataaagcaaagaaaagagtcattcatttatcctctaatttacaaaacattagtacgtagctttctttttttttgttgcaatcgatatattgatc

SEQ ID NO: 13961 - DNA, 3000 bp, Unknown
  misc_feature (1)..( 3000): cDNA_ID_3020878_gDNA_ID_2214678_Annot_ID_189235 3000 nt of promoter + ATG
tcttaagattttcagagtttccccattggaaagaaaaacaaagccctcataagatcatgatcacaaaacaacgaaatcaaatgaccaaaaccaaaccaaagttgatttagctgaagcatactatagattaatacgagttgattcatatggatggatggatagctgcagagaagaccaaaaaccgagaaacaagattgatcctcttaagaaatcgaaaaactgaaaacaagattgatcctcttaagaaaacaagcattcgcatcatcggtcactgtgaggtcattgtgaaaatccaaagaaaaaaaaaaaaaaaacaagtatgctttgctaccataaccagagttatatagaatatgaataacgagcaggtaaaaaaaaggtaaatccagaacaaagctatgtaaggtgaaaaacaaattgggtccaagtaccgatgaccaaaaacaatcttgaacttaggcaagaaaacttggcaactgatatcaaaatggactcttaaatacaaaagagaaaggggcgacactaccataaaagaggaatgtgatgaaagagattgagaagcttataaaaacctatggggaagaaaacaatgcttgaaggaaagaaaactcaggttgtttattccagagaaaatcaacttgaagcttttgaaagagtcccaaaactttttccagtactcaaaaagacagatttaaaacaagaatgtaaaaccattatgtctgatcctacaaacgggtctcaagacaactgcagctggaagatacagacttttggcagttatgacatatagtggacaaaactataaatgtcataagcttcttctccagctatagcgaacagatattcaatgaaaatgcgggaaaacataaaaccaaaaacaaggaaaaacaaaagagaaaaacatacgccatgccacagaagaaaaccagacgtgagtttgatgggtaaggagaagacagaagaccataatgggggactccaaaagggaaaacaaagagatagcaaactactttaaaccaatattgatcctagtaactaaatcttctagacaaaatgaccacatttcactggtttatgagaacagagcagaacaccaatgacagacttccagagagcaacagaaaattcatcctttgagcacacatctccctcaaaatggctcatataggggtagatacctcgttaaaagagactataaataatgaaactaaaaaagtaggtttgaaacatcaggcatagaaaataaagatccgcaaaaaaaactcctgcaattcccaaaatatcaagttggagtcgaagataccggactaatcattagcctaatctataacttgaaatatcagagaacatggtcataccacttgggttctcttatctcagataccaagcacgttcaccatcaaaaccagcaccagcaccagcacccgcaccaacaccgttaacattaccatcaccaacatattgtcccaccattcccatatgattcggtggcatcataggtccttgattcatcatacccgagccaaacatacgataattctgtaaaccagcaaccatcggattacccatcattgcaccatacataggattaaaaccaggaggaggctgagaatgtccataaaagggcatgttctgtccagcatacattgacatattctgctgctgctgatgtcccttatcaagtccatgacccaaatcaatcccaggcaaagccatttcactctgattacccgtatgactcaaatcaatcttcacagactcaaccggttgttgttgttctcgtggctttccagaattaaacggcctagctggtaaacaactaacagttcgattatacattctcttctccggattcttcaacgccgctctcgctcctttacgcgtcttaaacaacacaaagccaaaacctttagctcttcctgtatctttatccataaccacagaacattccgttatctccccataaacctcaaaagccgccttgagattctcatgcgttgtatcccatccaagaccacgcacgaatatgttccgttgagaactatctctatccgctgattcaaacactgctgagatcaatttagaacctttctcagcagttttgtaaattaggttaataagctcctctttagagtaagattcaagtagattcttaatatcttccttatcgaattcgaaatcagaatcagactcaatggtaacaatcgggaccgtaacaggctttgaatcgacgatctcttcggattcatctgatgatctcttatgtttcttcttactctccttcgatttcttaggagatggagatggagatggagatttctcctcttcttctacttcttcgtatttcttcgatttcttctttgatttctctggtttctcttcctctttggatttcgatttatgtttttttgagattttcttctctcttacagcgagttcttcagcttcgcgacgcttcctctccttcctctccttcttctctttcttctccttcttacgttcttctccttctttcgccattgttgacggcagtggctaccaaaaaaaacactctgaatagagtaactcctctaaaatagggtgcaccagagaacactagattatttaagtatatttataataaagtaaagagtctaacaaaaacgtctgggtggtgtagtcggttatcacgctagtctcacacactagaggtccccggttcgaacccgggctcagacatgcttttttttttgcaacacataatttttttttttaacatgaattagtagaggggcaaaaacgtcaaaatacagaaaaggaaaaagatacaacatttctggtttttgtgtgccggcgaagaaccggtgagtgacgggtcaattcacatacttgtttaacggcaacaaaaacctaccgataaatgctaaactaacgaaatcggatcatagctcgacgaagtctcgatcttttctattctctctttctgggtattcgtgggttttacccagatttcgaaattga

SEQ ID NO: 13962 - DNA, 3000 bp, Unknown; identical to SEQ ID NO: 13961
  misc_feature (1)..( 3000): cDNA_ID_2705706_gDNA_ID_2214678_Annot_ID_136676 3000 nt of promoter + ATG

SEQ ID NO: 13963 - DNA, 3000 bp, Unknown
  misc_feature (1)..( 3000): cDNA_ID_2705713_gDNA_ID_2214679_Annot_ID_136677 3000 nt of promoter + ATG
ttgataatattcacatagagtagataactcttcgacaacaaaaaagaaagaaagaagggaaattgcactctgtatacatagaaaattacaaaattaatagaaaattacaaaattaagtgttagaaaaaactactgttgaaccttctctctatcaagaaaatattcttatacccctataccttatttgtttttgatgttaaatattttgttaccttttaataataatgttattatcttccgataattatataatctttgaaatcaatcgttggttcaatagccggtaatttgtttatatcgtcaattgttttattaacatgttatgtaggtttgtaccttaagttttttcatccatatatcaaaatcctatccatatttcgctaaaaatattatcccgataatacgttatctgctaactattctaatgcttgtattttttctacatgattattcagtcgcaagtcaacttttttggccttcatgctaaatattttgttatcttttaatattaatgttatcatcttcgcatatatatgtgtctttgaaatctaaacattggttcaataactgaaaatttgtttatatcctcaaatatattattaacatattaagtaggtttgtacaccatgtcatttcatctatgcatcaaactctatccatatttcgctaacaatattatctcgataatgcgttatctgctaactatccagagttttatcatatctctttataggggtatatttgtcatatagattttagttgaaaagagatacctaaataaatgatcttcatgtatagattcttaattatttgatggttcctgtatagatttttaaatcacccaaaaggaaaattgccctacgactacaataaaaaagctggtacctacatgaactaataaaatcaagcaaaattgtattgacctaaacgccgtaattaagtcaatactaatatgtgttgactaaatgccaattagatcaataatcgaaagacgttggtcccaaagcgtctattcaacaaaccaaactttttttcttttgtgtacaattcaacaaaccaaacaacatcgttttggtcatgtttttaccgtttggctcaacataatttttaaaaatatataaccaggatatctatgattccaaaaaactcatgaagactttttgaatttacctcatttgaattcttttctttcttttttagttaaaagattttaaacaaattctctaatctgccaaaaaagattattattttgtttaggaataatttacaaaaacattctgtgtaagtggcattattttttatctgcttgttattgagcatgagagtttgtttctacttcttcgtaattgtttaagaatttttttgtaaacttaattgtttaaaaacgcagtctctttctcccggagaggttttgggacgacattaaatgcattctttattcttgttatgttttctggtagataaatttatcgtatcgcttatcacaattaaggaagataacacgtgctcccacacaaaagacagaaaaaccatatgcatgccgaatgatatttatgttctgtccaatggtttgcgaatttcaactatttaattagggatggctctttttactataaagagagaatgagatatttaaccaaaaatgtagatctcggaaagcatgttagaggactgacgactagattttcatgcaatctttgacattaattaactcatattttttcatttttcttggtttgttaaaatgtaaaattttggagtctttttttattaacgtttttagtgtccaaagcttattgtcgataatatcggccgtaaagctgtgactcttgaatctgccggatataaggcttcggtcactctgcttccgactagtagcaaggttcgagtctttatgtttgttggtgactttttctatttaacctattttgtaactggattttatctgtgtattgggcgttagcacaagtccgaataagttgtttttaacaaaaaaaaaaaataccacatgtgaaacgtgaattagtttttgtaaataaaattgaactagtgcatcaaacatttactctcaacattttgttcattatctacttagttaattaactaatattctggcgaaattcgattatgatttactctaaaagtttctgaaatgtatcgatgtgattcacaaaaggatatgaacaaaaaaatacggtaattttttcttaagtaggaaaataaatctttaagaaaattaaaacaaagaatcttaagtgtttaagaaaatacattttttaactagtacaaaatttaactattttcctcatgaacaaatctattttgtttaagaaactacatttttattttttacaaaaacaaatctatataaaattaaataatatgatctctacttacaaaaaaaaaagtatttctactcagaggaataaaatgataaaataaaataaaatctgaaacttaaaaaaaagtatgtaaaatagtaataaataagtccaaaattttacaactagatgaaaacaagttgtagaagattctgttttggcatttaagatctctctctcatgcaacaacaaaattttcaaaaaaaaaaaaacctgagaactaattgactccgttgggatggaccccactttagaaaaaaagatctaattggtagatagacagaacgaatcaggggcaaatccgtaaaataatccaacaattaattcaaaaaaaaaaaagtaaagaaagagaaagaaactcatcaacgccacgcctgtacaagagagagagagaataataagtttacagagtagagaagcttttaaattcgaatcaggggcaaatccgtaaaatattcctttttttttttcctttttcctcactactttatatctctaacctttaacttttttttttcttcttcttcttcttactcttcgtcttcttcttcctcctctgtgtctgttcatcggaaaaggagattttgtttttttgttttgtttgtgtggcggcgtagcc

SEQ ID NO: 13964 - DNA, 2557 bp, Unknown
  misc_feature (1)..( 2557): cDNA_ID_3020945_gDNA_ID_2214679_Annot_ID_189244 3000 nt of promoter + ATG
atagtggagtatttatgaagaaattaatttgtttagtgacaaaaaatataagataatatattttttatatagatgtgagtatttaaaatctttttttcttgtaggattaataactgattatataatttcatattcgacaactatattaagatactttaaaaaaggaaaaataacaatagatataaaaaaatataaacttttaaagaaaacataagtaaaaaaaaaaagaaaaaaaaagtagaacttctaaaaataatctcttcaaatgtttttgtaaaaattaaaaaaaaagccaataaaagaaataaaaaataagatattaaatttataaacgaaaaatctaaaaatatgaaagaattctgaatataattatgttacaaaattcataaaatgaaaatataaataatttaaatttattttaaaattttattagtttagaaaataagatatttattacaaaaaaattctattacaacttaaaaaaaaaaagtcgaagtgataagcttttaaggccgtcttaggggtgtcaaaatgggtaacccaactcaactcaacgagtttaaatcttctcaatttcattgcttatatatttaagaaattcggaaaaatattgattgtattaaattggtttagatgtgttggttaaacttaaatcggcattggtttagagattttagttggtttaatttatttttacaaaacttgatgggttaattgggtaaaccattacaacccaactcattttattcatcaaaccaattgactcaataactcatttgacccatcaactcatttgagttaatattttcaactcattagggttcatgagttgagttgagttgagttgacccatgaattttgatccattttgacacccctaggcccgtctacatgagatttaaaacgaccagtcatggttagcaaccacactgaatatttttaatattttaaaattttattattttatgtacaaagatatttataaaacggaaaaaataatatatgaaaaagagaaatgtaaaattttggaaaataatatatagaatatattaaacttatattcttatttttattttgttaattttcttctttttcaaaaaaaaagaaatattaataggaaaatattttcaattaacactagattttttcaatatatataatcaccagatgcatctcattcgatcataatttataaattgtacacttgagtcatctgtcacgattggggctgattactactcttaataatgccgctttatatatatttttatcgcatatgccactacggatacttttctcgctgtcagactgtttttgctttatatctttgacgagttgtaaaacatgtgttggtataagatgttattaacataaaagttttgagtctcaagaagaaggattgatgacaagcgttattggtcgatgtttgtgcttcttcatatcggttatgaaacataagaccttgatttgatgttgtttgagttaaaattttgggtttaaacaagaaggatcaacaacaagcagacatgttttattatctacacatatgaccatgttcaatttatttcctacgcaaataatttgtaattttgtaacattaaggattttggtttgaaaagtttcaatacaaattacttgggacaagttgtgtggtatgctaaaaaaaattatttcgaatggttattcagtgtttctgacagatggaacatcaatcgcttatgcccagaaagtgttacaagctaataaatctagggagttagtgttggtgggagtggaggaacatacattgcaaagaagttctttttggaaagatgtttaggccaatatagcgataattgtttacgtgaactacaaataaatgcaagtatggttaatgacctaggtaatttattgcgtggtttaaaaaaaaaacttagattgtatatataaatttacgagacgtaataaagataataaatttaattgatgagagttttcttgcattatgaacaattgacgttatagtctaggtaataaaggtaattgaaggagaaagagagaaaggtagatggattgcgacaagcaagagagaaatacagaaagaaagtcattatcgcgaagaagaagaaactacaagaaagcaaggcgtattctgacgacatttccgacagttctccgacaaatttttgagtggaaactagttcttcggaaatacttccgtcgcaaatgtcttcggaaatttaaacattttccgagggatttcggagaaatatacttccgtcacaaatgtactcggaaatttgtaacttttctgtggggtttccgaggatatattaaccgttgtactattttgagagattttcgaggacattttgaccgttgtttttttccgaggaatttccaatcggtgaatatagccgttcgaacgtagtcgttgatgtattcgttcgaatagccgttgtaaattcaaaaccctcggaaatcccgaggaaatctctcggaaatttgcctatatattccaaccaatttacatctttggaaaacaagaaaaaaactagaaacaataccaacagaaatg

SEQ ID NO: 13965 - DNA, 3000 bp, Unknown
  misc_feature (1)..( 3000): cDNA_ID_3020955_gDNA_ID_2214680_Annot_ID_189261 3000 nt of promoter + ATG
gttgatgcagctttggagttgatgaaaacgaggaaggaaagcaatccagaattattcaaaaacaaatcagttgtatttgttggatcgtctttcttaaatgtgattgatgagtcatacatggagtttttggataacaaagagggatttcagtttcagtctgaagaaatcagtaagctgataatagaggaagaaaccaagtgcatattggctcctttctgtatcaaaggaaaatgctgggttgccttgctcatccacttggaacagaagacagtttgtatatgggaatgtgcagcttcttatttaacagaagaagtcaagaaaaaatatgttgctgcctactctatagctatgccatacattgttcggaacatcctcaaaaaagaagacatggatgtctctccatttagcatcaaagtcctgaccacttttcctcaggtaacttctttaaatatatcatagtcttagaaatgaacattccgtaagtcctgacttctataacttctttgcttaagtaattcttttggtttttggttgtaggctcctagaaatgaagagtctcgtatctatatgctgaagtttatggaatgctactcaatgtataccagccattcaaaccttgaagggaacataattcaaaacgttatgaataaattggctgctgacatcttcaccgaattagggtcagtcactttgtagaagtagcagacttctaatcaaaaagtagtggagtataagatagatttatcagcttttgtttcttatttcataaaactttgtcatttgaatattttatgaacatctgtatggaacaagatttatgaagtttatttagttcaactcctgttttacaaaattactgtataatggttgtttgggttaacaggtgctttgatttgaatggaaaaggactttaaacatgcttttaaacagggtttttaaacgatttacaagctgctttataaggaatttaaaagtgttgaaaaagctgcagtagcggttattatgaaaaaaatttacaatcgtttttaaaatgatttacaaccgtttttaaaagagatttacaaacgatttataagctgttttaaaagcgttttaaaagtgttgaaaaagctgcagtaactgttattatgaaaagatttaccaccgtttttaaaatgatttacaaccgtttttaaaagataatttcaaccgttgaaaaagttacagtaatgttaaacactgtatctgttactaattgggcctaggcctgttatttagaaaaacaaactgttttagtttaaaaaacactaaaagcccaaaaaacactaaagcccaaaaattcactataacctaaaaacaaattaaacagggattggctgctgacatcttcaccgaattagggtcagtcactttgtagaagtagcagacttctaatcaaaaagtagtggagtacaagatagatttataaactttgtcatttgaatattttatgaacatctatatggaacaagatttatgaagtttatttagttcaactcctattttacaaaattactgtataatggttgtttgggttaacaggtgctttgatttgaatggaaaaggactttaaacatgcttttaaacagggtttttaaatgaattataagctgttttaaaagcgttttaaaagtgttgaaaaagctgcagtagctgctattatgaaaagatttacaatcgtttttaaaatgatttacaaccgtttttaaaagagaatatcaaccgttgaaaaagttacagtaatgttaaacactgtatttgttactaattgggcctaggcctgttatttagaaaaacaaactgttttagtaaaaaaaaacactaaaagcccaaaaaacactaaagcccaaaaattcactataacctaaaaacaaattaaacagggattggcttctgacatcttcaccgaattagggtcagtcactttgaaaagatttacaaccgattttaaaatgatttacaaccgtttttaaaagagaatatcaaccgttgaaaaagttacagtaatgttaaacactgtatctgttactaattgggcctaggcctgttatttagaaaaacaaactattttagtaaaaaaacattaaaagcccaaaaaacactaaagcccaaaaattcactataacccaaaaacaaaaaaagaagggaaccgtgaaaagacaacaaaaaagtaaccaaaaaaaaaaaaaaaaaagaatacaaattgtcgtcctcgtcttcttcctttcaacaatctgaagaaaatctgattatccagcaaaaaggaagcaattgaaggtaactaatttacgaaactgaagtttaacatttgggtttgttcgatttttgccgaatctcttttttgttctagcatttctaggtttttcggttgaaaacgaaacaagtaaaatagattgatatttgggaattttgaaggagtgttggaaattgttatataattttgatagatttatgttttaaagtttgatatttgggtttcaaaaaccttcaaagaagatttcaaatgccgattaacttctctgttgtagcaatttcaaagttttttcgttttgaaacttcaacagtaaatagattgatgtttgggtttgtgttttaatttatagatcctcacttaatttatgggttaccagttgattggatttggtttggaaaaggtttttttgtttctattttcagcggctgtgttctttgaaaaggattaaaattttgtttttggaatggtttcaaaacggtctttaaaaaggattatggagtaatgactgtgttttacaagggtttttaaagtcttaaaacgacttgtaatgactttgaaaaatggttttacaagggtttttaaagttctttaaacgacttgtaatgactatgtttatgtttcgaaaactacaaatgcataatggatttacaaaaatggtttttaaaaccatttcaaaactgtgttaatttaatgactgtgttaatgtatttaataaggttttgagaaat

SEQ ID NO: 13966 - DNA, 3000 bp, Unknown
  misc_feature (1)..( 3000): cDNA_ID_2992826_gDNA_ID_2214681_Annot_ID_189272 3000 nt of promoter + ATG
gataaggatatattttatattaattaagaattttcaaaatattatcaaaagtatttttttctttcaattagttaagatttaggatatttttatttataatttatttttgggttttatttttttgcaaaaaatgttttaattacattttcttgcagttttattctttatctccaaaataaatttgtcaaaccatgaatcaaaaagtaaaacaaaatataagaaaattaacaaaatttttaaaataatatatcaatcaaaactcttgcgacgagaagatcaattctagctttaaagttttaaaaaatcaaatgtaggtgatcataaggatgtttagaaactatttatgggcgttatagtactttataggattgattccactttgaagagataaaacgtaagttgcaaaaactgactaaggtttttttttcttgtttctttgttttggtcttaaattagagaaaaacataagctgtttctttttaatttaattatgaaaagtattaatttgaattttataaccaaattattaacttgattttcagaaaatcatacttcaaaaatcaacaattaagtcgaaaaataataaattaaacaaaagataagctaattattttaatataagtcaactagattttaacccccaatacactgtatgaacaatttcttttttaaagttagtatatataaaagtttgcaaattgaatctatctataaaataattttattttatagtttacaattgttattaagtaacgtcctgccgaacccgtcccaccaacccgtcccgttaaaaaaactcaattttttattaatgctgatcttatttatgataagtttatgaatcattgtctaaatattttgtaattttgtagtatttatatgctataaaatatctctacggtttgttgattataatcaaattattataatcatgcagaaaagcaatatcaaaaataataatttgtaaaattattccaacaaagaagccattgaaaatgtaatcgaatcaagttatagtattttaaaatggtgctttttctattatcgtgtagttaatgcaatatccaagtaggaagtttttcctagcaagtataaatctttagaaaaaagcacaatcgttgcatcgatttccgtgaaactctctcttttgcggaagagtttcgtttcttagatctagtccgctgttttttctttgttcttcaatcgttggtcaaatctactcaatgaaagtccaggagtgggctgaatctattctctgtcaacggtggtgtggtgttttcccctcgatgtggatgtggctcgggtctgttggaagggagttctacagcgtttgtcacacggttattgacgttgtgggttgcttcagttgctccggctcatcccttagtcttgagctccgcccacggcggaagttggggggataaaggagggttcgttgttcgcacggtggttagctgcagatgctttggatcttagagggctgttgtggatttcgcgtttagaggttttggatttgagtcaccagcttctagatccactacaattttgcatccatcgagtcagattgaatcgtgatagcttaagaattttttggctgttctcggttgggagagaggggttactgcccagtgggttgggttagtttttcaggatccgattacgtcgatgtgcctaatttgagcgactaactttccgggagatttgtggtgtgttggtgcttcagaggggtggatttgacgaagaaaaccggtctctttcatcggagaatcccgatctctggttgctacctcgaatcggtctttaatatgacttaggtacggtaagcacaccatcaaaccgattaagactaaaactttgaaaatttctcttcaaccaaaaacaatatgatctttcacattcttcagcctgtttctaactttaatctatgtatgaattgatttatgcatattattcaatatatagttgtatcatatacatgatctcagaacacttggtcttgcccacccgtgcaaggcagaatgagggtttggtattttgtgttttttttaggaacccacggcgcgggtcaacccctagtgacagtatactctttgacaaaatattcttggattcacccctagggatgaacctatcatattcacccttcttatttagtcgatcaaattacaacaatatgtcatgtaatactatatttaaaaatcaatcaaaataaaaatcacaaaataaaaatattaagaaaacaaaatctatatgcttttaattaaacaagattaattatatggcggtttgagtttataaatatgaattaggatttagatttacaattaattaaaattatatgttggtttgggttaatagaaaaatgattagggtttaaacgaaattatatgttgatttgggtttacaaatattgattagggtttagcttttacaattaaatcaaattatatgtcagtttggatttatcaatgaggtttagggtttagattttacaattaagcaaaattatacgtcggttttggtttatataaaaatagttaaagtttagattttacaattaaatgaaattatacttcggtttaggtttataaaagagttgtaagggtttacattttataattaagggaatgttcaacaataaggcacgagaatcattttccgagacactttttacactaattcttatattttggaaatttgtacccttaattcaaagaaatgtaattggcttagttgtgttgcaaaaattattaaattatattgttcatcacctcttcttgtaaaacactgtgactctctctctctccgaaataggaatatccatttttctcaaactaaactaaaataatgtgggtggttgaattggtgaaagaccaaatcgccgtaaacacccgcccacagtcgtcggttttggttctggccagatctaatatggtggcttcattcttcctcctgatctcttaatttgaatcggttactaggcttttgctagtggcaatg

SEQ ID NO: 13967 - DNA, 3000 bp, Unknown
  misc_feature (1)..( 3000): cDNA_ID_3021038_gDNA_ID_2214682_Annot_ID_189276 3000 nt of promoter + ATG
cataagtaaaaagctaaacatgagagaataatcataggatcaaggtgaagtggaataacctaacaaagactagtaagtgaaagaaacccaaaaaggttaaggctttacgagaaattgcaacaagagtgagcaaaattcataaacggagtatatggttttgtcaatcaaatgagtttgtaacttaaatacgaaaaacgagaagcgagaaccgaagatagaaactaaaaaataataatcaaacagccgagtttcgacgaaacaaattttacatgaaacataaatccaattcgatataagaacatgaagaaatttgggggaaataccggtggagagatcacaagagagaaagtcgtgtgcagcagtggtggtggacaatgacggagaagttggagagaatttagggtttgggaactaaattagaagtcgtcgtcatctccgtcgtcgtctgagcgaacatagtcaccggaaaatcatctgcgtcgttgtctgcgcaaacagagtcaccggaaaaactgaagaggatgatgtcgcccgagtcgtcttctacaacaaacagtaatttgcagttttttactggattagttttttacgtgtccgaaaaagtcttcaaaagtcaaatagggtaactgcaaattcgacgagtggtttggttaagggatctctttggttaatgcgggtttggtttgaagacaactggttagggtaatagtgtaactttgccaaggcaaagtgctgatgattttaaagtgtcgaaacacgtctaaacttttgaaaaagtgtctaagtatgcaatattctcaaaatataattactagtttgacttattagtgataacagattttttttagggttaaattggaaaatagtcactttccgaaacataattggtgaactaggcagtttactattcacaattagatttttagtcactcctttttttctctaccaattacaaaatcaattataccctagatcatctctactaattacaatccatgtcattatctatcccacgattatttatgtaaattaatttagaaaacaaatttatattgatgagtatttcaattattagattagaggggttataaaaagaaaagaaaaaaaatatatatgtttattataaagagagagagtgtgtgtagagatagaaaggggagtgagtgatacacgtttctaaatctctacctcatctagtgtcatacattagtctctctcctcagccaaaaggatctcaaggtaattttcaaaactcccactaccccacccctgcttctactagacgctgttttattatacgaaaaagtaacgtacatgtttcaataattataaatagtgaactgcctaattctataattaagtttgagaaactgactactttgcaaacacaccctttttttatgttatgacagatttttatctttaaacaaaaaaatctgtgcaatagtagcagttttgtcaaattaaaaaaaattgccagaatgacatacaatcgcagacaaaatgtttaatgtgatgacagactttttgtacattatgacagatttggagtatggttaaaaaaactgtcgtttgattacaggtttattaatcaaaaaaataattgctggaataactttatatagtgatagcaaatatgttttatgcaatgacagatttaaattttaatccatcttataacaaatttttatttcttatgtgatggtaaattagtttttacaaaaaaaaatatttgtaagatatttgtcacgtgtctttaataatttatacaacaaggttataaaagactttttataagtacgacagatttttttttttttttttttttgtgaaaactaataaatgacaacacaatctaacttaccatatatttctaaagttttagaaccgtttctctctactcacgacgccactatcgtttttctctctacttacgacgccactatcgtttttctctctactcacaacggcacaatttttatttttcaaactaccttggagatgatcaagtattatttcttttagggctaaaattctacttgatcaaccttattatctcttacttttttggtcaaaatctttctcttagggttataacaagcgaaatagagtgtgaggaaggattaggtgtttctcgtctgtgcaagtggacatttgaggataacaaatggttgttcttcattgataatcgtagaggttgtcgaatctagaagtcaaccgatgttgtttttcaagcaactcagctgtgtgatacctgatgatgagagccttgccattatttctgataggcacaaatctatcgggagagcaatcaatgtggtttattcaaaggctagtaggggtatatgtacataccatgtgtacaagaatattttggtggcaacgaggcgagccttgtaccgctcaacactgccatcaggtttccgcttaacccgataagaagacccgttgttggtgcaggaattagcacctccgtcaataccggtttaaacaaagggaaatgtgaatctaatcaagaattcgacataaccgggatatcccggtttgcctattaatgggcaaaagttgtgaggtcgccggaagacctaattcaatggatagagatcgcccagccgacttcctgaacttcggaaagagaagacttccattttgaaagaagaggatcttgtaaagaataaaagaaatgaagatttaaaccttagataattagaagtttatcatattctgatatcaaggaaacattgtataaatagaggggtttgtcctctattcaatggatccagaacctaatacaaaaacactacttttctcatagcaaaaaccctaacttctttttcaagcaactttgttcttcttttccgattactttagagctaagagagaagtgaatttatctaactccttagtataaattcattgtttgatttacaaaatcaacaattggcgtgccttgtaggggattataaacaaattttctctacgctctcgcaagaaaacatg

SEQ ID NO: 13968 - DNA, 3000 bp, Unknown
  misc_feature (1)..( 3000): cDNA_ID_3021017_gDNA_ID_2214682_Annot_ID_189283 3000 nt of promoter + ATG
gagaatggtttggttttgattactgtatcgcgctaagtgttttgggctaagtgactgaagagggaaatgaattactgttctcgcgctaagtgtttttttggctaagtgttggcggataaagtcattttagattcccgctcattaaattcctatcatagtgtttattaacccatattataaagaaaccccaaaaaaaaaccctaccatagcaggaacagaaaatgagctatcctatagtgctatcaatgttgatatttattgtagtggtaccaaatgctcatataatctataatatacatcatacaaattttctatatcttttcttgagttgaaataatgcttggaaaactaatactatcaaacaaatgcaataaatcataatagcgacgagataatcatataaaccatcaaatttagttctaggatcaaaaacagatgcaagcaaattaagaggtggaacttttctatagtattttaacaatttatctctcatactagttatgcatgatgacaaaacagtattattttcatgttcatgcatcacatcagcaatattaacaaattcatacaaaagtaaatgactagtaggagataccgtggttggaaaaaaggacaatcgttcctctctcttctctctcttcttaacctatttttcggatctagggtttttccatggccgcctctgtaaggagcttcatcgacgaaggttgggttagcggctgacacgggagtgggcgcctttcttctccggtggtgtgtggtgtggtggatctatggtttcaatgcgaattggtggctctcctcacagcagccatgagatgatgttcctccttgtctgctggtcatggacgctagcggattggaatggattctttaggctcgacagcttgtgagctgtagctccggtgagcggcagaagtcggactgtagatcggtgggtttcacctctttgcgacgagattaacagtggatctttggtcggatcctagatggcgagctgcgggtgttccttagctggatcttggtggatgatggcttgcctgagccagagaccgtcttctccgccgtagctagttttcccttagccggatctgaagtgaggtttgctttgggagaggtccttgggtgagcatcagtggagatgggggtaagtttcgaatccttcgtcttgctaggttggggagaggagggattgggtctcggttgtggcggttctcccttttccgaaaggattgttccaggttaggcttgttcttggcgttgatttgcggcggggttcgctagctcaagccaaaagtttgatgtcgaggtcgtagccacataggagtcgtccttgctagcgtcggttctagaaggcgatgttcgtgtttccggtgtaccgcacggttctgatcttgttttcgctgggtttgttttgggcttctttcattttgtaaccgtgtatttgtcgtttggcccatcttccataagcccatttgggattcttaataaaaaaaaaatgactagtaggataataaacaccggataataaaaatgttgagtgggccattaagctaaagaactgcgattttgttgaataaaactacacaataaatgtttataaccaatagaatcaacaagcatataatatgttgaattccactgagtaggaacatctcgagaaaactgtttgggggatatgttatgcattttacaaaatcaaaccattttttcattaattgtggatgaccccataaataattcaacgtagttttaattggtgaaataagattattttgagaaaccaataaaccatcttgaacacataaatttaaaacatgacaaatgcatcgaacatgaaaatgttttccacctaaaataagactataattatttattaattcatcaatggaagcaatattagcggatgcattatcaaacaaaatagaaaatcttttgtttgttaaattatatttttctataattatttttattaatttaaaggcatgtctcaaatataggatataattactagaatgtctcaaaaataggttatatcctttatctgggtttaactagtaattttctattattctctttgataggaataaaaataaagttagtattaccctttaattttttttaaaacatttttgtaaaaaattgtttgttttttttttttttggaaaaatctgctgcttagttgtgacaagtttatttttctgtaacagatttatttgtctatgacagattttttgcgacattaaatctgtgaaaaaatataaatctgtcgcaaaaaaaatctgctatcattatataaatttaaatatagttacgacaaatatttaatttgtaaaaggctttattatgaggatagacttttttacgatgacaccatacactttttgtaaatttgacagagtttttaacaatttggcacatttaatttgttttagtggcatcagacttatatttttaaaaactaatctgccataaagtaacatattttatgatgaaaatataagggtttgttacactatgaggcactttcggagaaacttaatgcacttaatacactttaaaaactagaggcactttgccttgcttttggagtgaaataagacatatatacccccacgatttcgtttgagatatcattgcaaaccgggttatggtttcgtttggtattggtttaaaatatacggttataatgtgcggtttagaaaaaacagtttgtgcgtgacgacgatcgtcggatttcaatagattaaacggccgagattaaacattgtaacttcccttgctttgcgagttaaaaaaaaaactgaaacacgagatcaattcaaacacataagattctgggtttcaatcatcgatctttggtcaactgtcgtgtccaaggagctacgattgttgaaaactgatatcatgaaattaaaacgaaaatccgtgcattctatttgttatgggtatcagaatataaccaaatctttttttcgtttatatgtacagggatcgatg

SEQ ID NO: 13969 - DNA, 3000 bp, Unknown
  misc_feature (1)..( 3000): cDNA_ID_2994320_gDNA_ID_2214683_Annot_ID_136697 3000 nt of promoter + ATG
cttaatcatcaattcatcatctctgatttagttcgtatttgtctgattcagttcctcctgctatgaaacttgatccgagaaggaaatatgcaattgttgttccttttaagttttaaacatggtaactttgtaaacaaaacacaaatagtagagtttatgtgcaaaaaatcagataagataaaactaaaaaaagcatgcttaagaggctgaagttaaaaccaatactcaaatgatgctatcactagccatttgatacgaataggatgaatgtgattatgagaaataagttgttgaaatctagcctagttaaagacgttagagacgccaacactaggctagtcaaccgcatttaaagaaacacaaaaaggcttttagttttgcagtagttatggacatatttgttgctccaacgtaactcctcttgatgtcatgaaagaaagaaaagataaaacccatagttttggagtatgtaataagaagcttagaaataaagcatgtaaacataaatcaaattgagtaaaaaaaatttagatgaacaaaacctttttaagaatgtttttgtttcaaattctcccttttgattctacgacattttagtaactctccatatttatatgttagaaattattctatttcttctttattgataaatactaagaatgtattccaccgcgatgttgtgtagattgaatatttggtaaacaaaatatataaagttcaaaatatatgaacatttaattgacacaattgtttgtaaaatatataactttttaaaaaaattgtgataaaacaatacgaaaaatggggaaaaagacacgattctaaacgactagaaataacattgtaaaaagacataactgttaaaaacaatttctaattaataaatttatatatttaacgaagagtttcaatataagaaaatgcaaccatcaaaactatttattcaaattaaaaataaaataaaaatgttttacgaacgattttgaagaaaagacgaaaatggaggggaaaagacacaattttaaatgaccagatgcaactttgtaaaatacaattgtacaaaatattttttcaattattaaaaattaaaataaaatattaatggagggttacaatgaaaagaaacaaccataatatgtatttattcagatttaaaataaataaaaatattttactatccgtaacaatgaaaagactcaaccatatgagatatttattttgattttttattatgtattaaatatttaatgaagagttacaatgaaaatatttaaccatataaaacatttgttcagaaaaaaactaaaagaaaaataggttacaaaaatattacgataaaaagaggcaaacaggtgaaaaagagttataatctaaggacgctactgaagataatatatcaatggatgcaacagttcgtcaaataaattaaatgatacaatggttcataaaaaaaaaaaaaaaaattgcaatggttcgtcagaaaaatcaaatgttgcaatggttcaactgaacaattgcaaatatttaaatgtattttagtaaattcaacttttattttattttatgattacattccgattgtaatttcgtcagccttacagctggaaaactcttgatcataataacaatggaaaagaagatgttaaaaaaaaaaaaaaatttatatagagacaagcgaccacatatattaaatatgccaaaggttgtgcgttcgtcaaacaaactaaatgtcacaacgattcataaaataaatcaaaatttgcaaagattagtcaaataaattaaatgttagttcaattaaatggtttgcgaaaattcatttacacaaattaaaaatatattttgtgaagttttataccgagaaacacgattatagatatcaaatatactagatgttgcaacggtttttattaatattaagggttacaatagttcctaaaataaacagaaaattacaatgatttgttagtaaaccaaatgttgcagtagttcaactaagcggatataaaaatttgtttcatattttaataatgaaaatataaaaaaatgtatgttgaagagttatgaacaaaagttaccatcgactttaacgttaaagagtattttaatgatgagatacgataaaaaaaacaactgtgaaaaataaccgtaaatatttcaacaaaatatgcgataaaaagatacaaccaaaaaacataaccataaatatgtaacaaaaagttacgttatataaaaagatacaacaattcagatacaatcgtaaaaagatacccaactaaaaaagatataaccgtaaaaaagtcctgactatatttcaatgaaaatacacgataaaaagacagaacgaaaaaaatcagaaaaccccgtaaatatttaataaaaatttacgataaaaacataaccgttcagaagtgtttgcgatataaagacacaaccgtcaaatttctttgaaaaaatacgataaaaagatacaaccgagaaaaacccaaaaaactcataaatattctatcgaaaagttgcgataaacaaacacaaccattcaaaagtgcttgcgataaaagaacaaccgtaaatgtttcgactaaaagttacaattaagagacgcaacccgaaaaagttacagtaaatttgttaacgaaaatttacgatatataaacgtaaccatttgaacttgtatcctactttggtttctaataaaattcagatgacaaagaaaaaacgcaaccattaaaaaaatgtaaaagactatttattgagattgtcttattattattagatttacttaactccaaaaaaaaaccatggaggaggtaagtccaatacacccaacccaaaaaatagacaaacccagcccaagcccaaaaagcccttctatttttatatgtagacgacaataatttttacagacctcaaagcaaaattaataaattatcgtcttgacgaaaaatcgtagaggaaaaaaaatccccaaattgtgtgaccggaattagggtttcgaca

SEQ ID NO: 13970 - DNA, 3000 bp, Unknown
  misc_feature (1)..( 3000): cDNA_ID_3021062_gDNA_ID_2214683_Annot_ID_136698 3000 nt of promoter + ATG
atatttaataaaaatttacgataaaaacataaccgttcagaagtgtttgcgatataaagacacaaccgtcaaatttctttgaaaaaatacgataaaaagatacaaccgagaaaaacccaaaaaactcataaatattctatcgaaaagttgcgataaacaaacacaaccattcaaaagtgcttgcgataaaagaacaaccgtaaatgtttcgactaaaagttacaattaagagacgcaacccgaaaaagttacagtaaatttgttaacgaaaatttacgatatataaacgtaaccatttgaacttgtatcctactttggtttctaataaaattcagatgacaaagaaaaaacgcaaccattaaaaaaatgtaaaagactatttattgagattgtcttattattattagatttacttaactccaaaaaaaaaccatggaggaggtaagtccaatacacccaacccaaaaaatagacaaacccagcccaagcccaaaaagcccttctatttttatatgtagacgacaataatttttacagacctcaaagcaaaattaataaattatcgtcttgacgaaaaatcgtagaggaaaaaaaatccccaaattgtgtgaccggaattagggtttcgacaatgtcgtccgggaagccaaagcaaggcgacacacgattggtggttgctgccactacggcgtcggcattgatggaagcgaagaaggctgatcacggaggatcttcgtctatcgttgagtataaaccgccggtgatgcttgaagatgaagaagatctagaagtaaagctccgacgtatccttgagaacgttcctgttcgtgttagtaatacttctggaagttccgctggttctggttctggagatttccatcaggtaactaaactaagcctttctcttaaatcgataaggctttgtatctggaatctgaaactgcagataaggctttgtattttgttattaggcgtagttaggtgtggtaatcaattacgagaagttcattgttgggatctgaattatcttagtggactttgtgttgacattgttttcttagttttgtgatggatcacaatgcctttatgcctatataagagtttgatagaatgttccatagactatcctgtattagtcttttgatggctgtgatctgtgaatgatttcaacttctgtatatgaattctgttcttcagtaactgaaaatcagctggattgtttgtgaagaatgcctggtcttttgttcttaggcatggctaagtgtggattcgaagctatagtcgattaattactagaagttccttgttgtacatgtgataggaatcttaaatttcttagtctataagtgttttgtgacgttgattacttagtcggtagagcttgaactgagagtattagttgcgagaagctcatgtgggtattagtaattaatggttgatggtcgttgtgttgattctataggttgtggctgagtgttatctgaagtgtggccctgattattgataaagcgtgtgtacatcattttcttattatactagacatctaaacttgtgcaatactgatgcattgtttttctattacagtaccggcaaatgaggcggagagaacaagaccgactaacaaggatggatattgactataacaagcggttaaaaatggcagagtttactataagaagagaagagaaacagaaagctgcagaggaaaaaacatcgaagaagcgtttgaaacgccaaaagaagaagcagaagaaacaggagaagaagcaaaaaccaaacactactgaggaagaagtaaagcaaccgagagtaggagaaatatcatctgacgaaggtgaagatgaagtagaagaagagtctgtgctagaacctttacgtccaatgtttaatatcaagttccaagagaaccgttcatagcttttattgtgacatgttacatgattccaaaactatctttgtgagattcgtttctttctttccttttgttttcaacaatgtacgggaaaaagaaatggagcaggttttaatcggcttttgtattggattagggttcatcaaatcaaccaccaatgtatattgacaagtaaaccaaaattctttagtcgaaaattgttaaaacgactaaactttggtgccagcagctaagctccatacacgcaagttcccacttttgtgtccactgaatagcaatccttgaggaccaattgtgagtgtgccaatcgtgtggtcccatccaaggaagacgatatcagacatttgtcccaacataagagtgatgttacagtgccagtatgttgcttcaaggtcattatacattgcagggtgttgagatcccacaccttgattgttttatcgacagagtatagcacttgacctccaacaacaaaagtacaaaacaagtgacttcaccactatgatgtccctcgagagatgtcaagtatttgaatggatcatcagactcagagtgtgtagtagctttccagactaagctactaccacaacttgttccagcaaaaagcattccgtttaatataaaaataccccatctttgaattgttgatacaccgatttaacatctctatattccaaagtaatgtatatattgttcacaatggaaaatggagattaaaggaacaacaaaaattgtgaaccaaaaaaaaaagaaatgccaaaagatagaatcagatcaattactcaaagataagaatggtttaaaagcaaaaaagaaatttagttaaggccatgaatggtgacatagaccgcacaaactgcttaaattgaagagacgactatgtgcgtaaaacgaagagactcaaaacaattttgggattcgtgagagatattgattcgctgcaatggaagaatctgttcatcaatcgatacgattcggctcaggtttcttctctctttctctcattgtttcattgttctacgactccattaacgtgtagatctaccgattcatatgatttctgaactgatgcagttgcagatttaatc

SEQ ID NO: 13971 - DNA, 3000 bp, Unknown
  misc_feature (1)..( 3000): cDNA_ID_3021077_gDNA_ID_2214683_Annot_ID_189291 3000 nt of promoter + ATG
agacccatttgaaccaaataacatcatcccaagatactttgtttgctctagaccttaaagattcctaagtatggcctgcatgaaatccgtttaagttgcatggatcagccactcttgagtgtagaggtaaccgtattcgcaaaggtccttatgtctcaaacgtttcaggatatgacccattggtgttcacgaatcaaactaaaaacactcattacagccatattccactcgggcattgtataataagtttctcagcaaaaggtcttaggtttagtaaaacattccaattccaagtgttccaagttgtttcttcaagcataagtttttttgtaatattgtattattcttgtatcatactgttatgttccatgaagatggggtatatcctttggatgttctgctaaagatctgtaatttatattgttacataactagattctgtaactaaaattttttaaattttaagttatatattttgttaagattgtttgttttgtttaatgtttaagattgtataatagtattttaatttttaattttagaatttcacatatggtataaagttttattttaatatcgattcaaacccatcctaccatataactccgtccaatgacttttaaacatcattttgttatccttttcaataatattttaattttaaaaatatataattatattaaatctaaaaatttatttaagtttctaatctaaacatttaatatcgtgtatttaattaacaattaaacagaagtagaagcctgagatatcgaatacgcccactttaataatcattgagacgtaacttatattgctagtaatgacaacatttttctagtgcacaaagaaatcaattaatgtcaatgacgttaaattgtatatattgctaatatttattgcaaaagccaggttttgtagccaaaatatctccgaaaatatgtatattgatttggctatagaatcaacttgctaaagtgaaatattataattgttcaaatattataaacttttatcaaatttaaaatattataaatatttgaactttataataatttataagaaatttaaacattataaatatttatattttttactacaggtgaaatcttattattaacgggcttgagtcgataataatacatgacaatttactacggttgaaatcgtagaattaaaaaccaaaaaataattatacaatcttaaacattaagtaaaacaaaaaacattaacaaaacatatacaactaaaaaattatttttttcttaaaaagcatctcgattattttgtaagaagtttaaactttataaatatttagactttatgcaacatgtgaaatcatagaattgacgggtttgggttgatattaatacgagatggtatactactggcaaaatcctaaaaaataattaaaatataattatacgatcttaaacactaagaaaaacaaacaatattaacaaaacaaatacaatttaacatataattattttaaaaacaaatctcgattcttttataagaagtttaaactttataaatatttaaactttatactatctgtaaaatcctagaattgatgggttttggtcgacattattacgaaatggtatactacgggcaaaatcgtaaaattaataattaaaatacaattatacaatcttaaacactaaataaaatatacaatattaacaaaacaaatgcattttaaaatttcaaatttatagttataaaatatcgtctctcggtgtatcatacatttaaatcaaacaaaataatagcatatatctatagatcattctaaaaagaaaatttagttaataaaattaggtttgcggtgtaccactagttaatctctaatataatacataaagttaaaaaaaatctcaatatagttctctgcatatattatgatttgaaatttcaaaagcggacatatattacccaattgataaaaaatgtatgtggttaacgtcttatatcggctaaatatttagacaatgatttagaatcatattatacattagacccagatccaattaaaggtgatcattttattattttaacaccaccaatattaaacatataaaatcaacttgatttaaataagattgtatgaaaccaaaaatatctcgtggtataccgttacttaataacaattgtaaactataaaaaataaatatctataaaatgatatagtttataaattcttatctataataaataattagtaaattttttaagccactacttttcaaaaataaatcatcagtgtataattaatttatttctcgcaaacgtgagagagaaaagtaattttgttttatttgttattccaaaatgataacatctctagtttaactttgtccatgagaattgagatgtgcgtattaacaatcaacaaaaaaactgctctgttctttctcttagtagctcaatttagcaaatttctcaacgccgttctctcgccgtcccaatcctctttggtttaagaacttctccctcttcagtatttcttgatagttgagcggagcctctgtccgaagatattccggttttacgtcagagtttgcaatctgtcgctttttaaccgttagtcagcaaagttggtttctgtttcttcccgttacaattctttgtgaattgttttgaagtgattttctcggtaaggtcaattcaagagtgatctttcttcatgactatggatctagataaagctataatgaagatgtcaattaaagatgacgggtctttgattctttccaatcaagctaagtttagctctatggagaggaatagttgtagtattatgggcagatttctgaatccccctcatcaaaggatgtcaaattggatattagacatgcctagaatttggcgtttatactcaagggtccgtggcgttgccttatcacaagaacgataccaattcttcttcaaataagaggaagatctacttgaaatcctaaaaacgggtgtgtggactcaagatggtgtgttatcatg

SEQ ID NO: 13972 - DNA, 3000 bp, Unknown
  misc_feature (1)..( 3000): cDNA_ID_2710753_gDNA_ID_2214683_Annot_ID_189299 3000 nt of promoter + ATG
gaacaaattagaaagctcattaagtataaattttgaatagagaaatacgtctattcatgtattaaatcaacatttacaaccaaaactgtatattccatataacaaacacaagtttctgtattttatagacataaaataacatattaatatgttactgtgttattttatgtgtataaaatctagaaaagtgtgtatattgtctccttttggattatattgtatgaaaaacattaaataaaatataatattttaagaaaaattttaaaaaatgttttataataaacatagtaatactcaaattacaaaaaaaaaaaaaaaattttatataaattactagataagtttaccaaaggtggaagaggactcctccatattctttccaaaaagggacaagtttgggcattgtatctaaattggtccctgagtggaacaagaataccccagataaagttaaacacaagtatgagatggtggaatacgccagaatctagatttcctttattctattattcttaatctcacttcttcgacctttttatgcaaccaatataggcataatcattggaatatgatagaaaatatgttatttttaatgtttataagttataaccttttcgagggtttcattttaaatataggtgtaacaccccctcccgatcatattagacgattttgttttaacattatgagttaaacacattactataatacgacaagggtttttgtcgtgtgttgtgtgtctatataaattggtgtatctatctccttcttagtgtgccgtcaaagagagaaacgaatcaaaaccccttgagaggagcagcacttaaatcattgagagtggagaagctatagttgtactagtgctggtggtgtcattcgttcattaaaagaaagagatcgtgagtcactgtttcgttgttatcatggtgataggtcatccgtggagatttgagtgagaaagctgaaccaccattggataatagaacttgatctaacaaagaggacatgttatgactggagaagaatagaaggatgggaagagatcggttgtgacgaagaaaatggaagcggtgatggaggagacgtcacggatcttaaccgttcatcaccggaaccaatggctacggagacgagaccgttcaacgatgatggcaaaccagtgatgagtatattttgtagcagatcatagatggtggtgttgtgatcagtcgaaggaaagaaaaagaaagaagaagaagagaaaagaggaaagaggaagaacagtttcaagaatgtttcttgcagggtgaattcccgacagaccagagggactcagataaggactaaggtgtctctagaaagaacatgctgtctaaaatccacagcaactgacggatcttcaatcagacttaaaatcaagaagttatgcacgtttctttctggacaagtaattgcaaagtctgtcaaatctagaaaactctaaaaaaacagttcgagatggcttgttgacgacagcgtttgaagcttttattgaagtcagatcaaactgtaaatttttggagttattcatgatactatcggctacataatcaacggtgggatcacgtttctaacggttagttcctgacttatatatacgttactgtgacggttttgtatggaataaccatgatgagttttattgtttggttgggcaaacaagatcggtttgagcctaagcttttcagggtcttcaagactcagtgttttagttcttggttgatgaaggtgttcttggaagcaagctagtaacttgtctaaaggagaaaggagaagagagttgttcttcatcttcaactaggctaaggtgagggtggtatttgcggatatgcagtaaactttttccttctatactctttgatagttactgggtataggctcgagaattgtccttgttgatttatgtgaatttgtgtgaagttaggtttttagtaacatgatatttgaaatgcattggtaacatgatttgatatatttaatatatattaaattacaaaattattatgtatatgagaacataaaactaaaaagtatggaaaagatatttaaggatgttggactgtaatggggccgacgggtccgtttcaggtcattaaccactgactagcaatgagaggaaggatcgagttacggaccgtggtcttgcagaaaataggcttgagtagccaaggttaataagcttaagtagccaaagttaatataggcttgtgaagccataaagtaaaatactaaaactaaaaatgaaagtaaaatatattgttgtgagcaagacgcatgtttgtttgtttgattgttagacattctgaatctatgctaagtaatggttattgattatatttgaattttttttattgtatgtctagtgggcagagttgatctcctcattgagtaaacttgttttactcacccctttttccctaggttagtaagtctcaattggtgaattttaaataaagaaaagttttggcaagaccgcatgaataacatgctattttggcctgtatagcgggacgggtgttataataggtttttcaaccatttttggttacatgttttgtttgagctactgcaaatgattacaaagtgtgaggttaaaaggagctaacaaatgatttaatggctttgtttcacttacttcacttttagatacacacatttcatttgtttagaccaaaaaaaaaaaaaaactataaataaggaccgagttttatacaagttcaggtcaacggtgtcgtgattttaatgttatgaaacactttttaaagaataaaaaacttaccaacccctttctttatctctttcagactttcaacctcaccttctctaagcagaacttcatagttttgctttgctccaatatcttaaaaaatttggtgaacaaaacaatcattacttgcagtggttcaccatctctctatcctatgtataggcattttcataaacatactcatagagaacagagaaaacctaagaactcgaacc

SEQ ID NO: 13973 - DNA, 3000 bp, Unknown
  misc_feature (1)..( 3000): cDNA_ID_3021062_gDNA_ID_2214683_Annot_ID_189295 3000 nt of promoter + ATG
gttatataaaaagatacaacaattcagatacaatcgtaaaaagatacccaactaaaaaagatataaccgtaaaaaagtcctgactatatttcaatgaaaatacacgataaaaagacagaacgaaaaaaatcagaaaaccccgtaaatatttaataaaaatttacgataaaaacataaccgttcagaagtgtttgcgatataaagacacaaccgtcaaatttctttgaaaaaatacgataaaaagatacaaccgagaaaaacccaaaaaactcataaatattctatcgaaaagttgcgataaacaaacacaaccattcaaaagtgcttgcgataaaagaacaaccgtaaatgtttcgactaaaagttacaattaagagacgcaacccgaaaaagttacagtaaatttgttaacgaaaatttacgatatataaacgtaaccatttgaacttgtatcctactttggtttctaataaaattcagatgacaaagaaaaaacgcaaccattaaaaaaatgtaaaagactatttattgagattgtcttattattattagatttacttaactccaaaaaaaaaccatggaggaggtaagtccaatacacccaacccaaaaaatagacaaacccagcccaagcccaaaaagcccttctatttttatatgtagacgacaataatttttacagacctcaaagcaaaattaataaattatcgtcttgacgaaaaatcgtagaggaaaaaaaatccccaaattgtgtgaccggaattagggtttcgacaatgtcgtccgggaagccaaagcaaggcgacacacgattggtggttgctgccactacggcgtcggcattgatggaagcgaagaaggctgatcacggaggatcttcgtctatcgttgagtataaaccgccggtgatgcttgaagatgaagaagatctagaagtaaagctccgacgtatccttgagaacgttcctgttcgtgttagtaatacttctggaagttccgctggttctggttctggagatttccatcaggtaactaaactaagcctttctcttaaatcgataaggctttgtatctggaatctgaaactgcagataaggctttgtattttgttattaggcgtagttaggtgtggtaatcaattacgagaagttcattgttgggatctgaattatcttagtggactttgtgttgacattgttttcttagttttgtgatggatcacaatgcctttatgcctatataagagtttgatagaatgttccatagactatcctgtattagtcttttgatggctgtgatctgtgaatgatttcaacttctgtatatgaattctgttcttcagtaactgaaaatcagctggattgtttgtgaagaatgcctggtcttttgttcttaggcatggctaagtgtggattcgaagctatagtcgattaattactagaagttccttgttgtacatgtgataggaatcttaaatttcttagtctataagtgttttgtgacgttgattacttagtcggtagagcttgaactgagagtattagttgcgagaagctcatgtgggtattagtaattaatggttgatggtcgttgtgttgattctataggttgtggctgagtgttatctgaagtgtggccctgattattgataaagcgtgtgtacatcattttcttattatactagacatctaaacttgtgcaatactgatgcattgtttttctattacagtaccggcaaatgaggcggagagaacaagaccgactaacaaggatggatattgactataacaagcggttaaaaatggcagagtttactataagaagagaagagaaacagaaagctgcagaggaaaaaacatcgaagaagcgtttgaaacgccaaaagaagaagcagaagaaacaggagaagaagcaaaaaccaaacactactgaggaagaagtaaagcaaccgagagtaggagaaatatcatctgacgaaggtgaagatgaagtagaagaagagtctgtgctagaacctttacgtccaatgtttaatatcaagttccaagagaaccgttcatagcttttattgtgacatgttacatgattccaaaactatctttgtgagattcgtttctttctttccttttgttttcaacaatgtacgggaaaaagaaatggagcaggttttaatcggcttttgtattggattagggttcatcaaatcaaccaccaatgtatattgacaagtaaaccaaaattctttagtcgaaaattgttaaaacgactaaactttggtgccagcagctaagctccatacacgcaagttcccacttttgtgtccactgaatagcaatccttgaggaccaattgtgagtgtgccaatcgtgtggtcccatccaaggaagacgatatcagacatttgtcccaacataagagtgatgttacagtgccagtatgttgcttcaaggtcattatacattgcagggtgttgagatcccacaccttgattgttttatcgacagagtatagcacttgacctccaacaacaaaagtacaaaacaagtgacttcaccactatgatgtccctcgagagatgtcaagtatttgaatggatcatcagactcagagtgtgtagtagctttccagactaagctactaccacaacttgttccagcaaaaagcattccgtttaatataaaaataccccatctttgaattgttgatacaccgatttaacatctctatattccaaagtaatgtatatattgttcacaatggaaaatggagattaaaggaacaacaaaaattgtgaaccaaaaaaaaaagaaatgccaaaagatagaatcagatcaattactcaaagataagaatggtttaaaagcaaaaaagaaatttagttaaggccatgaatggtgacatagaccgcacaaactgcttaaattgaagagacgactatgtgcgtaaaacgaagagactcaaaacaattttgggattcgtgagagatattgattcgctgca

SEQ ID NO: 13974 - DNA, 3000 bp, Unknown; identical to SEQ ID NO: 13972
  misc_feature (1)..( 3000): cDNA_ID_2710753_gDNA_ID_2214683_Annot_ID_136700 3000 nt of promoter + ATG

SEQ ID NO: 13975 - DNA, 3000 bp, Unknown
  misc_feature (1)..( 3000): cDNA_ID_3021115_gDNA_ID_2214684_Annot_ID_189315 3000 nt of promoter + ATG
gtccattttatcctacgggcgatggccgtggccttcgcttgaactccatgtcttggaacaaaggtttgtttttgacaattttatgcaaaaagcagagaactatgtgattctacgtttgtgatgctgttgtctcttattgcgtatgtgtagcttcgaacttgttatttgtggagtcaccagccggagtaggatggtcatactctaacagaagttcggattacaacactggggacaagtctactggtaaagtatatatcccattttttcagattatattagaacactgttgtatcttgacatgttttttgtatttgaacagtcaatgatatgcttgtgttcttgttgagatggttcaacaagttcccagagttgaagtctcgcgacctctttctcactggcgaaagctacgcaggtgtgtcttttattattctgattcttagtttatgaaatggctatgtgagtaacaatgttggtggttatgtgtttgatgatgttacttgtcagttttacttttatctaaccaatgtttgatttgattctctcgcagggcattacatacctcaactggctgatgtgatactcagctacaattcacgctcaagtgggttcaaatttaacgtcaaaggcattgcagtaagcaaaagaaccttcttcttaaagtttcatcaactcttttggctctcttctgatttttttttgtgtttttttttttgatacgagactatggttaggtagattatgatttgggttttcataatttcctttaaacgttaaagtgttttattttatgcattagcgttatgtctaagttgtatgatgaatacctatataagggttctcaattgattaataaaaaaactaagctccaacaattaacctaattctctaagagagacttgggtgaaaaggaagcttttgctttaaaacttttgggccataatattttttgtgtgtttctgatcagattgggaatccacttctgaagcttgacagggactttgcagctgcatacgagtacttctggtcacatgggatgatctctgatgaagtaagactcacaatcatgaaccaatgtgactttgccaatccaaagaacatgagcaatgcttgtatatatgcaatcgttgaatccagcgtcctcactgagtatatcaacagctatcacattctcctcgatgtatgttacccttctattgttcagcaagagctaaggctcaagaaaatggttagcacttatccacctttttctttccaacagaaaaacatttgtgtaaatttgtgaaaatggttttaggttaccaagattagcatggtagttgatgtttgtataacatatgaaagaagtttctatttcaatctccccaaggtacagaatgcgcttcacgctaaccgcactcgcctaccttatgaatggactatgtgcagcaagtaagttgtttgacccacttttcattttgttgatcaccaaaaaatgaagctgactgattgatattggcttttcacttttcactatgtcacagccggttaaactacagtggcatagacgggtacattgacatgcttccgagtcttaagagaattattcagaaccaaactcctgtttggatcttcaggtaagatttctattaaagatcttcttttcttgtactatgcagcttaactctcagcttgttaaaattgtagtggagatcaagattctgtaattccacttcaaagttcaagaacactcgtacgagaacttgctgaggatctcaacttcaagaccactattccctatggagcttggttccacaaagaacaggtagtttccctacaccatcaaaacaattctaactaagttaattgtgattgctaacttgtggatgttgggattgtaactaaggttggtggctgggtcacagagtatgggaatctactgacctttgcaacggtgagaggagcggctcatatggtgccgtatgcggagccctcacgagctctgcacatgttcagtagctttatgaatggccggagattgcccaacaaaccagatttaaagtcttctactgatgattgaaagagaagatatctctttgagtaagttgagatagaaacatattagggtttgtgtaataatgaaccgtgaaccccacggaactatttttatatactgccaaacattgcgatgagaatatagtatttctcatagattattagagtgtgattgtatcaatattatttgttacttatatgatttcgataaatgatgaatcttatcattttcgtttggacgtttcatacgcttattacatattagacatagctatctctagattatatgatgatttatgatattggtttcatttcatagttgactacaaggggatcctttccgggattttggccttagacaatataatgaaataaattgcaagatttttttggccttttttttttggaagaattggatagttctgtaacgaaggaatgcatttaatataatttaaataatttttcagtttatcctaattttaaatattaactaaatatagttcttggaattatatatcaactaaatatgatatacttaggaggttatttacatcttatccttaaaattaatttcaatttatagaacctttttttggtagggttcaatttatagaaccttaacattagtaaggactattttaaagttttttttactagattttggaaaaacaactttatgttttaacaatatgtaaaaaaatatatcacattagacaagtgtatcatatatacattcaaacgtaattatattaggtaagaaaatcaatctctttattttcttttgattatagaaatcaaggaaattaaatatcaagatttgtttctcttttacaaaaaataaatatctttaggtatgttggtgttatcatatatataaacatatgtagtacatgagaaaaacaaagcgaagatcagtctattacaaaactcaaaataaaaatagaagcaaaaaatcatagaaacaaaatg

SEQ ID NO: 13976 - DNA, 3000 bp, Unknown
  misc_feature (1)..( 3000): cDNA_ID_3021103_gDNA_ID_2214684_Annot_ID_189319 3000 nt of promoter + ATG
ttgctggctcagcagaagcagatacactacatcactgatgaagagcacttccaaatgcaagaaggggggaatgatcaaactgaagagctgtgctacattcagaaccaaggagggtttaacaagggctacaacaactacaagcccaacccaaacctctcctacagaagcactaatgttgctaacccccaagatcaagtgtatccacctcaacagaatcagtccaaaccttttgttcagtacaaccaaggttatgtccctaaacaacagttcaatggacgtttccaatagcagaatccaccaccaaggttcactcaacaaccacaacaagccctagcagctcaagatcctgaaattaagcaactcattcaacagatcatccaaggacaagctactagagccatggcttttgaaaagaagatagctgaattacacaacaagatcgattgttcttacaatgatctgaatatcaagtttgaagctctaaatttcaaaaatcaagtatgtggagagtcaatttgcctcaacctctgccccgaagcaccctcaacaacttccagggaaagcagtccagaatcctaaggactatgctactgctaatgctatcaccatccaccaagaagatgagtctccaccaagtcatcagactcccaatactgaggacaatatgattcaagaagggggggggggggttcaactcaaattgatgcacctgccactcagcaattcatctggactatagagcacacacctttgctgaatactcaccattctagaaaagagttcaaaagtgaaaaattcaagaaggatcagaatcaagagatgatcagcagtgcctctactcaagaaacatacaagaagaaagtcatccaagaaaagcttgatgatcccggttcattcactctaccatgctctctaggaccattgacattcaataggtgcctttgtgatttgggagcatctcttagccttatgcctctctctacagctaaaaggctaaggatcatggaattcaagttctgaaacttagccttactcttagctgatggttctgttgcacatcctcatggtctagtagagaatctgcctgtcaagattggaaatgttgagatacctacagactttggggtattggacgtagatgaagaaggcaaggatcccctgatcctaggcagaccattcttagcttcagctggagcagtcatagacgtcaggaatggaaaaattaatctgaaccttgaaaaaggcatcaagatgaagtttgacatcagagaagcttcaaagaaatcaacaacaggaggtcagagttttggaattcaagatatggatgttgatgaagaaacagaagctgaaacctcaccaaaagtcaactatacttctcaactcagcaagctgaagagaacttttgaccacaagaagagagaaacagaaaggctatctcagactgaagatcctgaagaagatgactggtatgagatgagaaaaaaatttaaatggcaaagcagagtcatagacggattgtcttcaagggtgatgaagctgaaagatcaactttggatatttgaaaaaagagttaaaaagttttcagatggtattgacccagagaagatggaaactgcactagctatcaagaaggacgaaaatttcacaacagaatggtttgcaccagaagatcagaaaggagttcacttagaggaaagaagcttagggagcaagttgttgagtgaggaggaaactcctattttgacttattctctaggagtgcctaaacagcccaccaacccctctgctgaagaggaacacttgacacttgattctgttactgaagaacttgtggaactcaggatagaatacaaagctcaagaggataccattggagagctaacttacaaaatggaaggactgaaccatgcaatcttggaacttcaaaaaatggttacaggctacaccagttttgaatttgaggattggtcaaaagaacttggttcagaagaagaagactactctgctgctcagaaaaatcttattttgaagaaaaatcaaatgagtactcatcctaccatatctcaagagaggatgtagagtatgactcaagcactgaaaattcatccactgaagataaggacttctctgttcctctcttcaacctttttcttactaagcactgtaagagtcaagcttaatgacttaaaacaagctcacttgggaggaagtcccatgtctatccatgtaaataactttctatttttcttgttatttttgatgtttttgtttaagtgttttaggtttgttttagtgaccctaagagagtcaacggtcgagtaaattcaaaccaagtcaagaaaaatctcaaccgttgatcgagtagaatgaggaggagtattttgagccattgatttggatgaccaaatgagaggagcattaccgtcgttggatcgagtgactttcagaagttaattttggtccgtttgatcgagtaaacaagaaagaaaagttccccgtcgttggatcaaatttttcgcacttcaagaggatgctcgatcctttgctcgagctctcattatttgaagaccatggcataacttcgtgaccccacttgttcccccaacactcttttactcaatggacaaagcgattacccatgcccctcaccatttataatcaacttttctatcccttcccaaagaaaccaaacaccaatctcctccacccattgaattcgacaaacccacttttgaaactctctctttcatcatctcattttcgcaacctctccatctctcacaaagcttcgaagtttcactccaaactctccctatcactcttcacgaattcgttctcacttcatcatacttcaccaaagttactcgatcacttccaagctcatcctcaagcactcaatcggtttcaagctccaaatttcatcaccaaataaactgatccccttaccccttgatacctcttggagagttgtttttaattgcttggttgaaactcaccacc

SEQ ID NO: 13977 - DNA, 3000 bp, Unknown
  misc_feature (1)..( 3000): cDNA_ID_3021093_gDNA_ID_2214684_Annot_ID_189322 3000 nt of promoter + ATG
gaaagcttccaagcaaaaggtcggcactccgatgacgaatcgtagctgctctcaccgcagctccagcagattccgcaatcgtccttccagcagtggacgattgaacccttggcttatcgaaccatccatgtttccgttccggtcgtttactacgaccgcccacggtttactaaccgtttatccgtccggtctatggtggtcgataaagctttcggcttatcgatccatccatacgatccgaactatatccttatcacacccaagggtccgtggattcatccatcggatcatcgtaggctagcccatgaaatccttcttccgtcggccttaggtttgctcacgggtccaacatccgttttgtccatcggtttttaccgtggactttcccgttggttatccgtcgagtcaccctttggtcttaccgatctctgatcagtttcaccatagctgaggagatagatacatgaaggcggccgcgatattgatcctatatggtgaatcacgtttccttacccattcttgaagctttctccctttactggtaagattgcatccatgggcgacccttgggtgtgtttggatgcacttatctttgtgcttcctcgaacacttttctcgatctatcccatccgacgatcgttctgtccgacccgttctgttagacgatcggactgtcccatccgacccgtccgacgatcggtctatccgatccgatccgtctggctgatccgatccgtccgatgatcggtctggccgatccgatccgacgatcggtctaccatatccgattcgtctctaagacgaacggtctaccctctccatcctatacactccatcgaaccgttggaccgggaggtagtatgcgcatcacttcggtcaagttatactcgccgagccgcaccccctttccgaccaacaacttcaggatgtgttggaattgttttgagaatgttttgtggtgtgtggatgttgtgagatgatcccaaaggccttgggcgtcctcccttatatagggggcgaatggatgcttcccgaagcatcacatccgttccttgcacccttccgaaaggtcacatccgttccttgcatccttccaaaatgtcacatccgttccttgcatctattgggtgatgcaaccgttcgttggtacccgctcgaccttacaccttttggccgagacatcgtttcacgggtgagctaccacagtccaccagctcgagtgtcagctgaccggaccacccagctgggtcagtacacgatcagctcaccgagctcagtcgagttgtcggtcagctcacctagctgagctagctagtcttccagctggtttagctcacctagcttagctagctagttcatgctagcttgtccagctcacctagctggttcagcttgaactttctcattcttccgactaagtattttagtccgctgctcgacccttgtctagttttcccctaaaacaaatcggcctctttatgaacgcgggacgcggttgttacaagtctaccccccttaaactgaattcttcctcgaatttggtgtgtgtaagatcttggttactccctaactcgggacacgggcgttacaagtctaccctcccttaaactgaattcgtcctcgaattcagcgggtgtaagagcttgtttactcctgaacgcttttctatctttggtctctccgagactttagatatcatatttgatcaaatctctatttccgagtttgatcaagtttcccgatctttgtctcttaagacactcgatcaaattcctgatcctggtcctctcccggactcgatcattatttcccgatctttgtcttgtcccggacttgatcaatgttttccaatctttgtctcttccgacattcgatcaaatttctgatcctggtcctttcccggactcgatcattatttcccgatctttgtcctttcctggacttgatcaatgttttccgatctttgtctcttccgatattcgatcaaatttctgatcttggtccttttccggactcgaccatattctcgacttaagtcttttccgactttgtcaatatttccgaccttggtccccatcggactcggtcaatattcccgacacaggtatctttttgaccttgtagtttttttccatgatcttggtcaatttccgtaagatcaaaaccccagaaatagtcaaatcccgactaagtctgtacccaatcttagtcaagttccgacaagatccaaattccattgatatcggtccatctccgaatatatcaacccactttcccgtcatgttgaagttttgactacaaggataatatcttggttcccgatcgtgagttgggtaactatttccgttttcgtacacaacaatccctcaacttccttatccgccaaaaccttactatgacgttttcctgagcacctatccatcctaggatcaagcatgctctgataccaacttgtgagacccagtcccggacgtctcggcgtccggcgaccgtgtactcaagttcgagcctcttcccggccgaacctcttagtttttcgcgattcaacatagaattgcctttacgaggctaaattctataatcatttcttattacacagtggaagtctttctaaccttggtttaattctaaccaactcttgtaccggttttatcgtctttgtcccttagacatagatcgatcctttactcggtcaagacatgcatattgttcgctaaccattctaggcctaacaatcgcatgttcctttatcctattttcacggtccattcccaaacgtctatcctaattagtaagctagatcgttacatacctcggccaatatgcggatttgattccttagcccgtttgtcgccttatcctatttgttcaacgattcgtatgcgatcgtgaatcgatgaaccaatccctatcgttacttagccatacaaccaaccaaccccactggtctaagtacaacaatagagattggggatcgtacgatttccttggttcatgatg

SEQ ID NO: 13978 - DNA, 1285 bp, Unknown
  misc_feature (1)..( 1285): cDNA_ID_3021170_gDNA_ID_2214685_Annot_ID_189327 3000 nt of promoter + ATG
gaattcttttattcacctcctttttctctaaccaatcagaatcttccaccaaataaaaaatatataaactcatttaactgtaaaattaacaataatgattttattatattttcttattttttattttaaataaatacaaatataaactttaaattccataaaaatttaaaaatatttcttttttttaaatgaatcatcatatcaaaaatatattcctcaacatgtccgtcaacatctacttaacaattttaaagtacatatttgctcatttgtatggatatgtttttttttatttactatatcttaactttttatttttggataagaaaatcaaatatgatgtttaatgctaatataaaacatttgagctaatttcctaaaacttctctacaaacataaatatatgattctcatttcacttttatttgatcttatatttatattattttgaattataataaaatatttattgttaataaaattttagattgtttctggatatattgtgattcaaaagtttttaaacagatatatattactcaatcaatgaaatatattttttatgtataatctaaaatataacaaaattaaatcattaaaaaaaatttaatcgattaagaaacatttgctcatttattgtgggtcgggttataataaaatgatgcaaaaacaaagcaaaaatgtttttacaaaaccaaataatatggaaaaccatataaaagataaaataataatggacaaaaatattgaaaactaaccaataagaagccatacacaatcaatcataattttataataaataacaacaaaaagtattatatacaacaattaatcggttttttaaaaagaagaaattattaatcctgcagtgtatattgaattatatatttttaaaataaaagtattattaaaaagaaaaataagaatatgatgtttatttttaagggacgggattatatggtaagacgggtttggatcgaggttaatacatgacaatatatcacagataaaatcttaaaattaacaatcaaaacacaattatacaatcttaaatacgatttagttataaaaaatctaccaggagtgtaatcaaattcaaacataagtttctaccaataaaacataaaaaataaataatacaccaatgtcataagtttataacaaaaaagtatatatatttatttcacggtgtatttcatacttattaattactgtcccaactattaccaacaacaaaaatacatttgtaacatcttgttttatagataaaataatttattaaatg

SEQ ID NO: 13979 - DNA, 3000 bp, Unknown
  misc_feature (1)..( 3000): cDNA_ID_2710768_gDNA_ID_2214686_Annot_ID_136708 3000 nt of promoter + ATG
catcaaaaatccattaaaaatgttttggtttttgtaatttacaattttcaataattctaaaccaatcatattcaattgttctttttgaaaactacaatttatcaataattaagagtgcattgaaaacttaaaaattgtatcgttttgaaacaaatttttttctagaaattggattaataaggaacagaacaaagataacaatcaaacaaagaaaaatagcaaagatacgtttttaatcgtccgatacgtttttaagtctgttcgtttaatgtttaattgtaatttgttcttgcccatttgggctttaatgaaattaaagtttgttgggacaaaaaaacttttttcggaaacagacatcattcttgaatttcgccccaatactgctctttctcttttccaagcagaaaaagggaattcgctgctcttctctcctctggttctaagcgacgctcatcattcacctgtatcaaacataaacaaggtatgtctcttaattctcccatatcatctcatctcatatctttgtgttcatttgcttgctgttttgtgcttatgtagttgtttcagatgttctgatgctatgatgttaatcgtattctcattttcatgatttagctgaaaaatgagaagttcatttgatttgctttctgttctgtgcttatgcagattattgattaaccaattaagcgacgctcatcattcacctatatctgacataaacaaggtatgtctcttaattctcccatctcatctcatatctttgtgttcatttgcttgatgttctgtgcttatacagttgtttcagatgttctgatgctatgatgtgaatcgtattctcattttcatgattcaggagaatggagtcagagggaaacatgaagaacttggttgtgtcacaagtaaccataagtgggtttggggagtcaactaaaacaaaagaacttacagattatcttgaaaacaaagtaggactactcgtttggcgatgcagattaaaaacttcttggactcctcatgggtcttatcctaattttgagatcatagacacttcaaacatccccaaatttgattgttacgagagagtggtgcctcatgcatttgtccattgcgatgcccataaatctttaatggatgctgcagagcaatccaaactcatcctcggtggccagccattaaaattcagcttgtcgtctgagaacccatatacacttaacccatataagttgactggtgtttcgcttgagattgggacggtttcgcaggatgacttttttttgtttctcatataagttggagttattggtgagagacatacaaacagtcaagcagtatagaacttttgttggttttgtgcttgttttgcagcttgcctcatcaccccgtgtctggtacagaacagctgatgatgatatctacgaaacttcggctgtcgatctcttggatgataatgacccttggatccgcaccactgattttacacaatctggggcaattcgtcgatgccttgggtatcgagtgttcatatctcctcgggatcacaataaatggacaaaagtcttagattatctaaagacacaaagggtgaacacggagcatgtgaggtggcggacctacgttcaaagtagaggtgcaacttaccccggttaaatttaaaaacctttctttaatagatcatttgcctaagggggtgaactttttttccgggattacatgtgtctatgatgtttttgggtgaacacatgtgtggttttaggtatgtttttttacatgttctaacatgttctcgggcaggttgatggttctttttggtatgtttttgaggaaacacttatgacttttcaacttcaagtgttttccacagaaagatgtgatggacttttggtattgaatataaagatagctatcatgaatgagaaatcctttgttgataaggctctttgtattttttttttggttatgcttctagaaaaaatgtctttcttacatatcttacatagcttcttagtcaaacatagaaaagaacaaatatatatacatgccaaagttttgttagtgatcaagtctttatacgctttacaaacctttataagtttttataaggctttctaacctttatgactttgtaaagttttataaggccgacgttgttggcatcattctctaatctgagagatgctcgacaattttaccttgtgttcggtttttcctattttaaaaatcttatggtctgtttgctcatgttaaggttttatatatagagttgtgacaaatgtaagttttaataacttaattataccagccttcttatattttttttattacaagccaggatcatccagttataacgtaaagctggtaccgttcacaacttcttttatcagatgtgtctgccattgtaattattggatttgtgaaggacgcaaaacatcatgttgatgttcaaggctttaatgtctaccacaaaaatcggctctccatactaggcttttgattttcaagagaaatagtggattacacgaaatccttgttctaatttattaacaagccttgggttacacgaaatcccttctaggatacgacaatcaaagtactctctcttgttctaggcaaagatacaagacaaacaaatagactttctagtgtttgtttttgtgtttcaccaaagaatatctcaatcctttggtcttgtgaatctctgttttttctctctgtttttttctcttctatgcctttttgatgcaaagagacagagttatataatggccaacgatctccacgtacgtttgcaaccgtacgtttagtcataactgtaattccaacagttgccttggtttataagtaaccattgacgaacagttttctcggttaatatgataaccattggttcacttaaatcaccgaaattgggattgatctctcttcgggatcgtatcactctgttttcttttctcttccaattctattttatttttctttatcacatcaaaccaaaaggacatg

SEQ ID NO: 13980 - DNA, 3000 bp, Unknown
  misc_feature (1)..( 3000): cDNA_ID_2710761_gDNA_ID_2214686_Annot_ID_136711 3000 nt of promoter + ATG
aggaggagggggaagttactgccgccacggctgctgctacaaaggttaccatggctgctcaaggtgttgttcatatgccggagaagcggttcagactcagtctggtcactaaatctacataatatatcaaccaccatgagtgtacgatttcatttatatatacacttacgtgtgtatgtgatatgacaatacacttacgtttgtaatgaagtgccttaagtttaagaggagaaactatcggaataaagtttcataatgtaatgcctttgtgtttatttaagttgttatttgcgatgtttgcataataaagttgtttctagttgaagttattctcttttggttttatgtgaccctattaattcttttttagtactggcctaaggaaagataaaagatgtacaaaaaagaagaagatttaaacaggctgggcaaggaaaatgctttttcttaaaagaaaagattactagatagttagagactctatcgaattttgacatgcacaatagttacaaagttcactaaatataaagtacgtagtattataaagaatctcttacaagatctatagcgctcaaagctagaagtgtcaattgggttgtccaaagcccaatggtcatgtccaattggaccattagttttaatgggttttaatggatggtccttattggacaatggtctgaaaatttgtccaagaccattaaggaccatgtccaatggtcagcccatggtcagcccataacttaatgttgcttgaatacaatgcattttcataagaaaagataagaacttagcttcctcttacaaatatgattagatggtacttaaaactgtaaaaaataagtcataaagtgacaaacttgaggagatacatagaaaataagttcatcaaaagagttaagcttagatttgggaattaaaaaatgtctgaatattatttgctaatcaacagattcatattctagtagaactaaccggagtaggagttgagagagaggtcgaagcgagaaagagagagagggagcttcgtcgccgagggagagagaagagaagagaagaaaattgatgtgttgagaaacttgatgggccaaccatagaccgtgtgggctagcccattaaacccgtggacataattggtctttagaccatttaacccgttttctttacgggccgaccatggactgtccataatgttgtggactgggcttagcccatggtcagatgaccatttgacggttctactcaaaggtatagaaactcattgtgtagggttttgcttttagatattctttggaggtttagagagtttcaccgccttttgtctcttggcatttaatgcctcccaacaacaactacgtacaagtctcaagtactggtcctattatattgttgttaataaaacatactttcttttacatgctgaaagaacattatcttcgcaccaaacctcgaaagatatttcacctaatgcgatgcattttataattctcagggacaaaagtactatgtatagtatattagtatgtctctctaaaaacgaaggacatttggggttaaaaggcttttcactattacgaaataaaacattgtatctccagttatagtcttagatcatctccaatgttcacctctatttatttttttctttattttagagacaactctattttttaataaaatatagttgattttgttctaatatatacccctctaaaatagatattgaatatattatcaaggatgtcagcaaaatgtcatattggtttatttttattcgtagatgtgatataccttgatttttactgattatatctatgatctagatatatgtttttagagtcttttttttgttttaacgtcttttaaaaataattgagaaatcaaatattcttccctaagttgtttattagtttagacttaaaatcaattttattaaccctacgggatatgactatatgagtcaccgaagcgttttgcatttctctagagctttctctagtcttcctaatccaaacttggaagcctttaaagttgtagcttaactttttcagttcattcctgtctctttctttccacctcactcagagaggtaaatacttaaaacttaacaaaatatttttaatcgttctacttttttattttcttgactgtgttcagtttctcaaacatggtaacctacaataaataaagctgttaacaataatgttctatattggaattttgtttttttgctcgtctctcgagattgttctttgagttttcgattgacaaatcttgtgtgtagattgggatcaatggtgacaaaaggtttatattgaaccatatagtcgttgtgttccatttttaggttaaataaatggttttaaattgttactgactagggtcttttgacgaaaataaaaaaataaaaaaaaaatgactagggtcacttttgacaaaattgtttcgggaaaatcaaatgttattccctaaaaagtcaagtgttattaaccctatgagatatgaggagccgaaacgttttgcattcccctagtcctcctaatccaaacttggatgcctaaaggggagtttgttgggataagcatgaagtcaataaattagggaataaaagttatgttttaaaataggattaagataaatctttaggagtaatctaaagatatgttaggagttatctacatcttattctattgtgtttgttatcatccctctcctatataagagttgccaaagttgtggtaaaccttaagagatttgagagagagattgaaagctttgttttgagttattttcaaagctaataaaaggagtgcttttatatttgatctaagtattcaaatctttatttggtatcagagcataacctaggtttcaatttttctttttcgaatatgagtgaaattgttgctgcaagcaacaaacctaaagaagggggggggggggtcatcatccattcattgtcccatgctgaacaacgctaattacacggtgtggactatgagg

SEQ ID NO: 13981 - DNA, 3000 bp, Unknown
  misc_feature (1)..( 3000): cDNA_ID_2705769_gDNA_ID_2214686_Annot_ID_136712 3000 nt of promoter + ATG
tgtggggagaagcagtaaggcactcaacctatatcatcaacagagtaggaacaagatctttgcagaaccaaacaccatatgaagtttttaagcaaagaaagccgaatgtagaacacttacgtgtatttggatgtattggttatgccaagattgaaggtccacatttgagaaagcttgatgataggtcaaagatgcttgtttatcttggaactgaaccaggctccaaagcatatcgtcttcttgatccaactaaccgcaaaattatcgtaagcagagatgtgtactttgatgaaaacatgagctagaagtggaacaattcagattctgaaactcgggacatctctggaacattctcacttaccttaggagaatttggaaacaatggaattcaagaaagtgatgatatagaaacagaaaaaaacggagaagaaagtgagaacagtcacgaagaagaaggagaaaacgaacacaatgaacaagaacagattgatgctgaagaaacacaaccctcacatgctactcctctgccaacattaagaagatcaacaagacaagttggaaaaccaaattatttggacgattatgtcttaatggcagagatcgaaggcgaacaagttctattggcaattaatgatgaaccatgggattttaaagaagcaaacaagttgaaagaatggagagatgcttgcaaagaagagatcctgtcaatagagaagaacaaaacttggagcttaattgatcttccagttagaagaaaagtcatagggttaaaatgggtttttaagatcaagcgaaattcagatggcagcataaacaagtacaaggcaaggttagtagcaaagggttatgttcagaggcatggtattgactacgatgaagtatttgctcatgtagctcgtattgaaacaattcgagtcatcattgccttagcagcatcaaacggatgggaagtacatcacttagacgtcaagaccgcttttctccatggggaactaagagaagatgtttatgttacacaacctgagggcttcacaaataaagacaatgaagggaaagtctacaaattacacaaggctctttatggtttaaaacaagcacctcgtgcttggaacactaagctgaacaaaattcttcaagaactgaattttgtaaagtgttctaaagaaccatcagtgtacagaagacaagaagaaaagaagcttctcattgtggctatttatgttgatgatttacttgtgacaggctctagcttggatctaatactctgtttcaagaaagatatggctggaaaattcgaaatgagtgatctgggacagctcacgtactaccttggcattgaagttctccatagaaagaatggcatcatattaagacaagagaggtatgcaatgaaaattatagaagaagctggaatgagtaactgcaacccggtcttaataccaatggcagcaggattagagctctgcaaagcacaagaagagaagtgcatcaccgaaagagactacagaagaatgattggatgtctgagatacatagtgcatactcggccggatctctcttattgcgttggtgtactaagcaggtatctacaacaaccgagggaatcacatggaaacgcactgaagcaagttctaaggtatctcaaaggaactatgtctcatggtctgtacctcaagagaggattcaagagcggattagtaggctatagtgatagtagtcatagtgcggatttggatgatggaaaaagcactgccggtcatatcttctatcttcatcaatgtcccattacatggtgttcacaaaaacaacaagtagtggctctttcatcttgtgaagcggagttcatggcagctactgaagcagccaagcaagccatatggttacaagacctattcgcagaagtgtgtgggacaacaagtgagaaggtgatgattcgagtggataacaagtcggcgattgctcttactaagaatcttgtctttcatggtaggagtaaacatattcatcgaaggtatcatttcataagagaatgtgttgagaataacttagtcgaagtggatcatgttcccggagttgagcaaagagctgacattctaaccaagccacttggaaggattaagttcagagagatgagagaactagtaggagttcagtgtgtgttggaagatgacttcaagcttaaaggggagtttgttgggataagcatgaagtcaataaattagggaataaaagttatgttttaaaataggattaagataaatctttaggagtaatctaaagatatgttaggagttatctacatcttattctattgtgtttgttatcatccctctcctatataagagttgccaaagttgtggtaaaccttaagagatttgagagagagattgaaagctttgttttgagttattttcaaagctaataaaaggagtgcttttatatttgatctaagtattcaaatctttaaagttgtggctaaacttcagtttgtgtttgcttttgtttatcaagattgttcttagactttttcgagttaaaaaacttgtgtgttggagtcatcatcgtgatcaatggaaaataaagttgagaaggagattacttgggtgattaaaaatttctcttctctgcaatctgcaacaatatattctgatatattcgttgttggtggctgcagatggtaagaagataaattgttttctaatatttttcgtctaatctacggtttacagataatattctttgattgctttcttttgtttttgcttgcaggcgttgtcaggccttccccaagggatataataaggctgattatctttctctgtatctcgacgttcctgataaagaatctttacctattggatgaagaagccacacaaaattttcttttactttagtaaataaaatttcggaaaaactctccaaacttaaaggttattggtctctatgcttgctaagagtatacctcatgtcatattttctggttttgttcagagataaaat

SEQ ID NO: 13982 - DNA, 3000 bp, Unknown; identical to SEQ ID NO: 13980
  misc_feature (1)..( 3000): cDNA_ID_2710761_gDNA_ID_2214686_Annot_ID_189344 3000 nt of promoter + ATG

SEQ ID NO: 13983 - DNA, 3000 bp, Unknown
  misc_feature (1)..( 3000): cDNA_ID_1442104_gDNA_ID_2214686_Annot_ID_189343 3000 nt of promoter + ATG
caagtctattgcctaagttactaatgctgcagagtcaattcctagactaatgtgatatccggatggcaaaccgatatagactagaggacatccacgtttccaacataatccattaaggctggagctaatttttctgcttttccttttacctcttcagtaaggttagtatttgtagaggttgactccttgttcatacctgataatgaggccatagtgaaaaagataatggtatttttcttccttataaaaactgaatgaaatgattttctttagagtaaaagggtgagaataatgtccgatgaaccaagtattttacttaagaaggaatgattatacaaaggttggaagaatgctgaggatatctttccaatgatgagagtactactttgtctaaatccgtaaaaagaataattgttggggagaaaaagaataccaaaactatgaaaatggtcgacttaacatggttttgtatgggaatgagtctaaaaagttcttgaatattaactttattgatgagtcctagcaatgaaagcctattagatatagttgtagaatttggtttaaaatttaggatgatgtgaatgcatgcgaataattacatggtagttatgatttaattagaactgttaagcatatgaatttggtttgaatgatcaaggtaatcggctagagaaattgggagttcctgcgtttttgaacttcttccacgaattcgatttttgtgttttggccaaggaaaagctaagtctgaagagttgatatacagtacctcaattttcactgctgtcagctacgatctaggtataggtattagagtctttttgttatttctagagtctttttagagtcttttcagctatttctatgaccgggattggattgaaactaataaagcattttggagaaaaacggaaggagttaagctaaaagacgaatttggagtctgacaaaggcatcataccgacacttccatggtgttgatcgacacggtttgtggcgcaacaagagtctaacggtttaaagatttgaagatcccagaatttacacctaaagatttttctatttacagaattagtccctgcacgtttttgagaacatataatatattttaaaaggtcattgtttagaccaaagctttatttttaggtcttctacttttgccctacaattcaaggagatttttggagagttcttgagagatttcaaaaccttgtagagaaaagatcttttcctaaactctattcttcttttgatttcttatatgcaatcttatacaaacatgttttatgtttcgatgatcatgtttgagtaatcccctagctgggtttagtgtttttcattagggatttagatgaattagtatatcgataacctgttaagatttatatttatagttctttatctttgattgtttttaatgctagttctagagtacctaactagaacttgatcctaagttaataggtaagattcgagaggcatcttattgccggaactagatgggcttaattagctaaatgaggataggtctgatttagatacttagctgaacttatcaaaccggattataatgtttgcttagttctagggatctacatataaagtggggtcaatacaattaagcatacttagtccatgcaacaagagttgattgattatagaattgaggtttgtagttctagaatagtgcaataacaatcctaattaactgctagaactattatttgtctatttcctgagaatttctgaaatccgacgttttaaacatctgaatcttacatcaatttaatatgcttttgtcttttgatatacaattacttttttttttatataattacttgatttagtttcatttctagattttaactttacgtgtgaacaaaaaagatttgtgagattcgacccttaaatactaatgacgatctcttatttgagagagtggtcttaaggtactttgatcacaaccaccttgtgttaactgtagccaagcaattttccaagttcttaaaaatttaattagtccttagtagctactttgtatagctcctctatgatctactttcagtgcatatagttttgtctttatccagctgtttaaaatctatcgcttgcgatttttgacaaaatctttaaaagataataaacagacgatttttttttgtcaactgaattatattagagaaacttgttgaggaagtatggtgaaatacaaactctcaaacgagggaaaaaccgacggatgacgaaaatgtccgcagaaacaaagccaacgaaaaaagaaatttcttcgaaaactaaagtcctaaagaaatgaactaaaaatataactagaaatacaaagcaagaaatatcaaaccaaaatcgaaagaggacaatcattcaagagaaacaaatagtcttgaaacctaagaaacatcttctaaaaaaaaaaaaaaaaaaaaaaaaaaaaaaatgaaacatcttctcctgaatctcctgcaaaagagatttatcaatggtgcacttagccaacccaaagataccatctactatctcccattatgaagacaattgacctctctaaacctagaaaaggatagactacgtccaaataataaagaagagaaaattactacaattaaagaatatataattacttgatcatccaataatagatcgctatacgtgtgtgatgacgtagataagaaaagatctaaaacacttgtggggtttgtgctatttatggtgtttcaaacttattcacagtaaatccaacgaccacccatacgggacccgacaccgtatacatactttgatacttatctccttaccactttgtttttttctatattgtgatacattacttcccttttaacattttcttttattactaaaattctttcgactgtggattagtttatttgacttttctcattccctcgtcctcattttcattataaatagagagcatgcatggggacatattattcatcacaagttttaagcagtatttgtaagaaa

SEQ ID NO: 13984 - DNA, 3000 bp, Unknown
  misc_feature (1)..( 3000): cDNA_ID_2710776_gDNA_ID_2214687_Annot_ID_136715 3000 nt of promoter + ATG
tataaccagagatttgtttttctatgttcttaaattaaacaaacaataataaaatgattgaaaaaatcactgtcattttttcttcttttgaccctaaattaaacaaaacaacaataataaaaagtttgttttcggctttttctaaccgattttaatttgtttttttggtagaaattttctgatttttttgtttttgcaattattatattttctctgatatgacttgtattttagcatttgatgctattgagatcgtgggagtttgcagaagtagcggttatggtttaagtgctatcaaaccttttgaaaaattggttttgaatttgaaaataaatatgtttgtgggagttttatgactgataaaccagtggatatgaaagcggttaaataaaacaacgattaaaataaatattcaaagagttacacgtgctaatgaatgaaataaagatgacgatattgacgtttgcttcttgatttttattagtttgggtgtaagacataattaaaagaatataattactaatattgattaggatttttaaaaacatgcatacaatgatgatgaaagatattatatgtatatatacgattagataaatattgttttaattataaataatgttaattttaaaaatattttaatttaactactgtttgtaaccgcaaacgtttacagaaaaaaagagttcttgaaatatagcgattttgaatgatccagagcagtttccaccagtttgtatgatagttatcaataattaacaaccgatagcacctaaacacgctgcatttggagtggtaaaaagaaccaatcaaccccttaaatccctaaaatcacacaatacgtaggttatcttttagtaaaaaataattgtcaaatttccctttggctgcgatttgagaaagatagcgatttgtttggtttggtccacacgtgacgtgtgtgatattggtataaaaagttgtttttggagttctcttctttttgtgtttgtactaaccgtaaaattggttgcttatcaaagcacctaactattttttttctttatcactttctatctgtttaaattttgtgaacttccagctggtatgagcttatattagattaaagtataacaaaacaaaaaaatatataattaaatatatgagtcttggtttgaatggatctcaatcttatataacgaaagtatttgggtgaggatttttgaatattgataaagttgttgtatatcattttcacattagtgtgacattaggatttttgactggttatgaacgatggcggtcaagaatggttatgacattagtgtgatatctttgcgagaatacaccaacttttagttcatcactgagatctcatacatgactggtagaaataacaaaaatgccgtaaccattttttttgaagttttgacattagtgtgatatctttacgagaatacacagactcggcgactccttatcttatattttctctctatctctctgttcaatcacttatcaatgataagttatcatcatcatcatccatcatcaaatccatttgtcctaagatgatattttctcttctttgaccatcttttggcttgtgatttgctgatttcctgaatccacggtggattcttgatttggggttttactaaaccgtttatccgatttcagatcattctcacccttcgatatgtgtgacttcacacacaatattcatatgaactccagttacggtgatataatacaaggcatgactttagtctttagatagcttgcaatgatatatattaacgtactagatgatgctttgtggtatggacgtaattagaattattttagaaaaaaacaaagatattaaatatattatattatatttattttattgataacatatctaatatagtaaaatatgatgaattttgtttgtttagtagtttttgacatctttggattgacaatgtcccattcataaccaatttctactattatggaagataacacgatttagtaaattcaaattttggtggaaaagacagttaaatggacttaaccgcttgactaaaaacatccatatttatttagtagctaaataacagatattttaaaatttgaatacatatattttgttcagacattatacattatgttagaattacaatttctaatgatatttttcaaaaagcttgtctaattaaaacaaaaccagtactttcgtttcttaataaagaacaataattaacttcttaattttggtaaccgattgactgaatcttctatatgtattgtgataaaatggagaatgagcctgacgacatgagctagtgataatgttgctgcggagcggatttccatactaatacaagttcaccttgtccaacaaagacttcatttcccattcgatcttcgatatttgttatattagaatagatctttcatacaaatgaaagaaagagagattgaacgtttcgtttcttatatacttcaagagtgaagcaaccaacttaacttaattatagaaacctttgttctgacattttacctcatccgttaaaataaataaatatgggcctgatcggaaaaagacccaatcctgaaatacacagactctattttatcttgctccgttagaccaaaatgttattagctactaccatttcattttcagttctagttatttttggctgaattttaatttcccggtcatttttcttctactttgcctccattttttctcagctcgatctttctctgtgaacaaacctaatctggtaagtttttgtagagtctcttcttcttcctattacttcttctacgttttctcttggatctatcaaagcaaaccctagaattcaacttcgtaatcacctctttcgtttctactttgagttcaattaggaggtttgattgctatttgagtctaatcaatcgcttatctacttcgcctgacctaataatctctgggatttctgttgattttgacaggtgcgagtaccttagcgaggtttcgctatg

SEQ ID NO: 13985 - DNA, 3000 bp, Unknown
  misc_feature (1)..( 3000): cDNA_ID_3409620_gDNA_ID_2214687_Annot_ID_136717 3000 nt of promoter + ATG
ccaacgaaaattgtacataacgaaatcaagccatacatagtatcctgagtaagctaaaatctgcttcaaaatgtgaaaatggatacatttttactaacaaaagtagtcaaaccaaaacgcattcaactgttttggtaccttattctataacgaacttacatctgcatttccaaagtaatttagctttatcaagtactcctttgagataaatgcaacaacttgtaacctcaaaaccaattatattgtaataacaaacaaatattgagagtaaaccaatgaaaacaacagtacgtagcttataatatgtaaccatagaaaagcatagtactagatcattgagaaaacaatcggactttgtagttcattgtcaacactaggaacacttgcaaatgagtaatcaatcctccatgctactaacagcaacaatccttctagtttattgtcaacaatacaaagaagaacgaagtaaaacagaaacaaacctcgcaagtttccgtcgccaagtgagaaaagcttgtttttcattagcatcaagtttctccacattcattttaggtgtccaatgaggtctacgaggaacttgaagactactagcatgtaaagcctcttctctcatcctttgctctttccattctttagctgttatgccactcgaactcgaacctgtatccctatttacataacataatcacaaaccaaaaaatgattcaatacaagcaaatctccaatttcacaagaatgattgaatcgagaagctcacatattgataggaacaggagttgcggaatcgtgatgaatcgcgaaaagacgttcagcttcttcggcttgttcgatgatggcatcgatgtcgctgacttcggtcacggattctagaaccttcttgtgttgatctttgtaggatttgcctttttccttggtttcctggatcatatggttatggtgcttcactaaggctcgacctagagatgttttctcgttcttccccattttcttctccggtgaaacctttgagttttccgattcagcagatatatatcgtgaggagacgattgagcacttttgtgttcttcttgtcgtgattttgattttgattttgatttcagcaaaactcggaaatgcagagagactctcgtgcgaaacaaataaaattagaaaagtagtattagcctattagatctttcaagcgaaatttactatctctactgcttccaatcgcatagatgtagatagttaagatatttcaagtgtttttagatacatttccttagatttataaaatattaaaaacttgttatataaaatatttcaaaatttttattagaaatatatgactttagacaatctaaaatcttttgtccaaaaaaaaaaaaaaaaaagacaatctaaaatcacgtaatagtaatgttttaaatttttatcatcttgtaattttgttttggacaaaaaatatgtatgaagagatgatagcaaaatgaattcggcactacaaaatttgttttgttttgatatatgttaaaagtttaaatgtattcacctgtgaaaaaaatatctttcaaatcgagagaatgattagttatcttaaccggtgttccaaagaaaaaaaaagattagtaatcttaacctttaaaaatggatattatgactatccatatcaaaaataatatatagttcaaagattaaaaaaagtatgaataactctagattatgatgttaaaaacgatgatatagtatatttggaacacataatgcctataaaaatacttatacgtgtctaaaatgattatttagttcaaaaacaacaccaaaaattgtgtaagagtacaattgaaaacgttaacgaaaatttaaatatactaaatataaacatcattgaaattatatattattgatataccttacatatatttgggaaagtttataaaatatgtaaaagaaaaaaagggtttataaccggattatatctaaccgaattatgttaaatatctaaccgaattatgttaaattttataatagcctaactagagactggaagcaatgatatcgagcttaaaggagtgctattgatttataaatttatatagaatttgaaaatctttattaattataaaattaaaatatatgaattttaaaataatatgtgtttatccatggatttgaatccttctattttctctttcaaatccatttaattttatttaaaacataatttggattctcaaatccaaaaacaaatgactaaacgaataacaaaggattttaactagtatttataaatcattgaatcaataacacatgatattaattaaaattttaaaatcaataattaaattacaaatgatttttgttcggattttcaattcattataaatctataaaccaataacccttcctaaacaaaaaggtaatgaaaatatatttttaaaaaaagcttattttacattcaaaatcttgttttaaaatctgtaagaaaaaaatgaaagcaacactatcaattgtttcctacaacactttttaatcgatattaaaaaaaaaaaaaagatagttagagcattttcattggaagtatctcaatgagatacccaacaaaaaaaaaatatgagaggaaggagaaaaaataggagagaaggagagttgagtttctcttccgagaaactttgagaaactattctcatccaatttggacaaatgtcatcatactattagttcaattattaaataataattaatatatttgttttagttaaaatattaatatatattttttttagaaacttttcttgtttttagatagagatggtcttagaagccttcattttcaaaggttgattaaaaataaaataaaaatttggaatatccacttgcgatcctttcttggaaaaaaaaaaaaaaatcatatgattgtgtctggccagacaagctagctatctcatttaatttcccaaaaagaaaatataaagcacgttcttcgtctcggattcagagaaactaatcttgaagatg

SEQ ID NO: 13986 - DNA, 3000 bp, Unknown
  misc_feature (1)..( 3000): cDNA_ID_3021211_gDNA_ID_2214687_Annot_ID_189352 3000 nt of promoter + ATG
ctatatacatcacaatcggggatggcggaaactcggaaggcttgcttaccgagtaagttttaccatattctgcaatcaataatagagtgactaacttgtaaccgactctgtaactaactctgttattgataatactcttcactttctttgaatatgtatgtgactggcttttgctatatctgtagcatgatgcagccacaaccaaaatactccgcgtttcgagaagctagctttgggcacgggttgctagagattaaaaacagaactcatgcttacttcagctggaatcggaaccaagatgggaacgccgtggcagcagattctgtgtggttgcttaatcggttttggcgagctcaaaagaagacatggcttgatgcattttaaagacaaattgaagaaggttttatttttgcagcaattctaaacgaataaatcagttagtgactgttttacgagggttgttattgagatttgattaaaacctcctctcatacagaaaaaagtttgttattaccataagtggttttgcacctatacaagttaatataccatttcactaatcttttcttttcatcatttctaattttcatcaccttgcaatcttttatcggttcaaattctgacacaaagagacatagttacattttaaacgaacagaaaacaaataaaaatgtataaagtatactacaatgttcttctattcacataccccacataaaacaattgaacttacatacaaaaaaataaaataaaaaacaaataaattactattaattctttcaaaaaacccaaaatactcataagaagaagaattcataggcttcctgatgacgtgtccttctgtgaagggcttctccaaaagccagccccatagaaacgatccaacatttcattttcaagcctgacgacgtcgtttaactcaccaccactcacatgacattcctcaaaaacaatctcagccgttagatcttcttcattcaatctagcgtgtacggtactttcgcttccttccgccgtcgctgacgcaagcaaaccatgtcgtttcctcgtaaaacgtcgtcgtttgcttcgcctccaagcttttttacaaaccgcggccggaactttatacacggctaaaaccattagattcaccaccgcgcatggacaacaacaccacacagccgcacactccgccgccgctcctcccgctacctctccaacttttcgtctctctttgcttaacgacgtcgtcgaaggaggagagtttctcatcgttgattcttccgatgaaactaacaacggggattttaaaatcacgtgacgagtcattgaaattaaaaaaaaatatcacgtgaccttggcaaaaaaaaaacacctctgggattaacgattagtgaaataacctttttctctcagatatctccgaggaaatagaatctagtgaaaattgacccatcgttgttgataaggtcattcatcattttgattctaggttatgttgctaatcaaatcataacgatgatgatcccaggaagagaaagattgagaagaactggtggatggtaaagtagaaataggggaggaggggatgaattggatgagttaaaaaatagctgtgtaaattttctaggattggttgtaattttcccgagaaaatgagagaaaattttggaaacgtttggtcagagagaataactgaatcagagaggttaaaaatggaaccgagaagatcggagaagatataaccagagatttgtttttctatgttcttaaattaaacaaacaataataaaatgattgaaaaaatcactgtcattttttcttcttttgaccctaaattaaacaaaacaacaataataaaaagtttgttttcggctttttctaaccgattttaatttgtttttttggtagaaattttctgatttttttgtttttgcaattattatattttctctgatatgacttgtattttagcatttgatgctattgagatcgtgggagtttgcagaagtagcggttatggtttaagtgctatcaaaccttttgaaaaattggttttgaatttgaaaataaatatgtttgtgggagttttatgactgataaaccagtggatatgaaagcggttaaataaaacaacgattaaaataaatattcaaagagttacacgtgctaatgaatgaaataaagatgacgatattgacgtttgcttcttgatttttattagtttgggtgtaagacataattaaaagaatataattactaatattgattaggatttttaaaaacatgcatacaatgatgatgaaagatattatatgtatatatacgattagataaatattgttttaattataaataatgttaattttaaaaatattttaatttaactactgtttgtaaccgcaaacgtttacagaaaaaaagagttcttgaaatatagcgattttgaatgatccagagcagtttccaccagtttgtatgatagttatcaataattaacaaccgatagcacctaaacacgctgcatttggagtggtaaaaagaaccaatcaaccccttaaatccctaaaatcacacaatacgtaggttatcttttagtaaaaaataattgtcaaatttccctttggctgcgatttgagaaagatagcgatttgtttggtttggtccacacgtgacgtgtgtgatattggtataaaaagttgtttttggagttctcttctttttgtgtttgtactaaccgtaaaattggttgcttatcaaagcacctaactattttttttctttatcactttctatctgtttaaattttgtgaacttccagctggtatgagcttatattagattaaagtataacaaaacaaaaaaatatataattaaatatatgagtcttggtttgaatggatctcaatcttatataacgaaagtatttgggtgaggatttttgaatattgataaagttgttgtatatcattttcacattagtgtgacattaggatttttgactggttatgaacgatg

SEQ ID NO: 13987 - DNA, 3000 bp, Unknown
  misc_feature (1)..( 3000): cDNA_ID_2705783_gDNA_ID_2214687_Annot_ID_189355 3000 nt of promoter + ATG
caatgtcaggaacgaagtcgatttcgtggttgccagcagtccatatccaaggttgataagcaacacttcgctcaacgaaccttccccaagtatcccatctattgttgtcgtggttagggtagcgatccgcgtaagacaagtctcctacaaacagaaccgcttgtccttttcccggattcatctcataatggcttaacgtactatttgagtcataagtttgtcctagatcccctggaacgtaacaaaaagtcacacataggaaagttgtttgaggttttattcaaatgtgtaaggtttgatatgaaacttaaagacaacatttaacataccaattaatccaaatgtgtaaggtacgtcagggcctgatttaggcgggataaagaaccagaaccgtctggaccacttgccactcccaatttcgtagtagtatttcgtatcaaactgtacacgaccatatataacaagtaaaagtaaaagaacacttctaaattaaggatattcgactaaaacacaaaaccaaaacccaactatcaatactgacaataaggataaaattaaccaaaaatccaaagaaaaaaacggctttaaagtgataagacttacttccaaatcatcgatgaggcaatggtgaatataaccagacgtgtaattaaagaaccggtaagtattaactgttgcttctgcttgtttcctcgatttctcattctcacaccaatattgaacagtcttagaaccgggcttaaccggagtcacccaagaaatgatcactccattaccttcatggttcccttgcgttacatgaacctgttgaggtgaattatgaccaggaggaacttcaaaaacatcgctgtctagtggcatgtcatctggtaaatcacttcctctgacatattcacttgtgaaccctccatagcaaaactcaacaagaacacttagcaagaagattatcaaagaaactcgtttgattttgaggtcagatcttgaactcatcttcaagattagtttctctgaatccgagacgaagaacgtgctttatattttctttttgggaaattaaatgagatagctagcttgtctggccagacacaatcatatgatttttttttttttttccaagaaaggatcgcaagtggatattccaaatttttattttatttttaatcaacctttgaaaatgaaggcttctaagaccatctctatctaaaaacaagaaaagtttctaaaaaaaatatatattaatattttaactaaaacaaatatattaattattatttaataattgaactaatagtatgatgacatttgtccaaattggatgagaatagtttctcaaagtttctcggaagagaaactcaactctccttctctcctattttttctccttcctctcatattttttttttgttgggtatctcattgagatacttccaatgaaaatgctctaactatcttttttttttttttaatatcgattaaaaagtgttgtaggaaacaattgatagtgttgctttcatttttttcttacagattttaaaacaagattttgaatgtaaaataagctttttttaaaaatatattttcattacctttttgtttaggaagggttattggtttatagatttataatgaattgaaaatccgaacaaaaatcatttgtaatttaattattgattttaaaattttaattaatatcatgtgttattgattcaatgatttataaatactagttaaaatcctttgttattcgtttagtcatttgtttttggatttgagaatccaaattatgttttaaataaaattaaatggatttgaaagagaaaatagaaggattcaaatccatggataaacacatattattttaaaattcatatattttaattttataattaataaagattttcaaattctatataaatttataaatcaatagcactcctttaagctcgatatcattgcttccagtctctagttaggctattataaaatttaacataattcggttagatatttaacataattcggttagatataatccggttataaaccctttttttcttttacatattttataaactttcccaaatatatgtaaggtatatcaataatatataatttcaatgatgtttatatttagtatatttaaattttcgttaacgttttcaattgtactcttacacaatttttggtgttgtttttgaactaaataatcattttagacacgtataagtatttttataggcattatgtgttccaaatatactatatcatcgtttttaacatcataatctagagttattcatactttttttaatctttgaactatatattatttttgatatggatagtcataatatccatttttaaaggttaagattactaatctttttttttctttggaacaccggttaagataactaatcattctctcgatttgaaagatatttttttcacaggtgaatacatttaaacttttaacatatatcaaaacaaaacaaattttgtagtgccgaattcattttgctatcatctcttcatacatattttttgtccaaaacaaaattacaagatgataaaaatttaaaacattactattacgtgattttagattgtcttttttttttttttttttggacaaaagattttagattgtctaaagtcatatatttctaataaaaattttgaaatattttatataacaagtttttaatattttataaatctaaggaaatgtatctaaaaacacttgaaatatcttaactatctacatctatgcgattggaagcagtagagatagtaaatttcgcttgaaagatctaataggctaatactacttttctaattttatttgtttcgcacgagagtctctctgcatttccgagttttgctgaaatcaaaatcaaaatcaaaatcacgacaagaagaacacaaaagtgctcaatcgtctcctcacgatatatatctgctgaatcggaaaactcaaaggtttcaccggagaagaaa

SEQ ID NO: 13988 - DNA, 3000 bp, Unknown; identical to SEQ ID NO: 13985
  misc_feature (1)..( 3000): cDNA_ID_3409620_gDNA_ID_2214687_Annot_ID_189354 3000 nt of promoter + ATG

SEQ ID NO: 13989 - DNA, 3000 bp, Unknown; identical to SEQ ID NO: 13987
  misc_feature (1)..( 3000): cDNA_ID_2705783_gDNA_ID_2214687_Annot_ID_136718 3000 nt of promoter + ATG

SEQ ID NO: 13990 - DNA, 3000 bp, Unknown
  misc_feature (1)..( 3000): cDNA_ID_2705789_gDNA_ID_2214687_Annot_ID_136719 3000 nt of promoter + ATG
tgtggttggctttgttgggtacccgaatgtggggaagagttcgacaatcaacgcattggtaggtcagaagcgaactggtgtcacatctacccccgggaaaacaaagcatttccagacattgataatctctgaggatctaatgctctgcgattgccctggtttagtcttcccttcattctcaagctcaagatatgaaatggttgcttctggagttcttccaatagaccggatgaccgagcaccttgaagctattaaggttgtggctgaacttgttcctcgacatgccattgaggatgtgtacaacatctctctacctaaacccaaatcctatgaacctcagtcccgcccacctcttgcctcagagcttctaagaacttactgcctctctcgtggttatgttgcctctagtggactacctgatgagactagagcagctaggcagattctgaaagattacattgaaggtaagcttccacattttgcaatgcctccagagataacccgagatgatgaaaacgagacagcggatgacactttgggagccgaaacaagagaaggttcacagactgagaagaaaggtgaagaagctcctagtcttggtcttgatcaagttctagatgatcttagctcgtttgatcttgcaaatggacttgtgtcttccaaaacgaaacagcacaagaagtcacataggaaacaatgattcggtcttgatggaacgccaattctgagagttttcctgaaaccgatcaacaaatgctcgaatatatgatacagttgtggatttttcttattgtagaaatcgtgataacattctaacagctgttgtttagatattatgtttgagcaaatactagtgatatcgataaagtttcaacttgatgctagtcaatatattgatgaagagtccttcgaagcaggtttggtagttgtaatatattgccattgagatattatagatcactcactcattgtgggtttgtttgttttctatttgtgggtttgtttgtttttaaatatgtgtaaaatcttggcctgttacattggctttataccataaataacaaaaaaaaaaaaaaaaaagatcactcattcatatgcaaagcaactcaaactacaattttcatttcccagacttttattgtattttttcaatttaggaatcagacttttgttttagacaaaaaaaaaaaagaataaacattttgtaacctttatattctccagcatcactcttgtactaaatcaatgcacatgcaaggttttctcaccattgttgatattttcattttttgctctatttcatagctttggactttggacaaattcaatagattcctcaagctttgtcacttcatctaaagtatgtcatcgccgtcttttaatgagcaaacaaacatatcagtaaagaagtcaacaatttatttgcaattggctcaaatttgagtagctcaactcttctaactcagaattttcctaggttcttcattgttttaaaaaaatttggcaaagggaaactttactgattaagctctttttgtagttaattacaaaccctctgaaatttaaattcatatataaaaaagtgtaacatccagattgtacgcaatgatgaatgagtttcattatttccattatattagtcatttttcttcatagattatttctaaagcttccaaaactgaaattggcggtttgtacgaagttaatctgaattgactaatgtcgtttctgttgtagatgacattcaatgcattagaaatcctcatttcattacgatttttcttcaccattcattgtatatttattcatgagcaatattgtttattccacttttatgtattgtaacatggatattattagcaatattttgatgatggagtttcatgtgttatattcatcaatgaacttaaaattgactgaattcttactttctagtaaatgtagttactgccatttaagaaccgaggacatgtgaccgaacttttcttctctacgtggttttatctagtctcaactctcaatttggatgatcaaaaccaatgtaaaagtcttatagcacttattggtgaccttaaattcgtaggtacattactagattctgtactgtaagatacatttctatatgttactgcctaataaattaaaacatttataaaaatacgatacaaacatttgaaagggtacgatgtcaaaaaaaaaaaaaaaaattttgaaagggtacaaactctgagaaagtgtgtcaaatacaaatagttttctaaaaagcgtatcaattatcatagtataaatcaccctttataaatcaccctaaattttcctagaaaacactacaatttgcaacatatgtctctcacaaatccaccattaggtatataaaataatcaacacaatattttaagctaactacacattaccaaatcagttcagtttcatgcgtattgtttgcattacataaatgatgaaacaatttcttagtacaagactatatatagcttcaatttcgttactcaaatcgaaatagataattgttttatttcctcaaataatttctgttgtttttatagtaattaagtaaatgataaaaatgatttaataaatgtaattatcttagcttaaagagagagagataaataaacaaagggcaagttttttgattgtttggtgttgagtgtctctctgtccttattcctcaacaaaaaaaaaaaaactgggaagaagaaagaacaaactcattttcaaattctccgaatctctctactccaattaacttttttccgggaagatctcaccggagaaaagctagctagggtttctccaccgtgaagattctagaagcgagaatttggaatttgctaattaagaagatgtgttacgatctttcttaattaaaaaagcattgaaattgacgaatttagggttgtgaaaaatatggatttggattcttcaatggtaccagagaatgatcaagatcctattgctacgtctgagaatcaatctcct

SEQ ID NO: 13991 - DNA, 3000 bp, Unknown
  misc_feature (1)..( 3000): cDNA_ID_2705793_gDNA_ID_2214688_Annot_ID_136720 3000 nt of promoter + ATG
tctgattagtcagagcatggaaatatttcgaattattgtcccctagagtcatccaaagactccgacttttctgataccaatattgttcctcatctcgataagcctcttttagccgtaatgttagatctgtaatctcttcccgtgttttcgaatcatccctcaaagccgcatttaattcatatttaatatcttctattgtctttcgttcgtacggagttaattctctccgccattgggagatagcccgcctacaattatttaatttttccacaaactgcctttctcctgaaccagtggcgagttttcagccagtagaaattgcctctaataacccttctttgcctatccatcttttatcaaaccgaaaattttgctttcctcgtgatttcttatccgcaatcgtggctatcaatggtgcatgatcggaagctaccatttttagatattcaataaaagaattactaaataaatcatgccaatcttcattagttaaagctttatgcaaccgacaccgtattggttttttatcccgccaattccgccaagataaccaatctccatgataaagaaactccaaaagcccgcaatcttgaattattaaatttataggtataaacgaagaagcatgtcttaaactgccccctcatttttcatggttacatgttaatgcattaaaatcgccaattaaaaaccaaggtgtatcccgagtcgtaccaattcgtgttaatcgttcccaaacttgatctctattttttggtatcgggtctccatatacaaacataagacaaatagtttttcctttataaactggttcaatatcaattaaccgattactttgaaaaatgattgagacataataatcattattataaaacagagctaatcccccactataaccaatagggtcaaccattgttaaatttttccaagtgaccaacaaatattttcatatataacgtagattattttgtttccgagagaaataaaaaatctgatcgatattttttccaaaaatcccttaaatatccaatggttgccatatttcctaatcctagacaattccaactcaaaaaggttctgaagttctgcttattcagttttctctctcgggcaccattttcgaggacagcttcccaatcaaacttttcgacgccggtgagcaagatgctcaccggcgtcgggagatcccaagtcgcttcaatctctattatctttgcatcacttttgtaactcttctaagcttttctctccatcttcccgaccaccacagcaaccctccattaaatccatctttgattctcggagatcacttacccatacccttcaacattgcttcactccgtcgatctactccaatggccactgtcgacgattttaaccccgccctagtgctaacgagatctctcacttccaaatttgcagttcctcaacccaaatggtaccgtcactcgtctatcttgagtctctggaccacttttgtgccacaacatccggtgaagcttcattccactctgatcttcaactcgccgaagtcctgccgccacagtcaccaactcttcatcgcagccactgagacactagggttcctgttattgggcctcccccatttcagcccatttctctcttggcccattgtcataagtgacggcccacctcctttatccattaggcccaagttttggctaaactttcccctgttttttctctgccaacgtttgtctcgattgctgaaaataattgttagatgtcaattaatccataatcaatcatcgttgctctgcttgtacaagccttctttgagaacctggttattagagtcacctagggattctactcttttttctagatccctttatcgaagccatttacaaaggttgagaaagtgcggcattatgatctcatcaccaaggtacggtgattaccgcagctttctcaccttccaatctccgtctcctttgttcaccgagttctctcttgtgaaatctatcaatttcagtgataaactccttatgctcatgaaaaccttgaagctcaggtctggtaatcttctacttgtgttaaaccaaagactaactttgtgtgacattcttaatctccatagtcaaggacattatgcgagagagaatccacctgttttgttgcagtttcatacatatctcttgcgaaccctggttattgcttcagcgatttttttgagtttgactacagacccttgctccttctcaacgtcattatgtcttgtgacaatgaccaatcttccacttcccggatcgatcgtggttgtgtctccgatttaccttcttctcgcatgtggcattgtgttctacaactcttgtctccgagctagcatggttttatcatcggactattgtacttctatctttattgtttttatctttgttgtactaaactctgagaatgatattctcctaagccttgtactaagtttgagtgattaaatgaaaacaaagttttttgacaaaaaaaaaaaagacaattccaactcaaaattttcataaattattctaatttttttttttttggagtattccttcaggtcccatccccttttgaaagacctttggacacagaaattgtgttggataaaattaatttatccttcctcaaaattaccagcattgtggcatatgcctaaaactcatcagatccatttaaattaagaccccaagtcctgaaagtaaacaaattacataacaacaaatccttaagaaaaagatgaattctccgaacataaccgaaagtatgataaaaaaaagatacttgaacagttaaacacaaatataatagtagatcctcgttcactgacacgaaacataaaataaagccaaaacctttggttcgttttattgaagtaatctcataaatgacaatgacttgtgaacgtgagccaacacaacaaaagaaaatagaaagcttataaagaaacttcggttccaccgaatacatatttttaaaaataatcaaaaaatgcaaaccatg

SEQ ID NO: 13992 - DNA, 3000 bp, Unknown
  misc_feature (1)..( 3000): cDNA_ID_2710780_gDNA_ID_2214688_Annot_ID_189365 3000 nt of promoter + ATG
tgatgttatctttttacagaggttctttgaaaggcggaagcatgacattgcataaacagagagcgtcatgccgattgacttaagcatcacttcttttcccccaagagataaagttttcccaaaccaaccagataatctacaacgcagcttatctccaatgaaagcaaaaagagccagcttggaaccactaaaacattcaggaattttccgtctccatcttcctgcgagatgccaagtatacttttcttactatgttttgtgattccgtcaattttagctccaaaggaaatggtagatttctgaatatttatttgttgtcccgaagcatctccatagagctttaaacattttagaatttcagaactctcttctatgtttgtgcgacataaaaacaagctatcgtccgcaaacataagattttgtattgaagggcttgaaaaaagtaatctcatacccgttagtctttggacattctctgactgcttcataacattgataagcgcctcaacacaaaagaataaacaagaatggagataggggatctccttgtcttatacttctttcaggtttgataaaaccatgagctgctccattaatttgagggtgtttacatcttcatgttaaacatctaacaataaaaccatctaacatatatttttaaaaacatttttcacaatcaaaactattaattccacgtaccatactgaccattacttttatttatttatttttgattaccattaattagataaaatattcacttatataagaacttgtgccatgcacgggtaaatttaactctatttaattttatttataatataagtttttcttagacttttaaattttttcactatgcttgaaaattatattgtggttgtgttttgtttcataacatgtttaaaggcataaatctgaattctaattgatttgttttcttgagtcactaaatctctgaccaaaattggcccaagtgtgtagttgtgggtgaaaactcttataaagtcttactaaaaattatttttatagtttagttagtggttaataaatacacatatatatgaataattaaaggtatataaaaatatgtacatattatataatatttttctacaaacaaaaatatatatctgatgttaaaaattgtgttctctgaatttcaataatatttgtaaattctaaaaatcaaactaaaaaaatgatttaaaagaagcgtaattgttttataaattacttcttaagacgtgaaaactgcggtttagttaacgtctacaataaagaaaaaattgggtagaaaacaatagatatgatccaaatatgatttttactaacccaattttgatctcaaacaatatatacactaagtttatgattttacctaaaataacatcacacacttttcaatttcgacccaatttggactcaatacatgctttagagtttagatgcatcaatatgttgtcgtttccagcccaaccacgcttaaatgataagtgcactttggtgacataggtggccaaattaattatttaaaacctttttgcattcatcaccatctttttgaaaccctggtattacacattagcattgcctcttcatcatcccaccattccgtactttacaaatgtacaacatgatctaaagataacttgaatttaggaatttgctaggtgtcctctaaaaaaatgatcaatgttcacaaatcgtgatgaatgggaatattccaaactgttgatatttgcggtagtgtccatatttgaagggctgtgggacactcaaaaattatatgattaattgtctcctatggcgtcacacatctaccacaaaccgtatcaaaattaatatctcttttcctcggatttgaagtaagcggcacatatccagtaataaattggcaaacaaaatgtctcaatttcggttgatattgaattttccaagaataagcttgaagaagtttggtatccaggacaaaatagcgagtttgtttccaccttgcttcatcatttgttatgtatagtagcgagactataatagatgtttggtatccaggccaaaatagatgataatattcatctataacacgacatatcaattttactataatatgaatacttatatacctattatcctaatttttcactatcatgaactcatacaacaacaatatataatatatattgagaaaatgtatgtagttatattatttgtaatctgaaacttgtctaacttaattgtaacaaataattcttttaaaatgtatgtggttatgttattttttatatatatatgattgaagttttttttttatcaatttgttctgatttgtttttttttttgtttactgaaaatgatgaaatttggatcccatcgttttttttgatgattcttttctttgttcttaccaataaaaattttatgttctttttgtttataaaattataacattcataaacgatgtcaaaaattataattttgaatagggctttagataacgttggaccggatcagcttacgtgtcagaaaaaaaaatcacataactgagagaaagagtcacaaattattacttcattctatctctaagactagttcggcattcgacttgtctagtactatcattttcttatatgtaatcgttaaagcccgaacaattccccgtgatagccaaaagtatctctttgttatcccaaaaggtaattaccttctccgatcctcctatcaacatcaaatatataaaacgcttatttcaaaaatcctattttacaagatgataaattatattttagcaacataaaaaaatagataatgaagatatagtaaatgtaataaggtatgtgtagcaagttatctattgtttttggcacgatgtatccacatttagccttcttatctttgtaactatggacgcggtcaataagtaacacgattcgtcttgtttgcctaaaagaaaaatattcgtctctgtttataacatttgattaacattttcaacactaaactatg

SEQ ID NO: 13993 - DNA, 3000 bp, Unknown; identical to SEQ ID NO: 13992
  misc_feature (1)..( 3000): cDNA_ID_2710780_gDNA_ID_2214688_Annot_ID_136721 3000 nt of promoter + ATG

SEQ ID NO: 13994 - DNA, 3000 bp, Unknown; identical to SEQ ID NO: 13991
  misc_feature (1)..( 3000): cDNA_ID_3021232_gDNA_ID_2214688_Annot_ID_189363 3000 nt of promoter + ATG

SEQ ID NO: 13995 - DNA, 3000 bp, Unknown
  misc_feature (1)..( 3000): cDNA_ID_2710782_gDNA_ID_2214689_Annot_ID_136724 3000 nt of promoter + ATG
aaccccctgtttgcaaaggtatggaatctacaaactgctccaaagattaagatttttctttggaaagtgttgaatggtgcagtagctgtagaagatagactcagaagtagaggagtaaaagctgatgagggatatttattgtgtggtgctgagcaggaaacaattaatcatattttgtttctttgtcctgtagctagacaagtctgggctctttctttagtgccatctgctttacatggatttggaagttcaatctttacaaatctttgccatgtctttgatatggtaaagaatagtctcataactcctcatatgcggtgtgttggtccttggattatttggattttatggaaaaacagaaacaagcttctttttgaggggattggttcattgccaaattgtctaaacgataaagcttatgaagactgtcatgaatggctcttggcacaacagactttaaagtctgatacacagccaaaggaagtatctagtaagaagtggaggccaccaccaaagggcgagttgaaatgcaatattggctttgcatggtctaagcagcagctttgttctggtgcatcttgggtggtgagagatgaccagggttcagtcttattgcatagtcgccggtcatttgctcaggtacattctctttctgatgcaaaatcaagaagttgggaatgggctctaagtagcatgttagatcatcggtttgataaggtcacgtttggatattcctcttttgaaatcattagtgctctgaacaaaccaaaggaatggcctatattaactggacatattgctgagcttttgagtttcactaaggacaaaccggattggtttttgttattggaacctcctgagtgtaaatagaggtgcttccttgattgcacaaaatgttgttactggttttagatgtcaatcttacgtggctaggggatgtcctagctggctgcgattactgtttgatgaggaaaggtgttgaatagcagaaaggttgtgatttgtgttaggggtcgtgtgtgatatttagttaggtgtcggtgttttctcgcttagtgtcctcttgtgttatgattgcttttagagatttatttactttttaggtttccattaggttaagctaaataaatttgttttttagtgtggttgtttattcttttttaagataaaccttctttttttacggtttttctttttccaattaatagattttaccttatctttgacttagtcttatttgtcttttagcttgagtttttgtttgtctcgctcttttcttactttaggttgttctatataagcgtctcttaaggttaagctagtatcacaaccttctcttgcttttcactttcactctcacttctggtgctatggcagacgagttgtgggatgagttacaacacttggagttgggaagggaggatcctgctctctttattccgcatgaagcctatgccattgtggagtctaggaatcggcttagtctgatagctagacctcttaatcctcgctctcagaaccttcacgctgtgatctcggctttaccaagagcatggggtctgactaatagagtgcatggccgggtccttaatgacacgtttgtccagttcatctttcaatctgagattgatctcttgtcagtactacgaagggagccttggctgtataacaactggtttgtgacagctcagagatgggaggtaaatcttacgtttcacctgttaacatctattgaattatgggttcagatgcgtggaattcctcttttgtatgtgtgtgaggaaactgctttagagatagcacatgagttaggagagatcatcactctggattttcatgactccactacgactcaaatagcttatatccgtgtgagaatccggtttggaattacagatcgcctgaggtttttcctaagaatcatttttgattctggtgagactgctctgattagctttcagtatgaaagacttaggagaatctgtagtagctgcttcagaatgactcatcacaggaactcatgtctttacaggcagattgagtctctccatagggtgactaacactacagctcaaaggaatgttagagaagaggtgttcatgagagatgaaaatctgagatcttcaatgaattcacaatctcaaatgtctgagagttcgtttcctactcctattgatccacctccaaggattcctcatcctcctttaaatcctgatgaattggtggctgcatattaccctcatacaagagctacctctttaccaaactttgcaggtcctttgcctcaggtacctcttagaagaaatgtggatgaaagggattctaacatccagcctttctccggacctgcatttgcagcacactctccacgtctggtggaagtaggtgaatcatcaaggcaaggtgagaatactcagaatgttcacacggtggaaaagggggattcatcaaaaagaaagaacatgggtggtcccaagtttaaagatgatgcaagaaagtccaatgaagatgagcatatgaatggagggattctgaaacctccaaaaaagcgttgatcactctgttataattctgtcatgttttttgatttagttgctttcaattcaatcaagcagccacaagatatgaagaagatggtatggcctaatatccctttttggttttggcatacccgaagtgtattgttatgtggtgtaatgctctgctctaattacccttactatactcttttgctttacaacttagatgactctctagttagataatttaatgttgtaagtggtaaaagtgtgtgtcaaactctgaaagtggatgttcttccactgttgtatcgtttacaactgctgtttttaataaaaagggtaatacttatgaaaaaaaaaaaaaccgtagacgtttgctgtaaaaaaaaaaaaaaaaaaaaaaggaaaaaacaccacaaagctcgtcactccgctaccgaccactcacatcacaagtcacaacctccgccttgagatg

SEQ ID NO: 13996 - DNA, 3000 bp, Unknown
  misc_feature (1)..( 3000): cDNA_ID_3021242_gDNA_ID_2214689_Annot_ID_189378 3000 nt of promoter + ATG
cataataaactcgatttaaattctacacacttcatattgagtgataacattttcatatcaaaataatatttatgacatatcaaacctatatcctagttagtattaaaaataattaacaattaacaaaatataattaataggcctaggtataatacccaaacccgaagaaccgatccaaaaaaacctatccgaacccgaacccaaaattttcaaatacccgaaaaggtctaaacttcaaaacccgaaaaacccaaacccaaatccgaataggtatccaaacatatctcaaattacccgaacgggtcctaaacttctaagcccgaaaacccgaacccgaaatacctgacctaaatacccaaacgcctaaggctaataattaataaaaaaacagaaatccacaaaaatatttagaaaccaaacattgttgaaaatatattttttatatatgccgtaatctcgtaagttaattttacatcatgcaaattaatattaaatgagttaaaattaataaataaaaatattctcattgaaaataattaaaaagttaaatcctataagctaagctatttttctcaaaatgttctatttatgattacattagttaaagacaaatttgttaattttctgttttttgaataaatgttaattgtttataaatatatagatatataaattagtatatgtaaatttgtttactttttaagatattctattttttaaagagaataaaaaagttaaattttgaatgacacatgtaaagatccgatcgtttgacttgacacgtgacacgatcctatgagttagcaactttgaaaaccatactttatataataagatttcatcggtgcttctataaattataaactatttctgacactataaagatttatattaagagaaactgaagttattgggacttctatagacttatattaaattttatcatactctttatttaaatttattttatagaagtttagtagtttcccaataactacaatttctcttttggaatttaagtaggcaagatttatattacttatcaacaaattaaattatgtgaacaaatttgacgcacatatctcaaaagcttgaactttactcatccaacacattagtttcgacatagtggcgagagtggagtatacgaaatacaaatctatgagctataaagtaaacattacaaagcctttgtcaaatttgatatatggacgatataaaggaaacttcaaacacacgacactaatcttatacatgtgcacacatagattaacatttagacgtttcttatatacaatatacatgcaattaatgtatctaagtggatcgttcttataagaaactccactgaaagattatgatatagaaagcaaaacgatattgaaattacctttaaagacaaaagtaggagaggttaattaaaagaatcttcttaatgccctggtatgaacttttaggaaagaaggagacaacaaagctcttccgacgaccagacaaacaaagagagtttaaatctccttatttcttcttcgagtgcagcaatccccatacaaagccctcttcttttggaattgttcagaaacaacctgcttaagttcaatacacgcaccacaactaaagaaatttaaagtgtaatttatattctttgattggatatataagttacatgagctgctaataaattacaaagctttatagctgatgactctccgcattgccgcagttacgaaaggtaatgaaaggtgaatggccgattccataacacaacggagaagacgtgaaagccttaacctatagatgacgtggcatttctttttttaaggatgaaagagcaatgacgtggcttcctctcaagtaatgttttttgtgctgatgtggacacacggaagcctcagagcatctccatcaatagtctctcacatagtttttccttcactaaaaaatataaaataataataaagtaggagagaaagtgagaaaagtttctctgcggagaaactatgagatacttttcttgccacatgtcatattttaacaagttaaataattattttcagaataattatttaaataaataataatattatatgataatgattaaaaaacaatatattgaaatactcctaccaattctactgatgaagatggcctcaaagaacttcttttattagtaagagattagcaaaactaacaaaaaaaactataattaaaaaaaaaaaagtgatattctgtatatttcctatttaactatattaatcccaactttgctctctctctcttcccctttaactggggtagtggagtttgttgtcttttcactatctagtcctacttactacattaccgacattatagtgctatattcttaataacttttctagaaactgttacttttgaaattcacccctaaaccgcagacgtttgattcttggtatagataaaaaaaaaaagaactctctgttctctttcatagcaggtcaataggatatttctttcgccgtttgaatcaaagtcgttccagttttcatttggacttaagaacttatctctcaattagtttgaattgagtggagctgttatccgaagatatctctttcttctgtcggcttagaaatcaagattcacttttttacaagttttgggagcttcctgtgttttaagaattctgttctgtgtggtttgtggtgtttgtgatggaactagaggacgcgatacagaagatgtctattgaagaagatactccgttgattctctcaaatcaaccagagttttgttcgaatgaaagaaacaactgtagtattttgggcaggtttttgaatcctgagtttcaaaggatgtctaattggattctggatatgccaaggatttggagactttataatcgggttcgaggtgttgctctctctaaagacaggttccagtttttcttcaagtctgaaggatttacaaggaattctgaaagttggtgtttggacccaagatgattggtgtgtggttatg

SEQ ID NO: 13997 - DNA, 3000 bp, Unknown
  misc_feature (1)..( 3000): cDNA_ID_2710782_gDNA_ID_2214689_Annot_ID_189375 3000 nt of promoter + ATG
atattgtatggttacatgggttaaagcatctcagtcggcgagttaccagaaaagtttcatatactttcttgacgagatcagtttgaccacatttattggcgctttatatattgtatttgaagatgctgaacattagttttttttccccaggtcagctggtttagtttcgacccagattttcacattgagagagagcaaatgtgctgctacctaactcgcacaacaaagattacacaccaattgatcagagataatttgcatgagaccccaacttatggtggatgggttgaagcaaaaggtcctaggtactgcccttccattgaagacaaggtaaattattttccctcttttgctttgtattgtctctttctttaaacaaggggaagttacatcagacatggttcatctacctttcatttgattggtaatgtttgtgccacatactggaatctaattgtggcttgtgagcataaccatggaaacctaaatttgctagacatagtaattttaagactggttccttctccaacatgcaaacataaattgataacacttttataaggagacaagagttcatctgctacataatggttagcaaaatagttaacagccttagagggaagcatgagtgaaaataggggatggaacagatcagtgggactgttgaatgtttggttggctttgaggccttttggagggtattgggaaagtttaggttccctagaataaacccaatggtgccttagatttctttttttcttggtccagtaagtgtgagtcatttctcaaggagttatacagcagtaatcgtttctaaattgtttcagtttaaatatactttattgtttctagcttggatgatgtcacggtagcaaattatatatgctgattttttgcaaactgctataattttttcatcattttttatttgcaaactcctgaaagtcccttcaattctctagttttgacgtggattcttctaattcctgaaagcaatcttgcatttgctttttctacagttggcacaaagaataagttgaaccatctttctctttaaactgcttttgatgaacttaaaaaatcttgtttggtttcagattgttaggttcaaagacaaagagtctcatcaaatattcctcgaaccagagggccgagatgttcctgagatctatgtgcaggttgatgcataccttagttatgttttatattttttgttatcgtcttagtgaaaaagtgtgaaggatgagaaagaaacctagcttgtcgcctatatgttaatatctaaaacatatgcttgtccagaaatttccttatgtatagtaagagcaagcctgaagtttgttactgctcagtggtttaatgtgggcgtttgtaagtcgagttttcaagactagagaaaatatatcttagctttgttgctaattatcaaggcgtggtatatatcttcttatgagtgtaatgtctttgatatcactagcattctcatgaattggtaatttggtattttcgtagggattttcaactggcctgccagagaatctccagttgccacttctaagaagcttgccaggacttgaaaattgctccatgcttaggcctgcctatgctgttgagtatgattatttgccagctcatcagtgttccaggtcccttatgacgaagaagattgaaggtcttttcttctctggacagatcaacggcacaactggttatgaagaggctgctgcacaggtgactgatctgtacgagtttttaatttccttaattatggaccttgagttcatgaaaaaggtttattcggatgatatggaaaaaaattacgaatactataatgaaaactgctgtttagactttgtacatatatagtgatagcattctctgttattcttttcaaatttagggtattatatctggaatcaatgctgccagacatgcagacggtaagaaacacgttgttcttgagagggaaagcagttatataggtacgttgattgatgatttagtcacaaaggatctcagagagccataccgcatgctaacaaggtaagttccatttcgttctcttgttcattatcctaattctcctgcattcttttatactttcatgatcaatcctccactctactttctgaaatatggtcaggcaggctagagatatgattccgaaattattagaagttgacatctgtgtagaaagaaaatatgttttttcataacattcgctttgtatgcggtacccatctaagtctgtctgatggtaataacagtgacatttttcatcaccaatttttctgcgttacataagagcttgtatgggggaactgaagagagaagcaaaaaaaaacctcgctggcagtactggaataaaacttgactttttaacttttcttgatgcggctatatggccatgacttgttttaactttttttttttttcttttccacgtgaactattttgtgcatgtactaatagcctattactacttatgtgtgtttagtaacacggaataatcaaatgtgttttttttctcaacgacagccgttcagaacatcggcttcttcttcgatttgataatgcggatagtcgactaacgcctctggggcgtgaacttggattgatagatgatagacgatggaagttataccaagagaagcaagcaaggatttcagaagagaagaagagactgaaaactgtcaagatttcaggttatctccgtattctgtttatttcagaacgaacttatgttgttggtccctgcatacatttaaacatgggatagcaaaaattttaaggcttgacaaaactggattaggtgcaatgcatgagttgatgagtgtattgcttgcagttgcagtaggtgatttggctgccgaagtttctagtgtgtcttctcagccagtcaaagaatcagcgacactagagagtctcctaaagaaaccacatatccactacaagcttcttgagaagcatggctttggaaatgaaacattatctagaatg

SEQ ID NO: 13998 - DNA, 2166 bp, Unknown
  misc_feature (1)..( 2166): cDNA_ID_3021306_gDNA_ID_2214690_Annot_ID_136726 3000 nt of promoter + ATG
cgtctcctttaaacccatcccgccatataaatccgtcccgtgataactaaaaatcaaattatttttttcttttaaatgatatttttatttaagatacttgttgtcaatttacaatttcaatctaataagaaaaattgtatgctacattgaaattttaacaatttaataaaaatcaatatatgatcgttttgaagattttatatcgaattctttgaacaaaaaataacacaatttcttgttaaatattttgtatcttttaaattaatatatttcctatttgtattttttatcttcaatatatttggttttaatatattttagaaaacctgttcaaataattattaaaatttgaatcccggagatatctttgtgattttctataatttaaagatatatatatatatatattgtttagatttgttgttgagatctttttagtgtctatttttagattttgtctattttctatatatatatattgtttagatttgttgttgagatctttttagtgtctattttttgttgcctttgtttgtttgcaaggtctatcataattaaggtgaagttacaaaaagatctataaagtattatcgtttacatattgattataaaatctgtagattatttttaaacaaattctgtaaattatatgtttaattgtaataatttaaaaattccaaaagaaaaatattaatatcgatattaaatttattttgaagtttcaaattttataaatatttaaaatttataagaaaagacaaaattatgttaacgttttatatatatttataatgtttaaagttcttgtaaaattcaatttataattttcaaaacttcataagttttaaaattataaatattttttaaaaactttaaagctacagttcataaaaagtttgtaaaattataatatttaacttttgataaaaagttaaaatatttataatttttgaaattttgtaaagtttctattctttaaaataaaaaacgtaagaaaatcggataaccactttaattttggacgcctaataaatcaagcttcctgcctactcgtaactggaatcattttggtcttttttatagtatgactctaaacaaatgcctaattttttaagcgatgtgggatattgtacatatattatttctccatcgattgaataatatatgttcattttaaaaaaaattaaattacatcatatataaaaaaagttaatattttattaactattaatattttatataaatttaaaataaattaaatataagatctaataaatttgaaagaagaatcatatatttatgtttaaattaggtaaagatgttttaggaaattagttaaggtaaataacaaatatggttagtttagagatattatatatattaaatttggtaattaaattaatttcgtttttttttttttgtgtagaaaatgggattagaaaccaattatgaaagattcgattgaaaattttcgaatcaaaacccaaaaaaaaatctgacccaattaaattctttaaagtatacttcaaaaatgttaagtagatattatatttttataccaaaaaaacaaacaatacccaaatacagtatctgaatcaaacaatatccaaaaattcaaaaaaaatcgtaaaatactccaaatataccaaaataccggatagtttttgtagctagaccggttactcattcaaaatcattcaaagaaccgaaccaaacaaaatcctgaaaagaaaaaatgaagggaatactaaactcaagatctaaaaacggaaagtaccaaaccgataccgaaccgaatacatttgaatgaagagtattagttttggttaatgaaaaaattgagtaattatttggctatacatatgaaagttgatcgacacatatcaaaatcttgtaactgtcccaaaagcatatttagaaatcatttaatattttcataatatttacttcatgaaaaaatcaataaaaagatttactcaaatcttaaatcttaaatatctttataaccaaaactataaagttagtatcggagactaataaacacaagtaaactatacgacttctcgaaaacctagttgctcaaactcatcaatggcgaaactaaaggttgctggtacatggggaggcatacttgaggtagaactcgagaattggactctaaacatg

SEQ ID NO: 13999 - DNA, 3000 bp, Unknown
  misc_feature (1)..( 3000): cDNA_ID_2710786_gDNA_ID_2214690_Annot_ID_136727 3000 nt of promoter + ATG
tttcgagtttacagaagagaaaaattgccccaaaagacttccctatttgcattattggtccctggacgttttatagggtctttatattgtttttagacctagttttcattattatcacgttttatcatcaagttcttatcaagctttttgaaaaccctgttactgagagacataagctattcaacgagtgttttcagagattgattcagatcttaatacagtgaagagatcctttctttcccttaatctatttgttgtgtttatgttttcatacccaaatatgttgtttgcttcaatcaatatgtctgagtaatctgcttgttaggaatagtgtttctcattagggattcatatggtttagtagattgcccccttgctacattatctatagaattcttcatctttaattatgcttaatgctagatctagagtaattaactagatcttgaatctagacaatagatatgcccgccataggtatctgtagttagatcgattatttgatgagcctggtttttaggtgtgtaataaaaattggcctaactactacggtaaacaatcgaactcgttaagaatgcttatttaggttgataatgcctcggcttctccggttattcttagctatagatatagggagtttcgcagaacgcgaccggttattccataattagagtttgagtttaagaatggttcgataacaacctagctttcattagatctactaaccaatagctttctgagaataccatgttcctagctctttatttaatcgtttacaacacaatcatcctgctgtcttttaccttgttttcttattatttcaatcataccctgctagcttaatctcgatattctactcactgtttggacaaaagagctccatgaattcgatccttaaatactgcaattgatctcttatttgagagaatagttctaggtaatttgaaccttatcagaggtatttatggacgatatctcagtttatgggtcctctttctcctcatgtttgttaaacttgtacatggttctagaaaggtgtgaggaaaccaatttggtactcaactgggaaaagtgtcatttcatggtccaggaaggaattatgctgggcacaagatttttggtaaaggaatcgaggtcgacaaagccaaaatcgatgtcataattcagctgcaaccccctaagacgtataaggatatcagaagcttcctatgacaggcaggattctacaggagattcataaaagacttttcaaagattgttcaacctctcactcgacttctttgcaaggaaactaagttcaatttcaatgaagactgccttaaagctttccattcgataaaagaagcgttggtgtctgctcccatcgttcaagcacctaactgggactatccatttgatattatgtgtgatgcatccgattgtgcagttggagcagtactgggccaaaggattgatggcaagcttcacatcatctactacgccagtaaaacaatagacgaagctcagacaagatatgctacaacaaaaacggagcttttaactgtagtttttgcctttgagaattttgaagttatttggttggttctaaggtgaaagtctacaccaatcttgtcgctctaaggaacatttacgccaagaaggaaaccaagtcatgacttctaaggtggatacaactactacatgaatttgatatggaaatcactgataagaaaggagttgaaaaaggagttgtagatcatctctctagaatgaggattgaggattcaatcccgatatatgacactatgctagaggaacagctgatgttctaagacgttgttaacaaaaacattaacacaaaagacatacttgatagagcatatgcagttgaagaagaaaaattgtcctggtatgcagatttagttaactatttagtgactggtgatatatccctatttttaatgtttaaactatgttttaggtataggttttagagtctatttgttatttctagagtcttttatagtctttttcaggtctttacatgtttgggattcatttggagataagggagcattctggaggaaaacagagaatttatgctgctgaagaaatccggagacaaaaatgtacgtaggtgtcaaacgacaccacccctggtgttgagcgacaccaatacctgacggcaatttcgaggcgtaacttattgatgttttgaagatttctaaattcggcccagaactttctcctatgtttaatgaaggctcatcacgtattttagacatataattaggtttttagggtcattgtttagacctaagctttgggaggctattccctttttctattctgattttgggagcaaaaccctgtggagactcccgttagagaagattcttcttaactatattcttctcttattttattcattgatttcttattcaatcatgttttgttcttctatgatcatgcttgtgtagttttcttgttaggttttggtttctcattagggatttagatgatttaatagattgcccccttgctaggttatctgttaggattcttcatctttaattgttcttaatgctagttcttgagtagctaactagaacttgaatccacacaataggtatgcccatcataggtatctgtagttggatctattatttgatgagcctggtttataggtgtgtaataagaatcggcctatctactaagttgaacaattgaactcgtttagaatgcatgtttaggttaatgatctctcggcttctccagttattctaacctataagcatagggagtttcgcagaacaccaccggttattctataattagagtttgagtttaagaacggttcgataacaacctagcaatccctagatctactaatcatctatctcctaaaaataccttaaacctgactcttttcccatcttatttatatcttgatatttattgcttttctttatttcttatataatctattggtctagcttgtttgaaaacatcataagtcta

SEQ ID NO: 14000 - DNA, 2094 bp, Unknown
  misc_feature (1)..( 2094): cDNA_ID_3021306_gDNA_ID_2214690_Annot_ID_189382 3000 nt of promoter + ATG
cgtctcctttaaacccatcccgccatataaatccgtcccgtgataactaaaaatcaaattatttttttcttttaaatgatatttttatttaagatacttgttgtcaatttacaatttcaatctaataagaaaaattgtatgctacattgaaattttaacaatttaataaaaatcaatatatgatcgttttgaagattttatatcgaattctttgaacaaaaaataacacaatttcttgttaaatattttgtatcttttaaattaatatatttcctatttgtattttttatcttcaatatatttggttttaatatattttagaaaacctgttcaaataattattaaaatttgaatcccggagatatctttgtgattttctataatttaaagatatatatatatatatattgtttagatttgttgttgagatctttttagtgtctatttttagattttgtctattttctatatatatatattgtttagatttgttgttgagatctttttagtgtctattttttgttgcctttgtttgtttgcaaggtctatcataattaaggtgaagttacaaaaagatctataaagtattatcgtttacatattgattataaaatctgtagattatttttaaacaaattctgtaaattatatgtttaattgtaataatttaaaaattccaaaagaaaaatattaatatcgatattaaatttattttgaagtttcaaattttataaatatttaaaatttataagaaaagacaaaattatgttaacgttttatatatatttataatgtttaaagttcttgtaaaattcaatttataattttcaaaacttcataagttttaaaattataaatattttttaaaaactttaaagctacagttcataaaaagtttgtaaaattataatatttaacttttgataaaaagttaaaatatttataatttttgaaattttgtaaagtttctattctttaaaataaaaaacgtaagaaaatcggataaccactttaattttggacgcctaataaatcaagcttcctgcctactcgtaactggaatcattttggtcttttttatagtatgactctaaacaaatgcctaattttttaagcgatgtgggatattgtacatatattatttctccatcgattgaataatatatgttcattttaaaaaaaattaaattacatcatatataaaaaaagttaatattttattaactattaatattttatataaatttaaaataaattaaatataagatctaataaatttgaaagaagaatcatatatttatgtttaaattaggtaaagatgttttaggaaattagttaaggtaaataacaaatatggttagtttagagatattatatatattaaatttggtaattaaattaatttcgtttttttttttttgtgtagaaaatgggattagaaaccaattatgaaagattcgattgaaaattttcgaatcaaaacccaaaaaaaaatctgacccaattaaattctttaaagtatacttcaaaaatgttaagtagatattatatttttataccaaaaaaacaaacaatacccaaatacagtatctgaatcaaacaatatccaaaaattcaaaaaaaatcgtaaaatactccaaatataccaaaataccggatagtttttgtagctagaccggttactcattcaaaatcattcaaagaaccgaaccaaacaaaatcctgaaaagaaaaaatgaagggaatactaaactcaagatctaaaaacggaaagtaccaaaccgataccgaaccgaatacatttgaatgaagagtattagttttggttaatgaaaaaattgagtaattatttggctatacatatgaaagttgatcgacacatatcaaaatcttgtaactgtcccaaaagcatatttagaaatcatttaatattttcataatatttacttcatgaaaaaatcaataaaaagatttactcaaatcttaaatcttaaatatctttataaccaaaactataaagttagtatcggagactaataaacacaagtaaactatacgacttctcgaaaacctagttgctcaaactcatcaatg

SEQ ID NO: 14001 - DNA, 3000 bp, Unknown
  misc_feature (1)..( 3000): cDNA_ID_3021294_gDNA_ID_2214690_Annot_ID_189385 3000 nt of promoter + ATG
gacttccttggtgttcttggcaaacatagctctgtacttattttctaactctttcttctgtcgaccaggaaatggaagtgtgggcttgtaaggaggaggaatgaatgctttctcattgtttttagcagcaactagttttagagcagcggatgatgttaatggatttgttggtcgagtatcaaggtcgagtatgggctcgagtacttcaattggtttatcaacttgatcttcattgagactgaaatcttccccatcttggtatgcactgtcctcagtgactgacttgggtctctctctagtggattactctcttccactccttatggtgatagcatgaacattagcatactccttgggattctgaattgacttccctgaaagtcctgtaactttgggagcagaggtagatgcggattgtccttccaagtatctgactttggaattcaacgcctccacttttgcattcaggtcattgtagttgcagtctaccttatggtgcaattcagatatctttttagcaatctcaatggagctagatacttgtccctgtagcagctattgtagcatttgtttcatgtcagcgtcaggagcagcatgaccttggtgttgctgaatgcaaaccccggtggtggttgctgttggtagttcccctgaaattgctgcttggaacaaaaccttgattatagggaacaaaaggtttgttttgaccttgttgttgctgtggaggatacacttgatcctgtggattagcaacgttagtgctgcggtaagagtggttggggttgtttgtcttgaagttgttgtaccctttgtagccaccttgattgtggatgtagctaacttcctcgtcatcaacaaggaagtgcacatgcttctgctggctaaaaagaatcttgtcctgcttgtcattcagtgctttgatctctttcttgtgtttgtcatccgagtcagttgttcctctgatggtcctgttgcagtcctcgttgtaatttccatctgactgagctaggttctcaaccaattcccagccttcttcaacatctttgttctggaaatttccattgctggcggtatccagaagcattcttatgcgtggtagaacacctctgtataaagtgctgagcatagaggctttcttgaagccatgatgagggcattggttggtgtaacccttgaaacgctctcatgcttcacagaagctttcaccagtcttctgtgaaaaacaagagatctcatttctgagtcttgcagttctggcgttggagaagaactttgccagaaaggccttcttgcaatcatcccaggtggtgattgagtcatgggacagattctttacccagatgtgtgctttgtcgcccaaggagaatggaaacaaccggagcttgaatccatctttactgacaccgttgattttggttaggctgcaaagcatatcaaatttatccaagtgatcgagtgggtcttccataggcagaccatggaacttgtttccctgaatcatcgagatgagaccactcttaatctcgaaattgttgttttagacagcaggaggtgcaactcttttcctcagacggtgattccttggtgcatctccagcaccaatgttggtgggtacattcgggtcatcttgttcatcagccattttgaatggatggtggtgttcaaggtcgaatgtgtttatcctttccctaagtcttctgttgaagcagttgatgttatcgttgaaaaggagattctggttgtgttttgatctagtttgcatacatcagagttgtacctggatcaagaagacaacaactgaaaaacaaagttagtaaccgaaatgaaaattaaaatagaacttgatctaagaaaatccgaaatcttaaatgtaacaaacaaacacctaattagcaacgacgccaaattaataataggtttttatgatcaaatatcctaaaacaccaatcatgtcgttgtagtattttaggttgtcaatccaaatgggtgtgatgctagcaatcaagatgcaatccgagttcacagagtcaagccaagcaataccaggttttggggtgttctaccagtcctaagtgaacatgcaggaaacagaaaatcaagcagaaacaataaaacactcgaccaacacaacttgttgcagagcactgggtgtggtcaattgactggtcgagtaatagacagaaaatgtaacatggatactcgactgcacagtctgttaccagacaacagggtggtcgagtatcaggtcgagtaacatgcaaaaattacaaaaactaagtaacaaatgacaagatgcagtaaacaatagtagagtaaacaaagaaatcaattagataaagaattcccgaggatggggtaattgagtagttttgtttcctcagtttacagaggtgattgacatgctcaataaattatccctagataacaagttcggtaaccaaatctaagtgccaccgcaacagagaccctcaagttaaactagtcccaaactcaatcagcattgacgagagctaacctaacaggcattacgaatcaacaagttaaagccaaaacgctccctgcaaccaatacctaggtacatagccacaaatttttggaattagtggttcagacatttcatcgaacaccttttgggcgcggaaatatcttggctcaatttccagttgatcagaaagcaataggcattaagaacaactaatccataacgatctataaatcaaagtcaaccacctagcatactgagaattctaaactactctaacctatcctcagaaacctactcactactcagacatcattgtagagaacataaacgatgaatagaatgaaaacataatagcaacatactaatagcaagatgacaacaggatgaacaacttagtaaacgaaaatggaaagcaaatactgaatactgaatagattaagagaaatccggattacaaaaacttcaagaacacagtgtctgcggaataaaacttagtcaacaaaaatgcaaaatac

SEQ ID NO: 14002 - DNA, 1814 bp, Unknown
  misc_feature (1)..( 1814): cDNA_ID_3021265_gDNA_ID_2214690_Annot_ID_189394 3000 nt of promoter + ATG
gatgattcatttaaaaaaaagaaatatttttaaatttttatggaatttaaagtttatatttgtatttatttaaaataaaaaataagaaaatataataaaatcattattgttaattttacagttaaatgagtttatatattttttatttggtggaagattctgattggttagagaaaaaggaggtgaataaaagaattcacctctataagtaaacccaaatatttttcaaaaattataaaacaagttaaaaaaatttgtatcaaacatattttacccaaaacggaaacaaaagttaaaattatacaaatcattgcatgtttaattataattggcggttgttttatgcagaattgaaattttcaacaaaatttagtagaagatgtaagatttgtaagataaactttaatgtaaattgcaaggtagtattccttaatttgattaaacagctaatatataaacatacattaatacggtgacgtataaaatataattatctgccataacaagaagtaccattttaattgtttttttttttaccggtaccatttagacgtttatgacatttaaatagaacaagttggcgtaagacagaagaatctttttcttgatgttttcttcttgggtattgtaattaataaattactaccattatgattaaccatatgctctgtacatttctactcctattagactgaaatattatataataaagcataaaataagtttttagtactaataccacgacatcaagaatttgacggtgtataagtttccacgaatctaaaaattggttcaaccaaaatatatgagtttttagtagataacatttctatcggtaattaaagggtgtaaggattgcattacgaaaatttgtcgcgttcatttttatctttagcccaagtaggttgcattgcatagcttctacttggaacactacttattgtaatgtattactaggcaataatttgactagtcaatccatatccattgtttatttaatctattatgtctaaatttaagaatcactaaccttatataaatatctacaacaagcctatgtaactattttctaacaaagcatacattactattctattcacaatgcttggaccgatgatacttaatagtttatactagttttgtatcttcctcaattggttaatgaacaccaatatgagtcttaacacatctatccttctctcttgtatttggtagatcataagaggaagaaataaggaattaaaattggtgatggctactagagactcttcttcacggagggtttaacctaattaagctcttaagccaaggagatgacccaataaatatatgtttaaagtaggagacacggaaacagctcccacgttcctcactttctctctctttttcttccctctatctctcatctcaccaacactaataaacaacaaccaagtttatatgatatttaaaatgtgtaaaagagttatatctccgaggaataatcaaatataagttttttttttctctctttctctctcccttgtgatcctccataaatcctatcatcaagtactcccctaaagaatcctttttctcttcctaatattactctttgtagtgagtagtggccaaaagtttccatctcccaaagctgactttcagttgagtcctcatggtaggttactacttcttcaattctataccatcttaagtagtgaaattacctcaatcatcgtaccgaattccttatatttgtaccctttatcctcatcttggctccttggtacttaattatagatttaatggtggatgtaggaaacagttgaattatg

SEQ ID NO: 14003 - DNA, 3000 bp, Unknown
  misc_feature (1)..( 3000): cDNA_ID_3021290_gDNA_ID_2214690_Annot_ID_189386 3000 nt of promoter + ATG
ggttctttggggtttgtccaaagaaccaagcttttattctgtagtttttctttgtgttttagaatcttgaaatattaattactcttaatctatttagttgttgtatttagttctttgagcaaagttgtttatcttgtttagatatacatttatgggtttgtgtgttgattatgttgcttgagtagtgattaaagttcttgaggatggatagattagggtaatctctaggatagtcaggtggttaagattaggttatatcccttctggattcgttggccttaatgcttatttcactcagtttagactggaattcgacccaaaagacgttcaaatcgatgcctgatctaggaattctagagatttgtagattctatcccaagagattggatgtttagactacttaatgacttttgatagattgttccttaaagcatgctttgctatgtttcatcaacgagagttgagattaggaactggtaaagttatgaggatcattgtcacgagagtggattgatctggttttgaatctattgtctagggtatttgcctttcgcctgttagccacctgatgaaccctagagttgcccttatcaatgaattcatccttaggacttctattcttcttagatttatttgtattcaccccttgattgcacttttatttacctgttatttcattcacctgttgagttacctgttatttcattcacctgttgagttacctgtttttgcattttatttcttaaatttgttacatgttggttccactcgacccaatgatcgagtagggcacttaagttctcacttttgttgtttgaatcctttaggattgttactagaatcccaccatcattataacatggcttgacttagttgcttctatacacatcttgattgctagcaataacagtggactggtttgacaccccctatagctgcatcgacatgttagtgtttaaggagaaattgaactaaacatcacattcaccatagttaggcctaaaaatctaactatcaatttgacgtcgttgctaattcattgttgcatggttacattcaagataccagaaaaagttaagatcaagttcttttacattactcaagttactaactcatcttttcgtctgcttgtttttgtggtataggtactaatatttgtgcatgcacactcggtccaaaggatctgcacacctactacctttcaaagacagaattgacagactagctcgtgagttataagaaacaaaagcaaaggaagactgtgatcaacaaagaccagctcctacggatcaacagaaaagaggagttgagatacaagacccacctaatgttgatcaaccaagaaacattggtgctggtgatgtcccaaggaatcatcaccaaagacaaggaatagtgccaccacctgttcagaacaacaactttgaaatcaatagtggtctcatctccatgatccaaggaaacaaatttcatggttttcccatggtagacctcttggaccatcttgacagttttgataggctctttagccttaccaagatcagtggtgtcactgaagatgggtttaaactaaaactatttcccttctctttgggagacaaggcacaccactaggagaagactctgcctctagactccatcaattcatgggatgattgtaagaaagcttttcttgccaagttcttctctaatgctcgcacagctagattgaggaacgcgatctcaggcttcaccgagaaaaacgatgaaacttttgtgaagcttgggagaggtttaaaggatacaccactcagtacccccatcacagttttaagagagcttccatattgagcacactctacagaggagctttaccaaagatccgcatactgctcgacactgcttccaatggaaacttcatgaacaaggatgtagaagaagtatgggagttagtcgaaaatctggcaaaatctcatggatgctacaatgaggattatgatctctcagtgagaggaactggagaaactgaagatagacaaaagaaggatatcaaggccctcaatgaaaagctagacaaactcttattgactcagcagaagcagatacgctacattactgatgaagagcacttccaaatgcaagaaggggggaatgatcaaactgaagagatcagctatattcaaaactaagaagggttcaacaagggctacaacaactacaagcccaacccaaacctctcatacagaagcactatgtagccaacccccaagatcaagtgtatcccccgcaacagaatcagtctaagcctttttgttcaatacaaccaaggttatgcctctaagcagcagttcaatggaggataccaacagccaaatcaaccaccagggttcactcaacaaccaaagcagacagcaggagcacaagatcctgacacaaagcagatgcttcaacaaatcattcacggtcaaactactggcgctgtagttctggaaaaacgattggcttagataaatagtaaagttgattgttcctacaatgagctaagaagcaaatatgaggatctaatatccaagatgatatacaaggaaagccaagctgcttccaatacgtcctccaagtatccagggccacattcaggaaaagccattcacaaccctaaagaatatgcacatgcagttacacttcgcagtggcaagaaactgctcaataatcagaccaaagagagatcactaaggatagtgaacttcaagaaggggaggatccacataaaaacgaagttcaaattgatgaaccaactaaacttgatcagccttcagcttcactcgaccctctactcgatcgagcaaagctaacttttgaagaaagaaaagatgcggttgtagaaaagaataaagaaattcgctccgccaccctacaaaccgacggtgcctttccctggaagattcaagaaggaattaacaaagaaatacaaaagccctttttgataagcaactaaaggagattgaattaagaatgccatta

SEQ ID NO: 14004 - DNA, 3000 bp, Unknown
  misc_feature (1)..( 3000): cDNA_ID_3021330_gDNA_ID_2214691_Annot_ID_189398 3000 nt of promoter + ATG
gtaggtttaatgattacttcataggtttgtcgcccacttcctcctatttatactcgattaaaccctcgagaattcactttccgccgcttgcaagaagaatcaaaggtagctctcattcttctccctgcgaattatttttcgttctccgtacttttatcgaattttctgataatgggtaagactatcatcgtttcctcctcctcttcctcttccgatagcgaaactacaatgttagtttgccataaatctcgattcgtagaaaatcaaagagccgaggcccaatctagtcgggctaatcaaattgagattccgaggttgatagatgaatcagatcgggatggcgatgacggtaatccggctatccttccagaagaaccggtaaactatctggatcgattcaaacccctcatcgatctggaagtcgcttacaacgtcaatccgagatattcagaagctgaagtcgtggcgaggtccaattaagaccgccgaatttgatcttgatccggttgtcgactagaacagtgagatcactgcgagtgaaactctctcaaaagaagaatccgtcgtcgaactgctttcttcttgtgggtgtggagatcgcccaatcatatacatgattcctggtgcagacgattgtccctggagtcctcccaaggggtatgtttgcttatacgaggcctacttcaggcaatgccacctctggtttccaatcccgtccttaatcatttctttcctcactcgccgtcgtatggcgatctcccaacttactccagcagcaatctgtaatttcgtcgctgccttgacttttggtgctaaggaaggctatcgagtgaacgttgaagagctgacaacgatgaaaaccagtaggtcgcctggatactaggtggtaaacaatcgccccaaatataacttcctccctggccctaaggttagcaatttcaagaactgggaggagttctacttctttgttagggctgatcttgaatcttacgagagtccgttctcgggaaggaagaggatgtgggcagaggatcctggtagacttctcttaaacagataggacttgaaagatcttgattttgaactcgttctcataatttctcttcatattgcagatcgctacaaggccagcccaaaatttccttctgagttcctagaggttagagaggcgatcttccgagctcacaatcgtacgtagagaagtatcacccggtcgcgagtgatataacccgattttcaccgattttatctatgttttatgtataggattttgagtctttatgttatttctcgggtctttttagtgtcttttcaggtattctatgcaatgggacaacaatggagataaggagacattttggagcaaaatctaaggaaaaggaagttaaggacgattttggttcaggaatcagcgaggagtgtcgaccgacacactcttggtgtcgatcgacaccagtttcagcccagcaaaaaccctagacgctttcgagtttccagaaactcaagtttgccccagaagacttccctatttgcattattagtctctggacgtttttagggtctatatatattgtttttagacctaagtttcgtttattaagtcttttatcaagttctttgcaaaaccctattgtgagagacataagctattcattcgttgttcttcagagtttcattcagatcgatatatagtgaagagatcccttctttcccattctctatttactgtgtttatgctttttaactcaatgcatatttattgtctggatttaagatctagttaattactctagatctagcattaagaacaatcaaagatgaagaattctatagataacctagcaaagggggcaatctactaaaccatatgaatccttaatgagaaaccctattactaacaagcagattactcagacatattggattgatgagtctggtttatatgtgtgtaataagaatcggcctatttactaagatgaacaattgaactcgttaaaaatgcatatttaggttgatagtctctcggcttctccggtcactattagctatagatatagggagtttggcggcacgcccactggttattccataattagagtttgagtttaagaatggtttgataacaacctagctttcattagatctactaaccaatagtttcctgagaataccctgttcctagctctttattaaatcgtttacaacccaatcaatctgctgttttcttaatttcattttcttactatttcactcataccctgctagcttaatcttgacatttaactcactgtttgaaagaagaactccgtgaattcgatcctaaaatactacaattgatctcttatttgagagagtagttctaggtaatttgaaccatatcaaatttggtgccgttgccggggttcttaggaatcatcattgagtttactcacgcgttttttgttttcttcttttctgtgtttcaggtgtatgcctaggcaaacaaggagcacaaaacagaaggagcttatcaacttgtctgttctggacttagaaaaacttgaacgcaccaacagaaaaactcagaaattagcaatggttgacagagtcatcagaggctggtcagagattggatgatcatggactcatcctacctgaggacgccaatgaggatcaggcgcgcctcaatgcgcaattagctgctagagacgcagctgggcttggtgtcgaccgacaccaactgggtgttgatcgacaccatcgagagcagcacacagatacaatcggtgtcgaacgacacaacagaggtgtcgatcgacaccaacaccagattcctgcagctattcctccagctgcggaaccacgtcgtactcttggggatttcaacaggccagacctgttctagctaatcgatcagcgattgtacccccaccattccaaaggaacaactatgtgcttaagcctgcctactttgctttagttagccagcatcctttccatggcttatctcatgagcagcca

SEQ ID NO: 14005 - DNA, 3000 bp, Unknown
  misc_feature (1)..( 3000): cDNA_ID_2705814_gDNA_ID_2214692_Annot_ID_136729 3000 nt of promoter + ATG
ctaagaaagctctgtgacttttagatgggttctcggatgaaaaaatcggtattcgatgaacaaacgtcaaaagcactcaagaaatggagaatggcagtgaagaagaagaaaggtgtgaaagccactactaagagactaggtggagatggaagtgcgagccctacggcatcgacagttaggtctacttcgtctgtacgttcattgcagcgttacaaaaccacaccacattcgatgagatacgaaggacttgaccctgaaacatcggatctcgacacagataatgaagctttgactcctcccaaatctcctccaagcttcgagcttgttgtgaaagttgaaccaaataagaccaataccggtgagactagccgtgacactgaaactgattctaaagagttctctttcgtcaagcctgctccgagtaatgaatcatctcaagaccggtgagactagtcaggattgtgaaggtgtagcctgcgccaagtaaagacttcttttcgagttaagcctgcgccaagtaaagaaccatcgtagtaaagatgtgtcactccagagtttttttttttttggtttcatttatctaatgctattgtaaatcaatgccgtggcgataaagtaatgtattgatgaccatattaattaaaataggctgaagaaaatgagggacaaatattaagaatcagtttagtaaaaaggttaaaagactcgtgtaaagctcgaaacgattttccagctggttctcaaatatctgttacaacataaggccactttcttctcctcgtcaattaatagactcgtgtaaagctcgaaaccattaccaccaatgggtaaatccactgtagagaatttgctccacaacaaagcaacttcatcagtatctacgtactttcttggttacatatatctccatcttcgattcatcaatccgatgtaacagtgagagtttttcttctctatcaactgatagagccatataatcacggttcagaaatggcggaagacaaaaatgtttaagcagtaaaatgttcatataaatctctcggttgtaaaatcaaaactgtgtaagcagtaccttttaagccaataagcatttccgatcccttcaaagacaaaccattagcagatgatggaaagcagtcggagggaggacatcaagaaacctccatgaatcagagctaagctcatagatttcataccccaaaacttggttgtctggcatcatcattttgtaccgtttctcccaaagtaagaaacggtacaatcttctcttatatagatttcataccccaaaaccctaaattcattagggttttcaaaaaaaaaaatcacgtttacctctaaaccaatcttctcttatatagataaatcataacgtttgtttgatttttcagttttctacttaaccaatattaaactaaagtcgaattgagatgagtggtagcaaaccacagtttaattaagaagttaattataggccacatgattgagcaagcctttttgttttgtaacacatcttatcagctgcttaaaattttggctgcctcccattggccaactggtctaaacatcattgcattggcattctcataatcaatcaatctaatgagaaactttgaatatttatgaaaaactgaataacaacataacataaacgaacaatgtaaaaaagaaaaacacaaaaaaaaaaacactttaaaaaacaaaaaccaaaaactcttaaactataaactcatgaacacttagtgatgaggtctgaaagggtgtaaccaccacctgttgtcaataggtgacaacttcttcttgggaacattcgggaaagtgaaggcttaggtgacggttgtcttaaaagtctcttttagttaattcatcgtattttcgatgggcattacgtttgatgcataaaggcccatatgggctatacatgtactgcgtttgagtggctttctaaggattgatgtattgtctctatgagagtattcgtttaactcatggagatctactctccacgatattttctgtaaacttttctttttgttgattagataaatagaaaattgtgtagagcgaaacttttaatgaattaaaatgcggaagcgattaaagcatgaatagataaattggacaagagattaaacgagggatcatctagtttttacactgatcactagtcatctgcttgcagaagaagtatatcattaatcaagcaaaacgagggcataaatttcttacaaataacttttacagtaggttaatgattttttaataacttgtccatttcacatgcatgtgtatctttgtactatacatgctaagtgtttcattaatcaagataaacgtgtctacgaataacttaaaacagtacaacttccctaaaaaattcattaaatgaaaggtttttatagattatacattgcacggtacggttcggttaccattcgaagtctaaaaagagaatgacggttctgataatgcttttaatcgcttttgtattgtaaatcattaaaacagtaagccggataccgaattactaatcagacccaaaaaagaatctataggaaaaatatcaactgaagagcgggtaggcttgaccttgaaaggaagaatggtgagcgagcggtggatagatatgtaataaattgtaacgctttcaaaatgtcaaagtcacaagtcacattactcacgagccaacactaaccatgcaacttttgttttgacattttcctaaactttaggtataaaatacccgcgtaataaataacctcttcataattgggtccacccactcacaggtccacacataaggaaccgaaaaaggtaaaattcaaaaacttacaaagttttttagagatgatgtggtgaagtattgcattaatggaataatgggaaaagaaagtaattgcaacgtacgtatagattaatccattgacacaaatgaaaagtttctttctatttaatgtacacaacaaaggttctcttcagagtaatttaggggaaaaaatg

SEQ ID NO: 14006 - DNA, 3000 bp, Unknown
  misc_feature (1)..( 3000): cDNA_ID_2710808_gDNA_ID_2214692_Annot_ID_136730 3000 nt of promoter + ATG
caacatgcaatgctttgttttactttatttggttaggtgaagaaagacaaaagcaacattgcctttttcattaccaaaactttcaatataagacatccacaaatccgcaggaatagacaaaataaagtgtaccaatatcaataatttttttggttggaaaataattatgtatgtttaactgatttgaatatactaacaatataatcattttgtcagaaagaggttttagattttgattaagaaatatgaaaaagaaagccaaaatatgctaaagatttatgttctagacagaatgtgaaacaaattagaaagtgatatcaaataaactaataaagcatagaaagcaaaaaaaaaagaaaggatttaaaggagaacaccaatagtctttcccagtctctaacagtctaactttctgctatctttatgctgttcgtagccataaagtaatacaattatgacctgaatgaagagattaaatgagtattcttaatattaacgacataagattttaaaatgctcttcaagaaattccatatagtaggtttaaatggtaaccattaggttatgtccaacggaaaggcaaaacgctattttaacgtggcaatgttaattttttgtctccaaccaaatggtatttttggtgtgtgactgtaacaactgcataattaaaaaacttattcttttttccttttcattttattatatatttaaaaaaattatctaattatagtagataaaatataatttgtattgttatttaataatctaattaagttttgtaactaaaaaacaatgtatcaaaattatttttgtattttttagttttaaatatctgaattataattagaaaaaatattaaaataagtacgaaattgattaacaatacataaattttttaattaatcattaaaaacatagaacttttaactcgacataaacaaattaaagatcaagaagctcatattaaactttgaaatattaattgactatttctggtcggcatagactaatagtatgatgtaatttatttgtacaattttgatttttgatttttatttatattaattaataagtaaaaaaggataatttttaatttagtaatataatgatagaggatattatatttagtgtgatttttggtgttgtggttagagaagggaaaaaaattaatgctaaatttacaccaaataaagtgttatttcaacactaaaatagtgttagggtgatgcccttatcaaagaggtaccactttgaatagttttgacagttatcaaccacaaaagttttatcaaatacggtacaaatttttttactcttacctttttttgtacaattttctcttacaaatcttttatacaattttgtactattctgaaaaagcttacaactccagttaaccgcttaaatttctggacaattttgtgttatgaatcgaacctagtattcattgctcataagtatcgaaagtaaattaaattgtagatcaactagcaaaacatactgtattaagggaaaaaactttcgattttgttgaagttatataacatagattgtgcaaaatacaattaatcaaagccatcaattttgagattccttagaagtgagattccctatcatattttgatcttatttttctactgttcaaaaaattaggtcttatttcatatctttaaaaaactttataccagtcctgatttaaaagtataaatgagaaaaaattgtataaaaaagattatctaacacggatttatttattatattattatgtaatggctagatgctagatcgaatcgcgttagttatgactcctttacatattttcgatggctgtagcatgatgtcaatcttagcctatctagtagttatgtgatgcgtcacatatgttaaaagtatgtatgtcagacatgatcaaggtctaaaggtggaaattgctctatcatatgtggtagaagaaaggaattaaaatagtttgatgaatcatttgacatacgagtaaaacatttttaagaatttaagaacttgttaactatgatatttttcaataaaaattaacttaatacaaatagtttatatattaaaagagagtcattgttgttatgtggcaagtccataattttgttcatcaacatctttttttcatttttggattcattatatacttctttttaccaaagacatttattcaaatatttagtcttatatataaatatttattctctattcctatcaaaaaataaaaatatttattctgtattaagtgcattgagtatttcaattgaaaaaaaaaatatttctttcctaaattatataattgtatacatatttttcctataaatagaggtatcatttaacacacacatcatttttccctagattgttttttttttaaataactattttattaatttcgatatgcaatcaaatttctaagaatccaaagttacgaaatttagttacatattcgaatacaaaaactactaaaaatgtatgtatcaaaacatccattttcttatagtttccaaatattgatattgcttaagtcaaagacaatcacagtttctcaatcaaagccacaattcactgctttcaaccttttttaaaaaactatctcacgcgctttaattcgcactctcctctctctttcttcttcctctgtcctaaaaaccataaatgacaataaataaagagtttagtcattttatcgtaaaaccaaaagaaagagaaaaagattaatcatcatcaatctaaagatttaggaatctacaatttcccagtagacagatttcacttttgcgtcttcttcttattccatttgatctaagtttctcgaaataggtacaaagttcgagtctttttcttgtaaccgcgtgaaaccaccaagaaacctatagtaagagtttccgcaaatgtgaattaaagacagctcatcactctgtcaaacttctacagtattaagttaacgaagcaggtacagccaaactaaaataacgcggagttatg

SEQ ID NO: 14007 - DNA, 3000 bp, Unknown
  misc_feature (1)..( 3000): cDNA_ID_2705834_gDNA_ID_2214692_Annot_ID_136732 3000 nt of promoter + ATG
gatatcataagttctaatgagtaatgattggtcaatttatcttgttgtaaattgttcaatatacgtgacgtggtccacttctatcctccaagactccagctacacaaagacacagtaacacaaacgcatacgcatatgcatgtgtcgtgtctttgtgtgtgtatgttgtatatattaatatattatctaaactataccattttcatgaaatttataatatattttctcaaatgatttaagaagataatgatatgtttacgagagtaaaaaaattaatgatcttccagtaatcaataaatatagtaaattgatatcagatcttgttgccaactatagaattgaacaaaatacaaaactgtcatcgccatgttatattatcgtaaagccagcttatatatccttccccattggtgttttttatttttactttgtttggtgaatattaaagcgcttaaaacacgttccaacagaataattgtttgacctttttagtttatctgatttttaatatcaattcttaaaaacatctcctcaatctttgcgtaatttgtcttttcctaatgcatcggatagagatagattcttctgagttcttgcatggttcaggtactttctattcgtttcttaatacgtgttctttcttttcggatgaaacataattcatcgatcgatcgatatgtataagtctgataaaaacttgatcgttgcttttgatcattactagtaaaacatctcaataaatcacataacatgtttcacgttttgaatcggtttttcagccttgttgtttcagatttgattgatacgaattttaatcattattattgcaaaaattcatatttaaatttgagatgtttttataatatacatgcttaagattcataccaataattaagttcaataatctagatatggtttagaaactttagatatatagagatgctgatgacatgatgaaggtgatgatcgattgatcgtttattcatttgtcatatatatgagttgtaggaaaaacatcttatgaatttagatccattaaatacgcttatatgcatgtgtgcatgttcaatgtgtagataagttctattctgaataaattgacgaataacaattattgatttcaatttcgttttgagtgtgcatgtcatgtgtctgagatatgggaaaatgaaaaggaaacttccctatatataccgaaacaatagactatcaactttgatctatatatacaaattgtagaaaagccttggatctaactgatatttccttatgtgagatacacattaatgtcttttgttttgcttcttaagattaacgtgttatatattatctctttattttaaaacatgttgaccaaaataatttatgtcttacgtgttgcatatgaaatagatccaatcgaatcagcctcccatatcttgaatctttgatatttggggtctaccattgatatgatttactttgttaattacttgatgttaatatttcattttttcttaagaaattgtaaactaattctttacatatatgcatggcaattaacttagtcaacaggttcaacattttataatgtatccagaatcccagatagtacctgtcctgataaaaccttttcaggatctcatgatatttcttaaaatataacagcttagtgattttaaataacataaaaattagccgacaaaaagaaaatatcataatataattctgaaaataactaataatttactcttttcaagtaattattcaaaataaatttagaaaactaattcaatgtatttcctcattgtcactcttttatttccctctacaaaattatatatatgaagtagttttttttaaaatagagccccataactaacattaggggtccatatatttgcattgtaatttataaacacgtgtagaacattataattatttaaaataaaatttagaacaataacttaatgtatttcctcctcgttagttttcctttttttccctctacaaaattacatatatggaatagttgttctttacttcttttaagtagagccccttaactaacacattaggggtccatatatttgcattataatttataaacacgtgtagaacctggcactgaagtctgatgaatatatatccatttgttttcacaactaccctagctttttgtatcatcggttactttttttttatcacaagaaatttctcgattttgattttgatttttcaatgttgtgaagttgagaagttcaacatgttttggacagatgtttttgaacagtaaattagtattttaaacatgtgaatctatttgcaaacgtaatgacgtgtcgtctgaccatttcttgaatgttagttaattttttagctctagttttgattaatctaccaattaggtcattcatttcagtttaagtcaaatcaacaattaggctcgtcctaacgttttcatttagccaaaacaaaaaaaaagatttcaacagtataaataattcgtccttatcaaaaaattaataaataaaaaagatatacatcattacttacgtaattgtttgtattttgatagttttcgataatttctatgtgacggtttttaaaataaaaataaatgttgaataacaaaaaatagtagtacaatagaatactgaattggtttgtgtagggtcaaaccaacaaatatggaaagaaaagtattatttagttacaacgtgaaaacacaggttcgtgctactactccaatgatacgggtctcaaaatactcaaaactctggcatgtctcaattccacaaattattgtttaatcattctgcttcttctgtaagtttatatataaatgtgtatatactcaacgtaaatatttgcttacctcgtatattttctctcttctcaggcttattaattctctgcagataactgcagaagaaagaagaaagaagaagaagaagagattagagcttgagccataatatataatcccttgatcattagtctaaagaaccacataaaaag

SEQ ID NO: 14008 - DNA, 3000 bp, Unknown
  misc_feature (1)..( 3000): cDNA_ID_2710800_gDNA_ID_2214692_Annot_ID_136733 3000 nt of promoter + ATG
tggaaggtccagctttcaaactaacatcactgcccctcgacgaaaactttttaatgaaaacagagacaacaacacctagaagcactaaaggggccaataactttactggtgaccattgtccaaacaaatatgtatatttctgcttatgttgctcttgtaactttcttgactctctggcttttccaaaaggcatgatgctgttttcgctctcgaagtgatttagggaaggggagggtagcattttcacattcattggctgatcatggagcaccctgataacaatttctgggccacgaacgtcaatttgtgatccacataacaatggcatataaattccagtttgaagtttaggaccgaggtcatagccagaattgaaaacaggatcacatagtaaagcagctctgaagtgagaaaccgtcaaattccagacaagcttcccagtggttttactaaaatgctcaagtttggaatctgttcgcctgataagaagaggttcattcacaaaatcttcagtgctagcgggcttcacgagagcattagtaatcttagtatctccagttgatttgtaaacatgaatcagcctccctgatctaccatcaaccaaataggcactagttgtttctgatccaagagtcacaccatcatctgttacaagtggcttctgcctaaaaaactcctgaactgtctgcagtgaatatgtgccgaaacaaagttaagataaacaaagtccagtaataatgaagtaaagagagagatgcttcatacccaattatgatagccatcgacagtagtagccgcctttgagttgttcagatattcaacaattatgtgaggacgagttatctcagtagcattttctgtgttgttattagcaggagcctgatataacgagtgcattggtgatcctgttgaaaaggaccagtatggtgtttctttcggttgctgctttaaaaacaccttcccatcacgatcaacaacaagtttcgtatttggctctgttggtggttcactgagtagaagacagataacatcacaaccagtaaccacatagagaagaatcaaaaacatctatcaaaatgtaatcaaaccaattcttgccaccaccaaaacctaatcactagtccatcacgtttacaatgctaatgatacctaaaacagtgtcaccagaatcaaatactaactaagtatttttaaacatgcagaggatggaagaaactcaccgacgaatctgcaaaattgatctgcggccgggactagatggaacgatcggatacgtcacatcgtcggcagcgccgccgcaaggagacatgatccatggtgagagtaatagtagtaagaagaaaagatggcggaggaaaggacatctcggcggcatggtccggatcaattatggagaatccgaacagagatagagatgatgatgatgatcagctgtgaaaaaacagaggaggacgagtcaatcatcgaatttaagaattgggagataaaagataagagaaagggttttcgaatttacctaagagtgaagtcaacgatggatcggagataagatgcgaagctttagtctgaggctgcggtttagggatctccgtctctgtccggcgagtttctcctcccttgcccccacccttagtgtgtctaacgcgttctccttttgaatcttcttaacaaaaaaatattttaatggaaaaaaatacaaaagttttttttttttttttaaacccccacgaacgaaccaaacactgttttgcttcgagtaaggtttgtctgaggctgcggtttaaggatcttcgtgtgccccaccgtactgtccagctaacttattcggccgagccgagccaatatgcgttaagctttttggtcttctaaacaccttttgctatcaacaaattcgagtgaaaatatcactaaaattactaattgtgttaaaaaaaacaaattttcatattgttaaaggtaaataaatcacattttcttttgttaaaggtaaaacaatcacatatacattagacatagtggcaaaaattgtgacgattatttttggtttaatcgtacttcttatcatataattttgtgtttatttcagtgtttaagaaaatgttaggcgcttagctggcggtgaccctccgcttagcgcatagaacgcttagtcgaggcctagacaattttagccggtttaatcggttttagaataaaacgatatatatttatatactattatctgaactgttgcaaaaactattataaaaaacggaaattatcaaatttttaaaaataaatttaaaatttaacattttagtaaaataaaataaaataataaaaagtataggtgtccttaaaattatttaaaatatatttttgaaatttttaaaaaatattaagagacgattagatccgcctagcctaacccacctaatgagagtctaatccgcttaatgtttacatagtctgccaaatctatctcactgattaatagaaccgattttgaaaaagtcaaaacggtataaaagcgtttagtgcctaggcgtcctagacgacgcctatcccactttattgaacactgatttatttactagaaattgtatcggtataattggagatgcatcattaaaaaaatttctatgagatcaaggtaaatgatcttaggtatgcaatattatcttgcaaaaattggttagttttggttaaaataaaaagagtgtttttgacctttttccatcaagagtaataccgagtttactagctgtattgctgtgtttacttcggtttaatcagattgagccggttagagaaaaagtaactaaaccggttttaaccgtcatcgtttcgttaaccatgaacgaataaggagctatagaattgaaaattttagtagtcaagttggctggcttaggtttaaatttaaaggctttaaaaagcttcttcctctcttccgttctgacgactgaaatcttcttcaccggcgaaatcgaaaagttttccagcaagaaattgaagatg

SEQ ID NO: 14009 - DNA, 3000 bp, Unknown
  misc_feature (1)..( 3000): cDNA_ID_2710796_gDNA_ID_2214692_Annot_ID_136734 3000 nt of promoter + ATG
cctttaaatttaaacctaagccagccaacttgactactaaaattttcaattctatagctccttattcgttcatggttaacgaaacgatgacggttaaaaccggtttagttactttttctctaaccggctcaatctgattaaaccgaagtaaacacagcaatacagctagtaaactcggtattactcttgatggaaaaaggtcaaaaacactctttttattttaaccaaaactaaccaatttttgcaagataatattgcatacctaagatcatttaccttgatctcatagaaatttttttaatgatgcatctccaattataccgatacaatttctagtaaataaatcagtgttcaataaagtgggataggcgtcgtctaggacgcctaggcactaaacgcttttataccgttttgactttttcaaaatcggttctattaatcagtgagatagatttggcagactatgtaaacattaagcggattagactctcattaggtgggttaggctaggcggatctaatcgtctcttaatattttttaaaaatttcaaaaatatattttaaataattttaaggacacctatactttttattattttattttattttactaaaatgttaaattttaaatttatttttaaaaatttgataatttccgttttttataatagtttttgcaacagttcagataatagtatataaatatatatcgttttattctaaaaccgattaaaccggctaaaattgtctaggcctcgactaagcgttctatgcgctaagcggagggtcaccgccagctaagcgcctaacattttcttaaacactgaaataaacacaaaattatatgataagaagtacgattaaaccaaaaataatcgtcacaatttttgccactatgtctaatgtatatgtgattgttttacctttaacaaaagaaaatgtgatttatttacctttaacaatatgaaaatttgttttttttaacacaattagtaattttagtgatattttcactcgaatttgttgatagcaaaaggtgtttagaagaccaaaaagcttaacgcatattggctcggctcggccgaataagttagctggacagtacggtggggcacacgaagatccttaaaccgcagcctcagacaaaccttactcgaagcaaaacagtgtttggttcgttcgtgggggtttaaaaaaaaaaaaaaaacttttgtatttttttccattaaaatatttttttgttaagaagattcaaaaggagaacgcgttagacacactaagggtgggggcaagggaggagaaactcgccggacagagacggagatccctaaaccgcagcctcagactaaagcttcgcatcttatctccgatccatcgttgacttcactcttaggtaaattcgaaaaccctttctcttatcttttatctcccaattcttaaattcgatgattgactcgtcctcctctgttttttcacagctgatcatcatcatcatctctatctctgttcggattctccataattgatccggaccatgccgccgagatgtcctttcctccgccatcttttcttcttactactattactctcaccatggatcatgtctccttgcggcggcgctgccgacgatgtgacgtatccgatcgttccatctagtcccggccgcagatcaattttgcagattcgtcggtgagtttcttccatcctctgcatgtttaaaaatacttagttagtatttgattctggtgacactgttttaggtatcattagcattgtaaacgtgatggactagtgattaggttttggtggtggcaagaattggtttgattacattttgatagatgtttttgattcttctctatgtggttactggttgtgatgttatctgtcttctactcagtgaaccaccaacagagccaaatacgaaacttgttgttgatcgtgatgggaaggtgtttttaaagcagcaaccgaaagaaacaccatactggtccttttcaacaggatcaccaatgcactcgttatatcaggctcctgctaataacaacacagaaaatgctactgagataactcgtcctcacataattgttgaatatctgaacaactcaaaggcggctactactgtcgatggctatcataattgggtatgaagcatctctctctttacttcattattactggactttgtttatcttaactttgtttcggcacatattcactgcagacagttcaggagttttttaggcagaagccacttgtaacagatgatggtgtgactcttggatcagaaacaactagtgcctatttggttgatggtagatcagggaggctgattcatgtttacaaatcaactggagatactaagattactaatgctctcgtgaagcccgctagcactgaagattttgtgaatgaacctcttcttatcaggcgaacagattccaaacttgagcattttagtaaaaccactgggaagcttgtctggaatttgacggtttctcacttcagagctgctttactatgtgatcctgttttcaattctggctatgacctcggtcctaaacttcaaactggaatttatatgccattgttatgtggatcacaaattgacgttcgtggcccagaaattgttatcagggtgctccatgatcagccaatgaatgtgaaaatgctaccctccccttccctaaatcacttcgagagcgaaaacagcatcatgccttttggaaaagccagagagtcaagaaagttacaagagcaacataagcagaaatatacatatttgtttggacaatggtcaccagtaaagttattggcccctttagtgcttctaggtgttgttgtctctgttttcattaaaaagttttcgtcgaggggcagtgatgttagtttgaaagctggaccttccaaaaagaagaagaaccgtaaatccgcgaaggatacaaataggcagtcagttcctcgtggccaggatcagttcgagctcattgaaggaggtcaa

SEQ ID NO: 14010 - DNA, 3000 bp, Unknown
  misc_feature (1)..( 3000): cDNA_ID_2710792_gDNA_ID_2214692_Annot_ID_136735 3000 nt of promoter + ATG
tcatcgcccattaaaaaaaatagatattaagaatttgagttttataaaaaaataaaaattcaatgcattggatattactaaaaggaaactatagttggagtcttcttattacgattttaattatatatagttggccatttttcttcgaatctaaattacggacccatgaggaaaatgaccgttgtctccgaacgggcttcgtgggcttattgtttgtaaactcacggcccattgacgtcttcttatttgattcaagaccagaaaccacgttttgtactgtagtcttgaattgctctgttctgctgatagaatagcaaagttctgttctgctgataaattagcaaagtaaatcttgaatgctagtttgtctttttctctcatgttatgtgtaagaagatgatgatgactctgttaggtaagaaagtccaactttgtaatctaatcagatttagtctctaattgtttacttgtgtctacatataaaagttgcaagttgcagatgttaagaactaagaagtggtatctgcagattttgggtattaaggaaagtttccccctttgaataaataaggacatatactaatgtaaaggttcctcctttttcacaaatcaaaatgtgtttctttgtgttctagtgaaatccaatccattgtgtctctgatgctgagaatcttgaagctttcgacatcttctcgatctgtgccattgacaagattatggcttcttcaactgccttgtttctgctcatcttcttcatcatcgtcttctttgctttctgtgcccagcgatgatcatatcgtccgtctcattctagaccagaaatcagcttctggagctttggaaacttttcgatgggcttcgacttttcctgggtttatccattctcgttccacttaccgtgctctgtttcataaactttgtgttttccgacgttttgatactgtctaccaactgctcgacgaaatgcctgactcaattggtttgcctccggatgatgctatttttgtaactatcattagagggtttgggcgtgctcggttgatcaaacgtgtgattagtgttgttgatctagtttcgaaatttgggatcaaaccatctctgaaagttttcaattcgattctggatgttttggttaaagaagacattgacatagctagagagttttttacaaggaagatgatggctagtgggattcatggtgatgtgtatacatatgggattttgatgaaagggctttctttaacgaataggattggtgatggttttaagcttcttcagatcatgaagacaagtggtgtggctccaaacgctgtggtttataacactttgcttcatgctctttgtaagaatgggaaagtcgggagagctaggagtttaatgagtgaaatgaaggaaccaaatgatgtaactttcaacattttgatttctgcgtactgcaatgagcagaagttgattcagtcaatggtgttgttggagaaatgttttagtttgggttttgttccggatgttgtgacggtaactaaggtgatggaggttctctgcaatgaaggccgtgtgtctgaggcactcgaggttttggagagagtggaaagcaaaggaggtaaagtcgatgttgtagcttgtaacactttggttaaagggtattgtgcgctagggaaaatgagagttgctcaacggttctttatagagatggagagaaaaggttacttgcctaatgtggaaacatacaacttgttgatagctgggtattgtgatgttggaatgttggattcagctcttgacactttcaatgatatgaaaacagatgcgattagatggaactttgctacatttaacacgttgatcagagggctttcaataggggggaggacagacgatggtttaaagatattagaaatgatgcaggacagcgataccgttcatggggccagaatcgacccttacaattgtgttatttatggcttttacaaggaaaaccgttgggaggacgccctggaattcctcttaaagatggagaaactttttccgagggcagttgacaggagcttcaagttgataagtttatgcgagaaaggcggtatggatgatttaaagacggcctatgatcagatgattggagaaggaggagttcctagcattatagtatcccattgcttgattcatagatacagccaacatggcaaaatagaagaatcacttgagcttattaacgacatggtgaccagaggctatttgcctcgatcatcaacattcaatgctgtgattatcgggttctgtaagcaagacaaagtcatgaatggtattaagttcgtggaagacatggctgaaagaggttgcgttcctgatacagagagctacaatccattgctcgaagagttgtgcgtgaagggtgatattcagaaggcttggttgcttttctcacgaatggtggagaagagtattgtccctgatccttctatgtggagttcactgatgttttgtctcagccagaaaaccgcaatccacgtaaactcctcattgcaggacataatccaaagttaaaagctagaggcagtgacataaatgatcattgagctcgaacttgaggcctttaataatgcatctgcaacaaatacgaagatggctccaaactagcaagcagagagatcaagatggtacgtttgcttcttttgaaaatctgttaaaagctttgggagaaaaggagaatgcctaaaatcagaagaggcagattttaaacaagaccatgagagaagggcaaaatggagaattggacatcgtcaaaatgggaaaatgtttgaagcacacccatcaataaaaaaaggacaagaggagcaaaaagaggagagagtcttacgtttcgtgctattcctctctctctcttttatctctctttctcgagaaaactaaagaaaagggggctcttttattcaaagatccaaactttgacaattcaaaatccaacatagaacacggatcaagctttcaaattcagacagagat

SEQ ID NO: 14011 - DNA, 3000 bp, Unknown
  misc_feature (1)..( 3000): cDNA_ID_3021353_gDNA_ID_2214692_Annot_ID_189423 3000 nt of promoter + ATG
agaagaagaagaagatcgttagagaattgtttgactcggactgagtttggggaaaacggtaggagcgagtttttacctttaggttttttttttttgtttgacgagagagcgtatgagtgagtaataggattttttttttgggggggctttagatgcgatattataataataaaataatatctatttttaaaataaaggcgacttgaaattttgcactgtggcgggattttttcgtgaaggagcgaaataatttgacacgtatgggaaagaagagcaacggacggaataatggattgtgctcttcaaatcctgaccgtccatttgacacgtgtacctgagcttgcagatctcgcccttaattacattcataaagttcttcaccaattgacgcatttgctttctaataaaccccaaatattgtttgaccagaagagagaaagataggaaaactcgaaccgggtttgaccagatcaattagatttaaccggtaccggttatttacattttttttcccctgtaaaatattcccctcccctcttttctctcatcgctcgctgcctttctctttcacagtcagcgctcttgaacggagaatctcagtcgcgccgtcaactttttgttgagaagagatatcatctgttttcgatccaaagaatagaaagcttggattccgaaatctccctttttgcttccccaattcgttttcctttacaagctcggcgcttgatctcgctatctctcaggtaggatcgagctatatacaacagtttctcaattttactagatataattgctttagattttcaagtgctcttgcgtttctggggttttgttaagattggagtttttgtttcttattctcgaaatctgttgattgattcgtttgatccatcaatgtttgtttagaaattcaaaaagcatgcaaatttgcagattctttgtttgccttgtgcgaattctatttccgtattccgtatcgaaactaaaaccctgactaggttatgtttcaagtgtgttttttagttttctatttgagggatattttaactaactccataagtttggggttttgtgaacagccaaaagtcttttctttcgtgacatcagtttcttggtaaaggaattcgatttcttcacctaatagagaatttattttagaactttggactgatatgttgaacattgatgctgatttggcagaaatggatcgtttgatatgatacgtatctacatttgtagaactgattttttcacctagaatttgcagcaagtaagactagaatgaataaaggggaagcttgtattatttgttgttaaatgagttgttcaaagagctttgtttgatatcattgttgcttctttgttacatgtggatagtttaggatgctacttgttaagtagtaagtactgttaaggtgtgtagaacttatatttcactgtgaaacgttggagtaggttgccgtttgtgccgttagtatatcttgttttcgccttttactgacaagacttatgaatgttttgctttcccgtagagagctgagagctgaggatattggaaatttggaaggtggaatctcaaatggctgaacttcctggtcaaataagacatataggcggtcgaatgagtcaactgctagagcagatatatgggttttcgagaagatctttgtttcgggtcatatctatgggtcctataccttgtcatattgcctttatcatggatggaaatcggagatatgcaaagaagtgtggtcttttagatgggtctggtcacaaagcggggttttctgcgcttatgtcgatgctgcaatactgctacgagctgggtatcaagtatgtaacgatatacgcatttagcatagataattttagaagaaaacctgaggaggttgagtctgtaatggatttgatgctggaaaagataaagtctttgcttgaaaaagagagtattgtgcatcagtatgggattcgggtctattttatcggtaacttagcgcttctaaatgaccaagtgagagctgctgcagaaaaagtcatgaaagccacagctaagaatagtcgggtagtgcttctcatttgcattgcctataactcgacagatgagatcgtacaagctgtcaagaaatcttgtattaacaagtcagacaatattgaagcatctaattataaacacgaggatagcgatagtgatatagaaggaacagatatggagaaccaagagaagaagatacagttggtggatattgaggagaatatgcagatgagcgtggcgccgaatcctgatatactcatcaggagttcaggagagacgaggctgagcaattttctcttatggcaaacaggtaatacccagctctgctctccggctgctctgtggcctgagattggtttgaggcatctgctctgggctatattgaacttccaaagaaatcattcatacttggaaaagaggaagaaacaattatgattgtcttgaaaggagactagtgaaggatatacaaaagctctcttctctatttggctttgtaatgtgatgtgatgctcttgtggtatactatcaaaaggaaacttgggattacatagaacaagcaatgtattttacacacgaactcatttgagtttttctttatgaatccttaaccaaaactccaaaagtcctctctaaagacatcttacttcctgttctgtcttgtaagatccagaatcttaacatttgtgtttcacgagtgtttttttctcaaaccaaaattaaaccaataaatttagttcgttaatggttcagattgattgcatatatcatggaatttcggtttagcgatattaaaacaaggaaaaccgggattggtatccaaaaccgtaccgggcgtcaagtctggttcggtaggttagagtacacgcttgtggcgaacttgcaattggaaacctaaaaagtcgcgactatgctctctgcaaagatggttctacttttggcttaaagagcaatgttttcgagtctttgcc

SEQ ID NO: 14012 - DNA, 3000 bp, Unknown
  misc_feature (1)..( 3000): cDNA_ID_3021375_gDNA_ID_2214692_Annot_ID_189416 3000 nt of promoter + ATG
taaagattagatattaagaattgagtttagtaaaaaaaaaaacaatgcattgaatatactaacggaaattatagttggagtcttcttattacgatttcagttatattggccacggtgacgaacaatctaacgccataagaaaatgtattgaacaagaatgatcaaacatattttgagtttttgtttaacgaaaactatgcattaagacttttatatttttcattaaactaaacatatttcgttgttaaatcgaacgtaaaaaagtttacgggaaaacatccatcgtttctggtgcatgcaaatttctttgctctctagaggttaattctcattttggaaatccattttgatcccgtagacatctaatttctccatcaagtcatgtttggcgtaaacgtgtatgattttgtcttgttttcttcaaagcttatcactttggttgcttcatatctaacatttctcgtatatgctatagactcgcatccatttttgtataaccttttttatcttgattttaaaaatttcttttccgacctctataatttataactataaataaaaaactgtctaaattggattattaatcgactgaccaacgttaaaacttaaccaactaactgagagggcataatggatatcttatttgacaaaattatgacgcctcaattacccccttatagtggcgtcatgatgggaaccaaacgattaaccccctcaacatttgtgtttctcatattacaacgatgcaaaagttgatcgcgaaattatggctgcatttaaatttttaaatattgtttagtgttttctaggaagagtaataatagtaaatataagaattttagaatttcttctaaagtgaggatcgagtggacttgaactcttattcacgatactcctccaaaaaaaactgttgttgtaaatgtaactcaatatgcagtttatacaacaaattttttacttcgagtcatgccaaatttagaacatcacatacattcaaccaaactaacattaaatttatgtgttgatgttttagtgccactaatatgatttgttcaatagttggtacaagaacattaaatgtttgtaagagagataaaaaaatggacatttttatagtatttttgcagcaaattttcggcgggttggtaaaagtgattttgtatataataggtatcagacccgtttagaatttttggtcattcaaaaatcattggatcggattatatataatccaacttttccaccggatatatatttaaaagtcacatacaaatattactaaaattggattgtatctactaattacatttatatatttaataaaacaaaaattagaaaatttggttttgatttaaatttatgattctcctttcatcttttttaaactgttttaaatcatcatataatacataaagtgaaaaaaatctcaattttttcttatgcatatattgtgatttcgaaattttttaaaacggacatgtattacttaattaatgaaaagtgtgttttcaacgtcccacatctgctataaagtttagacaatgatttagattcatattatacataaaattaaaatgaatccaacttcgaatgagtataaaccttaacataacaagcatccaaatttaaaaattgatgtacgaattaaatcattggtaaatatgcttcacattatatttatatgatctgctgaacttatgttggacttttgaattgagtagagtaaagggaatcatgacctcttatttttcgtcattcaagaaaaaagtcagaaagaactagagaagggctgctaaagaagaggaaagaagaagagttgaggaagagaaactcatccctagtctgacagaagaacaatttgcaaagaacatggacttgatgaggaaaaaagttgaccgctttcactgactacatggtggtaaagaaggtggaaaaaaagaagcgaaagatgctaggggcattcagaaagataaagcttgatattggcaactaagaaataagtataagaatgttcagagattcgagaaatttgacgaagaggaagagtaattctgaaattctatctgattactttctatttagtctcttgtacacttgtaggacgaatcttattttgtgttctaaaaccattatgaccaatggtagtgtgataccatttaaatagtgaggaagaaaggctggaaaaacaattaagtaacaataaatagattttgcgactattgaaataaactggtttgcaggtgatcgaggtttgattggaattcaatagatcaatatccgatgaaataagattgatttgctttctctctctaaaagatttaagagagaagatagaaaaaatcatcgcccattaaaaaaaatagatattaagaatttgagttttataaaaaaataaaaattcaatgcattggatattactaaaaggaaactatagttggagtcttcttattacgattttaattatatatagttggccatttttcttcgaatctaaattacggacccatgaggaaaatgaccgttgtctccgaacgggcttcgtgggcttattgtttgtaaactcacggcccattgacgtcttcttatttgattcaagaccagaaaccacgttttgtactgtagtcttgaattgctctgttctgctgatagaatagcaaagttctgttctgctgataaattagcaaagtaaatcttgaatgctagtttgtctttttctctcatgttatgtgtaagaagatgatgatgactctgttaggtaagaaagtccaactttgtaatctaatcagatttagtctctaattgtttacttgtgtctacatataaaagttgcaagttgcagatgttaagaactaagaagtggtatctgcagattttgggtattaaggaaagtttccccctttgaataaataaggacatatactaatgtaaaggttcctcctttttcacaaatcaaaatgtgtttctttgtgttctagtgaaatccaatccattgtgtctctg

SEQ ID NO: 14013 - DNA, 3000 bp, Unknown
  misc_feature (1)..( 3000): cDNA_ID_3021379_gDNA_ID_2214692_Annot_ID_189415 3000 nt of promoter + ATG
atgctgcaggcaggaaaaaaaacaaaattggagataaaagttgtttgatggcagtatcaagttacccaaagctgagactgaaaaacaaatgtgtttatctccattacctcttggtatataagtttcctcttcgaaggtctagaatcatctgcatcttccatagttatgtcttcattggttggttgggcaagcagatccagcaattcaggttgtccaagtgatttaacataagcctcaactgatacagaaacattcattgataaacttcaacatcatgtagcaagacacacaaacagtcatgcaaaaccaagcttcgacaacttctatgaaaaatatagatgattcacatacttgtctccgcagatattccctcttcagtggccttccgtttattttccctatcattagttacaagcaacacctgagatgtatcccctagatgcttctggtaccatagagtagcgacgcgaatagctgaattccagataaatttaaaattttaataacagatgcttaccaagagaagtatgtaagttcatcatcaagaaagtaacatgatgttaacaaacaaagaaggtgattgaatagtaaataaaacctctatcgttgtggtcatttgcactctctttctccatggcttgcacataagtatccctgtgaagagtttagtaaacgcgagaaaacaacgataaggacacggagaaaagcgtttctatagcttagtaggttccagtaaggagagcatctaatcaatataaccgaacagaaattccaaaatcattgaattctttatgttcttttgtccacctaaaatctggttaatctaaaagctaaaagttcgaacaaggtcttcttacttgtggacatgattggagaaaacatagaattgtctcgctggattgctgcagagaagtctgattctattgtaaaccgatctattcctgttcttaacttcgtccaacaccacagacagaacaacaacagtgtctatagccttattttccaacaaatcaatctaccagaaacaaacaaaatattacattagtaatacccacaagctcaaaacttttagcttatgtaatcaaattaaagaaaaattacttggtgaagaacgacgttggtatcaacaacgattatcttagaggaagacaaacgagcagctgaagaatcacaagacttgcaagagaaagctccacagtatatgtcatctcgtagataaacctctcttacttgctgtcgcagacaaagagttaaaagttacaataacgaacaaaaaaactcggaaggaagaagaagaagaagcatagagagattgaagagaaaccttttggattcttcctcctctggttttcttattgaaaactttgctctgcaacatcttcaatttcttgctggaaaacttttcgatttcgccggtgaagaagatttcagtcgtcagaacggaagagaggaagaagctttttaaagcctttaaatttaaacctaagccagccaacttgactactaaaattttcaattctatagctccttattcgttcatggttaacgaaacgatgacggttaaaaccggtttagttactttttctctaaccggctcaatctgattaaaccgaagtaaacacagcaatacagctagtaaactcggtattactcttgatggaaaaaggtcaaaaacactctttttattttaaccaaaactaaccaatttttgcaagataatattgcatacctaagatcatttaccttgatctcatagaaatttttttaatgatgcatctccaattataccgatacaatttctagtaaataaatcagtgttcaataaagtgggataggcgtcgtctaggacgcctaggcactaaacgcttttataccgttttgactttttcaaaatcggttctattaatcagtgagatagatttggcagactatgtaaacattaagcggattagactctcattaggtgggttaggctaggcggatctaatcgtctcttaatattttttaaaaatttcaaaaatatattttaaataattttaaggacacctatactttttattattttattttattttactaaaatgttaaattttaaatttatttttaaaaatttgataatttccgttttttataatagtttttgcaacagttcagataatagtatataaatatatatcgttttattctaaaaccgattaaaccggctaaaattgtctaggcctcgactaagcgttctatgcgctaagcggagggtcaccgccagctaagcgcctaacattttcttaaacactgaaataaacacaaaattatatgataagaagtacgattaaaccaaaaataatcgtcacaatttttgccactatgtctaatgtatatgtgattgttttacctttaacaaaagaaaatgtgatttatttacctttaacaatatgaaaatttgttttttttaacacaattagtaattttagtgatattttcactcgaatttgttgatagcaaaaggtgtttagaagaccaaaaagcttaacgcatattggctcggctcggccgaataagttagctggacagtacggtggggcacacgaagatccttaaaccgcagcctcagacaaaccttactcgaagcaaaacagtgtttggttcgttcgtgggggtttaaaaaaaaaaaaaaaacttttgtatttttttccattaaaatatttttttgttaagaagattcaaaaggagaacgcgttagacacactaagggtgggggcaagggaggagaaactcgccggacagagacggagatccctaaaccgcagcctcagactaaagcttcgcatcttatctccgatccatcgttgacttcactcttaggtaaattcgaaaaccctttctcttatcttttatctcccaattcttaaattcgatgattgactcgtcctcctctgttttttcacagctgatcatcatcatcatctctatctctgttcggattctccataattgatccggacc

SEQ ID NO: 14014 - DNA, 3000 bp, Unknown; identical to SEQ ID NO: 14007
  misc_feature (1)..( 3000): cDNA_ID_2705834_gDNA_ID_2214692_Annot_ID_189413 3000 nt of promoter + ATG

SEQ ID NO: 14015 - DNA, 3000 bp, Unknown
  misc_feature (1)..( 3000): cDNA_ID_3021387_gDNA_ID_2214692_Annot_ID_189412 3000 nt of promoter + ATG
atgcacactcaaaacgaaattgaaatcaataattgttattcgtcaatttattcagaatagaacttatctacacattgaacatgcacacatgcatataagcgtatttaatggatctaaattcataagatgtttttcctacaactcatatatatgacaaatgaataaacgatcaatcgatcatcaccttcatcatgtcatcagcatctctatatatctaaagtttctaaaccatatctagattattgaacttaattattggtatgaatcttaagcatgtatattataaaaacatctcaaatttaaatatgaatttttgcaataataatgattaaaattcgtatcaatcaaatctgaaacaacaaggctgaaaaaccgattcaaaacgtgaaacatgttatgtgatttattgagatgttttactagtaatgatcaaaagcaacgatcaagtttttatcagacttatacatatcgatcgatcgatgaattatgtttcatccgaaaagaaagaacacgtattaagaaacgaatagaaagtacctgaaccatgcaagaactcagaagaatctatctctatccgatgcattaggaaaagacaaattacgcaaagattgaggagatgtttttaagaattgatattaaaaatcagataaactaaaaaggtcaaacaattattctgttggaacgtgttttaagcgctttaatattcaccaaacaaagtaaaaataaaaaacaccaatggggaaggatatataagctggctttacgataatataacatggcgatgacagttttgtattttgttcaattctatagttggcaacaagatctgatatcaatttactatatttattgattactggaagatcattaatttttttactctcgtaaacatatcattatcttcttaaatcatttgagaaaatatattataaatttcatgaaaatggtatagtttagataatatattaatatatacaacatacacacacaaagacacgacacatgcatatgcgtatgcgtttgtgttactgtgtctttgtgtagctggagtcttggaggatagaagtggaccacgtcacgtatattgaacaatttacaacaagataaattgaccaatcattactcattagaacttatgatatcgtttggaatcagctaacatatacataattataatggttagatatatatacaaaacaaaggtagattaaagaaaaattcactagcaagttaaaacaaatatgtcgtccacacacaaagattaaagtttttgtctgcctaagcatgaaacttttttttggactatcgaaaactccatatatttaaaaaaaatcaaaagcggattatcatatccgacaaaaagaataagtgttgtgcttttttataagttctactgagcaccgaactatcacaattcatgtgatcctgaaattaagaatacatgtgtctaatttattcacctcctacatagttcatgtgaaccatatccctctcttgcttttttcggtgcaatatatagaaaataaatacaaatacaatgactatataatagttgacatggaaaaacagagaagaagattaaaccgatccagtgtatgaatccaaggcaatgaggtggcgaaaagcgaatgtactatacctgcaaaaatcgtggaacttctcgtcatactttgttgtgttgctaaaaacgtgcggaccagattttgcaggtttttttaatcttatcgaaaatgttacgattctggacgcgaatacggtcttggggagccctcttccaactattgagggttttgtgtttttgtgtttttgaaaactataagttgtttattttcttacccaatattatttttctcaagggccacaacattaataaaataaggtccttattctagtggcttctcaagatttaggtcccaacttttgcaatttctacaagtctcatttgttgcttaatcttacaacttatttaaaatttagctcatcattttaaacatttctttctcctcttttaactaaaacccaaatctttttttttttctcacaagttcatattttattgaggtaagcattacaaacatgggctaaaaaagccctacaacataaccagttacgaaaacaaactaaatcccaactcaaactcaatattgaagaagaagatttgatcagataattcctttcaaagccacatgttatcaacacgtgtatgatgagtaatcaaaagatttccatcgtcatccttcgccgtcgtagcctctgattattccggtgaatgaaattcaacacagtgaattcgtttgtttttcacctgctactgcaaaacagcttaatggataaaatacagatcaattaaactcaaccacttgctagaatcatcaaagaaatttgagatccaacaaaacggtaacagagaataagaaatatgattaatccaaaccaaaactgtttactagaccaatcgaagctaaacagacaagtaacagctaaaggtaattgtaatctgctaaggaaattgctttatatcttcaactaaaattatgaatcccttggataattttcgtaaactgcaatctcaaaggattaattagaaagcagactgttgaataatgcctattttgctttcaaaccatactgaagaagtcaaagagagaacaagtagttacatgtgaaagaagttggtttgaatctagttgcttttgtttacttggaaaactaagctataatctagagtaagcatgcttgtagtgggagcagcctgcaacagtgtaatcgtgtaggtgtcatcgtgtaggtgtcagaagctagtattttgtgttttactttatgttttgctataaggatgtatgtgtgtgtaagaaagaattatgggaaaattctaagaaaaacagagtttatgcatctctctctcaacttctaaatcgttttaattcacaaaacatgagtgaaagtgagaatcacaacatggtatcagagctacgctgattactggaaccaaacgaaatg

SEQ ID NO: 14016 - DNA, 3000 bp, Unknown; identical to SEQ ID NO: 14006
  misc_feature (1)..( 3000): cDNA_ID_3021394_gDNA_ID_2214692_Annot_ID_189409 3000 nt of promoter + ATG

SEQ ID NO: 14017 - DNA, 3000 bp, Unknown; identical to SEQ ID NO: 14005
  misc_feature (1)..( 3000): cDNA_ID_2705814_gDNA_ID_2214692_Annot_ID_189408 3000 nt of promoter + ATG

SEQ ID NO: 14018 - DNA, 3000 bp, Unknown
  misc_feature (1)..( 3000): cDNA_ID_3021398_gDNA_ID_2214692_Annot_ID_189407 3000 nt of promoter + ATG
tatatgacaggcagctccagagaaacgacaggcatttcgtcatgagcttcaaagagttggcaatgaaggcgcaaaagttctgcgtttgattggagaaaaagtggagaaaatggagaatctaggcccgggagagattctaaatgacgttcaacgtgcagcagaggagctacagatgaaaatagacagtaaatcctaccttcttgtgaactcagaaagctgggcagctactaaagagaaagctgaagcagaagaatatgaagaagaagctcacgagaccaaagtgatcaaatccttaagtcagatttgggataccaacagtagcagcaacaatcagaatccagctagtggtaatgatgaatctcagatatgggaatcaacagagagtatgatgttaagaaaccgtgagacatggccaagtgtgtccttcattggtggttctgtggtaaatgagacagtatataaagtatacgaaagcgcgagttctttgtctttagctacgtttgcttcccttctcatcgagtttgttgcaaggctggagaaccttgtaaacgcttttgaggagctaagcacaaaagcagatttcagagacccggttcctcttaacgtagtggatcaagaaggattatggacaacactcatgagacttaggagacttaggagatattttggcagaagttaaaaccgaatcttaaggggaccaagatgtagtaaatgttgtctgattttataacgaattttaatctatctgatcattaagtcgttaattaaattccaaagtgatcactcgcttagggtttagggccggtttatttgtctaatacttttgtaaatcactgccgtggtgaagaagtaaaatcttgactagcacattaccctacccttaattagggtttttccttttgacatttccattgtttcattcatgaccgaaaacatattgcattttctcgtggaaacttttgcatattctcactgattcttaacttaaaagataatcataaacttttataaagtatctccaacatgttgcattattatattgtacttttattgcttttccaatcttctataaattatcttgagcaaaactcatagattattattaaagaaattttcacagaagtggctaaaaaaagaattgctctcatgatttagcaaagtgagatgtggttttcaccatttgtcttttgaatggtttttagaccaaaatacccttaataggatcaaccaccccacagcagttggtttcggtttagtttctacggttcagttttaaaaaaaaaagaaaaaaaaactgaaacgaagaaaccaaagaagaagaaaaagaggaaaagaaagagatggagagatttgaaagagaagtagaaagaagttcaaacttcattatccacttcttcatatttcgacatctctccattgaactccaaaattgaggaagaaatttcttgttttcagagatgaacaaaatgcaaaaaaaaatcacagattcaaacaatttagctttttaaactaaagatactctaggtttacaagatttatatataaatagtaattaaaacgtataaaaaatgagattttgagaaaactgctaaagatggccgcaaaattaggtttgcagaaaaggatacacaggttgaagatgactggaaaattataattatacccttcattaaatttcttctgtgtacgtatattcaatttacagtgtacgtacacaaaattatttagtcgaacgtatatggtacgatttctaataagtcaagctattttattacgtattcttatatctcaataatctccatacatacataataattaaatagatatagatggtgaaataatatttgttcctcatattgaaaattatgtacgtatatgtgtaataatgtacgtatatttttgttggtaaattaatgtatgtacatgtgtaataatatacgtacatctttgtttgtaaattaaattattaagaaaattttattggtacaatattaaaccaatattggcagtgggcgagatatattctaagacgttcatacgatgtgattttgaaatattctgaattcttgacgacttgagcagtcaaatgtcatggacaagtatcatcaacgcataccatcaccaatcttgtaggatatgacctaggttgcttgtagcaaaaagattgtttgattgcgagataagacattgtttgttgtatgacttttctgttcttaaaaacactctccaatctatagtgtacgtacattggtacaaaccatgttgacacatacttcttggagtcacagctggtgtacggtcacccgggtgagaaatgttatctccgccaggtacacgctgacttgtgtacgtacactctgccaacagaagactgaattcccttggatgttgaacaatcagctgtgtgagaatgacgttctcctcaacattccctattccatattcttctacaatttcatcgttccacttgttgtaatcataatcttcgccactactttcactaccatcaatagtaggatcgatggtacttcccccatagatccatcgtcaccctgataatcatcatacccatcaccatcttcgttgtccccccatcttcatcctcatctgttttatcgtcttcaatctcgtcttactaatctatggcctcattattttcatcaacatttaaaacactatcacacacacggtcactttcagcatcgtcaccatgagtcctagagacattattcccgagtgtcttgacggttgtaatgaaagagacaaacaagttgagagaaggatacccaccacgaataaaaaaaatcgtatcccaccctcacttgactgtcaatgtagacaggagggcgtttagtatctatcatcactaacatctctcccgtatccagtaactaattatgggattgatctatggacttcaaactgaaagtctcgcttagtgtacatacaaattccgtgtacgtcatgttttccttaacacgtacacagcgaccaaacatg

SEQ ID NO: 14019 - DNA, 3000 bp, Unknown
  misc_feature (1)..( 3000): cDNA_ID_2705830_gDNA_ID_2214692_Annot_ID_136737 3000 nt of promoter + ATG
ttatgttttcttaaaaaaaacaaagaaacaacttatattttgtgtttgaatttcttgataatgatcggaactcttagcctactgacttttcctaattttatctatatattcaaatctagtaatttgcatgcatgaaattatagaaaaagatagataaataaattatgggataataaatctaagttaattaattagtataaaataggtagttgggtggtatcaaaattattttttaaaacgtataacatactctattaattagacactaatttgagggttattgaccgggtacgtagatgacttattaatcaatcgtaagagccactaggttattacaataattttttagttagattttttcttgcaactgctttgaggaacgatccatgcatatattatatatagaattggaatataaattaggcctaatatacataactaaagcttgtaatgggggattagtgttttgcatgtatgcagcaacgtctatagattatagggtgcgtaattagttttaattcatatgagctatttggtaataatatttcgttactaaatgatattcttatagcgagaaatagtttagtataatttgtagtgttgttaaaatgcaagtcgccacattaacaaacaaacaaaaagtgtccacttttatgaacatggatgattattcaaacattttttaacaaaaatatattttgggattcgaatttctatttacagaatagattgtttaatgttacggtccctattgtgtaaatttttcggacctaagattttagaattcttgtgttagaaaacatgttagaactttttttgtgtgtccatttgttgggaaaaaacaaatcaccgttacatatgtatgacatgtaactaagaaccacaacatgtccttttctctatgttcgattctctcgctgccatgaggatgcaatttttttagttattaaatagatgaaaagctagggatgattggttgtttccaaatcgtttgcaaacctgcaaccatttctaaacgctatagttttatacatgtgtgatacgagaatacaaaccgttttagcattttataacattttaattcgttttaaattttatgctcattctttcaagcatttgtgtgttagtaattaacaaaatttataaaaatatcaaaatatactttttgtaacgaaaatttaatattttctatataatattatgatatcaaaatcttgtatatttgatatatgtaataagagaagagatctatacataaaaaatgtttcacgcttatttaaaatatattttaataatttatactactatgtatttagcataaaatttcagcctttcataatatatgttttggtttctatttttataaaagaaatattgtatttattttagtaattttatgactatcagttatgatattatttatcaatcaattaaaaatgttatgcaattatatatataatagatgttcctaaccgctatatcatataaatcgttcaataacgttaaaaacggtaatctcgtcatctgttcccaaattttcacatccacgttttttctaacacatttaaatcagttaaacgccaaattaaaagttttatttcttctgcaaaaccagagttattatgaacaattgaaaaaaagaagcaaggtataattttgatgatcataagaaaaatgacggtccgatgtctccaaccatgagctgttcgttacatagtatgttgttcaagttatctactttttttttgtgtatgtggtcaacttttacgttaatcttgattgcactaaatttcttaaattattaaattgaaagttagtaccgaagagactgatttcacaatccaactacccttctgttcacgttccaacttacaaaagagaatgagaattctcattcattctctcatttatttatttcatgtctctcactttattactcttttttttttttttgttcttttctcctcaccaaaaaatagtatagaaacaaaggaatctttcaacttctctgacgaattttcgattttctaagtttactcaaattagatattttttaaaaactaccttccatgtacacttttattcatgatatatatatacatgaaaaaggtcctgccaaactaattaatactcaaaacatttatgctaccaaacaaacaaaaaaaacagaaaattaatttcaataattcttgatgatcattttctttgttacttattcacaataatgacaataatgataagttatttctttttcttaaaaaataatgagattaatgataacggttaacaggaaaaaactcaaccaataatgaaaatcaacaattattaactttggaacataataataataactactaaaaattttggagcggctcacaggaaccacgtacgtacccggagaagaatactctgttttatcattgaatctccacgtttcttctctcttctgcaaaattccgttttatcattttctctctctcatatcaaaagtgagaaagcgaccggagttccgtactttggatgagatgtgtttcgtcagtttccttactactaatcaccattagtcttcttcttcttcttctctctctctctctctgtctgaaaacgactttcctctgttcttctctcccccaattcttcttcttcttctctcatcctttcccaatctccatttttcgatgcttcattgattcacgagaagacaattccatttctgatattatttgtttcctttctcgatcgattctttgcgtaaaaacctgtttctgttctgtttcagaatctgtctctcttattactctgttctgttttgtctgtcttaataaagtttctttctctctttaaagacaaattcatagttccagtttccgaacttcactctctcttgtcggattctctgatgagtcatcagatctctgtttgaactatccaatttctcatcctctcttattttcttttttaatttcacttcaccggagatctccaatcgccggagaaatg

SEQ ID NO: 14020 - DNA, 3000 bp, Unknown
  misc_feature (1)..( 3000): cDNA_ID_2710864_gDNA_ID_2214693_Annot_ID_136744 3000 nt of promoter + ATG
ggccgatgcttatatactgtaagtggaatatgtaattcccgaaagtgccctccagatgttcacaaaattacgccatcgtactcgaattaacttcaactctctcttctctctctctttcttttcactcttgtttttgtttctgtgagtgctgtgtgtgttctcggtttgtaatatctaagtcgcacaaagatcagacaaagtctgtttgcgtttgatagcattagagtctgatcgaatttggaagacctgtgagattagggtttctttttgtttgtttttttttattccgaaggagagctgcggagcaattggaattacctcggttaaagcaatcacgtagctttggatcgtttagggttttctcattgggtttgggggatttgtattcgagcttcctcaaactcaatctgatggtgatgtgagacaaggcttaatcctgttaattggcgattctagggtttttcaatggcgagcacaggcgagcctgaccgtaaaaggcgtcactttagctccatatcaccttctgaagctgcagccgccgtaaagaaacagcctttcttttggccctcctccgaggacaaggtttctttcttcttcatctcccccttgtgcatgccctttacatctattctcttacttatccaatcaatcatagctttccagctattagagattcatatactgaatgtcttttgtctcgaatttggtctattttggaattgggattctctctcttaaggagtttgttttcgtttgatacagcttgatactgcagttcttcagttccaaaatcttaagctatcacaaaagctagaggctcagcaggttgagtgttctattcttgaggataaactctctcagatcaaggaaaaacaattaccatacaactccagtttgaagactgtccataagtcttgggaaaaggtaacactgaatttgctttcgattctaatagaacttggattagatctctttttctagagaactaattaatgcttgtatagcagcttacagcttcagtggaatcatgctctgttcgtgtgagtgattcaagcagcggagctcataggtttgtaaacaaggagggtatgaacaacttaagcccgccttttcttcgttctgttagtgctaggatctagtttagatttggttttatatgttacaaatatgactttttgaaaggttaactttaaattgctacacagatgggtcttctccagccgtgaaaaacgatttcatcaaccggctacttgaaactggtgctactgagagctcctcatccaatatctgctcgaatcagatggaagaaaatggagtgaatacgtcaagccagatgacgcaaaccttgtataatctagtagccgcgacagaggatttgaggtgtctgaaggatgaattatatcccacagttctcagaaccaatcttggtaaaggtatgacttccactgcgatcaattgtcagctcttgttatggcctttataacattttagtattaacccaggtcctatgtggaattgctttcttttctagatttgtgcggtcagctagctctgagtgagttggaatcagaaattaaaagtttcagaggggatctagatgatgtacttgtgaagttcaaatcactttctagagaattgcagagtcatcgcgatgctgatgctaaagttagagtagacctcaaacgaataagaggtagctacttagtctcgtctcactcgactatatactgttaaaatggattttttaattggcattgtttatatggatatagtattcatgcatcaaatgtaaatttgtaatcatatacgtggcttgacaaaaaaaggtcctatatacatgaaaagctactgaaatcatatctcgcttttgattgatgaggataagtgtaagtagaggtgatcaaattgtgaatcttccaattccacgcctgtgtatttatgtccagcactactcagttgtttaatagccatgattggatttagatcatagagattaagattgaagagagagatacattaagactggaagaaaacctctatggtagagccagctgttaagaagacatgtagctgtggaagatatactcattagcgaactgatgggtgtacaaaacccttctgagacatgaacttcttagttttcttttataccatttacccatatttatatatttcggtagattttaggagatagagaagctggtaattctttgagaatgacatacatccacataagtgaagcatcttaattttgttgataaattacccgtttaccttaagatgtaagatttcaatactgacagtagccacagttaagaaattcaaagagttaaaatttattttagtttacatgcctgcttttggattaatgcttcttgactaccgcatcaactgatattatactttatttggtctattcgaaggggagctagaggatgaggttgtggagcttcagcagtgtaatggtgacttgtcagcattgagagcagaaagggatgcaacagctggggcgtttttcccagtgttgagtcttggaaataagcttgctaccagtgatcgggagagggataaacaaagggatctgcaagacatggaaacagttctgaaagagttaacggtatctttgtttttctgatttgttttcattggtaattctttaagttttgggttgataacggcctggtttcggtaggtcctggcttcaggcaggctacaacagctaaaaaatcttcatgaggagaggacaaagatgcttggaaaaatgagtaatttacaggtcagtgtattgatccaattggggtatttgtattagtttgtctctgtatggggtttgatatatgaaaatttgtggaatggtagcctcttcctattgctaaaactgatgtaagagttttctaacagaacaagtcaaagtctgtgaggtgcatctcatcttctcaagcctgcctttctttgaaagaccagctagaaaaatccaaagaagcagttttccagtatatg

SEQ ID NO: 14021 - DNA, 3000 bp, Unknown
  misc_feature (1)..( 3000): cDNA_ID_2710862_gDNA_ID_2214693_Annot_ID_136745 3000 nt of promoter + ATG
ctaccattctaatatcagtaatttttccatggccagggcggtggtaatggggacaatgcggttgcaccacaagtgtttaattctttaccagctcttaatgaagctgcttcttatataactcaagcaacgtcttacttagggagctgtttttctgactattcaggtaccctttctttctatctgttgatgtcgtactcagtatgcaattccacgttcatatgctaggctttacttatggaaaatatgcttagcagatatttatggtgttaggatcttatcgtcaccgtaacataattcaggctttgcttagcatctgttctttcaatgctttcttcagtagaatatggtggcaaggatactatttcccacccccatgagttgttacgatcaacttccggagttgacgggaattccccagtgagtgtatgcatttcgcctggtgaaaggttttcaacttcttcagaggcatctacatctgatgccaacagcccgtcgagggaatctacagagattctgccacaggcaacaaatgcaatagtgacttcgaatcggttaaatttaaatggaatttcaatgttccaagggtacgtgtactttgtattacagatacaaattccccatactagtagatatgtaaaatcttaatactatgaatatgtgaaactgaagcaatacaataatctctatacactactacttcttgtcaagttttcagcatttgggtgattgatctattttaattcaatcaggctcattgagcgggcacggaggactgttcgtggctcggcagatgacataggatggttacagcgtgccccggagatgcctcctgttgaagatggaactgataggttcaataaaattctggaagacatcgggtatgaattggttgtagttgcatgttttgtgtgctttgtggccttttcaatatgctgtttaacatcctgttttttactaaatggctgcgttgatctggtttttatatccaggcatggtgtacacaggcttccaaatacagtggtgtacttattggttccaggtagcaattcttattctttgctgccagccacttaaactacattactgtatattaggactctcaaaattagttgaattttttttaggtcttttcagcaatcatggacctctatattttgtggatacgaaaacgaaattctcaaagatgggtttggcgtgtcatattgcgaagattcacagcgaggtaatcataactaactcaacttagtacagttacatttggtgtatagcatactaatatatggagaaatgtttatatatcagtcctcggttgagaaaaatgcgagagagataaaggaatacatagaggaactctgttggggatctaataagcgggttctacttcttgggcatagcaaaggaggcatagatgcagctgctgctttatcactatactggcctgaactaaaggataaggtcgctgggttggtactggcgcagagtccatatggtggaagcccaatagctacagatatcctccgtgaaggacaactaggtgattacgtcaatttgagaaagatgatggagattctaatctccaaagtcataaaggtttgcaacattcctgatctaacaaagtcatttcagttgcattatatcagcttcttgtgattgcctgttaaaatccttagttaggtggaaccgagaaactagggataaaccaaaacttattttgtttctggattctattgctctgctgatctttctgatgaattccttggaacattgtgaagggtgacattcaagcattggaagatttaacatacgagagaagaaaagaattcttgaagaatcatccgcttccccgagaactccccacggtttcattccgcacagaagctagcattagcccagcggttctatccactttatcacacgtagcacacgctgaacttcctctgacaaaccaagccgcaaaactgccagtggtaatgccacttggtgctgcaatggctgcttgcgctcagctacttcaagtcagatacggtgaaaagagtgacgggctagtgacttgctgtgacgcagaggttcctggttctgtggttgttagacccaaacgtaaactagaccatgcctggatggtgtactcttccttgaacgaggttcctttagaagctgatgctgctcaagtttgtgaagcgctcttaactttgcttgtccaagttgagcaagagaggcaacaaaaactcgcaacaaaaatcgattgataaaccaaattgttttatttctactttcgtcttgagacttcaaattactgtatttgtttctatctttttgttttatttcttactaatttactatcaggtttgaatcacacgataacaaaaaaattattacaaacggtagattttatatttataagactacttaatttgcttctttttttttcttttattgttgattaatttttattagaagattagttatgtttttctctctattcctttaacgaaccgtgatcgtgcggctcggatcgttggagattctatggacggccgatgcttatatactgtaagtggaatatgtaattcccgaaagtgccctccagatgttcacaaaattacgccatcgtactcgaattaacttcaactctctcttctctctctctttcttttcactcttgtttttgtttctgtgagtgctgtgtgtgttctcggtttgtaatatctaagtcgcacaaagatcagacaaagtctgtttgcgtttgatagcattagagtctgatcgaatttggaagacctgtgagattagggtttctttttgtttgtttttttttattccgaaggagagctgcggagcaattggaattacctcggttaaagcaatcacgtagctttggatcgtttagggttttctcattgggtttgggggatttgtattcgagcttcctcaaactcaatctgatggtgatgtgagacaaggcttaatcctgttaattggcgattctagggtttttcaatg

SEQ ID NO: 14022 - DNA, 3000 bp, Unknown
  misc_feature (1)..( 3000): cDNA_ID_2710858_gDNA_ID_2214693_Annot_ID_136746 3000 nt of promoter + ATG
tgacaggcaagtggtaagcttttggttttggatcaattgctcaaaaggctccatgatagtggccatcgtgtcctcctcttttcccaaatgacctcaacacttgacattttgcaggttttcttatagagctattttttgttctataacatctgtgcatcattgactacactgacatgtagcttataacaaatacaggattttatggagcttcgtaggtattcgtatgagcgccttgatggatcagtacgggctgaagaacgttttgctgcgataaagaatttcagcgcgaaaacagaaagaggattggattctgaagttgatggaagcaatgcctttgttttcatgatctctacaagagcagggggagtcggtttgaatcttgttgctgctgatactgttcgttatttctggcttttgtttttccatattatttcttgcggaaatggaatacatcggcatagagaaagataaatatgatttgtttctagtgcttattcaagtgcttttgaatatgcaggttatattttatgaacaagactggaacccacaggtggataaacaagctttgcaacgagctcatcgaattggacaaatcagtcatgtgctgtctataaacctcgttactgaacattctgtggaagaggtctgtgactgtcgtagtgtttcaaaacacaaagtcatcaaaaagcattatcaaaatctaaatgcgtgtgtttcaggttattttgaggagggcagagagaaagttgcagcttagtcataatgttgtgggagataacatggaagagaaagaagaagatggtggtgatttgcggtctctagtgtttggtttacaaaggtttgatcccgaggagattcacaatgaagagtctgataacctgaaaatggtagaaataagttctcttgctgagaaagttgttgcaatacgtcaaaacgttgaaccagacaaggaagaaagaaggtttgaaattaattcgagcgacactttgctaggaaatacatcatctgcaagtctggattccgagcttgatgaagcttcttacctttcatgggttgagaaattgaaggaagctgcacgatcaagcaaggatgaaaaaattattgagttgggaaatagaaagaacttatctgaggaaagaaatctgagaattgaggctgccaggaaaaaggcagaagagaagaagttagccacgtggggagcacacggttatcagtctttgtccgtggaagaaccgattttgcctgatgatgttgattccagctcagatgcaggatctgttaactttgtctttggagactgtacaaatccatcaactgtctctcatgagccagcaatcatattcaggtaaaacttcatttcaattgttcatctaaaaaccaaacctctaaaacttccaaatattgattttatggcagctgtgttgatgactctggaaactggggacgtggtggaatgtttgatgctctgtcaaaactgtctaatactgtacccactgcttatcaccgagcatccgagtttaaagaccttcatcttggagacctgcatctcataaaaattgatggtctgcaactttttttttttctatcttcctttcattttctaacaacatcaaagagttctcatgtattttgtgttgtgtagacaatgatgaccaacaaaacacacaagcaagcaagcctctttgggtggcagttgcagttacacaatcttacaattcgaggcgtaaagtcccacgtagtagcatttcaattccagaccttgaaagttgcttagccaaagcttcattctctgcttctcagaaatcaggtacgaacttaattactttctttctttaaagtttcatcatatttggaattataaacaaaagtgctcccaaagagcttaacacttgtgttgtcatttctggtatggtaatgttctctcctcaaaaagcctcactccacatgccacgtattggttaccaagacggatcagaccgatctcaatggtacactgttgagcgtcttcttcgaaaatactcctccatcttcaccgtcaaaatattcgtgtaagtttatatgtgtcgcccgtcttctttcttttgaataatccaaagcaaactcatttttgttgctttcttgtaggtactattatcgtcgatctccctgaatcacacaatgggatagtctttttgacgctgtaatataatttgcttttggttgtacatgtaacggtgtcgtttgtatgtagaaggaagacttgtaattgggcccagtagtggcccatattaatgtataattaaataatagcctaatcttataattcaatcttgatcactgagccaatttacacgtgttgcgtctctagtgcctctggttccacgttggtcgtcaaaattgaaatcgcgtttctattttcttcacgaggtttcttttccccgcggcttaggacaatatgatccgaatcgttgaagaaactgtctccttgtgtctatgtttcgttttgatcccacattcctaaagctccaggtaccttttctacgtttcccgaattctgattagttgattcttcttcctcaatccgttcttcccaaacttgttgccgatttttggatccggtcatcaactttgttgtttatttgtcatcaatgcaaaaattgagagcgtctgtgttttcacttgcatgttatcaattcctaatgttgtttgccgtttcattaaccggattcgagactcttcccgctggatttctttttttcacgtcttcttttctattttttatggatttggtattttgacatgttaagcaaccttcgttaatcagtttaaaatcggtgctttccgaaatttttagaagaaacatggaagcttaaaattttgaaattgctatttggaaaagctatcatttcataggcttagtctttgtaattcttctttacttgttgttcattggcatgaatatatgaaggattttatatttgattgtgtgtttgtttatgttgttagaaattgatcaaaatg

SEQ ID NO: 14023 - DNA, 3000 bp, Unknown
  misc_feature (1)..( 3000): cDNA_ID_2710854_gDNA_ID_2214693_Annot_ID_136747 3000 nt of promoter + ATG
tgtgtcccatatatcatgaccagataaatctctgtcggaagaatcatcatcatcacaagattcacaaccgttgttctcgacgttaaatcttccgacggtatccaacgatccagattcaatctcgtacggttcaccaccttcccataaacaaagcaatcgcccagcccatttcaaaacgctagtattagccacgtttttcatcactttcgtgtttccaaatctcttccctcctttcaacaccgagaaaggacctctatgagtgaaccgccacgtgtcagttacaggatcgtgctcttcttttttagcttccgttttaacgtacttcgccgtgaaagtggctttccgtttgttaccgtcgatgtgaaacgcacggagataaccgtgaccgtctaaaggatgaaccgttgagccatggtcgtcagtaaatagtcctggaccggctaagtagtatgtaccggaagggaagttaaccggtattgaaccttcgattggtttaattacgaccggttcgatagtctcggaacgttgtgacacgaataaagattggtaatcacggaaagctgaagacgtggactcgtcgaggatggtaccggtacgtcctaaaccggtgtctggtatagatattgatattgcggctcgtggaggtgcaagcggtggcggagtttggtgatgatgaatcggtggagattttagcggtggaagaaatttcggcgggatagggagagacattttggtcaacattttttgaaatatgcaaattatagtatagttttctatgatacacgcaaagcatatgttatatatatatatagattttataccaaacaaagattgagtgaataaaatggatacgtcatacgtggctgtatgcatgtttaggaactatggtggggtagaaaaagttgagtgattttgtggaagacatgagcaaatttggacatgaaagaaaaattcgaaaatggcagacatgatactaagccattgctttatgttgtttaatataaatttaaattagtgattagaacttggaagtgagtattattgcgtcacacgacacatgtaccgttaatcaattggtatatttttagttgttgctcatgaaactaacaaaattattgtcaatagattcactcataatattgaatagttggttataagaaatacgtgtacatcaagatagaaagattggagcagacaacaagaaccgagaagtactgatcaccgacacttctcaagttgatcctaatgatagatatggacattttatgttgtatgtatgtgtcttgtggataattatgttgtaatcaaataaaaaactaataagagttccctttttattacaagtaataatcaatacttgtataaaatttccactaacatcgattcattttgtgcgttaatctcattggctaaatcaactaatattttgttttaatgaagcttcaaatcgacccacttcgattataataaaatactttttgcgagttgggactgaaacattattaaattgttaaagaaactcattatggtttcggatttcaacgttaaaatcatagaaccctcattcatatgtcttcagtttggagaacatttagagacaagtcttcggaacaatgatcttcaataaacaatgtcaaaccaaagggcgcccatattttataaattacaagttacgccatgatatcaatctacatgtttttgaacgttatgatattaattagctggttagatacttgataaatatgtggagttggcagttatgaaccgttgaacgtattctttatacttttatagataggagtttgcaagtatttacatgccaagcaatccgatttttttgcattaattaattaaaattttgcaaactctaaactttggtagtattattgagataaaagtatggtactaactagtttgataactaaaaatacccaaatattgcatatacaaaatcttgtaaattatgtatgtcaactagtatcttctaaattttacaccatcgagatggcatgaatgaaacagttttcgccaattactatcttttaaaagtcgtatttcttggttacacgcaaaaccaattttgttgcgattggtcgatgagacatggtcaaataataatgcaaatatagattatttcagaaattgttggattacgtaacctacatgaccagccgaatgattttatcatgtattatccatccacgcataaatacagtttaaatcacaaaaatatgagcacaaatcgtgagtataattaagagcaaaatttacttatggtatacggcagtaaaatggatgtgtgatatgtgttgggaacatagagatggattccttggtaccattaagcagcactcgaggagttttaagagtgaatggaggagtaatggtgggagaatattagtgctaccaaaatatttaaaatcaaaaagagtgttattaaaatgattataagtttgattaaatgtttaatatttgaccatattgccaacaatggaattaaaggtgattgagcgtaggtccttcgtgtctctcttctcatcatttgagccgtcgatgccgaatctgctgacgtcacaccatccacaccacttgtctgtattttggaagctttgtgattatttccccaaatggactttcatataattatcttagtatttccccttatgatttattttatagcacctaaaatgatttgttaacgaattatattcggccaacttcatgtcggaaatccattttagtaatttctcgagtaaaataaaataaatataagtcgtttatcaaatttttttattttttttttataaataaatcaatatatttggtcaatctaaattattgtttaaaacaaaaatctaaagtcaataaaaaaacgagagacgaaaataaacgacgtcgtttattgagcttctattttccttttccggtcttagttaattcccggttcaaccggtctcggttcttttcctcgaaacggtagcgtatgacgaagaaaaaatg

SEQ ID NO: 14024 - DNA, 3000 bp, Unknown
  misc_feature (1)..( 3000): cDNA_ID_2710846_gDNA_ID_2214693_Annot_ID_136751 3000 nt of promoter + ATG
cttgcactggtgtgctttgtgccaggaacacagggagatgaagaatcatctttctgatacagaagcctcatcatcaactactatggatcctcccccagttcaagagatgaacactgaggagagaagagacgcttcatcttcttcgtcctcatccccatcatctgccaaaagccaacacaatgatctcgagatggtccctctataggaaacgttccttattaatctctgctgcttatgctttaagctgttttttctgtgcagagaagttttcgtaccagatgactctattgtccttaggttttaaatatgcaaaagtttgttctaagaacaagttcaatagtactcttaagttttacagaacttaaattcatgacttcattgaatctcttggaagaaggaagaaaactattttgtgattaaacactgcatgattggtaaatttgtttcgtatttcgttattttgttcttttttattataaaacttcaaagtaattacacaagcacccgtggcctaatggataaggcgtttgacttctaatcaagcgattgtgggttcgagtcccaccgggtgtgctattctaattttactgaagctgacgaaaacaaattagaattttacccgactttttgttccctcacattttatctgctaaatttttttctgtcagtagtcatcacatcatgatccaatacaaggttatgagttataaaatgttaatgttactaattttcgcacaaatgactaaactcaaaacactgatgatgttaggaaaccaaagatgaatttacaaagtgttgactgcactaatccaaaacttcttgttttgataccttggacaagttgaccttcttacttgcacctcaggcctcagcttgactattgtcccacgtttggcctctgttctcaggtggtatcccctatcagtactccagggacgccagggccaaaagcttggcatattcagggagtttgcggaccagctttatttccccagaggaaaaaaaatcacacactcccaaatcttcatcctccatcgtggtcaaggcgtttaggctcggaggcggttctccatgaagcgtcgcccaatgtgatagccactcatgggctctcaccatttttttaagaataaatttttcaaattgatgagatgagagattctgttaaattttttttattttgcagtgtccaatagtagtctctctttattgggttttcatgaaaaaaataaattattagttcacacgtttccaacaacattttgctgcttctttagttctcccttgagccctctcttcaagtttgcggatcctagcttgcaatccacagaggtagtcctgttcgaagccattaaaacaacgccaaaagtcagagtagagtgtaaagaactcagattccaatttgatgaatctccaagagcacaagagaagttacaatgcaattatagatatgataggttctgtaagttacaatgcaatttttcttgacagacgctcaatgtaccaaataatgaacactaaagatatagaaaaataaggaagcaaacaagcacacaatgaaataagagagcaaacaagtaagtaattaaaacaagcaacgaatcaaagaagaaaataaggatctttttagacactagaaaaaatcattcaactatgaactcttttcaagatttctgtaactaccaaccttacacgattgtcatggctaattgccatctgtcaaaccttggtccatgtagcttgttgaagctcaaatcactggaaagtggaaactagacacgagttacttacatcatcaaagacccattttacaagctaaagcagatatcaagacaacaatttccatcggttgaacaacaaactctaagcaaaagccactatatccagaagttagaaaattttaaagtgtgtttttgacttacaattttaaagccactataatcaggtaaccattataaagtgtaacccgtcttccttctgccgtaatctcactgcacaacaatgcttaaattagtaacacactctagttcatacatcaaacaagaaaaagatgaatcttttaagtgtgccggatatcaatttcctataaaacacacacctaggagaaaatacgtgcatcaagctagaaaaacttgaagaaacactagttaaatctgcgatagacaatgaatactaacttgaataaacactaattaaatcttcttccaagagatgtacgtgacatgaacatatatgacaaatccagtgagattcaacacaaattaacacaaatccatcatcaattaacacatctactcaaacccatcatcaattaacacaaacctagaacctcaaagggctaggctagaagaacttacaatcgacgtgaccaccgccttcgagaaggatgaatccggcccaaccattgctcttgcgcaaccactgctcatacaacatatcgactgcttaaattcaacccgcaatcgtcggagcaaacgaccggctccgtcgccatcaccagcgttttcattgtcgtttggtttcgagagagtttcgcgaaaaatagaaattgacaaagtattttccttcaggcgttttttttttttcagttttgtcaaacaaaacatccaaaacgtgacacgtacacgtctctcttctctttcaaagtttctctcaagagagacagctctctctgtaaaaacgatttctgatttaatttttcacaattttattctgagaacccactgagagaactctaatatcaagccattggagatgctctaaggtgaagaatcagagattagaagagagaaaaagaaagaagaagaagacaaagataacccatcgggtccaaatgtactccgggtcaaataacccatcgggtccaaatgttaaaccggaagtttatcaaaccgaatctgaaccaaaattgataatacaaacacacacactctcctcaagtctctctcacaaagaaaagactcaaacccattttcctaaaaccctcgtcgtccatacaaagcc

SEQ ID NO: 14025 - DNA, 3000 bp, Unknown
  misc_feature (1)..( 3000): cDNA_ID_2710842_gDNA_ID_2214693_Annot_ID_136753 3000 nt of promoter + ATG
aaaccattaaaccaattgacattagcattattgagttttccttgaaaaaatgagtaattaattagatgaatgtaaataatttcgagtaaacatttgaaaattataaatattaaagaaggagacaagagggataaaggaagagcatatggtctatcatctttgcatgttattcgtcagaagagcttattatctaaaccaaaaaaacgtctcctttttattatctttctatggagtataactttattttcttctaaaaattgacttggaaaaaaaaatatcgagtgttgttgagaaaaactcatataataatattcggtgtcattatgggcacatgaggccgcacgtgttcttgctgtttactttgggatcaccgtcctctgtcacgtcacgtgattcaagaaacaaaaaatcaaaagaataaaccaaaaaaaaaagtttaagcatatagtattatcaataatgacatatatattaatatgaatatatgccagtaacgagcgttcttagtggtcactggtcacttgcacactactagagtcacgagactacaacatttgggagtatcaaatccataagtcaatttttaaaaactatacaattttcttttgtcaaataagaccaaaacaagagactgtgattgaaagagagaggctaaagagaagttagtgccaccgtacgtcaatgtactttccttctattattattttctctcttttgatatttttttggagggaatgatcatatattattgcagcaaatagctaaattttggtttggtaaattatggtataaatagtaaatttgagtacatggaatttagaaagtgaaccttctgagccaagaagaaggtgacagctggaaaagacactgtcggtagtaagtgaaaaataaatataaaaaacaaatatctctcatatgggtacctctcgttccgtgccatcgtgtttaattaatgttgaatgtgcagtggggttgggtccttgtggggagtcactttgtttagtaacaaactaaaaaaatacattagtatatgatttcacataactcaaatattttgttataaattaaattgttttttctcaatgtgatcaaaaccctagcaagcgtcacacgacacggcccgtttctttctcattttctttaattaaactcaatagtatttcgttaagttttgtgtagattcttaaaataacgggaatagattacgttttttcgtgcaaatcaatagtaattaatttctcatttttagggaacttgcacggtgttgcacaacatattcagttcaaacatataaaaattcatatacatgtaggtttatattacttgcatatcatatgaggttcatttcctgaaatattcaattggttttatatttggtattactcttttgttattaacttatttttaatgcatcctctaatattcttcttctttacaattttatggcccccacatggagccacgtggctatattaacttttcctttttacattcgtttattttattttcgtataagatgaaaacaatttatctttagaacttgtgtggatatgtcaataactaaaattgtcggtacttaccatgaagcatgtgttatgcctatgtatatttggaaaaaaaaagggagagggtagtgaaattagcttaactaatagtttatccgccgaacaactcttgtactcgtcaaaaaaaaaacaaaaaaaaaatcagacaaatcggccctcttccattattcgtctgcactctgcagcatatacgtgtattatttcgctaattaaccttattttgctataactttagtttattttgcagcttagttataactaactatatgtatagtatacgcattaactggaggcgatggagcaatgcaaattgtacgtcaattgtagtttgtgtacatatatagaaatgatattgtagcaaacgctgtggtagccactagccaacgaacaaagtttcatatacggacatgcgtatgattatttgaaagaaaaagagcacagggaaatagatagatagacccactaaataagtaaataatatgtacataatatatagtacagaagcaatgaaagagacgtatatatatgttgactgaatatctttttgtaattataagaaaaaacaaaatatgtaagttttaaacgatcgatcatggatataactctatttgctggttggaaaaaaaattgctttccatatcataattttctagctcaatgcgataacacaagattctatatgttaaaacaagttaaataaattgacaacaaatatgattgtttagatgaattccctattactgaatagagttactcatacattaaaacgtgtgtttcctagttaaattttattttgaagaaatcaggagaatgaaggtgaaacatacaatattagctaatcaattatcatttttttttttttttcaaaatcaactcatggtgaactagcagttgaaagttagtcatatgacatgtaaaactcgagttttcttgttcgattattttcacttcgattagttggccatataacattgctatatactataaacacataaaaaaaatatcaaaaacactctattcctccacaaaactcacatagttttgtaactcttatagtgaattaatttgtgtagttcttaataacaatttgtataaatataagtgagtttacactaactctattcatccgtgtagtataagtttttgaacatttcaatagctcagtaggtgcaaagttttaactctcttcttcttatagataaaagtggatgataaattaaaaaataaataaagaagagagaagtgaataaggtcgagtcggtcactcacggtgcatggtcactctctctgcacgttctcttgccctctctctctctcgttatctcccctattaaagactctaaccagtcacacagagagtgagaaagagagagagacagagtcagagtcttcgtctgcaagagagaacaataccactcaatcataatctataaca

SEQ ID NO: 14026 - DNA, 2225 bp, Unknown
  misc_feature (1)..( 2225): cDNA_ID_3021416_gDNA_ID_2214693_Annot_ID_189453 3000 nt of promoter + ATG
taacataataagcatgtctactttacattcatacacaagcaaccaagaatttcaatcttgtcttggaaatccagctgcccatctccttgtttgattttcatttactccacttattgttgttaaatacatacataaccacttgatttattggtaatgctattatattattgttgtgtgcttgttatggttgtagatgtagtagtgaattagatatagaataaacaaatatgttagcgtgatccatgttatgtcatcgaggtgtttcattaccacgaattttcttagaaattgtgaacaacatattgggaccgtgcgattaatttgatttgtgttgacaaggaaaaaattgttttataattttaacataagtttggtttccaacaccggtgtttagtactgttttaatattgtatacctaatgtaagtagtttattaagaatggacaaaatgtacattaactacttaatatttaaatgaacatttgttttaaaacaaatagcagagtgaaaaatttgacatagcaatgtcattttcattgaccaaaattaatatatcaaagtgcgattcaaataatataaacttatagtttaggtttttaacaaaatagtggaaatgtttcgagatgctttcacacaaaacaatactagtattttcttcaaaaactttaatacatatatatatatatatatatatgaatataatgtagttttgaaaataaattccatgaacaaaaaaaggtcctaataataaattcgaataaaatagtgttagttatttaactaacacatgttatgattaacaactttaagttctttgcaaaaaagagtttagtttttaaatcacgagttaaagtaatcgacaccaccaccatcttagattttgtagttaagactaattaaagaaaaaggaagaatacttccaacataatttagagccaatggatttgaagtgagacaaagcatctcagccgttgaaagattttggtctcgatgttttcaaaaaatcttcaaaaagccacaccagagagacactcaaatagagcaccggtccgtcagattcagtttcgaaaaccaggcccaaagccacctgccagacttgtttcccctctaattactatattgtccttctctcttttgcagtgtcttcctcgaatcttaagggtaaaattgggaattaaagtaaatattagtaatgaaccatctgcgtcagtttcgtctttttgctctgtttcctcggcatatgtaagatttttttttctttcaaaaaacactgtttcagatcagtgaccctttctttcattattttggagaaagtattcgaaaataaagtacgtgaaaacgggaaattatttaaactgagaggtgaaattctttttttttattttcccttccgttattgtattattttccaatggtatgttggaagaatttgttttagatttttcgaagataaagaaaaatcaaccaataaaaataaaaatggcaaaaacatgttttagttccttttgaggaaatgttgttatagagggattatccagttatagacatcatcgcaagaccactaaattcgttgtacacaaaaatgataagcaactagtagtactttgttgtttcaaaatttacaagtagatagaattagctcgtacacaaacctctataatagtactatagaagaagcaacttacggccaaaattgaaagagtaagacaaattaagttgtagggggagagtagagtcacgcgctggatttgcgaagagactcgacaatgatggcacaagaacacggtacatatgtagataagtacatctacagacataagccacacatagaggacgagaaaccagaaagaaaaaaaagaaatgaaaattccttattacaaaaaccaaaagatttagagagagagagagagatagagcattgatgaagaccactttttatatattgcacgcatccatataacagctacagagaaagaaaaaagaaagaaagtgattttagagaaagaagaaaaaattaaagaaagttggggcgccaattacaagttttgagctttgcatgtgtttctttcttccgtacattaaccactctgagacataacctctctctctcttcttttgttgtctttctgttctgttcttgagatctctctctctctctctctctagggttatttttttctgggttttttgtttttacagttactctgtgttgttgaggaggcgatg

SEQ ID NO: 14027 - DNA, 3000 bp, Unknown
  misc_feature (1)..( 3000): cDNA_ID_2710816_gDNA_ID_2214693_Annot_ID_189452 3000 nt of promoter + ATG
tccatccattcctaaccttgttactattatctatcagtctttttgataattaatacaaatgttgatatgtagagtacgacgaatcgtaaattgtaataattgtttcgttttgctgtaatttggctctatctttatacattagaagagataatcaaaaaagagataaaaataaagccaaaataaatgtgttttttttgcgctggtcaaagaaaaaaaaagaagtccaaatgacagttatacccctaataacgcaccatgagaactcagacgattaagggtgtaatagtaataacaagaagtgagtctccggtctgaaactaattaaggagacggcaagagaaacaagacatacgtttgctgtcccacgttgatcttgttgtttactctctctctctcctccatcggcgacgaccaccggagatcagcgtcaccgtaccaaaacatcatttaccttcttttagatttgttgttttttaatcagttgaatcggaataaaatatcgcatcagagatgagtaacgagcttctcaccatcgatcctgtcgaccttcaattcccttgtaagccttattttttcctcaacttttcgatgattcgcatatgtcttagatccaacttcttccgaattagttgtaatgattttgtgatttctttctttggatgtgtagttgaattgaagaagcagatctcttgttctctctatttgggtaacaagaccgataattatgtcgccttcaaggttaatttcaatttttgaattggatatatattcttttgtgtatatcttaatgttttcaagggtcaattattttttaaaggttaagacgacgaatccaaagaagtactgcgttaggcctaatactggtgttgttcatcccagatcctcttctgaagttttaggtttgtctctctttcttttcgttattgatctccaatggataaaagatgaggaatttactagttttgggatcatggttttgattttttgttttgttttttaattagtgaccatgcaagctcaaaaggaagctcctgctgatctgcagtgtaaagataagttcttgcttcaatgtgtagtcgctagtcccggagccacccccaaggatgttacacatgagatggtattactatttattattatttaatttggaagctttggttacttaagacagtgttttatcgtgtaatgatgaacactgcagtttagcaaagaggcagggcatcgagttgaagagactaaattgagagttgtctatgttgctccaccacgaccaccatcaccggttcgagaaggatctgaagagggctcttcaccgagggcttctgtctctgataatgggaatgcttctgattttactgctgtaagtaacacacatctcttgctgagatatcatagattttttgtactagtgttgatttccttgcgttatctttaatttaggctccaagatttagcgcagacagggttgatgctcaggataattcatctgaggtaatttaataacccatctgacgcttcatgtaactgagctaacttggcatgataaagagtggatgagttttacactattacgctacctacattagtttaccattcaaccctatggaattctctttcttgtcaggttgtttagagcagtttagtcttttttttgttgaagttcagatcattccagttattagcaacttaatggctcttttattgtacactgcttgatgtgaaattctcaaacctattaggccaataatcttaactttttgtttattactgaagaattctgaataatcttaaccttgtttgaatgaagctttaactaatttctgaaaatactgtcgtccagaagaatattgtttcctctgctgtagttttagctttttactgattatgcatgcaattgaattggtctaagctgcaacatatctactagctattaattggcacattttagcattgaagttacgagacctgagtgatcattctattacaatgtaattttgacacctatcaatttgtatgatatcaggcaagagctctggtcacaaaactcaccgaggaaaagaactctgcggttcaactgaacaacaggcttcaacaagaattggtaagcaacttttaaactattccttccggtggttggtttaagaatcaaagaaactatttgtctgaaatgggaattgatgattaacactttcataactagttacccggttttaggagtagcggccattttcttgttatctgagttgttagatttaagctcaatgaagtctatgtaccctgcttttcttttttgttgcgtaacaaggacctctcggataacaaaagatttaatattgcaggaccagttgaggcgcgaaagcaagagaagtaagagtggtggaatccctttcatgtacgttcttctggtcggcctaatcggtttaatcctgggatacattatgaagaggacatgatcagatcccttcaacaaaatactccaaaagtctcaaagtgcttaaaaaagcattgaaaaggaaagaaatcaaattgtgtgaggaggacaatcttctcttctgccttatcgtcgtcatgcacctttggttaaaatctgaacttagtgcgttagaggatttgtattacggtttccataagacttagaattgtcacaaaatctcctttttcctctctcttattacaactttgtgtagtcttaaacacttttgtttcttcgtcttctctcatcttaactttttctctccatctctcatagaataaagggatgaaacatgtcgccttatcattgttttagtgaggatacaaagactctaaataagtcggaaggttctaactctacctggtacatcttcgtagctacaaaacaaaactcgccgagacattaaccaaatgacaaatacgaacacactcttcctcagacatgatgatgattcagagattttgatttttcaagaaaactctgtttttcctctttttgtttttgcctcttggggcatttggagagca

SEQ ID NO: 14028 - DNA, 3000 bp, Unknown
  misc_feature (1)..( 3000): cDNA_ID_2705845_gDNA_ID_2214693_Annot_ID_189451 3000 nt of promoter + ATG
attcttatcctctgtaggcgataagattgtgaagatctgtgaaggcaagtctcgaaagttgtcacctttatgtttcctttggaatttgtcttgtctcgaaacaaagagatttgattgattgttaaaatctggattcgattttgtattttgcagagtatggctactttgaaagaaatgaggtcagtaatatcaaagctaaaaacattcagggtctggaactagagctgacatcagagcgtcttcaggaatatgacttcaactctatcaaatccacttgtttcaataaagaggtgcgtgcgtgcgtgttataagtaacattgacgaaaattttcacgattttgcttgcttgcttactcttttactcgttattggtgttagattgggatcttgtataagcttaagtatggggaaataggtgctaagttgatatccaaatcatcccgtcctatggctcagttcactggtactgttagacacctcggtaaactctctggtttggaactcacttccatgagtattgttgacattaacggacacaagctcgataagtggcatgttgggctcactctcattgcagggaacgcctctgtgcagattagacggttagtagttttaaaacgttgattcctccacctcttatagaacaataagcattgtgtggtgaattctgaatatgtttcctctttgcagagaggctgatagatacgttgtttcaacccgccatcatattcacccgagatttgtgtcgctcactgagctgagatcactgtatttctggcgcatatcactcccgtccactgtggcgatgggattcgagttcgagcttaaccctaggataactcttgaagtgatggtctccgaatcccatcttcaacctccgagtgttgcactccaatatcaatgttcaagggctcagtgtctcattagagtttacggtgatgtctactccaaaaaaaatggtgtatcttttgcgtttcgtccttcttctttcgtctagttactcggatttttaccctcaaattactttttttttacttgttggcctcggctagttattgggccaattgtttctatagtgggccgtgtattacagacagacacacctaaacgacgacgggtcgagaggataaataaatgggaatattctcggaaacattgatgtgattccaaatattttattcccaatttggtattcttcttcatcatagctcgaaaccctaactccccacttccatcgaccatcgacatgttttaatcttagaattgtgaccaataaggtgatggatacatttcaaggcaagtccgaaggcctggaaccacaattggcatcgaaggatcttcaggcgtcgaagccgataatttcatcatcttcttcgttatcagagcgtcgatacaagagtggtacttttcttttctccaattctcgatcatacttgaatcatatgtgtttcgttttgctccgaatttctaaatcaatcagaattacgtggttatgtatggctgatttgttagaattattagtgtagctatagaccaagattttttcttactcaagagttgtgattttctctcgcaggcagaaagatacctattattgctattgaatgccgtagatgcttatcagtctcttctccggtagttattgccgacccttgcatgcacagattctgcggttaggttcttctttactctttctttaacccactagctaatgtgtgtgactgaaaacaatcagggtgtttagctttgtcttattttaacacaaacccctgattctggactaacttattaccctaacaaaattgtctttttttctttcttaatgcaacagtgaaatgtatcttattcctctggggacgccagaaacgtagagaaccttgtgtatgcccccttgatggagaaaagatgatttgcttacatcctcctatgaacattgccgaatctgcggctgaggagattactggccttgtcgacgtttataatcctatgttcaatccacgccattacatggtaattaatcagttcacctcctaatcaattgaacatgctctaatattcttagtaagggagtagttattaatatcttttctaactctctgcttacgaacattatgttgtttcttctttgaacggaaaatcattatgcatttttaggacatggccgagacacaacttggtaagttccttgatatatgctttatgtatagatgtttttagactttgttttgttgaacctaactcttttagttacacgttttttttgtagcgcggacatttacacggttttactgtttggatctcactctcctactcatgggggcacttgcgtactgcttcaagtgttctaaagcctcccgcacttagaagtctctattttaattctcttggaacgactttatgagtatgttataattaaactattttaatcctgaattctggttatggatctgtgtcattttggtcaaactcatcatgtctttttctccgatatccatccattcctaaccttgttactattatctatcagtctttttgataattaatacaaatgttgatatgtagagtacgacgaatcgtaaattgtaataattgtttcgttttgctgtaatttggctctatctttatacattagaagagataatcaaaaaagagataaaaataaagccaaaataaatgtgttttttttgcgctggtcaaagaaaaaaaaagaagtccaaatgacagttatacccctaataacgcaccatgagaactcagacgattaagggtgtaatagtaataacaagaagtgagtctccggtctgaaactaattaaggagacggcaagagaaacaagacatacgtttgctgtcccacgttgatcttgttgtttactctctctctctcctccatcggcgacgaccaccggagatcagcgtcaccgtaccaaaacatcatttaccttcttttagatttgttgttttttaatcagttgaatcggaataaaatatcgcatcagag

SEQ ID NO: 14029 - DNA, 3000 bp, Unknown
  misc_feature (1)..( 3000): cDNA_ID_1450508_gDNA_ID_2214693_Annot_ID_189443 3000 nt of promoter + ATG
caacatgataagcttgatgtatttatcatcgtgtggtgaagaataataaagtaaagaaaaaaagaatagatgaatctggagggacaaaataaagtaccaagtaataaattgagataaccaccgccaccgcacgaatacgtttgatattaaatgccaaaaaagggaccccgttttgatttttcttacacacaaaatatcgtcccgtcaaaaataatttactatttcatcattgcttccctgattcatttttttttttttggtatttatttgtctctcccccactttatttataagatttaacatcatatcttttccttaatattcatggcaatgatatatcattgtcattttaaaagtaagagtatatactatatagtgtgaacatcattctaccaaaaatgcatatgagaaacaatctttatttcaaatgatcaataaacataacaagtatttttgaatacggaaaactaatctctctattatacaaaaaataacattaaccaacatcaaacttagacatggttttaataaatcactgctttttggggatatataaaataaaaatacacagcattgattgaaaggaacacatgaatgaatgaaataagattttggaaatgatcgatatgtacgaaggtaaaaaaaacagtatacatttgtcgagtctgtgaccgtacacaaaatgtcaggctccataaccttatgcccgatagaaatgtatcattacactctctgattcacatatctgtctccatctcgagattcgtgtttcagatctaatacattaatgtctacgtacttttgttcgtacgtacgaattcgatacgaaacttctttcatgattcgtatcccaattcccaaccttacttacttttctccaaattattagtcattaacaactaaatcaccttataatcaaaactcatatggaaacaatgatgtggacctaatttcggttggaagatattttgtttatctggcttagattttgtcctttgatttagggaatcaaaagaaagtcataaacattaattttgcctgtaaaatcacacatttcagatttgttctcgtatgacctacaaataaagtatatgattacacaatcaatctttagattcaagaactttgtccctacttcattatattcagctaacatttctttttaattctctgtcgtgcgaaaggttgttgacaatataaatgatatatgtacttgtacgcgtaatgctgctaatacattttaatttgggcttcttctgggccttaatatttgggctttaaataagttatctctcccacttacgcatgtaaacacagctctgataattacgctgaggtggcattttttaattggctaatgcattaagagatgcgtggcgagaaatttcccctcctataaaaattgttgaagagtccggtcaactccgaaagtcttcaaatctctccgtcacgaatcgttctctcgtcgtcatcaaaatctgttagccgaatcaggtgagccctttgttatttttgttgtttatgatctggatctctgttgattgaggaaattggtagatctatggatttgttagatgagcgtgtgcgtagatctgaaaatgagatctcgatgttgaatctgaatcgcggctggtatacgattcccgatctggatacgattcaacatgcatagcatctgagaattttacatagaattttgcatgttcaatttttgtctcgctgatttgagaattttaggattgcttcatctaatttagttttgttgactcgatgctgaaattagttttctgcgtttgagagtttcgaatcttccatctcctgaaaatgcagctcaaactcatatagtatatgtcaaattgaaacaagttttttcaattacgtttctaagaactcttgctaaccagaacaggattgtaccaagtaatttacatgattaaacctgaatttgtactgatttgagcttacggataaatggaaacaatgtgatagtagtatataaatttgggtatacgtagttgccttgtgggaagcaaatcttttaccagaggtttctagtatcatatagaatgtatgaccatggaaaactaaacatgagcttaatggtgtttagatgtctcctattatttcatttgcttaataattctctgtttttttttatatatgatcgctcttttgcttccgatttcctaaaggccaaccattattctcagatagagaaaagaagaaagaatggtgggaagtggagctccacagagaggaagtgcagctgcaactgcaagcatgcgtaggaggaagccgaccagcggtgctggtggaggaggtgcctctggtggtgcagccggatccatgcttcagttctacaccgatgacgcacctggtctcaagatctcccccaatgttgttcttatcatgagcatcggtttcattgctttcgtcgctgtgcttcatgttatgggcaagctctactttgtcaaatgatgacaaagataatagttgaagacaatgccaccctaagtgactgctagtgatccaaatattatacagtggtttcaagttaatgttttaattttgtggtttattaccagagtataaacgatctttcacaattccagtttctttacattcaaattttcaatattcttcacacatattataggcatgagctttttatacatctcacaaatgacaatgagtactattatcacctttttaactttaaaaaaattcaattgttgatagcataacacactcatagtcaatggtcttgagtgaaataactaatctattaaccataactaatctataaaagtctctggcgtttattgaacaattaagaaatagatgggaaatgttggagataaactaaacttttcagggtcttagttgtcaatctgaaacggggcccgattaaattatactcgggtcattcttttgtccaccgggtttttcttcagaacttgagcgaaggaggtcgcgatattggagagatcttttctaatg

SEQ ID NO: 14030 - DNA, 3000 bp, Unknown; identical to SEQ ID NO: 14025
  misc_feature (1)..( 3000): cDNA_ID_2710842_gDNA_ID_2214693_Annot_ID_189442 3000 nt of promoter + ATG

SEQ ID NO: 14031 - DNA, 3000 bp, Unknown; identical to SEQ ID NO: 14024
  misc_feature (1)..( 3000): cDNA_ID_2710846_gDNA_ID_2214693_Annot_ID_189440 3000 nt of promoter + ATG

SEQ ID NO: 14032 - DNA, 3000 bp, Unknown
  misc_feature (1)..( 3000): cDNA_ID_3021440_gDNA_ID_2214693_Annot_ID_189436 3000 nt of promoter + ATG
catccaccaagcaaagaagaggccttcgcagatcacaactgttgtttgtggatcaatgtagccactgaagagtgcggttactgctgcaagtgccatacctccttcgacacatacagcatggcatacacatggttgggtccaaggaatctcttccctcacagcttcaatgttacgcccaaacagaacacacggacaaaagagaccagtcctgcctgcaaaatcatacaatagcattgattcaaagtgtcccttaggtgcatattgaactacaatggaaacgtttcgccaaagtaatagggaactcatgcacaagaacaagtgattaagaatcatctgtttggacagttacaaaacaaagaggaaaaacttacagctctctggatcttcagcacaaccaaaaatgccggtggtccagttttcatcagaaggaggttcataggtttcaggtagaacttgcatacattcatggcacttgcggacattcaactgtaaacaatttcaaaaacagaaaaagcagtagagtggttgtaatacatgacgccacactacaatgactaccatagtgagagcagaagaaattcagagaaagattctagtttcttgattccatcacacattcttataaggaagctcaaaggaacgtacactactagtactctaggcttattttaatagttgcttgatgagactagactaatcagtgttgatacataaaactttaaaacaggtagtggtgccaataagaaatcgctatatgttcatgtcacaacagatatgcactactagaatctatatcacatcacaaggatctaatgcacggagaaattcaagattgatcaaagaaatcaaatcaacagagactagttacactattcctcaatcaaacaggacaaaaatttcatctctaagacctcatcgagaggtggagatcgacacaaacaacaatcgggatcaacaagaactctaccaccacagattatcaaagccatcaaatcgattaaggtacagatctaaaggaattacgagatcggagttctctagaaacgtgcgttaagagtaatgcagggagggagaatctaacgtacctgaggaacatcaatgggctgattgagttcaccgggtgtgatatcttcttcgacaggagcctgctctttcctcaatttcacgtaacgcgaactggcgtttccatccgccatcgaaaccggtcaagagaaatataataatctctgaagatctttcaccaatgaggtcgccggaatccaagaactggaattttctctctaacaacaacgttttgtttcgatacgcgtgagtcgtcgtgactcgtctatatccatgtgagaaagtcttctcatgattaagaaaacaaatccgaaagatagacgccacgtcgtcgttttaccctctttaggcggtgtacattgtgatgaaaaagtaattagaagaaacttgggataacaacaacaaactaccagtcaatcaatagtgttcaatgatacaaatatttatggtaaaatcagacctctcttctttttcatagaaaaaataacacgaaaactacaagaagataatccatttcctgagattatgtggtttttgtaattcttatcaagacatccagtgctttggagccatcaattcacgatctccacccgaaccttgcaatgcgattttttgaatccgagaagagaattcctctgcctgttcaatgttcaaataaatgttgcaagttaaaacacaattgtagttattgtaacaatgcgtagaagacaaatttaaaaaacttactttctcatcaatccacattaaggaactgagttgattgttcaagattctgacaactacatcaagtggactcatcccatctatcgcttcaagttctccaccctgtttccacacaaacatgtttatgatgtatgttcccagcaaaagcaaacgaatagtatatgataagttactgcgttacctggtttgcatttacggattgtataatcgatctgatttgttcagtcatatgctccagttctctttctactagctcagactgttcatacctgggatgaaaaaacaaagtatattgtaagaaagcatagaatcaggatgggatgcgcatgatagagctaattcttctaagcatagatcaaatcatatttgtttccgtgtctgtgggttttctttcattattcatcagaataatatgaagcagaaaggtaatgatgcaaatagttctcacattgcatctctagttgatgctgcttcatcgtccagaagtgatttccgctcgtcattatatatacgctcagcctcttcctccatgctttgcaaagccttgtcaaccttaaacagaaacagagaatccaaatgattagcacagtggctttggtatttgacttgcccaatttcgaattaagcgaggtagaaggtagacaatctccatgtcagataaaaaaagagtgcgactgagagagatgatgaacaagagatatattgatttcccacagataaggcacacatgatttcccgctgcaagttacaatcagaaacctcatttaaagattaacatagagatgtaatagttttattgcatacctcttgctgatgagtctcgattaattccagctgtcgttccaagctagattgggtttcaaccacttttgcaacttcaatctgtttgttggtcaagtacacaaaaagaatgagctaattatagagtagaggcctgtatgagctaaacatacaaactcagaggtcagctcagaacaatgtctctgaagaaagattcataacggaaagaaattttaacagagactccataatatgacaaagttttttcacctcaagtctcaaaagaacatcacggttttgcaagatccgcttatcccactctgctattgcatttgcctgtttccggaatctccctgtgcgctcttgtagctcagtattccactccttgataatctacaaataaccagcatttttgaatattatatatataacatg

SEQ ID NO: 14033 - DNA, 3000 bp, Unknown; identical to SEQ ID NO: 14023
  misc_feature (1)..( 3000): cDNA_ID_3021443_gDNA_ID_2214693_Annot_ID_189434 3000 nt of promoter + ATG

SEQ ID NO: 14034 - DNA, 3000 bp, Unknown
  misc_feature (1)..( 3000): cDNA_ID_2710832_gDNA_ID_2214693_Annot_ID_136757 3000 nt of promoter + ATG
cggatctcatttcttgcatggagatgaaacttccgccggctggttgaatttcaacattggacaaatctccatcgccgttttcatactcaacaacaaatgaaatgtagtacggatttgctccagcgtccatacgaaaaactatgttagttcctcgatataaacatgccgcactgataataagaagaaaaaaaaacaatagtcaagattttcatattttttgaacatcttatatgtgattggtatatcatgtcaatagttgaataacaaaatactcaactaagaaaaatattttaactgaattaagttctttttgtagaaaaaaaaaatggtaacgtaatttatttgatttatcagagttttattttctttttacgcatcaacaatatccaacacaatttttctcaaatacatggaaacataacctcatggtttctcttcaatttctatattaagtaaataaataacttaattaagaaaaaaaactcaaaaccgggaatttttaaagtatatatatatatatatatatagttaccgtttgtagttgacacgtataacaccagcggatcgaagttgatcggcttggccaggtttggctaaggcacccatggctttgccgctaagatcaatgtggactggttcagaggcgcaaggaccaccagggcactcgtcggttatcgtcaccgttattggtgaccccgagcacgctggatgtccgatgcatacaacctaataaataaaaaagttaacatatactatattagttgatacaagtaaaatcttgttgtaaccatataatatatatacattccgatcttgcatgctacgtcaatttttttccaaaccaaatagttaatgttcattctatctgattaattaaatatgtcaaacatagtttaccatttttcaaagatataataactggtcattttattgaatatataattatatatactcaatttatcatgttttatgaacaagtttagctatataaaaaatattgtatcctcttagatgaacatactataataaattactaaataatacattacagaaattaaaaagcattaataaagctgatcaacaatacatatattacaatcgctcttgccctatatacattcatacgaacctgataacatgttccacatccttttccattgttgaacagcgaaggacctccggctgaaaccatcgcgtatagtggtggattagccaccgcggaaccgtacccacaagctcctcctacacacacatatatatatatatatatatacacacatttaagcatcatataaatgaatttactattctaagaatttatgtatatatattgttagaaatatgtaatattattacgtaccggtgctaccggcgccgaatggttcaccgtaccaagtaactccggcggttcccgatccagctacatctatagtctcattttggcaataacaaaattttagtgagactgcgaaaagagctaggagagcgaaatatctttgtgatgatgccattgatatatctagctatatactttgttttgtataaaccaagctttctatactcttttaaaggtatttgtgaatttgattcattagatgacaaagctttttagtttttataatggtttattttttgaacactctcacgacgcgttcaactttcaaggaaattgtatatttgcaatataagtgaatctttgtatctatggaggtcaaactctccaatcctcttacatgaaaggtaaatttgaagtgaaaagagtaaaactttagtctaaaagataaatgcattcaagattgtgttgaacaaattttggtaattgatttcaaagtaatttattaataacttgctataaaaacttttggtaaagaaatagcatcattttttggtcaacaaatacatatcttcttatataagattttaattatattggtatatttactaccattgacaattgactaaactttttggtaaaaaacaaatgtaaatactattaagctaatattaaacaaaatatgtaatgtctattatgaatcgatgaaatgtaacttacgagagcaatattcatgatagagacaacgatagataaaaatatacaaaaactaagaaatagaagtaaatagtgacaatttgccagcagtattcatgacaacataaattttatcaattttttttagaaacaatattatataactagttttattataatatcataaaagcccacaaaaataaaattattttcagaagcaatttaaaaatggtatattaattgctgtaatttttgaaagaataaattatatatataagaccaaaaacatgtatttaggctaaatagaggaaaagagtaaaactgtcgtttaatgatgctgccgagcgccgagccagtagtacatcgggataaagtgtagctccgaaaaatgcagcacaaagacgaaaaacccttattagtattttatttattcgtttgtagggaaaaaagttgtcattaaaataaaaatatacaaggcaaaagcccaacacgcctaaggcccaaacagaacgagagaccatcttctcttgtgccccacacacacacacgcggcgtctgattgtattcgtgatatcatcctctgctagttattgaattcaaaccaaagtccctttattagtatttaaccctctgcttccccagatttctgaccttgtatgcttcttcgtcgtgttggtacgcgttccctttctctttaacttccttgtgcaagttggtttagagcaagatattattagctttaggtgtgattcgatattcatgggtttcagaatgcatctcatatttgccactagtgtgaaaattaacaacttcccctttagggtttttgtcctcattcatcaattttggaaattctgatggaaattcgaccttggttagattttggaagctttaggctttattgatcagtaagattggaagctgttgtttcgcatcgattcaagcctcaaaatctgagtttgggagctatg

SEQ ID NO: 14035 - DNA, 3000 bp, Unknown
  misc_feature (1)..( 3000): cDNA_ID_2710820_gDNA_ID_2214693_Annot_ID_136760 3000 nt of promoter + ATG
ttttataaatatagaattaaataaaagaattgaagtttaattgttttatttttatttttgtcttcgtcttcttctttagttcgttggttgcagaagaagaatgctttttgtcacctactctcctttgtagtttctctactctttcttcttctctctctatctctgttctgtaatttttgtcgtgttgaaaaatggagagatacaagtgtagattttgcttcaagagcttcatcaatggaagagctttaggtggtcacatgagatctcacatgcttactctttctgcagaacgttgtgtaataactggtgaagcagaagaagaagtagaggaacggccgagtcaactctgtgacgacgacgacgataccgagtccgatgcttcttcttcttctggtgagtttgataatcaaaagatgaatcgtcttgatgatgaattggagtttgatttcgctgaagacgacgacgttgaaagtgaaaccgagtcgtccaggattaacccaactcggcgacgatctaaacgaactcggaaacttggatcgtttgatttcgactttgagaagctaacaacgagccaacccagtgagttagtggccgagccagagcatcacagctcagcttctgatacaacaacggaggaagatctcgccttttgtctcattatgctgtccagagacaaatggaagcaacagaagaagaagaagcaacgtgtagaagaagatgagacagatcatgacagtgaagattacaaatcaagcaagagcagagggagattcaagtgtgagacttgtggtaaagtgtttaaatcgtatcaagcattaggaggacacagagcaagccacaagaagaacaaggcatgcatgacgaaaacagagcaagttgaaacagagtacgttcttggagtaaaggagaagaaagttcatgaatgtccgatctgttttagggtttttacttcagggcaagcacttggaggtcataagagatctcacggaagtaacatcggagcaggaagaggattgtcagtaagtcaaattgtccaaatcgaagaagaagtatcagtgaaacagaggatgattgatcttaatcttcctgcacctaatgaagaagatgaaacttctttggtgtttgatgaatggtgaaaacgaaaggtaacaacagactttgcgtgattcgggttgtcaaaattattattctttgttttttggggtttgattacttttatgttaatgcaaaggaggctacttttacatgttctaacgccaagttgtttcagtactagcctcacgtcgtgttggcctaaatcagagagagcattcaattttctttgttttttttttgtttgttagacattttttaaggtattcgtaattgtatcaatttcttggtttctctggcaattttaggtattactgtttcaatttagaagctagagaagtaaagagtgcccacttcatctatctctttcgcctactattaggggcaaaaaaaagaaagtcaaatctaaaaagagaagagaaacaaactttattgttgctcttatagtttctatatcattttcactgtagaatcaaatttggcctttggctttggggtttaagctataccacctacttagaattattcttcacgtatactttattctttacttatgattggaaacatacccaatcactaataatgttcgtaatcaccactcaatactcaatagatatcaacaaagttgtgtgattcaaagttgttgtgattgttcaactagacttatcacgcaataatttggtgggtacttactaggattgtacagattaaaatcataaatccattttttgcttggtgtctaatcacttggatttagtgtttacaaaatattagttatgaatgtcttttttaataaaattgtgtcattcaagagtttattgggataaatttcaagagtttttactttttatttcatgtcaaaaagttgtatatttcatgcttttatttttgtcaaaacgtttaattttgattgacaatttttaattttataagatggacagaaacacgttttccaaaaacaacaaatggacataaacacattgggcttagcccatacaaagtggatacataaaatagaaaaaccaaattaaatgactagaaataaaaggactgggcccgagaacgtgaaagtaagcccaacttacatagaagtccaaaaacactaaaactttcatgttgttaatattttccagtttgcattattttacacttatacaaataacaacagatgcttgattctcttggaatcttcgaattctctgtctttaagactttacaaagatctcattaattaccactttaaccctgaaatctggtcacgggtctgggtcattttggtcacttttatctctaatcccacaaacgtaccggcaaattcttccttttttttctgctcgacggtctctcgaggacgcgactcacagtcacatcaacagcatgcattcagaaaaatcaaaaaacaaatgaattatatgataaataaaattagttgatcgaggaatcaacctaaattctatagtttataccttgacaaaaagatagcatgaaatcagcaaactcatgtaatataccaaacataccataaaaggtccggtcaaaaatagaaaaacacgaaaaagcattataactaaattcaaagttcaaacataagactcaaagagaagttattagagaccgaatatgccagaggatttgtatcttcttctttttttactatacaacaacaataatctaaccttattttttttcatctctttattacatgccatattcacaacacttcgtcacgctaaagctaagcatatccgctttcatattcctttacacaaccactatttatatatctctatatttaccctcttcttcttcttccaatttcgttataatatacttctttccctttttcaatcaaaagaaagaaaataaaccacacacatttttaaggtaaaaacttgagtttatattttg

SEQ ID NO: 14036 - DNA, 3000 bp, Unknown; identical to SEQ ID NO: 14028
  misc_feature (1)..( 3000): cDNA_ID_2705845_gDNA_ID_2214693_Annot_ID_136761 3000 nt of promoter + ATG

SEQ ID NO: 14037 - DNA, 3000 bp, Unknown
  misc_feature (1)..( 3000): cDNA_ID_2710816_gDNA_ID_2214693_Annot_ID_136762 3000 nt of promoter + ATG
ttttaattctcttggaacgactttatgagtatgttataattaaactattttaatcctgaattctggttatggatctgtgtcattttggtcaaactcatcatgtctttttctccgatatccatccattcctaaccttgttactattatctatcagtctttttgataattaatacaaatgttgatatgtagagtacgacgaatcgtaaattgtaataattgtttcgttttgctgtaatttggctctatctttatacattagaagagataatcaaaaaagagataaaaataaagccaaaataaatgtgttttttttgcgctggtcaaagaaaaaaaaagaagtccaaatgacagttatacccctaataacgcaccatgagaactcagacgattaagggtgtaatagtaataacaagaagtgagtctccggtctgaaactaattaaggagacggcaagagaaacaagacatacgtttgctgtcccacgttgatcttgttgtttactctctctctctcctccatcggcgacgaccaccggagatcagcgtcaccgtaccaaaacatcatttaccttcttttagatttgttgttttttaatcagttgaatcggaataaaatatcgcatcagagatgagtaacgagcttctcaccatcgatcctgtcgaccttcaattcccttgtaagccttattttttcctcaacttttcgatgattcgcatatgtcttagatccaacttcttccgaattagttgtaatgattttgtgatttctttctttggatgtgtagttgaattgaagaagcagatctcttgttctctctatttgggtaacaagaccgataattatgtcgccttcaaggttaatttcaatttttgaattggatatatattcttttgtgtatatcttaatgttttcaagggtcaattattttttaaaggttaagacgacgaatccaaagaagtactgcgttaggcctaatactggtgttgttcatcccagatcctcttctgaagttttaggtttgtctctctttcttttcgttattgatctccaatggataaaagatgaggaatttactagttttgggatcatggttttgattttttgttttgttttttaattagtgaccatgcaagctcaaaaggaagctcctgctgatctgcagtgtaaagataagttcttgcttcaatgtgtagtcgctagtcccggagccacccccaaggatgttacacatgagatggtattactatttattattatttaatttggaagctttggttacttaagacagtgttttatcgtgtaatgatgaacactgcagtttagcaaagaggcagggcatcgagttgaagagactaaattgagagttgtctatgttgctccaccacgaccaccatcaccggttcgagaaggatctgaagagggctcttcaccgagggcttctgtctctgataatgggaatgcttctgattttactgctgtaagtaacacacatctcttgctgagatatcatagattttttgtactagtgttgatttccttgcgttatctttaatttaggctccaagatttagcgcagacagggttgatgctcaggataattcatctgaggtaatttaataacccatctgacgcttcatgtaactgagctaacttggcatgataaagagtggatgagttttacactattacgctacctacattagtttaccattcaaccctatggaattctctttcttgtcaggttgtttagagcagtttagtcttttttttgttgaagttcagatcattccagttattagcaacttaatggctcttttattgtacactgcttgatgtgaaattctcaaacctattaggccaataatcttaactttttgtttattactgaagaattctgaataatcttaaccttgtttgaatgaagctttaactaatttctgaaaatactgtcgtccagaagaatattgtttcctctgctgtagttttagctttttactgattatgcatgcaattgaattggtctaagctgcaacatatctactagctattaattggcacattttagcattgaagttacgagacctgagtgatcattctattacaatgtaattttgacacctatcaatttgtatgatatcaggcaagagctctggtcacaaaactcaccgaggaaaagaactctgcggttcaactgaacaacaggcttcaacaagaattggtaagcaacttttaaactattccttccggtggttggtttaagaatcaaagaaactatttgtctgaaatgggaattgatgattaacactttcataactagttacccggttttaggagtagcggccattttcttgttatctgagttgttagatttaagctcaatgaagtctatgtaccctgcttttcttttttgttgcgtaacaaggacctctcggataacaaaagatttaatattgcaggaccagttgaggcgcgaaagcaagagaagtaagagtggtggaatccctttcatgtacgttcttctggtcggcctaatcggtttaatcctgggatacattatgaagaggacatgatcagatcccttcaacaaaatactccaaaagtctcaaagtgcttaaaaaagcattgaaaaggaaagaaatcaaattgtgtgaggaggacaatcttctcttctgccttatcgtcgtcatgcacctttggttaaaatctgaacttagtgcgttagaggatttgtattacggtttccataagacttagaattgtcacaaaatctcctttttcctctctcttattacaactttgtgtagtcttaaacacttttgtttcttcgtcttctctcatcttaactttttctctccatctctcatagaataaagggatgaaacatgtcgccttatcattgttttagtgaggatacaaagactctaaataagtcggaaggttctaactctacctggtacatcttcgtagctacaaaacaaaactcgccgagacattaaccaa

SEQ ID NO: 14038 - DNA, 3000 bp, Unknown
  misc_feature (1)..( 3000): cDNA_ID_2705859_gDNA_ID_2214694_Annot_ID_136766 3000 nt of promoter + ATG
catcttctggctttccttcaatcctatataaacatttcgataaagggttcttgagtttgagataaacaagaacaacaataaaataaaaagaaaagagcatatatgagtttaatggctggaggggaaacatgtaaataaagcaatcaaagaggttcgatgttatattgttaaaactatgtaccctgaaaatgaaacacgctctcctggtttagcaccagcaggtggtagcaacggctctaccaccgagtgatcttcacttgaagcacaaagaacctgcagcaaagaaatcaaaaacacagaaaatgagcaaatgtgagagtgtgaaatattttgatagctgatgagctggattgaggcagacagaagagagtattaccagtccttgtgacattacatctcttagctttccaggtttgacatttgtgatgagtgcaacgaggcggttcttcatcataataacgcaggaatcaagaaaccatagataagtaactttcaaccaaatttatagattgataaaccaaattttacgcctacaaacaatattagtaaattaagacataactataccgttagatcctcaggactgcagaactttgctaagccactaactacttgtctcactttatcctccccgacatctatttcttccaccagcaaactgcattgtcaatacataagaaaagtatttcaacaaattagcagatgttcagtgaaatctttaacagagccataaaagtgaaatgtttttgaccacaaacctatccgccgatgggtgcttccatgctttacgaattagaccaacctgaatgttaagcaaactgacactaagctctgcctctttcttagctggttctggttcagcaggcttcttcttttcctttttggcatccttctcttttgctgcatttttctttggttcctacacgaaaaaggacagaggagaacaccagattcaactaattaaagagactcacagtcattgaaatcaaacttaaaagttaaaataagtacctctggctcagttttctttgtgcccagctgcggctgcacatctggcttgtcaacaggctttacaccttctgcagctttttttgaattagaatttgtttccaccttaatggcaggttttggtacctacgtttagaataaatgaaaaagatcagaaaaccattttctcatcgcatgtaatacatctgaaaaaagtagcatgttattattgtttctcagtctaagaaaatgggtatgaaaagataattcacctcgaagctaaattctggtagcttcacaggtattggtgcaaataatgtcgacaactcttctttattctgtaaaataatacgcagcatatattcgtaaagcagacaatcacaaggaaagaaaaatgtgaaaggtgatgttcagagagtgcatatctagctatagtcactaacgccgttacgcgtacacataaagtagtcctccatggatttacaggctacctcggcgcaatcaagtaacaaaactttatgatgtcgaacttacctggatgtaattcacccatcttatgacatgtggtactttctccttgtctgaatctgagaggccaagctgggaacagcaagtcaaacagataacagttagtatttaatacctttagtcatcagtttatgaaaatttgatcgtagcatctttatcaagtaacataaaattacttatacaggaacgaaaaataagtagactacggaatatagagaagtggtaccactgaagaatgcagagctgaaaacacagcaacatcagctgccgatggcgtcaatccgtttcccaagagcactgacttggtagctaactctaaattcaacttttcaagagctgaaaaccaatcctttgaatctgaagagaaaccttccgcaaaatctagccacttcaaaacctgaaataggtttttactctttaaaatgtgaaacaatgacgcattatgcaaacgaaagccaacgaatcctcatcatttagcattacacagaactcaaacatactaattcattttttttctaacgtggtagcaacgagaagggaactcaataaattcccagtaagagtttggcgtttatgtctataggaaccaaattcaagaagaaacgacttacatcgttgttttgtgcagatacttcctttccagatgccttcaatacattagaataaagtgtcttgatatcactttcacccgctccgcccacaaaaggttcctaaacaaatgaatcaaatcaatttcagaaacagaaccaataaatcatcacaatgtaaaatcataaaagccaatttctaaagttttttcctttttcatgaccagcttgatgcataagcgtaaacactgataagtccaaaacataaactttctaattgatttcagtacccaatcagataatgttcgagttttctccactaactaattcaaaaaatgatcatacacatactcagctaccaagcaaaacctcacaaaaaagcagaagcttttgagatgtcatcttcttcaatacttacaggatccaaagagaagtgtttgcagagagctgaaagaatcatctgcttcgcctttgaatccatcgtcaacttcttctctttctctattttcgaaattttgttcttctctttggggctcttcgctgtaagaaaacacactgcaatttcttcgatagggtttttgcttgatgtaactaacggtcctaacggacttccaactaacggcgttatctccatctataatgggcctagatatattagcagcccattaatatgttcttactatgggctttaccaccgaaagcaatcattaataaaataaaataaatgaattaacttctcagattcttcaaagacctagagtgtcttcgtcttcgacgacggcaaattcgtggaagctgtttcatcgattccggcttcactgaagcggcgtcgctcgacgtttattattccgacgactaggcctttgaggcagtttctgattaacttcaggcgataatg

SEQ ID NO: 14039 - DNA, 3000 bp, Unknown
  misc_feature (1)..( 3000): cDNA_ID_2785798_gDNA_ID_2214694_Annot_ID_136767 3000 nt of promoter + ATG
ataccaggctgaatcagagcagttcgtcttcggatagaaacgtcgtactcttcatcatctccatcggaatacatggtttcatctttctcaattctatttccgcagaaaccttgctgggttctgaaatggcgatcgccgacggtttcgagctcccggatcttagtacctgaatctcccacacggaaacgcaaagattcatcttcaacgtggaatacgaaccgaggatcgatactgtcgttaacggacatttgcttttccgccggaaaattcagaaggcgatcgatagagactggaagagcacagagagagagtttaaaacgacgtcgtcgtaagtgggacatgagtagcacgcgcgtcgtgatggttaatgattatgaaaccgtatcatttacctataagcttttggtgggtccgatttacatggactcataaagtgatatcgccacgtagacataacatataggtttttatatttatctgaattaccttaaaaacaactaatatcaagaaccgggttacattcagaatttctcgaccacaattcgtttacggtttagagaacatacagtacaatgccattacagattctccattttgttctacattaaagagggatcaggtaaactcaaaaaaaccaaaactatagtgagtaggatcacagtgtagtaaccggtttagctgggcaaatgaaccaagtttcggtttgataaagatgtcctcatttcacagttcagtccctgaggggtttcattcccagtgatgctctcagtctattcatctctgcaatttcaggatttggatgatcggttccatcttccttcatcttctccttcttttctttctttttcttaggttcttcccgatcccgcacatcatcagtttcatgtctcttacgatccctactcctgcttctacttctgcgccttgccctgtctcttctgtctcgttctctatctctgcctctttccctgtccctatctcgctctctatagtgatccctgtctctctccctatcccggtctcgaccatgcccacgttctctttcatagtctctgtcatgatctcgatccatatcatagtctctgtcataatcacgatccctgccaatcacagaaccatggtcaaattataattcatgaaacaatgagctcaagtctcaacatcaatcataatgaaaatctgtaacaaaaagaaaacattgattgagctaaaaactagatgggaagtgctctcatgattaactgatctttttcaaagtaacacaatgacaactaccatatactgtatcagggtaaggattgtaataatgtctgatccataatacttctctctgaacactgtcagtacagagaaacctggaaggatctctacaaatttaatttcggaagctgtatccaaccgctgatggcttgagatgccatagtggaaacagacactcaaaagacagagtactagacatgatgcaagagcattagctagatcaaacagcttccacaatcacaaagaatttttttttgaaaaatgttaactagcatagaaatgtatctagtaaaggtcacggattcagatacctgtgtctatgactgtcgcgtctcctgtctctgtctctttctctttctctttcaggactcttacggcgctgatcctgtaaaagaggaggaagatggtatcatcttagagctgctagatagaaacagaaaacagatcacataaaaactattgcagaatgaaagcactgaccatctcatcttcagatccatcagcaatcccttcattctcctccttttcttcctcttcttcaaagtcgtcttccaaaacacttttccttggctctaataaaccattctgttcaagcgtccacctatcatcagagtgaaaaattaaccatcttaaaatactgcagaaaccaaaaactaattattcagcttcagacaaatgcaaaagaagaaaccttttcttcaaacgtggcattgcaatatcacaagaataatccttggttagaagttcctcaatgacttcgtccacatgtgtcagcgaaaactctattccaaaccaaagaaataaatctagttagtgaacaaatcaatcaaaagttaaacacaacggatccatcgaaagaaaatgaaacttactcccatcagataacttttgtctcactttccggtagtcattgtagagaggttcgaggtagcgatagacatcaacatcagtcccagtgagacgcagatagaacgcaccaagaatacgaacatatctgcagaaaccaaaagagtaaatatttcagtaattcaagaacaaatatctgcagaaactaagagagtagattatctaagaccaatagatttgagagacattccatacctgtatacttgagaaacaactacgacaaggctaatagcagtatccaatctagattacgcagaaataagcttttggttagaaatcttacttgtagtcatcattttttatgaactccacgacaatttccttctcaggctggatttgaagcatcttcaatatgaggcaaaggaacggagtaggcttgcggctaccaccaaaggtaccacctagatggtcgagctccatagctttgtccaccaatgtctccgccgtgagaccaaagcactgctccttccaaaaggtgtgctgataaatcttcgttcgcacaatcttctctaccagattctgcggattcgttcctcttatattctttgccaacggatctgttctgtttgccattatcgcctgaagttaatcagaaactgcctcaaaggcctagtcgtcggaataataaacgtcgagcgacgccgcttcagtgaagccggaatcgatgaaacagcttccacgaatttgccgtcgtcgaagacgaagacactctaggtctttgaagaatctgagaagttaattcatttattttattttattaatgattgctttcggtggtaaagcccatagtaagaacatattaatgggctgctaatatatctaggcccattatag

SEQ ID NO: 14040 - DNA, 3000 bp, Unknown
  misc_feature (1)..( 3000): cDNA_ID_2705869_gDNA_ID_2214694_Annot_ID_136771 3000 nt of promoter + ATG
gatttttttgatgaataaaattttgcattcattcaaaaaaaaataaaaaaaaaaaataaaaccgaaaaccctaaaatccgaaaacaccaagaaacgacaccactccctatgaactggactctagtaaccaataaaacgacagaggaaagagcgttttggtagacgacccaagtgagataaaaaggcccaactgaatatcgttaagggccaagaataactgcaaaagacgaaaaagaatctgttcactctctctctctctggctcgctcgctctcaatctttccgatttggttgggttcttctccaactccaagtctctgcgaaaatggcggcttcggtgcaacctgcatgcttagacctccacttctccggaaagcatccaccgcttcttaaacacaacgctattatcgtccgctgcgtttcttctccaaatgtaattcccgaagctgactccatctctggtccgcctgatatcatcaatacgaaccgtgaccagcgcaaagtggttcgtatcgcttgggagaagttggttcgatggtctcgttctttgcgcgctaaagctaaaaccgatgttcttgagcgtactcgcaaggttttattatcttcactttctttcttaatttcgtttgcgttttggagaatttgaaagaatctgggggtttttaggttgttgttcttggtggaggttcgtttggtactgcaatggctgctcatgtagctagaaggaaagagggattagaggttaatatgcttgttcgtgactcttttgtttgtcaatctatcaacgagaaccaccataattggtactttatagcgtttgatttttatccaaacacaattcataattcttgaagacttcgcagtgataaggttgattctgttgccagtaagtattttcctgagcacaagttacctgagaatgtgattgctacaactgatgcgaaagctgcattgcttgatgctgattactgccttcatgccgtgcctgtgcaggtttaagcacattgagtatttgtttttagttttgttgatttgtttctatgttctgctgattaatgtggggttgttgttgcagtttagctcttcgtttctagagggaattgccgattatgtcgatccaggattgccttttatatctcttagcaaaggtctggagcttaatactcttaggatgatgtctcagatcattcccattgcgcttaagaatccccggcaaccttttgttgctctttctggcccgtcatttgctctggagctgatgaacaatttaccaactggtttgtttgactcttgttcttcttttgtttaaatcgaatagcattatagttttctattgctgaatgatgagaaatgttttcttttggtatgttattttgcttgcagcaatggtggttgcctcaaaagataagaaattggccaatgctgttcagcagcttcttgcttctagttacttgagaataaatacttccaggtacaacatttcaaaacaagactccattggtttcaatgatttctggatgcatttccctgctgggctatgataatatccatttgcctacctgcttgagagtttattcatgtcttgtatatgtgtggtgttagtgactgagctctaatggtcaacttcttaattcctcgagggagttttgtgcactcagcttgtaacctctgatcatttcagtgatgttacaggcgtggaaatcgccggtgccctgaagaatgttctagcaatagctgcaggaattgttgatggaatgaatctcggtaacaactctatggcagctcttgtgtcccaaggttgttcagagataagatggttagccacaaaggtagtaagtttaatttgtgtctataattgcttcatagaaagtggttttttcggtccatgcaactcactacaatgattactaaatcctgtgtttattgcatttctgcgtttttctgtcttgtatgtgagaagatgggtgcaaagccaacaaccattactggtttatcaggaactggggacataatgcttacgtgttttgtaaatctttcaagaaaccgaacagttggagtcaggttagggtcaggggagacactagatgacatactaacctctatgaatcaggtgtgtttctcattggtgtcgctcttcatatggtaaaacaaaaaggattggttgaatctgaaacccatgaatcaaataacaattgctgcgcaggttgcagaaggtgtagcaacagccggggcagtgatagcattagcacagaaatacaatgtgaaactgccggttttgacagccgtagctaagataatagataatgaactgaccccgactaaggctgttcttgagctcatgaaccttcctcaggttgattataggtttcacagattcccatttcgactcggctactcttctggtatttttatttgactctgttctgtataattctggttttgcagattgaagaagtatgaggtagaacaatcgttttgaggaccacatattcaaagagatggctttaaggcggcaagagctttgcattcgtttagagatagctaacgatagagatgattcgaagtgagttttgtaatcgatttttaggcctgaatctcatgaatgtgaattgttcataaacattttacaaaatctctgtaaatttttctcttacatctataaaaatgatgtttcagtatcttgtttagagtggagtgtggaatttggaataggcttcgtatgatcttcagactttcggagccatggatataagtatgggtgtttcaaattcgggtacacccaaccggtttaatccaaacttaaaccgtaaaaagccgatcaaaaaaataaacaatgcgcatgggctttgaagttgagaggcccacaatttttgaaggctcagacgtaaacggtgacgtataggaggcaaaacccttgcaattgcagtgtcgtcgtcgttgagtagtcgaagacggagggaaagaaacagagaacttgtttgtttcgtcgaagaataagatg

SEQ ID NO: 14041 - DNA, 3000 bp, Unknown
  misc_feature (1)..( 3000): cDNA_ID_2705877_gDNA_ID_2214694_Annot_ID_136774 3000 nt of promoter + ATG
gacccggaaggtgaagggatcgtcgttaaggcgttggacttgtttcttggccgggcaattgtatagcttttggtgggtgcacctatagtacgccctgcaaaatagaaatttaataatcttacatctatatgataatcaagtagtagctaataactttgttttttaaagtacgtagttaatgattgaattagattaaaggtatttgataacgaaatctgagaaagatatgtacttgtaacatcgaagtttcaacttccagctgaactttaataataggattatttggtcattctatcactaataaacttggtggttaagaatcaaaagagactgattacaacatatgatgtgatgggaaaatatgtaattaactaaaggaacttcttgtgaccttatatatgaaaagatattattatgaccttattctacattactaatctagaatctttgacttgttctggacgaaaagcttattttcgtcttccaagttccaactaaacttgggttatattaatctcagatatagtataaatacttatttggtaactaaagttaaattacctaggaaacctagagccaagaatttctttttgaccgtatttacgccaagtatggttatcgtcgggtggcagatctgtgttccccgtccttagcgccgccaccaacaccgtttgttcttctccttcgtccttcctaaataacgtactcatttaatgattaaattttaatcgtagtatcgtacatacgtcatataaagtacataccaagttcaattattggtttgcaaacaaaaaaaaaaagtttgaatgtgaagtggacttgaggtggttttccacttttggctaacctagtcacatgtaactggttcaacccacctctcccctttatggagttaaaaaaaatgtagaccaaaaggcaaaagaaacatgaaagtggactaatcaatgatcatcgatttaaacctagtgagttttaaaaaggtttaaatatttgtatatgtatgttcttgctttaattaatttttggtaaagattagggatacaaatatatttaccacatttttatgttctaatttgattatgttatcattcataatatttatcaaaatctgatgttttctgaaaaaatatttttaaaaagatgtaggtacatcatgataaaaaaatgtatctaattaggaaaataaaatttgcaaaaaagtttttaaaatttcgtgataattgaacaaaaactatgttcagcccaaatatttatatcaatttatgattattattattccgtcatttcattattcatctcatacacatccattaattttgtttatacgttacgtacgttaccaattttgttatatgcactttgttccaagaaattatttgttacatgtatagcacgaattatacctttgttataaatttccagataaaataatacttgtatattttaccttctccgctgccttggcgtggaggaaccgctagcgccggatctttctactgcagccgtcaaattcctttctccaccaccatcaacggccatgagctgcgtctggaacatggcctccgttccttgagacgacgtggacccgccataccttaaccaatactcttgcatcagacccggttccatctgcatcaacatctggtttgcaacggacacaatcaccggtttggttttgtttaacgcagtctcggagttcttaatctctagtaacatcttcagccgctcgtttgcatcactgaatgtctttacgatctcgtcaagagatgtcaatagagattccggtggcttttccggtaagctggactcgagcgatttaactagtttcattccgtggaagatcattgacattacctcttccatctggtaacttatttttttgtacgagtacatgtttttaaaatttatgcacacatacatatatatagacgaagagatacgtacacgacggttagtcttgttttccaacagtttgcttcgatgttggttccaactctattgaaattttgaatatgcagattattcaaacgttgtaattatctacttaaagcgacataatatcattacctatactgttattttttggggctgggttaagtaaaatggaattttctttgtcgacaggtgaaatatgtccaagaatcaacaaatatttactaaataacgttacaaatactcgtttagcaaaatccaaaccaaagatctaactaatgataacccattgacccggtcggagatacttaggatgggcgagttcgttttttgttataaacacggcagaggaactggtaataacattgaccaagtcatggtcttctatatatgttttgagacttaattaataatgattatttatttctttcaaatttcaacattacaagattttcttagaagtctagacgaagacttaagattttcaatgctgagactgttgaatttttttttcttaaagtggagacacataagctaagaaatttctaaggcgttgaagcaagtttggtaagtttcttgacaagattcctaaatagaaatttactttggatccgaattatgtcttgttatagttacttatagccccttgcaaattggaataattaacggggataatttgcacaagaaaatcattggacaagaatataagcccacaaaattatacggcccacatactatgaattcggcccaaaataaaaatgtcaacagatccaaactctacgacgtttttataagtaaataaaacaacacgaattgtaataagcaaacacgaaaacggcaatggagtaagtccgttcaggtcgatcataataattccgacgaattagaaagcgaaaaaacaaatctacgaaattctcctctttccgaagatgcagattgaagaagaaggagaagaatcataagaataaagctttgaattatcccgttttgctccaccttcgttcttctgattccatatagatccgtttaatagcagcaacgttgttcaattgagaaggtggaaacatg

SEQ ID NO: 14042 - DNA, 3000 bp, Unknown
  misc_feature (1)..( 3000): cDNA_ID_3021476_gDNA_ID_2214694_Annot_ID_189476 3000 nt of promoter + ATG
aaaaattatcttcaatgaagactccgtcagatctccaacaaccttccgctccatagtaataatctctttctttaggttttcgtttctattggttagcaaatttacttattataaatagggtaaatgttgcctcccgggagaatatgttaacaaatctacgtatgaacatttagttattaagtaaaagtaaaatcaaaattttagctacaaattgagagattttgttttcccattctctaacatttaccggaaaaataaaaacagttactaatatttgagctaaacgaccgccacaaagggtgattccaacttatataaagaaggtcttgttgataaacgactaagatgtaaactgattcgcgtaagattaatatcaacggtcaaaatttaaaatctagtgttagaggtcaaccaactttgactgtgttagacaatccagctggcatttactattaacactgataaataatctcacacgtgtcaaatttccattcgttgattaaacagaagacatctaatcataaataggagaaaataaattgaggatgaagcaaaccaatcaatgattattaaaacttgattgtccttgttgctaactgctgaataatgattcttgggttctacatcaagaaaatgaaaatttgttggaattttaccttgttgattataaaattggatttttacgtttcgaataaacatcatactttacctagcaaacacacccttatttcacgaatcctcaaaacttaagattaaatgcctccaattccaaagcattaaatcgttggaagttaagagacttaaacacaatatttttcgtacatttaattttttgttaatgatatagctcgttaaacaccttgcctgaattccatgatttatattatcattagtaaatatacaaaaaaaaaaaaaaagattctaagaagaaccattattcgttaactagattaatgtcaacattccaacacagccatcgatgatgatgatgattcatcaagaagaagaagagatgccctcaaaacattcaatcgtcattagaagatccaaataaataaatcaagacaacttgcttgaattccattattcatattatcattagtacatatgcaaacatgcatgatttaatttatgataacttattatcagtatgcattattcattattcataacaatatcaaattaagaattcacaaccacatacagatgataaatcatgaaggaacataaccaagtatctcaaattccatgagagtaagtgacaattgaagaaatccggtttcctcaggaccagagaggttaacttcacggtaaaaatcaacccctttaaccgttggcaacaatgtgactcttctcccaacgaaataggtaccagttgaattcgttttgaaaacatctacatataaagattctacgggaaaattctgatcttgaaaaagttgtaattcttcatcaaactcaggatctccttcggttgctacaacctttgtttcatgtttctcgttttcatttgtccaagcttcaaccttgtattgatatgggcgaccattggtgactccgattgtaccaaagatattcacaagtagcttcacatcttcacctgtgattattatctttttccctcgcatttttcttcttttcaaataataaatctgagtagaataatatgtgtgattgatatgtcaacttaactacacctcaacaattgtttttgtggttttttctctcactaattcacgaaattcgacattttctaaatatatttatgttaaaatgcacgtgtttcatgttgtaattctttgtttataaacaagaaaaaatagatgctaaacaatgagaaataaatgttgtttgaataataaaaaaaattgaatgtttcttaataccatttcaaatactaaaaacaatgaaatatcatatttagagatttatttctatataatatctattttggtcatattcttagttatgatatttgactactattcaaaaacctaaccccaatatagtcaaaactatataaaaatgcagtaagatattaaatgctgttgaacaaaattcaatatcttatggcttgaaagtaaactagtaagatagctacaaaatgcatggtaagaagttaggataatcatattttaagaaacgaaaataaaatacctaatataagcttcgacacatacagctctttcttactggaaatcttgcatattccgaacatacatttttattttaggacggatatacctatagattcatttgcaagattgatttcctattgaaaaaaaacatgttgtggattcaaatatttgtcgctttttgttcattctcttttgtaatttcctaaacgagaggtcactaatccaaaaatcgttagcaattaactagaacatcttccatggttaacaccacctatcaattatttattttcttcaatgaaactttatgaaactctttccattttattaatttatatattaaagtttttgttcacactaaatttattgactcaatatatatctactttataactaaatactaattatttcatttactttttattttattaataatctacatatatatatatattgtttgtcttgtttattgtttttgcggtttgtatatttatatctcatattcatacaattttttagtatatatgcttaattaattaagatcgaattgtggcttgtttattatttttgcggtttatttatatgcatctcatattattacttttttaaattaatcgattaaaatttattaacttacgtaacatatttgatattgcataaattaaaaatcatatgtatataattctctttagtttaaattttaaaatgaataaagaaaaaaacaataaaatttgaaaactgaaaaccttttaaaacgaaaaagaatggctaagatgatgaatcggtctcgtacgggaaacacctacgttttggtttagtccggtttggttgaattcccagagactttgcttgaattgggtcccca

SEQ ID NO: 14043 - DNA, 3000 bp, Unknown
  misc_feature (1)..( 3000): cDNA_ID_2705885_gDNA_ID_2214694_Annot_ID_189473 3000 nt of promoter + ATG
gtcatgtcttttaattttagagtcccttcttacattgaacgaccttttggctacatatgtagacacaatcaatagttgatcataaacaactttatatatgtatatatatatatatatatatatagatatttatatatttataactttataagacaaagagtgggttcagattagtactcacagaactcaaacaataatagaaccgatcaactagccaaaacagaaaagtgttcctagttgaaatcaaatgacacctagaaataaaacaaatcactaggttacaaaaaaaacggtttagtacaaattaaaacttgatagtttgagatctgagtagtgatcgctaaatgggatttagttctaaatacattaaagattaaaaaaagtagaggctgccgtaaaattagtggggactaattaagaaataaaataaagtaataatgaccataattataatttatataactatgagttggatctagttgaattattgacgttttcaacgtacttttattggtgttcaactttttctgtattttaaaaaaataatatgaaattagattcgtacgtagcaaggactgtctcttgcgaattgatgaaataattatacttgagacaaagaattctctgattgggtatagcacgaaataagattcaacttacacatttaagaactatatgttttgcatataaaaaattaaaccaaattttaaatttcgtgacagataatgatccagagtagtcttagcgataagtagcaatccgttaatcgaggcctcttggttaattattttttaagacaactaagcttaagattagattaagcacaaaatgatgtatttataataaacattgttattattctaataaccatttgtcatttgtcaatagcagttccccaatcatcgttgacctttctctcatcatctccgaaagaaagcaataatttaacatttgaatataactagtgtccatattttgacaatctctaaatgattaatcagttgggatttatagataaatgccgaatttggatgagtaaacgaagaagtaaaacaaagctgtttggacatatttattggttcaaaccgagaaataacacattcatctttttacgatcgaagtcaactactacaacaacaaaaatatcgttaattagttcgtacacaaattatatttcataaatatttcatcgttctaccattatactactcaccgttcattattattgttggtataatctgtttcgttaagttgtatgataaattaaaactagtaaagccgttttgtttttgtttatagttgaaaaagtaagcgtaatataatctgtaatttctagagaattaataagcaaacaaatggatttgactcttatggattttttttatttatttgcgagtggatgtacaatgtggactgaaattattgtgactccgaggagtactcagtggcacctgccccctcattgccgtcacaatatcccaatactaaacaaatgttacttttttaaaaaatattgttttttttggtaggaaaaaagatgtattgttttatgcgtcacagaaataaaaataataattaaccaactcaaaattactcattttaatgaaacgaagatatttttcattcaacggatcaaaaattcaaaatgagtcatttcttacgatcataggttttaatttatttttggtattaaatgagatgactcacacaaatatttcaatagttacacgagtattaattaaagtagtgacagtttcaacaaattttaatatttttgttcagttcaaaattcatagatttttaataaaatcagtactgccaaagtgatcagggccaagcaagcaataggctgacataacctagagttgtgacttgtgattgtattggttcttttaccaaatgatccaaaacattgattatctacttaagtacttttccggcgtttttaatggcagttctacaaaacataaagataaaattaaataacgttggcttagtataatgagattaatcttgattactagttttagatccgaactaagcggtctcaccacgattatctatatatatatatatatatatatatatatatatatgcttatagcttttagttttagtagctagtctatccatgacaaaattcatcaatgagaatattcattaggatccttctgcttccgtaaatgcacgagaatacacacgtataaatagtttcttcttaggaaaaatactactatatagcaaaacatatacatttatatcttcaaaataaaattacgagattgataaaactctaaatattattctgtcttaagactatttgacccaattactcttaaaatatattagtggttggtctgatatagaatatatcttgtcaacatttatcctctttaattatcaaaaaaaaaaaacagttctccttattttggttctttcccttgaaagtgaatttcgtggtactgaaaaataatttgaatgtcataaaatattagttatataactctttctccaagataaaaacaaaataatttttcgcaaaaaacatttaaaaatctaaccaagttgttggatcgttttcatgagcattaattaattaaataaatccgcgaagaaaggagaaaaaaaatacccaccaagccatcaaacgtgttacggagatgggtgatgtcattccacatcatcaatgtgacataagcaaagctcttgcaagccaatgggtgaatagataagttataactttccaattataacctcaaatccatgactaaattcataactacgttggttactttccctttataccctttcatgttcattataatgcataagcatctctctctctttcctaagcatcttcctttgatttttttctgatcaagagaaaaaatctattttcttctctttccactatattacaacatttcttcattctcaaatcatcatactaaaaacctaaaaaaagttacatattcattgtatctttgtgagaaaaaaatg

SEQ ID NO: 14044 - DNA, 3000 bp, Unknown; identical to SEQ ID NO: 14041
  misc_feature (1)..( 3000): cDNA_ID_2995201_gDNA_ID_2214694_Annot_ID_189471 3000 nt of promoter + ATG

SEQ ID NO: 14045 - DNA, 3000 bp, Unknown
  misc_feature (1)..( 3000): cDNA_ID_3021484_gDNA_ID_2214694_Annot_ID_189469 3000 nt of promoter + ATG
cttgatgaatgagagtaaatgtcctttaagataaggcttgttaattgggtgcttcgagaataaaatattcaattatctgcttaaaaatttgttgctgggctgggacagcaatataatgttcaatgatctgcatattaaaggaggaacaaaaacgtactttcaaggcttgtctaatgatgtttctgaggttgagaatctcagttatctgctaaaattctatcttgtcgggctggggacatgataattcaacattctgcttaatgatgcttttattaaggcttcttgatagtctgcaaaatactctatatcttgatgggctgtgaaaccatgatgatgatcaatgttctggtggagtaaaaatgacatctagtaagacttctctaatgatgtctgagcagttcaagtgtctgctctgctatattgtgcatattgatgggataaagaattcttttaacgatgcttctcgataggaagattcaatagtctgcaataactctataatttgatgagctgggacatcatgatgatggtcaatgttctgcttgaggaaaaatgttctttattcaagtttctcttgttgatgttctagtatctgcttaaacatcatgacaaaaattcaatattctgcaaaagctccatattatgattgcttctcgacaggaaaattcaatagtctgcaaaatctcatatcgtgatggactgggacaatcatgttgacgatcaatattctgcttgaggtaaaatactattgctgagctggggcagcattgatacaatattcaatactctgcttgatgaatcagagtaaatgtcctttaagataaggcttgttaattggatgtttggagcatgaaatatatctgcatattaaaggaggaacaatgtcctttcataaggcttctctatggttgcttgactgaggcagcaaaaaaacatccaattaaaggaagaacaaatgccctttttataagaggcttgtttatgtgttgagactagagttgagatatgagatatttcaggtcatttgtctgcttagagagatgcattgctaggacatcatgagaagatcaatattctgcttgaggtaaaaaaatatcctctattcaagcttctctaataatgtatgactgagaagtttgcttaaacatcatgacaaaaatttcatattctgcatattgctaaagggaaaatgtcctgcaatataatactcaattgactgcactgatggaggagaataaccttttaataaggcttcttgaataacagattgaagagttcgagtgtctgcaataaaagctatagatcatcttgttgggatgacaacatgattcaacattcaacgatgtcccgatttctgaatttcaagtttctgcttgttgatgggactataaaatggtgtcctaagattgaaaaattcaagtttctgcttaaacgacagttgcgttgggacgacgttataaaatacttgaaatgatatccaataatctctgagattcaagtttctctgctaagaaaaaagaagaattcaagtttctgcatatattatcttgtgttgtactggggcaacatgatatattcaatcttctgcttagaccagcctttgaaaaagcttgtcaaattatataaaatcttcttgaggaaagatcttaggacagatttagagtattcaatcctctgcattcatcttgctgagacttgatgaagaaagtactcaatcctctgcgtctctaccgtctttgcaaggaggtaagtgtttcatctcaactatattgcactcgtctatgcagtgcagtgttatattttgacattggtctagtagcaattgggaagttcatttttcttctacttatgtacttctcttacaaattaatcactgtgttctaactacattttttggtgattgcttcgtaacagggaagtattgcagaaatccagttacgtgactgttgaactttctcagaggtgttctctttcagatccttaactctcaggtttcaggttgctctcttactctttcgcatcttgttgagcaaaatttcgtaaataagaagcataaattttatcagaggaggataggagctacatgtctactatttttagttttttagccaatgggagagctccacttcataccccacttttaccaatcgtgtgattccacactcagtctcacccatgtcgcgttgagcgcgtgtctacgatttctaaagggggttaatccacaaaaatcatgcctttttggatccacgcacctcattctcaaaaacccatcgcgtgtcttattttttttggttttcttctctaaaccaaagtaaaccgaaccgagatcaatttgaatttcaaaaccaatgtaaacccataaaacccatcgctgtgaaaacaaaaagctcggccactgtaaccacaaaaatggagacgacacaacttcgaagagaaatcaactcgaaatagccaagagaatgttcgaaaccccccccccccccctcaaatccgatgcttcctttgattccagcctccaaaagcccatctgctcaaatcttcatttcgaggacgaggactcgaggagtattacaaggtacctctatagaatcaatggcttccatggattttgaaactttacttctaataaacaccattgtaatgtctttttggttgtgtaaggaacaaaggatagtgaaagctgaagagtgggattcgtttatggagtttcagagtttttttgactaagtggcctctgtttttgattcttcagtggtcaattttgtgatgggatttgattgaaattgtttttgatgctcactctttatcttagttatgatgcattttgtgattcctagacatgttaacaaaatagtattgagcctttgaacttttgaaacagagcctgactatatatcattgaagctttgtcttttacgccttttaaaaggaagttggcttttggggtgtacatcaacacttaatgtttggtatcattgttgagaccttgaggacaagatg

SEQ ID NO: 14046 - DNA, 3000 bp, Unknown; identical to SEQ ID NO: 14039
  misc_feature (1)..( 3000): cDNA_ID_2785798_gDNA_ID_2214694_Annot_ID_189464 3000 nt of promoter + ATG

SEQ ID NO: 14047 - DNA, 3000 bp, Unknown; identical to SEQ ID NO: 14038
  misc_feature (1)..( 3000): cDNA_ID_1448161_gDNA_ID_2214694_Annot_ID_189463 3000 nt of promoter + ATG

SEQ ID NO: 14048 - DNA, 3000 bp, Unknown; identical to SEQ ID NO: 14043
  misc_feature (1)..( 3000): cDNA_ID_2705885_gDNA_ID_2214694_Annot_ID_136776 3000 nt of promoter + ATG

SEQ ID NO: 14049 - DNA, 3000 bp, Unknown
  misc_feature (1)..( 3000): cDNA_ID_3021559_gDNA_ID_2214695_Annot_ID_136789 3000 nt of promoter + ATG
aaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaataatggctcagttcacgggtcgggtcgttggagactacttggtgggtcgtcaaatcgggtcgggttcgttctctgttgtttgggaagcgaggcaccgcgttgacggtactgaggttgctatcaaagagatcgccatggacaggcttaacaagaagctgcaggaaagtctcatgtctgagatttttatcttgaggaggatcaatcatcctaacatcatccgtctgatcgacatgatcaaggtttctttttttgatttgaagtttcgatttttttggtcggttctcattttttagctgagaattttgaattgaggttagctttgttactatatatgtttctcatttgctcatcccaatgccaattttgtgtcataatgccatgattttgccggtgaattttggatcatatacatggaattaagcttcaattgtggaacaaaatttgggtctagtttgatgttgttctgatttgggcaatgtgatgcagtctcctgggaaagtacatttggtgttggagtactgcaaaggaggtgacttgtctgtgtatgtccaaagacatgggattgtccctgaagctactgctaagcatttcatgcagcagttaggtaaattctagtggcacttacttactctctgttttgttgtttttcttggttgccagaaacatgttttgtaatctctgacgggttttattttatgtaacagcggccggcttacaagttcttcgtgacaataatattattcaccgagatttaaagcctcaggtgtgtctgattctcattcctttcatttcaatgatcttctgtgcaccaggtgttttttattgttaatcagattagtgtgttagttgatctcactgttaaatgatacaactttcagaatgatgaaaggatgctgtagaagggtgctctgttagtttccaataaaacatgtttttggatatgttggggtttccttgtccaagtcttggagattccatctttgttgaaatttaattcttaaggttctttcgtttttgaaacagaatcttcttctatccacaaatgaaaatgatgcagatctgaagattgctgattttggatttgcaaggtattgtcatcagcaccccttgttactagatcaaagagtgtaatatgaatgaattagagaaggtttcaaatgggctcaagctgcttttgaatgtatattgtcgaatttctaggtaatttcattgttttcttgggggattatacttattatacgcctcccccattttgaacatcgctcttttcttgacgcagatcgttgcaacctagggggctcgcagagactttatgtggttcaccattgtatatggccccagagatcatgcaactccagaagtatgatgcaaaggtcagacctttctcttactaagctacctaggcccttctcttgacattatctccttacaatcctagctgaatacacaggcagatctctggagtgttggtgctattttatttcaacttgtgacaggcagaaccccttttacaggaaacagccaaattcaggttttgtgttctgtctcattgacttctatattatgtatgtgtttgtattctggtgcattaaactaatacgttctccatcgtgtgtttacagttgctccaaaacattataagatcaaccgaattacattttccaggggactgtagagatttaagcttggactgcatagacctgtgtcagaagttactgcgccgtaatccaggtcagcactaattctgcttgaagtagtggagactactattcttttgcatgaaaccatatgccccaggttctattggcatgtgtgttgatctaaaaatgtgaaattatattgaattgtggccacgttggattggcgattcaagcattttataatttgtaccgtgttcagagttttttgtttgattagcacaattaaaaacacaaattgtactgttgccatttcagtctgtcctaactttccgagtaactcatatcaacgggagttgcggagttttccagaacttggaattgtgatttgaatagcggtttatactaaactctagtcatctcctacagttcaccgcgtattttattcgagagagcatggtcctactctgtgtgtatccaaatacgattacaaatcattcttgaatatattgtcttttgcagtggaacgtttgacatttgaagagttctttaatcaccctttcctttcggacaggcagtcatatgatttctccaggtagatgtgacaattgtgggggctaatgcttttctctattttatgcagaaatttgtactgattaaactatctgtgctacaggagtagattggggttaagaaca

SEQ ID NO: 14050 - DNA, 3000 bp, Unknown
  misc_feature (1)..( 3000): cDNA_ID_2705917_gDNA_ID_2214695_Annot_ID_136790 3000 nt of promoter + ATG
actcatatcaacgggagttgcggagttttccagaacttggaattgtgatttgaatagcggtttatactaaactctagtcatctcctacagttcaccgcgtattttattcgagagagcatggtcctactctgtgtgtatccaaatacgattacaaatcattcttgaatatattgtcttttgcagtggaacgtttgacatttgaagagttctttaatcaccctttcctttcggacaggcagtcatatgatttctccaggtagatgtgacaattgtgggggctaatgcttttctctattttatgcagaaatttgtactgattaaactatctgtgctacaggagtagattggggttaagaacaatggacggttttctttcgtctggaagcagtccctcgagaaacatggaagaaagttctcaagaagactgtttgccgttccttctagatgatgattctagtggacctgaggggagcccttcatatttaaaaaagacatcctcaatgaagtcgtcctctggaattaaagtcgatacgagaattgagaggaaggaggtggaatctagtcctttaaaacatacagaacttacttctggatatagtagtttcaaccaaaaagtggaaaacgatagatttagatttgaaactcaaataaattcagataggagaaaccgcagggaaccgacaggattgactgattctagatcacttattgctccaggaagaggtaattgaatctttaccattttatccaccgtagagaatgataaagctttcttgttctgtttctcacatatgtcagttctgcagtagatgattctcaagactccatggatcaagacttcgttctcgtatctggaccaccagtagatatgccatcatcttcatcaagttcttcgaagccttataattttccattcaagtctcagtctcctcctgtagagttattcaacagaagcataagttcaacggctcccatgccaataattggtgctactagcaacagcattggtcagtttgggagccttgacagtcagtattctgccccgagcacttctcatgggtctctggatcttggtgatgcttttgaacagccatcaactcacagcctgacaagaatcaggtctctgagaaaatatgcagcaacaattgcagaactagtttatgaaagggtaacgaaacttttcactgtttgtagatagtcacatattatcatcgtgacatcactggccatcatgagtttctgagtagattattttcatgattctttgtatagattgaatctgacaaacatctagaagctttctcgatccaattggcgattctggcaatttggaaacaggcactgcacatatgtcatactcaggcaatttcaggtttggaaggaagcccaagccaagacattaacaaactaagaagtagcagcctgaaacacgatactcacagttctaataaagtcactgatctcagccatgatggatcggaggagatatcctctcagattcagaggcaatttatacaggagattgagcttgctgaagaacttgccaagagtattgaacctggtatgtttttttttctcttgggaaaaaataaacatttgtttttgaggtattaaagatcttaaaaggttttcatctacatgtttgtaggaaatacaaaaatgccagatgcaatggagacgatatttgaagcagcacttgatcttggaaaacttggaggagtaagtttcctttgtcttttcacaaagaatattgatgaacaatccaaaaacaatgaaaacaaaacaatcaacttgtctatactcattctcatatatggtgcctgtggctttttctgcaggttaaggaggttatgggagatacagagaacgccggaaaccaatattcgaaagcagtgcgtttgctggtattccttttagtagaagcaccaatgctgattctgaatccgccactgtctctcacaaactcagtcaggtatcgtctcaggacatatattgatttcctcagcagaagattaaaacatctgcagtcacatagaagaagttcagctggtcagatgcaaggatcatcgttagctatgatgaacagacaatcataaatccattcacttgggttgggttctcttgtttcttgtgttcttttatgaaaaaaaaaaaaaaatctaaaagagaaaaatgtatatgtttttgtacagcaacatcatatattcttattcttttggggttaatctggagggacgttggggaaatgatctgtgtgatggatgttgtaacttgtaacattttcttgttctattttgatcttaatcctatgttttttacttgactttatgcaaaaatatatgttatgatgattcttggatacattatttatgtataaataaatctatgactatgtttttaaactaattgtagagtatttatgatgcatattttaaaatcttaaaatctccttaaatctttctaataaatgatattcttaattttggttcgtcaagaataatatttatctcttacttaagtctttgacttatttatgtattgtactttattcgtatctcaaaattatgcaataaggacagaaccttaagggtttcagtttcccacacgtatgcagatgttaccacacgtgcaagagactgaaaagaaatatatacagtgaagccgaagaaaaataagcgccagtggccctaatcactcttgcagtcaccactgtcgccgtccgtctctccttctccttcttagggaccattcctcctctttcagaccagattctaggttagggtttcatcatcatcggctaaagtttcaatctttgaaatttccgttatctgttgatctcattattctctgattttgtgtagtttccacaagtttattccttttgatacattcttggggttttgttgtatttgcaaaagctttttttggaagaagcttcttatagcttgctggatttgatttgatatttgtcgaaattgccctgtttacagaagaggaaaa

SEQ ID NO: 14051 - DNA, 3000 bp, Unknown
  misc_feature (1)..( 3000): cDNA_ID_2705937_gDNA_ID_2214695_Annot_ID_136793 3000 nt of promoter + ATG
gacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatggagcataagaatattggtgcagaagtacttcaagatacgtacgatgatcaacagaaatgggttcttgattcttctcttgatagcagaggacgtgttcctcttcgggctcgaactggcgcttggagagctgcactcttcatcatcggtacatagcccttattgagattgtatatactttataccatagaattataacactgaaagaagtgtactataatatcccaaaatattaaatctttgtgaagtcttttgtttcgtcttctctgcacagcgatcgagttcagcgagagattgagttacttcgggttagctacaaacttggtcgtctacctaacaacaattctaaaccaagatctcaagatggctataagaaatgtgaactactggtcaggtgtcactactttgatgcctcttcttggaggctttatagccgatgcatatctaggccgttatgctactgtcttggttgcaaccaccatttatcttatggtaacatatgttcttacctctgatatatcctaatccaatttatttaaagattccataaacaaccttaaactgtgtcttgatggttaaacagggtttggtccttttaacaatgtcctggttcataccaggcttaaaaccttgtcaccaagaagtgtgcgttgaacctagaaaagcacacgaagtagccttcttcattgccatttacttgatctccatagggactggaggtcataagccttcccttgaaagctttggtgctgaccaattcgacgatgaccatgttgaagaaagaaagatgaaaatgtctttctttaactggtggaacgttagtctatgtgctggtattctaacggccgtgactgctgttgcctatatcgaagaccgggttggttggggcgttgctggcatcatactaactgtagtcatggctatatcactcatcatcttcttcattggaaaaccattctatcgttaccggacaccttctggtagccctttgacaccaatcttgcaagtctttgttgccgccattgccaaaagaaatctaccttatccttctgatccttctctgcttcatgaagtgtccaagacagagtttactagtggccggcttctctgtcacacagagcatcttaagtgagtagaaccaaactcaaaagtcttccatttgttaatttcaaccattctaaactgtttccttgtagatttcttgacaaggcagcaattatcgaagacaaaaatcctctggccctcgagaaacagagtccatggagacttctaacgttgacaaaagtcgaggaaacgaagctgatcatcaacgtgattccaatatggttctccacgttggcctttggcatatgtgcaacacaagcttcgacgtttttcatcaaacaagcaataaccatggacagacacatcggtggcttcacagttcctccagcttccatgtttacacttaccgccctcacattgatcatctcactcactgtctatgagaaactcctcgttcccttgctaagaagcatcacacggaatcaaagaggcatcaacattctccaaagaatcgggaccggtatgattttctccctcatcaccatgatcattgcagctctagttgagaaacaacgattggaccgtaccaacaacaacaaacccatgagtgtgatatggctagctcctcagttcatggtcattggctttgcggacgctttcacactagttggactccaagagtacttttaccaccaagtccctgactccatgagaagcttaggtatagcgttttacctaagcgtgataggtgcggctagcttccttaacaatctcctgatcacagccgttgatactctcgcggagaatttctcggggaagagttggttcggaaaggacctaaacagcagccgcttggaccggttctactggtttcttgctggtgttatcgctgccaatatatgtgtctttgtgattgtggcaaagagatgtccttacaaaagtgtgcagccaagccaagggctctcctgattcgtccatatccgtcgacgtctaaataaacaagacatgcaatgctaagtatatgtcgttaagtctaacattaaaaatcattagtaatcaatgttggtgttagatttttttctttggttaaaagataaatttagagttgaagatttaaatttcttatgaaaaagtgccaacatactttgttcaatatttgtattcgcattacgcttactagtaacccaaaatatatttccatttagaaatttgtcggaacaaattgtcattaacaaaaaaaattgaaagaagaaaagtcttggaaaaaaaaagacaacttgagaaactgttacgcatattccgggtatctcagtatctgagctgttttaccaaaatacccttctccttctccaagcaagatttagggtttctcaaagagttttccttttccctctctctcccatgtcgatgtctccgatctccatcgtaattcagtttccttcaattgatgtgaccttcgattccaaactcgcaaacccagaaacgggttactcatagaaacagtgatagagagatatg

SEQ ID NO: 14052 - DNA, 3000 bp, Unknown
  misc_feature (1)..( 3000): cDNA_ID_2705941_gDNA_ID_2214695_Annot_ID_136794 3000 nt of promoter + ATG
agagaggtgatgatggaggtaagaggaggactgaaaatcgtggtaatggtgggagattgagaaatggagggtcttcttcttctcaggtgtatgatatgactttgcagaatgatgggagatatgaaattggatcttaggtatgagttcttctttgttgtgtttggatcattgatgtctctgaacataatgtgtatgtaatctggaatagtttgattgtgattatgcaaagttttcagttttagggaagcaagtctctgtgttcaagtataggttttggttgatggattattgattggtataagcattgtctataaactggttaacccaccaaagtccttaaaggttggtccttttacctctacatcacaattcttacttccctcttcactagatatacctttcatcttcattttcttcattgtatcggcacaaaaaggcgtcatggatttattagagtaagaaacacgtaaaccatcattggtgacatcaaactgcatgttatcttccgatgtcaatacatttccggatgatgaagcagaataaggcgatgatgatatacataaatccgaattcctctgttctgaatcatctctcctctgttttttcttagtcctacttccttcactttcctcttcttcttcgctcaatgagtttatgatttgtttgactttgatcatgagggtttgacgtttcagccgaacgcattcacggttattggaacggtgatcatcaacaatctcctccacagttaatcccttatttcttgattctgtaacaagtttcgtaaatccccgaataggaacgctcccgctgctacttcctcttttccccatctcaaagtttttcagattagggtttctcggaaacaggggaaggtgtgttcttattacaaaattggggaggtgtagcaggctagccgtgagcagctgaaatcctaactctacttgaatggcgcagacaaatttatgaagccttaattgctcactcacttgggccttggatatcataatgggcctttgattcataatcatcatctaaagcacactatttatggttatggttatggacctatggttcaaattcttgccaattttttttactaatgaagtttatttattccgttattcttgatcagcattggtgatcatttaatacactaaataaaggaaatctatatgataatgaaatggcttaagtctattggatgtcaaaaagtttgcacttgataatggcatgatctccacaattcgctttcttgccacttctttgtgtggtacgttatcgctaaatcaattattagatgattggacttcatgtcaagataaatttatgtcaattttcttccagccactctggtgaatggtgattaatgttcaacttttaagaccactgggtctgctctaattggttatccattttaccgacgttcatttttgtcatctttagatctttatggtaacattttctgactcatcaaccattgcatggtgcttcatttgatttacagccatattgttaagcatatgtgtatcctatatatgacccacttctactgtttttagcagtgcataacaatgggagactgtattataactttctatgcgtggagcaaagcacgtgaaatagaaggatgcttagtggaggttagtattttcaatcaagtactttgtctaatttatcttgttgccatgacaaacgtgggaaagtagtcattctagcttctgtaatttgagctctttatttctcgcctttggccaagaaatcaaccagcatgtggtacatgtgctttattatattctgtgagctctttcttaaaaggagaactctaagccaattttttctttcttaaaaagtaacctcactgaagtggaggtcctactttcaggcaaatcaagtttattttggttaaggtggtgaaaaagagaccattcattggagaatgtggttttgatgagtcaatattcaaaattgatttacttttaagatgtccaccatttacattgtcatacttgctaaactgcgccaagtcttgctagaagattctatctctcttttcactatttgtttatgttggtattgcttgttggtgattcagttaatagtggttagcactatgggacaaggtttatctacttacctcagccataggccatagccataaagtcccatttggggttgactcttaggaattacaatcaattgtttaaattctgttggagaaagattgtaattataacaatctaagcattctatcctagtggagtaggtggagttaagattcagggttaaacaaacaaggtaatattgtcttagaataaagttcgttgtgacaagatgcagaacattgagagttttgattcccaataagaaaagtaaattgagtgggtagttttgagttgaattcatgtttttcattttggtctgtcagaaaaaggataagatttaggttagcgggataaaatcttttagtagaagaatgtaatgagggaatttttctttgttgtttttgcctgaaaaggtgaaaagaatacaaaaaccatcctgtaaagtttgttgaaggacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatg

SEQ ID NO: 14053 - DNA, 3000 bp, Unknown
  misc_feature (1)..( 3000): cDNA_ID_2705949_gDNA_ID_2214695_Annot_ID_136797 3000 nt of promoter + ATG
aacgatgttgatttgaagcaggagaggttaattccgatcatcgtcgccgccattggagctgaggaagccgagcaaattattttatccgttccagattttttttttattgttctttaatataaaattgattttacaatttttaggttgactttttcagtcaactcaattttcacaaaatgttacaaaacaactctcttaattatattcgaatgcacacacacacatatcaaatcaataaccaaaaaacattccattctcatagggtttggttggttacactcacaagttattgaatatccctattcctaaacgcccgcccacggaaaacagcgaacccaagagcatgcccgaaaatcgcggctaggaaaacaccaccgttgaaggaaacaacagccagaatcactaggtagctaaagccggacttgacggtatacatagccgtgcgaaatgcaactttagcaagcttatcggcaccctgtttgatggatgacgcgtcagagcaccgagcaagccactcagctaagaacgccagaaagaagacgaagataagtgcgagtgcatacatcccacggtcagaaccaggccagcctgagaagagcacttggcagttgtaaccccaatagaatgttgggtgtaacagtgacggtctatgtggcgtttgcgtttgcgttgtggtggtggtgttccaagcctctactacgacaacgtttttgctcgacaacatctcctttaatttggtgtaaaaagagaattgggatgtcgttgtcgtagtggaaataggagactcgctagtctttgcctataaaaagtgtttcgtcttgagaggaagagactggtcctactaaattatatgctatgttcatgttatgaagcaaactcaagatttgattgtcggatttttctttcgaaaagctacaccatgtccatcaataaactatttttggccgtatatttgtaatcaaaattcgtttttaaacgtatatataaatacattgatgcacatatcataagctaagctagctaactaaaagtaaagtatcttatggtttaatatgtttttttgtctacgttagaatattttctttgcttttttatataaattttatcacaagctattgcaagcaataataaaaatattaaataaaatatgctaataaaaaccagtaattttattttgattcacttaacaagtaaattagttatttccccaagcttgttttcaaataatcatcaatctattctaggctatctagtggttaatttgtttttagactagggaacaatcgatcatatgattagtcgatatacgaaattttttgattatgtcaacaaaaagtgacataaaattttcagtgataaaggtgagctagcccatgttacaagagctaaatactaatccgatcccctcgattcaacagaacatttttaaacttatccaatttattattatatgctttacgtcaagtttgcgttcttccacgagagaagccttaacacatgatggaagagtgtaatgttgcccatgccaattgccaagaaacaaacaactatgcgtctatgcttatggcgggcaccgactaggccacgttctctatttcacaagtttaaccgcgaacacacaaaaaacaaacaaccaaaaaaaaaaaaaaaaaaaaaacttaagattatgagtttgaagacttggatgcacgaagcatagcaacgttgaaggtgaggagaacgatctttaatgggtatagtccactttccatcatctaacctttgtttatacggatattccaactcaagtataatccactttaaacttttgtgatgagtgaaaactatttcaaaactacactttgctttttttatgcatttcaaatttcactttattaatgtaaagtgtataaatatttgaataattggttttgaatctagatcttaatgtcaaggcacctataaagagaaaacatcaattcagttgcaattaagggcatgtagctatatacatttttttgttcttcagccgaaacagtacttcaataatgattcaaaacacacacacaaaaaaaaaatagatagcgaaacagttatatcttagccggaccaaattttcctatgaaatcactgtcagctttcttactcattacctcatgcggcactacctttggaccaccccgatttgataatcacatccaatagatttcaccacgacaaggtactcaaatcctctaactaaatgtaagaggaagaagatacaattaccaaattcagtaaactagagaaaacttgcactaaaattattatttctataagaaatgttttaaatattttaatttattaaattagagtaaaaatggatatttaacggaagagagagtggaataattaataaagaattaaatccagtagtaacagaaaactcaagtgtttggacttcagtggcagttttaagtactttgcttcggtcagaatccttcaaacactgtttcttcatctcccttcgtcttctaccttttgatttcgcgccaccacgctccaaccttttcgttttcctctcactgctttctccgatctgcctgagtttctccgtaagtggtccctaattcccactttttcctctctctggtttggtttggagtgacaaaaagaaaagggaaagttacaatttcgttttcctttctctttcttctttggtgatcccattgctaaaatttgctgatttccttgcaaaggtttctgattctcctaagttttagttagatctgtgatctactgatatcctctagagcctcaattcttcaagagactgtttagcttttgctaagaattgagtatgaagtactgaattgtgtaattccaatgaattctctagtgatatttttatgcttaaactttatgtctttgttattgcagagtggttagtgtaaaggtggatgaagaaactaagatttggtttagtccctgaatgcagtatagagtcattgctttgaggttgctggtaattattctaccact

SEQ ID NO: 14054 - DNA, 3000 bp, Unknown
  misc_feature (1)..( 3000): cDNA_ID_1397867_gDNA_ID_2214695_Annot_ID_136798 3000 nt of promoter + ATG
atccacaaatcagaaactgttttgttcggtgttgactcgactaatgaagagcttgcagcaatagttcagacaagaaacacaactacaataatactcccaagtggagttcacacattgcctaaagacggtaacaattctcctctcccgttgattaaccggtggaaaaccggtggagaatgtgactgcggtggttgggacatcggttgcaaactccgtgtcctgtcttataatcatacaaagactcaaactttgtcaagctttcaattgtttgatcaggtaaactaacttgttcacttcaagcagctttcgggtatcgatggtttgagtcatttttcaacaatttgatttgattctcacaggaaagagacgagccagctttcaaaatggtgagccacggcgatgaactccactctgttgagtttggctcatcgatctctctcttggaagcgttctttatttcgttagcagtaactagtcatcagagttggtgtcaggaggaagaagaagaagaagtggttgtgatcggagattgtctgttaaagagagaaacaccggcgaagtacgcaacgaacccaccggtttctccaatcggtcgggtctagaggcagagagagttgggcttagacagtgttggatctggtttgggctgggctttaatataattgtaattaagaattacatggcataattaatcgtttagaatttgggtaatgtacaaaatagtgaaatgcatttatgaataatatagtgcttatggtttttcctatagtcctttgaaaaaaatcgaactgaaattattttcagaaaaactcatttcgagacgttttttcggttgaatcaaaactattttagattttagtatttgatgataaaaggaatagagaggcatgtgaggaagaaaccgtatttgacagacatgcttcgctgcattaccctacgtactcacatgcttctccaaatcatattcctccacgtgtagtgtttttttcttctttctcaattagatatagttaaaccttaattaagttttgttaagatttgcaaattggccacttacttaactctggttaccccgacattaccttcgaaattttaaattaaagcgtcaataacggttggtgggtttcatctcgtgaccactgactactttttagttttacttactgaacaaaaaagctctttatcagaattttgaatataccacttgtttcctatttcggataaattgatcatataaaattataaagtaaaggtttttctcttagaagataaattttttttctccaaatttgcataccatttaaaaaatgaaaaagactcttttaaaacaaaacacaggctgggactgataatatgatattctagaatctttcctgaaaaagaaaacttacatagaaacttcttcttactatgaactttttgtaaaagaaaaaaaaaggttcgaaatgagtgaaaatgattttaacgtgcattaaacttgtttgatatgaatcaattcatgtaataggattgaatgctgatagtaacatcatacttattttctgacaataatttaataaatgagtacacttgttctaaagttctctttgagaattctagaatacaagtctgcttaatcaaaaggctattttaagataaatgaatttttaaaaaggttaagaaaacgtatgaaagacttactgtgatggacatatcaatcgacagttattgggagtttttttttggagtagcaaagaaatgtaagaaaaaataatgagaagaagataaaagccaaagttgtgaggcttgtcggaccaaaaatggccaaaatgctagcaatccttgaaaacaagtgatggtaactggaacaccaaaatttaatgggttgattgaatcattgaaagatttgactttcaatatttttgatattttcctaaggagacttttatgacttttctttcattagtctctctagccaaatttgttttgcacggctcacattttgccttcaacaattttcattacttgatctaacatagttacttcttaaaaaggcaaaacaaaatttactttaatagctgagtttcttttttgtttctttaccatttaaatcatatagaatggctaaccatatttgaaatagtattgaatcgaatgtatctaccattagaccaccatgaatgatttcatttatactcatgtattttacagtttgttaagttgattcatatactaatttaacaactgataattgttacacatccattaagctttcatcaatacttaaattaatagcaaaaatgaataattaacagctaaatacacccaaattttacagaaatattctactcctacaatttctaccagtcactactctctaattttggtataaaaatcatatagctcactatataacagctatcaacctgtaatatataaattctgataattaatattggagaatttagtctaattagctaaacattttattcgtataaagaaactttttttttcctcgtataaattctaattttcgtttcgtggtttgaattatactttttttgtttttatatataataattttcaattcaaccgtttctccgtgttgaactctaggcctttttaatctatgccttcatttctcagattcttctaaagaaaaatttcgcttttctctctacttcaaaacttttgataatcttctttaaactttcttcttcgatctctctttgttaactttctttcgttacgtctctctcgttctcgttatttcttattctcagatcttggattcacgaccatctcgatcgttgaccgtcgaatttgggttcggctaaaaatccaatctttttttttccggtgagaagctcgagagagtatataatttaataaagggtacgtacgattttggttgagtgttttgatgatgttgacccaatttgttggggtgtgaagtatacttatggaactgattgtcacaatacaagaagaacaacatcatcaacaaacaagaataataag

SEQ ID NO: 14055 - DNA, 3000 bp, Unknown
  misc_feature (1)..( 3000): cDNA_ID_3021527_gDNA_ID_2214695_Annot_ID_189514 3000 nt of promoter + ATG
agttgggcaaggaagctttcccttaccgttacagttggtgcatctgcggagaaaagagagttttctgtaattaaaaccacacttttcattttgcaaccatcaaagtataagtagagttcttgatctgaactcacattgtgtcggacccatctttatgagcaaccaagcctcttccatagcaagtggaacacttcatcatctgattctccttgtaaaatcctggctctccatcagcattgcatgttggacatactacatctcctcttccggtgcaacctgtggatcagttaaaccaagtctcatcagtatttacaacattctgattgtcctaatggtcatatgtacattacatttgatacctgtgcacttctcaacagtctcagaattaggaaccaggacttgagtttctttatacgggacaaacagagtaggaaactgcggtctcaggtccagttcccataaccccggttcagatccatgtttctttccattgaattcaccaccagtgaaaggcacagtctgtgtcaaagcttccctctcctcaatgaaagtatcaagagttccgacataaacattgcagtcttcaacagcatgaatcttccatgtacgagcaggacggcttccccaacagcaacgatgaccaatatgatcaataagcagctctcttatttcaatctcatcaagaaactgcctgtaagaaattacataacgttcaacataagttaagaaagtgagggctaacaacagcaataagggaaaaattaggaaccattatcactagaattacctttgttgcaattcatgacctgctccagatgcacttggataaccaatagcttgagctgttaaatgccaagaagaaatcagaaatttgtataaaaccattaagaagcaaagagagaagattataggaaatgaatcaatgatgaaactttcacatttggaagatcaaaaatcaaaatctagagaaaacagcatgtagatcacttccactacgaatcaagactcgaataaaaagtctgctactttcaatggaagctgatcaaataactaaaggtgtcaatacaaaattttgaaggatcaggaaagatggaacgagacttacgaatgggtaacgaaacaggggtcttgataacgggaggataaagagacggaggatcagaagaaacagcagaagcggtacggatttcttcgacggtgacgacgccagctccggcgaaagatgggttacgagcagatgagctatttctctgcaggtattggtatgaatccaacctctcggattcattcgttttctctgatcctaaatgagcatttcgacaagacaattttatgaatcagaggactcaaaggagatatacacagaggagatgatatgttcgtctgaatttacctgaaagcagaggcttatccatggattacgaatctctctgtcttcccaattaaccaaagtagtggtttttcttagagagtaaggaaaaacccaggtcaattcgatcttcttctccgtgcgagagaaattttcattacaagaagaaacaagacaagaattcgagtttttcttatcgggtcgggtcagatccagatagaaccgggtcttcgtattgccacgtgtgaaacggttgaggatattttcacccactatataattggttgttataagtacgtaagctaaaaagagattcacgagggaaataattgcgcgttttggtccagtgtttaaggagagagagcaggtatatgaaaataacacttacacatggatgcttttaagtcctatcacatgcggcatatcggcaacaaaatctttttcatgttcgttcatttccaagttattcaatatgaacgattccaaaattttgtcgttgatttgattatagttgacctggaaaagatactatagatactaacgaacatcatctctgttggtctagtacatgtatttaggagtggacacaaaatggattttttttacttttttggtgctctgtccggattcaacatatatctagttttgtgtatcattttgattcattatggaataattggttacaagttacaacttcataatgaacaatttattataagacgtcgtcgactctactgatctcacctcacgtatgattaagcacaatattggtgtatgtttcttttttctagtgttgagatgtctttcatacaaatcccatgaatatgcatgtctcttgttctctcaatctctgctaacacaatttacgacctctatgttatattaccataaaaacattacaagagaaagaagaaaaatttaattagttttcaaattaataaaaatttagacgttttaagaaaataataataatttacaggtcataaaaaaactgattgaagaaatatatttccagctctaaaacccaattcctaaatctatattcatttagaaaatatatatacatttggtatttaatattcttaaatggagtaagataataaatttatattgtaatattaaataccaaatatatatattttggtgtctttttaattaataaaaaaataacaaagacacttattctaaattaagaagagtcaattaacgaaataataaggaatgaaattctcaattatgaaaaacacctgtcacgaaagtaaacgggaaaaaaatcgcacgatagataattgcatcggtgctcagtgctctgtttatctcgttatataataatgttagagaaattggatgtgaatgcaatggggcggtttaatgtgaattgatgagtagacacaacaagagtttggtttggtaatggtagcaacaagccaagagcactaactaccgacaaccactcgcgtccacatttgaattttcctcaattcccccactcacgctttttagctctttctcaatctttcatggcggattatctctctctctctcacttctccttctcgtgtgattctgattctcctctctaagatccgtatctctcttactctcccttctcaagctcacttcaatcaacc

SEQ ID NO: 14056 - DNA, 3000 bp, Unknown
  misc_feature (1)..( 3000): cDNA_ID_2705969_gDNA_ID_2214695_Annot_ID_189513 3000 nt of promoter + ATG
agtaaacgtatatacataccccggaccacggccatagcacaactcgttctgtccattgcaggtactgtgattgaaatcacaaggcagtccagtgtcaatgcaaaaggtaccaagagtatttggactcacatcaccacagtttgattgacagaaggcagagacaaatttacgcttcgaaccgtttcttactcgggttttaacatcaagggacttatccacagaatgtcctctagatgacttataagtagccgcaatatccaaaagtctactctctgaaacaaagtaaaacaaaaccataactttccacatcagtctctctgcaactgcaatgtagagaattgctacattaggtaactcaaggaaaggatatgactcacggtttctactgaaatcagaaacaatggttgatactctccgagggatgtttctagagctaacagaattcttctgtccattctcaaaccaatcctccataaaccgagctgcagcgcctttgttatctccactaatcaacgagttagtccgactcatggaagtcccatgagtagcaaaccagttaaaactaccagtaggtcccaactgagaatcaacaaacttaacaagagtcatttccttatcaacatcatacttatatttactcctctcagctgcaggattgttcagataagaactcggacttcgattcacaccagcatccaaaagatcccctattaacaaatcatcacacaaaatggctcaacaaacacaagaacatcaataaaggagattgacaaagaaaagattgtaacttctttacctttgttaacaaaagcagaaccaggacgtaggctttcgtgtgcttggacaatgctttgctcaatgccgttaacaacaacgtcaaaagattgacgaacaaatccaagagacgtcacaatatatgtgacgtattgaagatatcctcctggtccagcatgtgtgtgaattccacttattgctacattcttctctgtgtaaagctcaccatacctattgaacttttaaaaaattagctatccattctcatggattaatcactgattccactaacactctactcaaagattaaatctttagctaattaaatattcataccttgctttgagacgctcaagaactttgattgtaacgatttgagaagccatacaagcgtcgagattgacaaacacgacgcggttaccttgaggctcagcgacgatgaaggcacgagctcgtaaccggaaatgaataccggaagcgatttgatctgagtttgcgtagcccatcatgttgacatcagcggcaggaccagtgatgtcatagcttccgactccgattaagtatgcataaaccgttcttgaaagaagaagaagaagaagaaagagtataaattgaaacaatggtagtgaaacagccatggttgattgaagtgagcttgagaagggagagtaagagagatacggatcttagagaggagaatcagaatcacacgagaaggagaagtgagagagagagagataatccgccatgaaagattgagaaagagctaaaaagcgtgagtgggggaattgaggaaaattcaaatgtggacgcgagtggttgtcggtagttagtgctcttggcttgttgctaccattaccaaaccaaactcttgttgtgtctactcatcaattcacattaaaccgccccattgcattcacatccaatttctctaacattattatataacgagataaacagagcactgagcaccgatgcaattatctatcgtgcgatttttttcccgtttactttcgtgacaggtgtttttcataattgagaatttcattccttattatttcgttaattgactcttcttaatttagaataagtgtctttgttatttttttattaattaaaaagacaccaaaatatatatatttggtatttaatattacaatataaatttattatcttactccatttaagaatattaaataccaaatgtatatatattttctaaatgaatatagatttaggaattgggttttagagctggaaatatatttcttcaatcagtttttttatgacctgtaaattattattattttcttaaaacgtctaaatttttattaatttgaaaactaattaaatttttcttctttctcttgtaatgtttttatggtaatataacatagaggtcgtaaattgtgttagcagagattgagagaacaagagacatgcatattcatgggatttgtatgaaagacatctcaacactagaaaaaagaaacatacaccaatattgtgcttaatcatacgtgaggtgagatcagtagagtcgacgacgtcttataataaattgttcattatgaagttgtaacttgtaaccaattattccataatgaatcaaaatgatacacaaaactagatatatgttgaatccggacagagcaccaaaaaagtaaaaaaaatccattttgtgtccactcctaaatacatgtactagaccaacagagatgatgttcgttagtatctatagtatcttttccaggtcaactataatcaaatcaacgacaaaattttggaatcgttcatattgaataacttggaaatgaacgaacatgaaaaagattttgttgccgatatgccgcatgtgataggacttaaaagcatccatgtgtaagtgttattttcatatacctgctctctctccttaaacactggaccaaaacgcgcaattatttccctcgtgaatctctttttagcttacgtacttataacaaccaattatatagtgggtgaaaatatcctcaaccgtttcacacgtggcaatacgaagacccggttctatctggatctgacccgacccgataagaaaaactcgaattcttgtcttgtttcttcttgtaatgaaaatttctctcgcacggagaagaagatcgaattgacctgggtttttccttactctctaagaaaaaccactactttggttaattgggaagacagagagattcgtaatccatg

SEQ ID NO: 14057 - DNA, 3000 bp, Unknown
  misc_feature (1)..( 3000): cDNA_ID_3021531_gDNA_ID_2214695_Annot_ID_189512 3000 nt of promoter + ATG
tcgttttatgtctgtgtttgtgtaaatttttatatagtacagatttatgtctgtttgtgtttatggccttgtggggattttgctaattatatgctttttttggttgattttattacattctttgatttatttattagtacttcccaaatatggtacaatagaatattttcaagtttaagcatctcatatactgtatatctggattttaaaactttgggtatagataataacactagtcataaatgttcacgaatcattcataagccagtgacatatttgctcaatcggagaaagtgaacggaaaaggttacaggataggccggtgatggaagagaggcaatctccctcagcgtccataggttcacacagagatagagagtgtatattgttttctacgattagagcaactatatatatattacccaattaaaagtaaagttataacttatataagttctaacttacataagttctaacttctaacctatcccacaacaaaatggtttgtagtttatacccgatccactaacactctctcgcccatgtacacctctagatcacggccacacatgtcgttcgtttaccctttaattattattttgttatttagaaaaatgaacaatgcaacttagttgctatcattacatgttttaaaatgtttattatctttgtctttaaaatttttagctaatttcttacactagaaactgaaaaacgtacaaattaacacttgatcaagatgtaacatgtgggccaaaccttagatttgccgtcaaatatattggacacgtaacccctaaccacatacctcctatcacctgctaccacgtggattcattccaaacactttccggatctcaagccggtcggcaaagagcaccagcgtgaaattcgtcttctgcaccttcttcgtgccttgatggccgttggatccgaatcagacggccgatacacgatctcccttgatcttacatgtgaacttgtcatttgcgttaagtcaagtaccaaatcatttgtaaatatgtcggacgaggtacaaaaatgtgttgttatacaacaaaatatttaaaactcatataaaataaaggtatacaaatgtgaagagtattgcaaatagatttagctggttagtgatgttttgaacgtcatggatattgtcgtagtatgtgtttataagttgatcgttgtctatgtttcaatgtaaaaacagatttttggatgtaataaattagaaatgacaatcggttttaaacttcaattttctgataagtggttcattgaaatactcaaagttgatgatttatttttcctcgtttagaacttgatgatcttcgcaaagatcttaatcataatataattagattttgtttgtgagtaatccagtcatatatagaattaaacactagcattgtatgtttaaggcaaaattgcaattacaataagattcggtttcatatcaaatctcttgtttatggaacatgtatgtgtcttttttttttaagaagtttttttgaatagaggtttggtgatagatatggtcctttttttttaagaaagggagggtataacgatataaatatattcttcttccaaaaaagagtgaagggcaacaaatacaagaagaattatgttgaaatcaggcgttaattaaaaacataaaattcagatgtgtattcatgctgcattgaaattatttatatcgaaaatgataattgtagtaggagtagaataacaaagacatacacaagtgcaactcggtgtaattagataagatcactgctttgcttctttgtaccttcgatcatgttcttgtataatcaagattcgtatagaagctaatatattcacatgtttttgttcttctaattatgaagttgaaccatctattattgtagttggggattaatggacgatttgaaagaatcaaccgaaactcactagatcgtgtatttgtgtcttggttttatgttttatctttttaaaaatttctatactgaatctggttttcttagcagcttaaatttttaattaatatcagaatgagatcatgataaaacttttcacaaaattgttgatcttgtattagagaacaaattgaacaaccatgagaatgaatttcatgagtcacacacatcttcacattatctagatggaaacaagtatacttactagaaaattcaaatggagccacctatcaaataaatcccctgttagataactcatgatcaagatattcatgatcaagaaattatctactcgattttctgttttagctcttttgataaacactaatttttaagtgttttatattcctcacacacatattcaccaatagattagtcattaatctcaagttaacacacgtacctttatattcaatagacctaagtcttgtttctgacctcaaactgttggtgccagactcccacttccatgttcgaacttctttacattctttaagtcaggttattttttggattccaactgtagtgacaatccatacattccatggctaccaaacttatcttgattcacattatgctaagaagctaaaacatacaaaaagaaccgaaattgtcgtgagtttttttaatacgatagggtattaatgtattcttaacaacgttatggtcttgagaaataaaatatgcaaatctcgggtagggttatttggattagtgaaatttgggattttcttaatttaaggctaaaaactatgaaatttagagatttatgacagttaataaatacgaataacggtgttcgttgcaattttatgtggtacttatttgtttttaaaaaaaaagtttagtactaaattgttcgatttcgaaagttaaatatatttttgaaagttataaaggaagaaaggatttcttagcaaatttccgttatttaagttggagagaaaaggtttaactcaaaatatcgcaaaaccctaacaaaaaattttcattcttcctccactctctcaattccaaaacactgcgccgggaagac

SEQ ID NO: 14058 - DNA, 3000 bp, Unknown
  misc_feature (1)..( 3000): cDNA_ID_2705961_gDNA_ID_2214695_Annot_ID_189511 3000 nt of promoter + ATG
tcataaatctctaaatttcatagtttttagccttaaattaagaaaatcccaaatttcactaatccaaataaccctacccgagatttgcatattttatttctcaagaccataacgttgttaagaatacattaataccctatcgtattaaaaaaactcacgacaatttcggttctttttgtatgttttagcttcttagcataatgtgaatcaagataagtttggtagccatggaatgtatggattgtcactacagttggaatccaaaaaataacctgacttaaagaatgtaaagaagttcgaacatggaagtgggagtctggcaccaacagtttgaggtcagaaacaagacttaggtctattgaatataaaggtacgtgtgttaacttgagattaatgactaatctattggtgaatatgtgtgtgaggaatataaaacacttaaaaattagtgtttatcaaaagagctaaaacagaaaatcgagtagataatttcttgatcatgaatatcttgatcatgagttatctaacaggggatttatttgataggtggctccatttgaattttctagtaagtatacttgtttccatctagataatgtgaagatgtgtgtgactcatgaaattcattctcatggttgttcaatttgttctctaatacaagatcaacaattttgtgaaaagttttatcatgatctcattctgatattaattaaaaatttaagctgctaagaaaaccagattcagtatagaaatttttaaaaagataaaacataaaaccaagacacaaatacacgatctagtgagtttcggttgattctttcaaatcgtccattaatccccaactacaataatagatggttcaacttcataattagaagaacaaaaacatgtgaatatattagcttctatacgaatcttgattatacaagaacatgatcgaaggtacaaagaagcaaagcagtgatcttatctaattacaccgagttgcacttgtgtatgtctttgttattctactcctactacaattatcattttcgatataaataatttcaatgcagcatgaatacacatctgaattttatgtttttaattaacgcctgatttcaacataattcttcttgtatttgttgcccttcactcttttttggaagaagaatatatttatatcgttataccctccctttcttaaaaaaaaaggaccatatctatcaccaaacctctattcaaaaaaacttcttaaaaaaaaaagacacatacatgttccataaacaagagatttgatatgaaaccgaatcttattgtaattgcaattttgccttaaacatacaatgctagtgtttaattctatatatgactggattactcacaaacaaaatctaattatattatgattaagatctttgcgaagatcatcaagttctaaacgaggaaaaataaatcatcaactttgagtatttcaatgaaccacttatcagaaaattgaagtttaaaaccgattgtcatttctaatttattacatccaaaaatctgtttttacattgaaacatagacaacgatcaacttataaacacatactacgacaatatccatgacgttcaaaacatcactaaccagctaaatctatttgcaatactcttcacatttgtatacctttattttatatgagttttaaatattttgttgtataacaacacatttttgtacctcgtccgacatatttacaaatgatttggtacttgacttaacgcaaatgacaagttcacatgtaagatcaagggagatcgtgtatcggccgtctgattcggatccaacggccatcaaggcacgaagaaggtgcagaagacgaatttcacgctggtgctctttgccgaccggcttgagatccggaaagtgtttggaatgaatccacgtggtagcaggtgataggaggtatgtggttaggggttacgtgtccaatatatttgacggcaaatctaaggtttggcccacatgttacatcttgatcaagtgttaatttgtacgtttttcagtttctagtgtaagaaattagctaaaaattttaaagacaaagataataaacattttaaaacatgtaatgatagcaactaagttgcattgttcatttttctaaataacaaaataataattaaagggtaaacgaacgacatgtgtggccgtgatctagaggtgtacatgggcgagagagtgttagtggatcgggtataaactacaaaccattttgttgtgggataggttagaagttagaacttatgtaagttagaacttatataagttataactttacttttaattgggtaatatatatatagttgctctaatcgtagaaaacaatatacactctctatctctgtgtgaacctatggacgctgagggagattgcctctcttccatcaccggcctatcctgtaaccttttccgttcactttctccgattgagcaaatatgtcactggcttatgaatgattcgtgaacatttatgactagtgttattatctatacccaaagttttaaaatccagatatacagtatatgagatgcttaaacttgaaaatattctattgtaccatatttgggaagtactaataaataaatcaaagaatgtaataaaatcaaccaaaaaaagcatataattagcaaaatccccacaaggccataaacacaaacagacataaatctgtactatataaaaatttacacaaacacagacataaaacgaaacagagagagattagaaaaaaagcttcgacgcctctcagccttaagccgaatctcacggtggctactaatacagaaccccccccccaaaaaaaaccataacatgcctaaccactactaaccctctaattccaaaaacaccaacaaacaaacaaaaaaaaaaacaaccttttttttctctctctctcaaaaaaaaaaaatcaatcctttttttcaatttggcgcttttctagagattgattttgtttctcaggcggcgagatg

SEQ ID NO: 14059 - DNA, 3000 bp, Unknown; identical to SEQ ID NO: 14054
  misc_feature (1)..( 3000): cDNA_ID_1397867_gDNA_ID_2214695_Annot_ID_189506 3000 nt of promoter + ATG

SEQ ID NO: 14060 - DNA, 3000 bp, Unknown; identical to SEQ ID NO: 14053
  misc_feature (1)..( 3000): cDNA_ID_2705949_gDNA_ID_2214695_Annot_ID_189505 3000 nt of promoter + ATG

SEQ ID NO: 14061 - DNA, 3000 bp, Unknown
  misc_feature (1)..( 3000): cDNA_ID_2705941_gDNA_ID_2214695_Annot_ID_189501 3000 nt of promoter + ATG
ccgtgagcagctgaaatcctaactctacttgaatggcgcagacaaatttatgaagccttaattgctcactcacttgggccttggatatcataatgggcctttgattcataatcatcatctaaagcacactatttatggttatggttatggacctatggttcaaattcttgccaattttttttactaatgaagtttatttattccgttattcttgatcagcattggtgatcatttaatacactaaataaaggaaatctatatgataatgaaatggcttaagtctattggatgtcaaaaagtttgcacttgataatggcatgatctccacaattcgctttcttgccacttctttgtgtggtacgttatcgctaaatcaattattagatgattggacttcatgtcaagataaatttatgtcaattttcttccagccactctggtgaatggtgattaatgttcaacttttaagaccactgggtctgctctaattggttatccattttaccgacgttcatttttgtcatctttagatctttatggtaacattttctgactcatcaaccattgcatggtgcttcatttgatttacagccatattgttaagcatatgtgtatcctatatatgacccacttctactgtttttagcagtgcataacaatgggagactgtattataactttctatgcgtggagcaaagcacgtgaaatagaaggatgcttagtggaggttagtattttcaatcaagtactttgtctaatttatcttgttgccatgacaaacgtgggaaagtagtcattctagcttctgtaatttgagctctttatttctcgcctttggccaagaaatcaaccagcatgtggtacatgtgctttattatattctgtgagctctttcttaaaaggagaactctaagccaattttttctttcttaaaaagtaacctcactgaagtggaggtcctactttcaggcaaatcaagtttattttggttaaggtggtgaaaaagagaccattcattggagaatgtggttttgatgagtcaatattcaaaattgatttacttttaagatgtccaccatttacattgtcatacttgctaaactgcgccaagtcttgctagaagattctatctctcttttcactatttgtttatgttggtattgcttgttggtgattcagttaatagtggttagcactatgggacaaggtttatctacttacctcagccataggccatagccataaagtcccatttggggttgactcttaggaattacaatcaattgtttaaattctgttggagaaagattgtaattataacaatctaagcattctatcctagtggagtaggtggagttaagattcagggttaaacaaacaaggtaatattgtcttagaataaagttcgttgtgacaagatgcagaacattgagagttttgattcccaataagaaaagtaaattgagtgggtagttttgagttgaattcatgtttttcattttggtctgtcagaaaaaggataagatttaggttagcgggataaaatcttttagtagaagaatgtaatgagggaatttttctttgttgtttttgcctgaaaaggtgaaaagaatacaaaaaccatcctgtaaagtttgttgaaggacaagttcaggataagattttgatttggagattcactttgggtttggatttaatgaaaattagaagtttaaagtaagttttatagaccaagttgttggacaagcaatcgaattgggagctatgttatgtcttgattatgcttacgagttcttttatgttacctatattttcacctatgtgaatacggccgttgtgttgactcatcatcctcaacatgaatgtggaaaaaattaaggaaaattagaaaatgaaaactgcttgaggctgaaaataaggcaatgtgaaaaacactgtacaagatatgactcaacacagtgagcttacgcctatatatagaggaccaagtgttcttcttctctaacacacacacactgacacacacactccttaagatcatctctctcgtgtagtgtattttgtcaataaaagttgaacagatggagcataagaatattggtgcagaagtacttcaagatacgtacgatgatcaacagaaatgggttcttgattcttctcttgatagcagaggacgtgttcctcttcgggctcgaactggcgcttggagagctgcactcttcatcatcggtacatagcccttattgagattgtatatactttataccatagaattataacactgaaagaagtgtactataatatcccaaaatattaaatctttgtgaagtcttttgtttcgtcttctctgcacagcgatcgagttcagcgagagattgagttacttcgggttagctacaaacttggtcgtctacctaacaacaattctaaaccaagatctcaagatggctataagaaatgtgaactactggtcaggtgtcactactttgatgcctcttcttggaggctttatagccgatgcatatctaggccgttatgctactgtcttggttgcaaccaccatttatcttatggtaacatatgttcttacctctgatatatcctaatccaatttatttaaagattccataaacaaccttaaactgtgtcttgatggttaaacagggtttggtccttttaacaatgtcctggttcataccaggcttaaaaccttgtcaccaagaagtgtgcgttgaacctagaaaagcacacgaagtagccttcttcattgccatttacttgatctccatagggactggaggtcataagccttcccttgaaagctttggtgctgaccaattcgacgatgaccatgttgaagaaagaaagatgaaaatgtctttctttaactggtggaacgttagtctatgtgctggtattctaacggccgtgactgctgttgcctatatcgaagaccgggttggttggggcgttgctggcatcatactaactgtagtcatg

SEQ ID NO: 14062 - DNA, 3000 bp, Unknown; identical to SEQ ID NO: 14051
  misc_feature (1)..( 3000): cDNA_ID_3021551_gDNA_ID_2214695_Annot_ID_189500 3000 nt of promoter + ATG

SEQ ID NO: 14063 - DNA, 3000 bp, Unknown
  misc_feature (1)..( 3000): cDNA_ID_2705983_gDNA_ID_2214695_Annot_ID_189519 3000 nt of promoter + ATG
gttctcaacggatagtgacaaaggaaagagaaaatagagagggttgattagtgagattataaaagaaaggtgtgaaattagaataaagagaaaatatgaggggtcaggttttgaaaattccttatcgctagttccgttgtataactttagcagtgagtcggtagtacaacactactactactactgcagacagagtaagcaaaaaagtctaggggctctcgcttgttaaatgactgttacgcccctaggttttacttctactatcactacctatgaagttaaaaaccaaagaccatctttgttttgtttcacgaacttgaagggacaagccatttgtttgtctactcaaattttgagttttcacactcttttttttttttttttttttttttttaatttgtaaggtaacgtatttccaaattagctggaaccaaaactcatcatttaagactatttttgtccttacacatttttattcgagtttaaatgtgaataccgaatgtccaaggtcaaaagtgacaccaatctttgtgttttgatgttcgtacgttttgaaccttctttgatcttgttttctacttttatgcatgttttactatttttccatgattcgagttgacatacctatttatgttaaatccatggactaattagtttgatcatacatatatctattctatagtcgatttatggttaaatgcacgctggctggtctagaataagttcgttaactcttatgttctacggaatttacatgactagtatcatgtatgcatgtatgggtcttgtagagaacatggaagctgagtgcaacaatatccttacttggatgataattgtatgtgttagtttatttatgtgtgattgtattaatataatgaataatcataatattgattcttaaatgacattttaaaatatatttcgattttttttttcaatttacgaggaaaaaacatatgaatagtgtttatactttaagggggaaaatgcaaagtcaggtaatagctcgaggatgtttctgccattacttattcactttataatcacatttcgctttcattttttccttttctgtcattctctttatattttctgtctttccactttcattttattttagctttttcttgttccattgctctttttgttttctctagcttttgccttttgagaacacatcaaataatgcatgttaaataagatgttaattgtactcgtgtaaaaacctcttacataaaaaatgccaactttttatatgttttccatgtacaaaatcccatcatcttatttaactttattatataaaattggacacatgaaaaaccaagagtagaatttagttattcagtgtggaggtaaattcacacacgtgaatagtattatctcatcccaacaaaaaaaaatgaatatccaaataaactcaggatttaaattttaaaatgaaagaaaaaaattaattgggaaaatgaagaagggcgtggaatagcaccgacggcgcacgggggagagtgatgaagattgatgagagtcacgtcggtgagtcacgagttacttaaccagactggtgtaaaccacacatatatcgattttgggcttagcttcggcccattttcttgagatagatgactcatgtcttcatatggtcggatatattaggctaaaagtttcataagaaaatgttattttgttctgtctctttcaattgttcccccgtaggttgttgtatatttaaaataggcactctcttcttttttagatgtcgtagaagtagtttttatattggtgaaagatcatgtttctctcttcttttttagatgttgtaggagttttaatggattttggaatcttttatttatttaggaaggaattcaaaacatgcgagggtaatgtgacctctgccatgttatgaaccactcataggtgcattcccactttgaactttttttttagactcacttttgatgatttgaaaatacgtatagccccaaatgaacatatcttgagaaacacgagcaatttctcataaatgcctaatagtttagccgtttaggcatctcatgatctcactgtaaactattaggatagttacacatacacttaaataatagttacacatacatctaatattttgaaaatcctttatattctatgaattatccacaccaaatgacatcatgtgtgactgtataaatacgactacaaatctatgtaacctataccaattacaaatatgtttttctatgtttaatagctataccgtttgtgtgtgatatatatgattagttacattaagatactttaacacaattctagatttctagtgcaatgcagttatcaaatacttctgattttgaattgacaaagcgacttaaaaacgattgattgtaaaacaacttaccacatggcaagcacactcctaaacgcatcgaacaaatccataaactgcatcatacatacaacaaatccaatggctttgtcattaggatcactaccgtagcaccagttggggcatagtgaaatacaaatgcctttttcttatgtcattgtcttaaacagacatgaccatctctctaatttacgactactttttcctttttgggctttgaatgaatcacgctttcaaataattgggctgcttctttctttcccattttagaccaatttcaaagacaaaaaataaaactagcaattgctaaccgaaactccggtatcccggttaacccgttgtaggtggggctgacgtgggtgcaatcactttgtcatatcaacacatcacgtgtctccacgtaggatgcagcagaaactatttactacattgactaaaatacccttcaccaccaaacaccaccagcacacgaaactttcatacgtttctttcatggcggattcgctctctcgctgaaactctctctctctctcgttactccaaccactcctaattattcacatcattattggcatgaaaagttaatctttcctatataacaattattaatg

SEQ ID NO: 14064 - DNA, 3000 bp, Unknown
  misc_feature (1)..( 3000): cDNA_ID_1807244_gDNA_ID_2214695_Annot_ID_189518 3000 nt of promoter + ATG
gtttttctctttcattatctccgcttattacattcttgatccgcgtatcttgaagaaatcaagattacagaaaaattaatcaagatttcaagatttggtttccttatataaatagctaaatatagcttttcacataattgaatcgttcgtaaattccaaaattgtttttcaaaagtgtaaaacacatgaaagaatatccgataatttaaacaaataaaataaaataatgatatataaattagaaaaagagggagtggttgttgaaaaaaagagtaggtgcgttagtttgagcggcaagcgtggagaaggcttgaccttaatgtgaatgtgaaacttattaccaaaccgtttataatgtggccgtgtgggtcacgttaattgtccttttattgagttttgtctggcttcaaagctaaaaattagttacaatctcctgattttggagacattcaattccaatgcaaaggacagaaccattacataggaatataggatatgatcctaaattttgagtttagatcactgataaaccgaaattcagatttaatctcaaaacaagtaaaaaccagactttcttgctacttaaggtgtggatgatctaaaccaatagagaagttctcaattactagattgatttcttctatatatataggttagggcactttgatgagtaccacttaaaatgtttggctaacactatatatatgcttttggtactatgacacttgtttattttgcagtcctccttcctatggggttacattttttcatccgttatcggaggggcattggtggatcggtatggaggaaaaagagtgttggcttggggtgtggcattgtggtccttagccactctactcactccttgggcagctgcacactcgaccttagccttattgtgtgtccgcgccttttttggcctcgctgaaggcgttgcaatgccctccatgaccaccctactctctcggtaattccttttattctacattttgaaaacgttttacgtttttaaactattgggtttgaaagaaccacaacctaagttagatatatggtttcctcaggtggtttccaatggatgaacgagcgagtgcggttggtatatctatggccgggtttcacatgggaaatgttgtgggacttctgttgacgccactcatgttatcttccataggaatctctggtccatttattctttttgcatccttaggtctattgtgggtatccacttggtcaagcggagttacaaacaaccctcaggacagtcctttcatcactaggtcagaactcaggcttatccaggctggaaaaccagttcaaccgtcaaccatttcgccgaaaccaaacccatctttgcgacttcttttgtcgaaattgcctacttgggcgatcatttttgctaatgtgactaacaactgggtgagtttgagtttaatagtatctttatcagagcaatacctcatcttttgttgccataaactcacacggttttcgttagttgttgttcacagggatactttgttcttctctcatggatgcctgtttacttccagacggtatatagggattattccatgttttcattcagatatatatgaacttcaagaaaatatatgatgttttatatctttgtcttgtttgatcataggtgtttaatgtgaatttgaagcaagcagcttggtttagcgctcttccatgggcgacaatggcgatctcaggttactatgcaggagcagcatcggacttcttgataagaactggtcactctgtaacctcagtacgaaagatcatgcaagtgagtattagaagtgccatacttggttaactaaatagccgacccataacattctaacggaaagtccctgcttttgtttgtcagtctattggatttatgggtcccgggctgtctctgctctgcctcaacttcgcaaagtcgccttcttgtgcagcggttttcatgaccattgcattgagcttgagttcctttagccaagctggatttctcctcaatatgcaagtacgttaactctcacccttatataaccaaccattcattctaaacttgattgatcactaacctaaccattttgggataatcttgaatctcacaacatcttttggtttctctttgcggaaacaggacatcgcaccgcaatatgctggtttcctgcacggtaataatgttatcagatggtggatcttttcttcttcttcttttgcatcgattttgtttcttgctgaaaaagttagggtttgtatatctggtgtgcgagacaggtatttcgaattgtgcgggtacgttggctgcgatcgtaagtacaatagggacgggatattttgtgcagtggctcggctcttttcaggcgttcttgacggttacggcctttctttactttgcaaccaccgtgttttggctcctctttgcaaccggagaacgagtcttctagatccaaaacgctctccttggacactttactgtttagagctttgactagaattaaaattaaaattcattctttcttttatttggaagttagagtagatatttctctggcacgtctgtgataagcactatatatacttccgattaaatcataaaatagaaattagtttttatatacagtattgtcagtatcattcaaaaaaatgatttcagtctagagattgaattagttaataatggtggccaagtggccaaaacctagcttctttagagatttcacttactatttttcttaaaaatgacccaaaagatgaatgagttagagatatataataagtacacatcatacgaccacgagaaatgaatcgtttacatgtgaaaaacgacaattctagtaatattatcatgtgtgaactattccattatttgtgaatttatttacagtaaacaatcagacccaaaaaataaaaaattccaattaaagttctccaattggagttgattctgcccttattagagagatctgatctttccccaattccataacccgaaaaatg

SEQ ID NO: 14065 - DNA, 3000 bp, Unknown
  misc_feature (1)..( 3000): cDNA_ID_3021519_gDNA_ID_2214695_Annot_ID_189517 3000 nt of promoter + ATG
aacttacgtttggtcaaagaggagaatcgagcaaggtacgaatttatcgaccggacgaaggagtttggagatcggagcgaagacgaaacatcaagcaagccacgatcctattttcttcaaattaattacctttttcagaaaatatacttttttattctttttgataaataccatattttatggattttacattaatttggaacaattattttaatgatacatgtataattatttttttttaaactatgggttatttttttcaaaaaaataatgtgtggatgtttcaaaaaaaatcaaatttcataatgaaacaaacaaaaattcgaagaagataatacacattgtgttgagaacaaacaattattacacattgtcggattaaccatataaataccgaactttgccttttgatttggccaaaaccttaaagttaaggtaaaaccttcatagctgtccaacaatgttaataaatccatcttagagtttaaggtcattgacagaactttcagtaactttgtctcccaaagcactccttatgtgatacacatacactaatgggtaaaaaatttcaatttctctgaccatatcaataaatgtcaacggcagaggcaaaaaaaaaaaatttggtcaacgaagcaaatcatagtggtttctaccactgtaaagaagcctaacaacattcttgtttgtcttcccctttccccagcctcctcgaaattcacttccatactcttgaatcggtataaaacccggcccataccctcctcctcttccatgctagataaacaataccaaataactcaagttctgaatacagttactagaacaaaagaaacacctagtcttgcttacataagactcaaattcaaagggcgtttacctcgtgctcaggtatgtagacgatgataggctgtttacatagcttggagagaacctgttgaagcaaaacactgacattagatcatttctctatgatggcagttttaaatgcaggaaactcactagcagctcggactctcctccccagaaatcgtgtcttccaatccgctggcaaaagctgaagaaaaatgcttaacgtgataaggaaaaacaatgccatttagctgaaaagtggtaatgagtgtgaatgaattcttatgagttatgactcaccgtttcagagactcatccacagtgatagccactaaagcttctttgtacttctccctttccttggggtcattgcatataacctctttcacagccattcgtaactcatctgtgaaacaaaggcaagttttgccacacaaaaacatgatgaacaagagataaacattcaaatgtatagaccagagaaaccacaaaacatttttccaccaaaaaggctaacagaatgaaacaaaatccagttttgattccccaatctcagcaagcttaacacagttcaatctcttagatttcaaaaacacacaacaaaaatcaaaacaaggctatatgatcaaatatatagttacctgcatcatctctctctcgttgggggttaagagtaatacccttattaaaggccattcctttcacctaatttacattgaaaaatcacatcttttattcaggaaaccccaacaagaacacataaaaataacagaaactacattaccaatgctcgaaacagacatctcccatcccctttaactctatccacagcatacttctcaacctttttcgctgcaggagaccgattcctagagatgaatataagaatcaattcgcagattagcgtaaagggttttatcagagactcgattgttgaattcaataaacgagaaaacacacatcgaggaattgattctggcgaagaacacataactatttcccttcgttgtgcttatgaatgaagcagggagtgaagtggaagatattgaatctgacacagaagcagtaggagaagaaacaagctcgaatctagcgaagccatttctcagctgctctagaatgttatctgcgatattaatgaatgatagtgttagaaattaaacgagaacaaagcaataagggtgcagagcaatgaagtacttactgttggaagaagatttgagctccattgcaggggacggagataagggaggaattcgaattttgacttgaagaagcaaggaagaagactcagaaatgtagccatgaatgtgtaataagttaaatagttaaataactctacgataacacaaatccgttgtagtctagctggttaggatactcggctctcacccgagagacccgggttcgagtcccggcaacggagtttttttaatagtttttctttttttttgtcggccgtccgattaatccattaaacgacaccgtcacatataacctaaccccaccaaatccaccggaacatatccaaataagtgataggtgttaatctcacacgtaggaggagtcacgtgggcacgtgcgagagagcaaaggtctaaactttatggtttaacgaccaaccggaaagttctggcaattggcaaggaaggattcgaagctggttgtttcccaatctgcataagaaatatcgaaacacttccacacaaaatccacgcgctctctcacgctcactcactcgcataacacttgttccttcttctctcaatttcaaaaaacgacgatctcttcgatgctttctcttccttcctccttcatttccttctgactctgctcttcttcttcgtcttggatcttcgaatttgtctttgtgatttgaggtaaagtttaattctttgagctgggttttgttttgttgttgatgggtttcagagatttgcttgttttatttctgagacacgaaatgggcagtggaacaaatctgaccaatttgtgttcttcttcaattttatttaatctctcgtggattcagtgatcgacgattgcttttgatctaatttgtgttggttttggtttctgtcagtgttatagaataaagatctgtttggagtggatccattcaagtaattgaagaactcaacgcaaaaa

SEQ ID NO: 14066 - DNA, 3000 bp, Unknown
  misc_feature (1)..( 3000): cDNA_ID_2991191_gDNA_ID_2214695_Annot_ID_189516 3000 nt of promoter + ATG
cttggctctattggttcgccctctatgaacactccaatctttcggtacttagccatcctgtgtttcaggagctcctccccactcatttttccgaattcctacaagttcccaaaaaaaagttagaactcttttagatccacatccagcgttgagaagaacaactatgcctacattcatgttttcattgatagcaatctttatttgctgcgacgtccatgaaggatcggcatgggcccctccaagcggttcctgtacaacatgtgagagttactcagtgatccaaagtgagaaaagaagtgtaagaggaaacagatagattagaggtaggatcagttacaggaatgattccatcagctacattaagcttgaccagctccttggaggtaattctaagcttttcagcagcctgcgtacacgagtttcattcaagtgtaatattagagtctacatgatcacttttaatcgagtagtagagcagtgtacatacctcaggagcagccttagaagtcttccacaagatcgctgcacatgcctctggactgtgaaaggcaaaacaacagacgtgataaatcaatctgtaaaaacatcatctcatcatacctactacattgggaaaaagtttacctggcaacatagaaaactgcgttttcgagcatcagcattttattcgcacagccaatggctagggcaccaccagaaccaccttccccaatgacaatagaaagaattggcactttcaggccgaacatcgtcctcagattgttggcaatcgcttcaccctgttatacagataagaaaaaaaatgttatgatgcagataaaccagtagtacatttcaaacataaaagacatttcttctacctgtccaagttcctcggatttaagatctgcataggctccaggagtgtcgataaatgtcacgattggaaaaccgtgatggtctgcataatacatcatccgaagtgctttcctatatctgttgtagacattacagaaatttgataagagagttgttgactctgaatgtttctatttaactacaaacaggaagctcctcgtgaaaacatacccgtgaggagtaggcataccaaagttccgcattatattttctttggtgtttctacctttctggtgacctatgaacatgtaacgttttccatctatggttccaatacccgtcacaattgcagggtcatcataccccgctcggtctccatgaagctccataaactgaaacaagagcagagagtcccaagaatgtaaaaaaacaagaatttatcgtcaatgcatgacaaaaaagccttactactgagagaccaaaccttgtcagttatgttatgtatatgatcaaggaaagtaggtcggttgggatggcgcgcaatgttcacacgttgtatcggagtaagatgcgtgtaaagatctttcagtgcctgacattaaaatggcgggggtcagtaagaagtctttcccaaacaaaattgtagctatacattaacatcaaatttgaatggtgggtctccctcaactatataaattgaaaaccaacctatactagcatttttacctgtctatacttgttctccaaagtgataatctgctcagtgaaatccaaccccgtttcattcgccatcttcctcacctgcatcacaagaaccaatgttatgagaaacttcacaccatacaactgctaggggaaatcaaactaagatgcaaacagatgataagtattcacattcgtacatcaacaatcttcttctccaattcgactagtggcttctcgaaatccaaagtgacaggcttttgagtatcccccaatggtttgaactcggccaggtaagacaagactcctcctttcacattcgggtcaggatttgcaggccatggatgctcaaatttcttccctttcttgagccgagatgtcaccgccaagtccttcctcctgatggtagtaaacactgctcttcctaaggttttcaatggtaccccattaacaccattgctcgaactacgcaagtaatctgaagcagaagcagaagaagctcctcctaaagctagtgatgaatgcgatattgaagccattttttgcgttgagttcttcaattacttgaatggatccactccaaacagatctttattctataacactgacagaaaccaaaaccaacacaaattagatcaaaagcaatcgtcgatcactgaatccacgagagattaaataaaattgaagaagaacacaaattggtcagatttgttccactgcccatttcgtgtctcagaaataaaacaagcaaatctctgaaacccatcaacaacaaaacaaaacccagctcaaagaattaaactttacctcaaatcacaaagacaaattcgaagatccaagacgaagaagaagagcagagtcagaaggaaatgaaggaggaaggaagagaaagcatcgaagagatcgtcgttttttgaaattgagagaagaaggaacaagtgttatgcgagtgagtgagcgtgagagagcgcgtggattttgtgtggaagtgtttcgatatttcttatgcagattgggaaacaaccagcttcgaatccttccttgccaattgccagaactttccggttggtcgttaaaccataaagtttagacctttgctctctcgcacgtgcccacgtgactcctcctacgtgtgagattaacacctatcacttatttggatatgttccggtggatttggtggggttaggttatatgtgacggtgtcgtttaatggattaatcggacggccgacaaaaaaaaagaaaaactattaaaaaaactccgttgccgggactcgaacccgggtctctcgggtgagagccgagtatcctaaccagctagactacaacggatttgtgttatcgtagagttatttaactatttaacttattacacattcatggctacatttctgagtcttcttccttgcttcttcaagtcaaaattcgaattcctcccttatctccgtcccctgcaatg

SEQ ID NO: 14067 - DNA, 3000 bp, Unknown
  misc_feature (1)..( 3000): cDNA_ID_3021523_gDNA_ID_2214695_Annot_ID_189515 3000 nt of promoter + ATG
gagagcgcgtggattttgtgtggaagtgtttcgatatttcttatgcagattgggaaacaaccagcttcgaatccttccttgccaattgccagaactttccggttggtcgttaaaccataaagtttagacctttgctctctcgcacgtgcccacgtgactcctcctacgtgtgagattaacacctatcacttatttggatatgttccggtggatttggtggggttaggttatatgtgacggtgtcgtttaatggattaatcggacggccgacaaaaaaaaagaaaaactattaaaaaaactccgttgccgggactcgaacccgggtctctcgggtgagagccgagtatcctaaccagctagactacaacggatttgtgttatcgtagagttatttaactatttaacttattacacattcatggctacatttctgagtcttcttccttgcttcttcaagtcaaaattcgaattcctcccttatctccgtcccctgcaatggagctcaaatcttcttccaacagtaagtacttcattgctctgcacccttattgctttgttctcgtttaatttctaacactatcattcattaatatcgcagataacattctagagcagctgagaaatggcttcgctagattcgagcttgtttcttctcctactgcttctgtgtcagattcaatatcttccacttcactccctgcttcattcataagcacaacgaagggaaatagttatgtgttcttcgccagaatcaattcctcgatgtgtgttttctcgtttattgaattcaacaatcgagtctctgataaaaccctttacgctaatctgcgaattgattcttatattcatctctaggaatcggtctcctgcagcgaaaaaggttgagaagtatgctgtggatagagttaaaggggatgggagatgtctgtttcgagcattggtaatgtagtttctgttatttttatgtgttcttgttggggtttcctgaataaaagatgtgatttttcaatgtaaattaggtgaaaggaatggcctttaataagggtattactcttaacccccaacgagagagagatgatgcaggtaactatatatttgatcatatagccttgttttgatttttgttgtgtgtttttgaaatctaagagattgaactgtgttaagcttgctgagattggggaatcaaaactggattttgtttcattctgttagcctttttggtggaaaaatgttttgtggtttctctggtctatacatttgaatgtttatctcttgttcatcatgtttttgtgtggcaaaacttgcctttgtttcacagatgagttacgaatggctgtgaaagaggttatatgcaatgaccccaaggaaagggagaagtacaaagaagctttagtggctatcactgtggatgagtctctgaaacggtgagtcataactcataagaattcattcacactcattaccacttttcagctaaatggcattgtttttccttatcacgttaagcatttttcttcagcttttgccagcggattggaagacacgatttctggggaggagagtccgagctgctagtgagtttcctgcatttaaaactgccatcatagagaaatgatctaatgtcagtgttttgcttcaacaggttctctccaagctatgtaaacagcctatcatcgtctacatacctgagcacgaggtaaacgccctttgaatttgagtcttatgtaagcaagactaggtgtttcttttgttctagtaactgtattcagaacttgagttatttggtattgtttatctagcatggaagaggaggagggtatgggccgggttttataccgattcaagagtatggaagtgaatttcgaggaggctggggaaaggggaagacaaacaagaatgttgttaggcttctttacagtggtagaaaccactatgatttgcttcgttgaccaaattttttttttttgcctctgccgttgacatttattgatatggtcagagaaattgaaattttttacccattagtgtatgtgtatcacataaggagtgctttgggagacaaagttactgaaagttctgtcaatgaccttaaactctaagatggatttattaacattgttggacagctatgaaggttttaccttaactttaaggttttggccaaatcaaaaggcaaagttcggtatttatatggttaatccgacaatgtgtaataattgtttgttctcaacacaatgtgtattatcttcttcgaatttttgtttgtttcattatgaaatttgattttttttgaaacatccacacattatttttttgaaaaaaataacccatagtttaaaaaaaaataattatacatgtatcattaaaataattgttccaaattaatgtaaaatccataaaatatggtatttatcaaaaagaataaaaaagtatattttctgaaaaaggtaattaatttgaagaaaataggatcgtggcttgcttgatgtttcgtcttcgctccgatctccaaactccttcgtccggtcgataaattcgtaccttgctcgattctcctctttgaccaaacgtaagttttcttattgatcgatgtttatcaaatattactcctttaacgacgttctcaaaatcgattaaagtaatgagattgatgaactttgattgctccagtttcattgtagagcctttacctagattagtcttcatataaattgtgtagttatagattgggaattgaaaaaattcagcttagtttcgagtttgatcgcagctaacgtaatttctagggtcaaatttgcgatttttagatgattttttaagtgtgattttgtgtccatcagcttaaaagagttctcttttagcaattcattgctactttctagccatggatgatgttttgggggcttattactcctttagatatgtgtttctttgttttcataaccaaatcaatgatcctggctcttttgattattctgcaggtcctgacgaaataagatg

SEQ ID NO: 14068 - DNA, 3000 bp, Unknown
  misc_feature (1)..( 3000): cDNA_ID_2705957_gDNA_ID_2214695_Annot_ID_136800 3000 nt of promoter + ATG
cttgattgttttctatcctctccagtttccacagagaaatcatggggttctggacactaatggaaggattgctactatttgcaaacgcactggctatcttaaacgaagaccgttttctagctcccaaaggatggacgctcgcagaactccaccaaacgggcaaaagaaactctctcaaaggccaaatcattggtctcatccacgcctgtcattacatgaggcttcctctcatgctctttaacttaattgtcattgtctttaagcttttctctggttaaaatgatcaaaccccgtttttgaataaactcaatccaaacatttctgcaacttctttagcaattcattttatagtatttaacttcaaaagctcagatttgtatacattattgttatgcttcttacaactacaaacacagtgaaacaaaataaaaacaagttctttgaaaccaaaagcaggaaactttgaatcaaattcattcaacaggaatcatgacctcattggtcctaaacggtggtaacgtccatggaggattatacctagcaagaacgaaatctccggtgatcttaaacccatctttctcaagatgactactcagcttcttcaccttctcactcaccacactctccgacgctataccactaaacttaatcacaccatacttcctccctccttcctccttaatcacaaccctctcatccgttggacgtggtgcctcctccgccttcttatacatcgacggcaacaaaaactgcatcgtcaccaacttcttccttccttctccaccaccttccttagttacaaccggagaagtcatctcaatcttctcactctccttagtaatcaccggagcagtcatcgcaatcttctcaccttccttagtgatcaccggtgcagtcatagcaattttctccggtttctcattctccggtttgccaaacacacctatgtacttagccaaaagctgaaagcctccgtctttatcacctttgaactccgacgcatcgtatgtaacctccgccgcaaccgctggtggatattcacggatctcataaccgtcaccggatttagtcaccgtgtatttaggagtctctacagcgattttaccaaaaaccattcccattatgtaagttttaccaaaaactattctcataggagaagtagtatttatcagtttggttctttcggttactaaacgcaaacgtgtggttagcatttgacaacgtatgtgtataaaaatatttcaatttatttatagaagaagatatgataaactcaaatcgaatttttggctttttttgtttgaaaaatcagagacgcgtcatggttaattatttgctttatgactaaatttacagaagcagtttgacacgtttctggtttttgtggttcagagcattctttcgttacgtggaggttcaggttacacgacaaagatgagagactattctcggtggtctaaaaaacgactttgttttagacaaaacggtgcgtagttgtttttagaaaacggcaggtagtttgcgtctcaaaggatatatctgttaccaaacagaagagtagggttttgtcttcggcggcttatataaataattttctcgagccattgaatcttagaatctgttcgtcgatttgtctgattaagctagggttttgatagattttcttattcgatcttgttttcttttggtttatgttttgataagagagcatcggtgatgaatccatgaaaaaattgttatccttgcactttgattgctagtgaagaaacaaatggggttttcgatgtctgagatgctcattactttttttgtcttctttgctcgattttgcttcgtgttagactgttaggattggatcgatgattgattagttaaaatactgcgttatctttctgcaaatctcctataaggatttgaagacaaatcatgaaaaacctgagatccaatgtttttcaatcaattatccaatgtttttcaatcagttgttttaaatctggattggttgatggatagaatcagatcgatgatgtcatattaaactgcgttatctatcttaaaatctccgaaataggagttgcagacactaaacagaaaacgctgagatctgatattagcctaatttcaattgatagtgtttatgacaatggcttgttgttttgttcttaatgttagtttttggattcttaattaacgagtagtgtccgaaaaaaaataaaaaaaaataaaaaaaattaacgagtagtgttatactgaacatattcataagagtaatgcattaatatgattggcgtgttcgaaagaagaaaaaaaactgcaacagagctcggctgatgcaaattgtgaacttgtatatgattgaaccaaacctgactcaaattaagccctttagttaggcttttgattgccacaagcacacaaggcacaaaagcgcaagccaaaaaaaacaaaagaaagccttgttgaagaaaacaaaaatcaaaaattttgcaaggaatgatcgaacccatgaactggttttcttactctcagcaccttaaccagtagaactaactgcagtttcagaaactgtagtgtaagaatgatttatcaaaccagacagtacaaagtagttaaacccaaattacataaatttctaccaaagttatcaagataaaaaaaaaccatagtttaaattgaaccgaaattttgactaaagttatccagataaagaaaccaacgaaccagccgaaaccagacggtccaaaatagctaatcgcaaaaatcttaaaatcgaacggttccataacaatatatggttttccaattttgtcccttacaaaaaatttggcatcacccgccacaagaaatctcccgggaaaatcgaaataaaccgttccaattccaaagcttctaaaatctcccgctagtcctttaccttcttcttcttcttcttctaatcaacttctctctccctctcctccgcttcttcacattccgatcattagtgttttcggagaaatg

SEQ ID NO: 14069 - DNA, 3000 bp, Unknown; identical to SEQ ID NO: 14058
  misc_feature (1)..( 3000): cDNA_ID_2705961_gDNA_ID_2214695_Annot_ID_136802 3000 nt of promoter + ATG

SEQ ID NO: 14070 - DNA, 3000 bp, Unknown; identical to SEQ ID NO: 14057
  misc_feature (1)..( 3000): cDNA_ID_2705965_gDNA_ID_2214695_Annot_ID_136803 3000 nt of promoter + ATG

SEQ ID NO: 14071 - DNA, 3000 bp, Unknown; identical to SEQ ID NO: 14056
  misc_feature (1)..( 3000): cDNA_ID_2705969_gDNA_ID_2214695_Annot_ID_136804 3000 nt of promoter + ATG

SEQ ID NO: 14072 - DNA, 3000 bp, Unknown; identical to SEQ ID NO: 14055
  misc_feature (1)..( 3000): cDNA_ID_2705971_gDNA_ID_2214695_Annot_ID_136805 3000 nt of promoter + ATG

SEQ ID NO: 14073 - DNA, 3000 bp, Unknown; identical to SEQ ID NO: 14067
  misc_feature (1)..( 3000): cDNA_ID_2705975_gDNA_ID_2214695_Annot_ID_136806 3000 nt of promoter + ATG

SEQ ID NO: 14074 - DNA, 3000 bp, Unknown; identical to SEQ ID NO: 14065
  misc_feature (1)..( 3000): cDNA_ID_2705979_gDNA_ID_2214695_Annot_ID_136807 3000 nt of promoter + ATG

SEQ ID NO: 14075 - DNA, 3000 bp, Unknown; identical to SEQ ID NO: 14064
  misc_feature (1)..( 3000): cDNA_ID_1807244_gDNA_ID_2214695_Annot_ID_136808 3000 nt of promoter + ATG

SEQ ID NO: 14076 - DNA, 3000 bp, Unknown
  misc_feature (1)..( 3000): cDNA_ID_3021559_gDNA_ID_2214695_Annot_ID_189496 3000 nt of promoter + ATG
gatgttctagtatggctctaaaacattcatccaaactacatcattggtattatgttattgccatggtatattcagatggatgataataattgtcacatatatagcgttattgtgaaataggataccaaaccaacttcatacaagaactacaaattatatacataaataatcaacaaataatatatagactactaaaattcaaaatgcttcagaaaactaagaattttcacataaaataaattctaggaattttccaaacgagaaccattctaaaagatgtgaaacaccgaagctcagcaacctcctccgcctccgcctcctcctcctcctcctccgcctccacctccatccccaccgccaccaccaccaccaccaaaacctccaccacctccatcaccgccaaagccacccccatttgctccatcacctatttccacatcttcacctccgccatcctctcctcctccaccatcacctccttctccgcctcctcctcctcctccgccgtcaccaccacccccacctttgcccccggctccagtcaaggccgcaagaaatatcaaaacaccaacaaaagaagcaatagcaatgataattactatccaagtatccatcttatgcaaaatcgttacgtttagctaccttcgattgtgtatatatagtttgttgccgagggttggctgcagacaaataacgtgtgtcaagcttgtattgacttaagacttttattattcatatgtttctatattcaaacttcaaaggttttcattacgggccggtaaaacttcatctattaattaaaatgtttctatattcaaagttttcattacggccggataatacattccgtatgatgcttgctttctttgataatgccaactatgacaaatcttatactaataaatatagatagctatatctttgtcgttgataaaataaaaaaaaagctatatcaatgtttgtctaagaatatatcgattgactcggtcagttgaagttgaattccaattggtttaaccgttcaatctatgtgacatatttcacacggtcttgaccagaatcaaacatgagaaagaagtgcatgcacatatgatcatatcagttttggataatttagccttgttttgaagactttgataattatgtggaagtatttatagtctggtatatatataattatgaaatgtctacaaatttattggatatatacgccacagtgacatgtttgaaaattcagtatatatgttgtcttcattgtttagaaaatcggacagtgaaatcttttttttttttttttttggtttatgtgaattactttgacgaaagttcaacagattatatgaacagtgaaatatttttggtttaagctgaaattttgcaagtgttatgattcgtatatttatggcttgcatgccaaacacataattcgaggaaccttaatatttaaactaacatcaataatcatttgacaaggacgatcagacaagtcacatttttaactcgacgaggtatccgaataagcccaatcgaattcttttccaacccgaatacccggtgatgtaatatactctaataattatacttttctgttcataaaaattgaatattctagtttttgttgtttgttctacaaaacttgattttctagcgttttcattttatttttattgatatataataataaatcttaaacttgtaatgactgaaaatattaatcattaacttatttttggttaaagtaggtcaagacgcaagtggtttctaatgcaggtggacttccattgatgattctagcattgaatgcagcgttgcgtatccagactagcgtttggctcatgtttgttacttagtatttccttatgttttgcttgcgctttgctttttagttaagtttgcttgtgttagaaaaccaaaatcaaactcttgtgttagcttagattaaatgaaattgtgtattcttgatgatcctaagtactagattgataaaaatattagtctgttattagttagaatttaacttactaaaacgcttgtaaaacgcaagatcacccatcatcgatgatgacaagcgttatcattaccgatgatgtagacactattcagaccatccgccaaatcaatgcagaggtcttcatcctcgggatcactgccggaaatgaccacaagttagcgtgtctagccgccggagcgacacagtgcgtcacaaacttcatagatgtcaaaaagattaaggatatcctcgaaagtctccccgacgtcccggtcccagccccccaccgtttaaatccacatcatcaacctcgatacattcattagtatatatatatatatataaacagaagttaattatatgattattttaacattatgttacattcattatatatacattattaaaataacacaaaaaaaaacgttaaaaatttgtcttaacaaaaattcattacatgctattaattttcatagatagtggatacatacgctatagtgacactgacatcttaaacaaaaatcaaatgtattaatttgtcttaactgtgttaagaaaattggacattgaaatattattcggtttgagttgaaattggcatttgacggatccgtggtttgcatggtgtaccaagcaagaatcgttggttaaaagaaaagaacacacattaattatcatgtttatgcgtaattgatatgtaagttaagtagattatatgcttctcaaaactaggtatttagacaatgagattagttagtcttaattattaaattaatatcccgatcttatcatataagccaaattatacgaagattcttaagaataatcattttaatttcactaacctctctctatctctctcttcattatccgaattaagccaatcgaatccttttcaacccgacgggtcgtgaaattccccaaaagattcctctttctcagctcaatttccaaaagctccgacctttacgatcctctagattctcggcgccggtttctcggagtaaata

SEQ ID NO: 14077 - DNA, 3000 bp, Unknown; identical to SEQ ID NO: 14063
  misc_feature (1)..( 3000): cDNA_ID_2705983_gDNA_ID_2214695_Annot_ID_136809 3000 nt of promoter + ATG

SEQ ID NO: 14078 - DNA, 3000 bp, Unknown
  misc_feature (1)..( 3000): cDNA_ID_2710890_gDNA_ID_2214696_Annot_ID_136813 3000 nt of promoter + ATG
ctccatccacttcaacatctgtatatacacaatattggcaaaaccaaaatctgaaacttccataaaaaggttaaactctcagtttaattaagcgagaatttccaaacctctagagcgagatcgtaacgattagaacaaatgagacgcttggagatcaatcagagctccaataacgagatgtcgtgaccaagttgatccgtttctgaagcagagaggtaacgttgcctcgtggacagttctttctaaattgtagcgcctcggtttcgaaaatatggtaatgcatgtagagaggtttaaaagaatttagtgttttgttaaagctaaatttggatgcttgctaagttaaatttcttattcatttggctttggattcattttggcctattgggaagttgaacacacatattttcatcaattgggtaatatatatatcccttttcaaaattttaaatcacaatatatgcaaaacaaaaaaaattatgattatttttttaatttgagatattatgtgatgtttcaaaacatttaaaaaatgtttaataataggagaattgtaattttaaatcttaagcaaatcttctaaatatttatatttttatatatggtataaccgcttcacaatttataattttgtatatatcttacccgatccaaagaaaaatatggatatccgatgtgagattttgaagtacattcgatattaagtcgggtaccaaatttgttgtatcacaatttaacccatccaatgacaaatgtacttcgaaaatactataattaactataaagattatgtctctctcttatttctctcgaattctttagagagagaaccaccccttgattccgattgaattcctttagagagagaaaggtcccttgattccgtcttgatctgaaagtgaattcgtcctttggcctattttcttctgcttttactccaaaatgcctccttatatccattcttgtcccaatccatagcatacctgaaaagactcaaaaacatatacctaaaacatagctaaaaacagtgaaaatagggttatatcaactcccctaaacttagtttattctttgccttcaagcaaaacacaaaagccgaactcgtggaagaagaacaaaggaactcccaacattctctagtctattgccatgatcattctaactaaatccatttgcctagcaagtctaatcaaatcctaaccaacatgtaattcttcgtaagcttacacaacattctagattccacacctaagttccacaactatatccaccaggctttcattcttgggtctcatcaagcaatctaatattcaagaactttctagactcattcttgtactataccatgataactcgactattctctttctttctttttttaattatttttatcctccaaacttgttcttttcagagataggataaaggagtactcgcttcatcggatagatatcctccgtatatttttcaacatttgcaattgatcattccttagaatgtaagataaaaggatcaaaggaaaaattcctaaccctttacactacaagaaatcatctcaatcacactttttttttatattacataggggaagataacttattctatatcatctcatatattaccaggtataaagaaggagtaaagttctatgaatactaaccgttttgatgaggtaaaaggaagaggaatgagattagctccaaccttaatggattgtgttggaaaccaagatatcctcaagtctctcggtttgccatatggattatccaatagttggattgagtcgaactttcagcaataatcaaccaggcaataatctaaagaaatacatatcataattcctaactagactatacaaaaacgttttttttttctttttgttttcttacctttttgttagaaaaaaagaaaagggaaattagcaaaactaaccaacaaaaactttatatttgaaaaactaacacctcaaactatatgtgatgtaatttatataataattccaaacataacatgtgcgtggtttacacgctctctttcttcttcattctgcttctttcatctcgaacttatattgttgccgctgtgaaaattcaaattgagggtgaattgcagagaatttacaatacccaaaataaagcgtggatacataaaacgagcaacttgggaaagtttcgaagagtgatatagatcgacaccgttagagtggcgatgcaagggtatccggtttttcgatttgggggtttcgcataacggcgacagggctggtgacggtgaagtcgagtaagcaacttccgggtgtgcaatttgtggcggggactatataatcgtcgaatttgagttgcgactagggtttgtgcattttgcatttgggggtttctaattagttagagattaactctgtttgggttgatagaagtgagaacagttggttctatttgtgacggcacctatacgaacatcgaatttcaggaaacattggtggattcgaagtgctccatcgacaaacgtgattgtcttatcaaagtttagaaagtcggaggtatgagttgaaatatttagtctttgtcacaaatcattgatgaactgtattcaataatttcctaattgatttgtgtgtttaattatgtggttttttcgctttagcatttgctgtcatttgttgttaaggtcggattgtagtgttaagttaagcgtgtatgtaatcctgaaactaatggaaagatggctacatattgcatgtgtggtttaaccacctatatggtgagttattgaacatttagtgccagtttagattacatgatttgtatacatctgttttgggtatctcgtaagcgaaaagaagtgataatggtacctttgaatttcagggtatctgttaaatgggggatgatgagttgacaaagcgtttctttcggctttgttctgaacccgaaggtcgaaagaggataaacaattactttacacttaggtggattgagattataaaggctgcactagatg

SEQ ID NO: 14079 - DNA, 3000 bp, Unknown
  misc_feature (1)..( 3000): cDNA_ID_2710886_gDNA_ID_2214696_Annot_ID_136816 3000 nt of promoter + ATG
gatactgagcagagactaatcggtcgcagatccgtcattctatctggatttggcttcttaggcaataagcatatttgagtaaagttccattcaacaggaaaggatcgtgaaacaaataacttcttaacttcctcacaaacctgctgtccaactacattccaataggattaaaaaaataatcccgtcatcccatctgctccaggtgcactgctactcctaatagagaacactgcttgtttaatttcttcgttagtgacctctttagtcaaagcaatattcatggtaggtgtaacccgaggtgccataccatcaagtaaatccgcagcattgcaaggttgtgatgaggtaaagagccgttgaaaataatttactacaatatcacctttagatccatctgcaaattgctccacgctattgtcatcgattaatgaaaaaactttattttgcgctcttcttccttgaacacttccatggaagtacttagtattcttgtcaccatcatgcagccaattttcctgagttttttgcttctaataaccttcttcctctctataagctacaaccaactctcctctccatttatgtaagagaaagtaattaggaaattgtttgctgccttctgtttctaaaaactctctcagcttcttgatctctgtcttagaatttgattgtgaggctcttttccatctggataatgatcttcggcacgctgcgagtctgtcaaataagcttgtgtgctcatccataccgtcactattccatccttgtctaacaatatccacggtttcaggtttagaggtccaccttttgtcaaacataaatcgaccaataaatgattggttttcattgacaaaccgagttatcaacggcctatggtctgaaccaattctctccaagtattcagactgcacacgcgggaaaatatgaaaccattcagcattcccaagagctttatccaatcggatttggatccacatgtcattgcgtttacccgcccacgagaatttattaccagaaaaaggtatgtcacggagacgacaatcttgtaccatgttgcgaaatggaataaaggaagattcttcacgaccaggcccaccaaacttttcagagttatcccatatctcattcaggtcgcctacaacaaaccatggatcattccttgctaaaccaatagttgttaaattgtcccatacatcttgtcttaaatgccaagctggatctccataaacaaatgaagcaaaaaaccataaggacccaagcttaacttttgtatcaatgattctcttgtccgagcggagcacttcaacttcatatgatgctttccaaaacaatgcccttcaggatccacgatatgaacattatcgtagcctaaccattgcttaactttcagtatgtaatcactggagttcttcgtctccatgaggaacagaatatccggaaaatgagtacgtctcatttcctttaaacttatgttagagaaaaattatttgatttttggcttgaaagttataaaactaataatttattctttaattcctgggaaattattttgctgagaaattctattgttatggtaactatatgaatatactgataaatgatacattattagaaaaataattaattataaaagggcattgcaaaaatgttaagagattttttttattataaaactatatttagacaaagtgaatataaaaatagtgtattaaatttgagaggaatgacacatgtgcaatgaatagagcgccatttgttagcttcttagagcatctccaagagatactctatcccctcaaatataaagttttaggttctccaagagatactccattacttcataatttagagtattgaatagtgacactctatatttggagtatcactattcaatactctaaatttgaagtttcaccttttttatttgcatttaagtccctaaaattcaatatttcatatacaaattactatgtttatcattttagtccttaaatttttatatattcaaagtatttcgacaatttttggcttgtaatctacagattataaataaaatgattcatctatgtcttcgtaatgcattgattgatcatatatgagagcattacggaaaaaaatttgttgagtaatttgtaatttataagttaatttatgtatttttaatttttatttatatgtattttatttataaatttattgttttgttaattaagattatgtgtaatattttaatgtatgttttagagttatttataaaagttatatggttttaaaattattatgaacaatataaggactataatgcaaaacacacattttagaaactttatatttgaagtataccgtgggagaagaaactactcatactttatatttgaagtttacatactctatatataaagtatctcttggagatgctcttagaatatcacttcgaggagatcttactttattatatagataaagatacatacttcttgttgcatcatcttttcttaactatttatagatgaccaataaaatttgtaaaactttttcattcggtaagttcggattatttgatattattatcaaaagatttaaatacatacttcttgttggatcataacgaatgccggttttctatttgtagaaataaacctaaatctattttctccctattttaaattgaaaaaaacaacaacataaattatggaaagcaaaagaaaaggcataaaaacagttcaaaacacacacatatgcattgtcaaaacacctcagtttaaggtctgccacaaactacaaaaccgcatgcaagccacttgtgtaaagtgtatatataccacttctttgtcttcacaccacatcacaaaactaaagaaataatcacagttatttttaccttttactcttcttgttctttaagacaattcaaaagagaataaggagagttttaattttctgtctaaagaagccgagcttcgtgaaaattgttgtttctcatcattgtgattcatcatg

SEQ ID NO: 14080 - DNA, 3000 bp, Unknown; identical to SEQ ID NO: 14079
  misc_feature (1)..( 3000): cDNA_ID_2710886_gDNA_ID_2214696_Annot_ID_189539 3000 nt of promoter + ATG

SEQ ID NO: 14081 - DNA, 3000 bp, Unknown
  misc_feature (1)..( 3000): cDNA_ID_3021584_gDNA_ID_2214696_Annot_ID_189543 3000 nt of promoter + ATG
gtgagatattaatttaaacaccacatctacgaccgacacaactttccgaacatcctcctcgtcctcatcagattcaccagctactttcttcatcttcttcttcttcttcctcgtcttcttttgtgcatatcctccaccagattaaacaccctcattgtgatagattttctacttctttgcgggagattcagacttagcggctgctttatcttttacgtttttcttcttcttctcattcctcttcacatccctatagcctttaacattccccatgtatgtcttcaatcaagtgatcaagtgatgggtcttctacttcatctagccacatatgaaatagctcgcttacatcatccgtcataaccattttacgcacacgcatatataacataagagattataaaacccatcagtatgtttacagtcagtcatcaataagtataacgcagacattgctcaactatgattccaccatcactaaaccacaaccaagtcattactaaagtataactcaaccatcaataaacaataacacatccatcacaaaacataactcagccatcacaaaacataactcagtaagtaactatcataacagagccaaaaccttacctcaccaccatgcgctgtaatatcttcagcaatggtcgattccattgttgcacgggtacggttgacaccccatctaagtaatagaatctcatcctctttgattacgttcccatatcgctctccaatggtgttgattgacttatacgcccgagcctgtaacacgaaagcaacaccactgatggtgtacgacttgccaataggcctcttcaactttatagaatcaacaagggcttcaaatgctaaccgactccataaataagtcttcatggcttcgtcatcaaaaattcttttggcactctcaaatagtatcctagagttatgatgcaagccaaaaagtccattggctagacgagtcaataaccccaaccatctacgcttttcaggaggccatgctctccacactactaagcctcgcctaagtatctaacttaggaccttcaccacaatgcacattcaattccctgaagaacgttttgtagtccacttcaggttcaaactactctataggcagtggatctgtgtttaaccccgtgatatgaccaaattaattcaagtcaaacctgataggttaaccagccacgagacaccaaatctccttcttcagtattcttaactgtctacagagtagtgaatgtacagtattatcagaccaaacaaaatgactatcaactagcttagcaattactttaagaggtgtctttttcatttgattccatgcatcttctctaattgattctctaatcagagggacatctcccatctcgatgttgtgattaatggctttattctctagattagattccccttctggataaagtcttggagggtaatcccttgcttggtcttcagacatctgataaaccataaatcagccataagcatacattaattcagtcacaacataaaacaaactcaaccacagatgcattaaaaatataactcaaccaaaacataaaaaaaaaactcagcaacaacatcacagaaactcaatcacagatgaaaggttaagccataactcagccaaacataaaataaactcagccacaatatcacagaaactcagccacagatgtaaggttaaaccataactcaatcgtaacataaaacaaactttgccacatacgcattggtaaaccataactcaaacacaccatataacaaattcagacacagatgcattgataaacataaatcagtcgtgaaacaaacagtaactcggccatcaaatcgaatagatctaacaaatcagccatcgtatgtaaatcagtgacggcgaaaatcaaccgtaataattgtcgataaaaaccctcaatatcacagttttcgtaaaacggtttcagtcacgggaatcacttgctgttgaacttagatgtcgaaaaaatctaattaaagttagtttagacacttaccggaacaagttcaaatgcgacttgatagggatgtgactttactcgacttaaaattcgacactatcgaaggattttggccgaaagagatgagataaatagaaaacattgacaaaattagggttccaattaaggaatcaagtcgacggaacaagagaagagagagccagagaatagttctttttttttttttttttttttttgcacgcggattaaccgtgtagagggaaaaaggaaaactaaaaggtttaacgaaattttcgggtaatgacgtggattaggataatgacgtggataatgattgtttttaaattaaaaaaaaaatattatttagataaactaatcaaaggtgttaattgtaattatacaaatgctcaaaacatatgagtaattttttaaaactctatgatattctagtaataaacatacttttctatgatatctgagtaattaattcacccatttttaatataaaaataccaaaaaattagttttagattataattcataaaacctaataagtttttagtttaaaactaatatatcatagtcacaactcatgactaatatgaactactgaggaacaatgggagattagatcgcatagagttcaattcccgttctcaacccatgaccaatatgaactcaaagtttccttcaaaaccctcgttgctccgttcgatgcctaatttaatagggaacctcaaagcggctctatttcattctattccatacatatcccaattccattcatttaatatcattttggtgtcattgacataagagatgtaatttctagtctatctctttatatttatatatatgaaaagttgcaaaatcatcatataataatctagaaattgaaatagaaaagaaaaaagagaggtttgtgatggaatttcaatcttttatagtaggtaatctagtatccttatgcatgaagataataaatttggtcgttgtggtcggactctattgtggattt

SEQ ID NO: 14082 - DNA, 3000 bp, Unknown
  misc_feature (1)..( 3000): cDNA_ID_3021580_gDNA_ID_2214696_Annot_ID_189544 3000 nt of promoter + ATG
tgtcgcttctagcggaattgcttttttgttgttacaaggtgggagaactgctcattctaggtttggtatacctattaatcctgatgatttcacaacctgtcatatagtacctaattcagaccttgctaatatgctaaaggaagcatctctcatcatatgggatgaagctcctatgatgagtcgttactgttttgaatcattggatagaagtctaaatgatgttattggaaatgttgatggaaagccatttggtgggaaggttgttgttttcggaggggatttcagacaagtacttcatgtgatacatggtgctggtagggcagagatcgttttagctgctttaaattcatcttatctttgggaacattgcaatgtcctcactttgacaaagaatatgagtcttatgtctaatgatttggataaagataagggagagaaaatataagaattctctaactggctccttgccgttggtgatggaagagtttcagagccaaaatgatggtgaagttctcatcgatattcctgaagagttacttattaaagatgccaatgatcctattgaagctattaccaaagcattttggatacctcgatttgtcgcagcctaataatgatcctaaatttttccaagagagagctatattgtcatcatgctcgagaaacttaatggtaagctaagtttaaaattgccgtggactaagactattttgttgtaagaattctaacaattgttttcaaacacgtgaatcaattacttatttaagtgcggatagtattgatcctcaagatccagcgtcattgaacaatcccgtcttcacaccttatttcctcaatagtataaagctttctggtttgtcaaatcacaatctcactctgaagattggtacaccggttatgttactaaagaatattgatccaaaaggtgggctatgtaatggtactagattgcaggtaacgcagatgggtaatcatatactagaagctagagttattactggagatagagtcagagacaaagtgataatcataaaagcacagatatcaccttcagatacaaaattgcctttccggatgaggagaaggcagtttccaatagctgtggcttttgctatgagaataaagaaaagccaaggacaatcactcaaagaagttgaaatttatcttcctaggccagtattttctcatggccagctatatgttgccttatcaagagtcacttccaaaaaaggattgaaagtgctcattgtggataaagaaggaaacacgcagagtcaaacaatgaatgttgttttcaaagagatctttcagaacctaaggggttaggaattcgtttcattgctttggttattcatatgatgttttgtattgttgtttcaaacaacaatgtttttatttctagacaatcgtaaaacagatttcatttctagacagcataaatcatctatttccattaacgctaaaaacaagaaagctttattcaattataccttcagtcaaccaaatctaccaacgaaaaacatggtgtataaacttgattgaaagctgatgtgtaactaaccttatatatatgagtattgatttggttgtcgacgatttgtacacttaaacgccactgagatgtatgaacacctatgaacaacaaatctcaggtacctatgatataatatataaaccaattcatcatgtcaattgccttataccattcctatatggaatcattaaaaagagttgcaaataagacatgactttataagattgtttgtattaatgacagctgctaaattaaaaatatgtgaatcaattcattggtttagctctctcctataagggtagaaacaaataagaaacatgcatgttcccgagtcaattgaaatgtgtttgttcgcatttaaaggtgccgtatcacagcttatttctgcacataaatcgtgaaaaacaattaactagcaatgttataagacaattaactggctaaagtctatctctttcttagctactctaaacgagataaagcagtacaaagaggaaaccaaactacgagctttgcaacatataaatttcgaaattagtgctaagggtaataaccaactcaatcaaactaaaatctaagaagtcatgtgtattgtcaatcttgatgaacggattggaaaactcataaactattacaataccaaaaccataaccaaatatatattttccagaagattgaaaaatacctgaactttgatactataagagaaatttcggatggttttgtagtaatcagcaaaatacgagtaacctcagcactaattttaatcaaaaaatgaataaagtcaagctctttcatatattcacataactatttggttagactaatgagacaaaaccaaactaggagctttgcaagtataaatttcttagttttagtaaagggtattcaccgattcaatcaaactaatatctagaataccgtcaagatttttgtcaattgaagtaactgattggaaaacacataaaccattgccataccaaaaccataacctaagaaatttgtgaagaagattcaaaattacctgaactttgataatgttagagaaagtgtcgattgttttgtagtaatcagcaatcaattcaaccagagatgtctgtattctctcaaatgctctgattctatcggcttcaacattgtcatgcacccattgtagctcaagagatttttgtaaaaaaatcattggaagttgaacagagatttgtaatgtgggcaatcgctggtgacttacatttttggaagacacgaatgctggtatacgccaaaccaattgcaaaaatcggtggtggaagatcaatctgacgataatggattgaatgatttagctaaagtgagcattgctcttccgtcgtcagctacggatgtggtgaagaaggtggtgtttgtgaggaggaagagaaggaggagaggcgttggagcctccattgattagagaacacgacagtcacgtagagaggaggaggatg

SEQ ID NO: 14083 - DNA, 3000 bp, Unknown
  misc_feature (1)..( 3000): cDNA_ID_3021594_gDNA_ID_2214696_Annot_ID_189540 3000 nt of promoter + ATG
cagctcttgcctcttttgggtcacccaacatgttaacaatggaagtatcaatcgcatcttggttctctactcttgaagccctagctgaaagtagtatcacatagtccttgtctacgtctttggagaatacctaaagaacaaagaaatccacaagacatgaagcttctaacgtaaccaatttaaaaacaaattatgatgatgaagagatttgtcttgaaacctcaatcaagttcttgtcaactgtaagtttgttgagagttagagttccagttttatcgctgcaaagaacatccataccagccatttcttcgatggcggtcattcgttttgtgatggcaccttgttgagacaacctatgtgatccaatagccattgtgacagacaacacagtgggcatagcgattgggattcctccaatgagaaggacaagaagattgtcgattccatctctatactttcgatgttggatcggatacattataattatctcaatcaacattcctattccgattgaacagatacagaagttaccaatggcggttaagacctgcaacatttatcaagaccatattagagttatatcataagattgcttgcatcgcaaggaaatataattcagaggtcagtcatatataccttttggaaatggccaacattgttagtactatcaacaagatgagctgccttgccaaagaaggtatgcactccggttgcaatgacaacagcctcgatctcaccttgtttacaagtggagccagaaaaaacctcgtctccctggtgtttagtagctgggagagattcaccggtaagagcagattggtcgatcttcagaggatcaccttctaggagacgagcatccgcgggaacaatgtcacctaacttgatgctgattaagtcacctggaactagaatcgcagcttcttgctctccccatctcccatcccttaatacctttgtttttggtgcaagattggccatgagagctgcagctgcattaccggcattgttctcctcgatgaaactgattgtcgagttaatgatgagcaaacatgtgattccaacaaagtcttgccaatccggtggcctcccaccgccatttgccaacacaatggccatgattgcggcagcttccatcacccatgaaagagggttccacataaaccctaagaactttagaaatttgttctctaccttctcttctagtttgtttgccccaaatatttgtagtctgtttcttccttcctctgaagacaaaccttcccgggaacatttcagctgttggaacacttcgtccaccggaattttctcctgtaatacatacattcatggtttcgtacgttttatcaacaattcatgttaaaactattataaggtaaaatgtgtgttttagcaacaacaaattacttacaagatcaacattctccttctttatttcatcccatgagatatcagcagccatgatgaatcacaatgatgagaaacaacaattttcacgaagctcggcttctttagacagaaaattaaaactctccttattctcttttgaattgtcttaaagaacaagaagagtaaaaggtaaaaataactgtgattatttctttagttttgtgatgtggtgtgaagacaaagaagtggtatatatacactttacacaagtggcttgcatgcggttttgtagtttgtggcagaccttaaactgaggtgttttgacaatgcatatgtgtgtgttttgaactgtttttatgccttttcttttgctttccataatttatgttgttgtttttttcaatttaaaatagggagaaaatagatttaggtttatttctacaaatagaaaaccggcattcgttatgatccaacaagaagtatgtatttaaatcttttgataataatatcaaataatccgaacttaccgaatgaaaaagttttacaaattttattggtcatctataaatagttaagaaaagatgatgcaacaagaagtatgtatctttatctatataataaagtaagatctcctcgaagtgatattctaagagcatctccaagagatactttatatatagagtatgtaaacttcaaatataaagtatgagtagtttcttctcccacggtatacttcaaatataaagtttctaaaatgtgtgttttgcattatagtccttatattgttcataataattttaaaaccatataacttttataaataactctaaaacatacattaaaatattacacataatcttaattaacaaaacaataaatttataaataaaatacatataaataaaaattaaaaatacataaattaacttataaattacaaattactcaacaaatttttttccgtaatgctctcatatatgatcaatcaatgcattacgaagacatagatgaatcattttatttataatctgtagattacaagccaaaaattgtcgaaatactttgaatatataaaaatttaaggactaaaatgataaacatagtaatttgtatatgaaatattgaattttagggacttaaatgcaaataaaaaaggtgaaacttcaaatttagagtattgaatagtgatactccaaatatagagtgtcactattcaatactctaaattatgaagtaatggagtatctcttggagaacctaaaactttatatttgaggggatagagtatctcttggagatgctctaagaagctaacaaatggcgctctattcattgcacatgtgtcattcctctcaaatttaatacactatttttatattcactttgtctaaatatagttttataataaaaaaaatctcttaacatttttgcaatgcccttttataattaattatttttctaataatgtatcatttatcagtatattcatatagttaccataacaatagaatttctcagcaaaataatttcccaggaattaaagaataaattattagttttataactttcaagccaaaaatcaaataatttttctctaacataagtttaaaggaa

SEQ ID NO: 14084 - DNA, 3000 bp, Unknown; identical to SEQ ID NO: 14078
  misc_feature (1)..( 3000): cDNA_ID_3021617_gDNA_ID_2214696_Annot_ID_189532 3000 nt of promoter + ATG

SEQ ID NO: 14085 - DNA, 3000 bp, Unknown
  misc_feature (1)..( 3000): cDNA_ID_2706002_gDNA_ID_2214696_Annot_ID_136817 3000 nt of promoter + ATG
cttgactcaatcaagattgtgaagataaaacaggagatggttgaaaagaataatgaagctaaagtcgttggtgagaagctcaatttctgaatgggaagcagaagagggagtacgcagatgaagttaatggagttaatgtgaagccgatggagtaaacataaaagtagtattcatgttgcatttgcttctgctttgttgttttagttttaataagtggtttttctttactgtttccacatttgtttctgttttttaaatgataattggttttccatttggtttttaatcttcttagttcctcaaaatcattgaatactaaactcttatcacctttcattatctaaacaaatgaagatgtgtcgttctgttctaaaacaacaatctctctcagaagaggaatcaattgtctctgttgcaattttagtaattggcagcatgaccctttgagttaacaaagtttgatgttattggcaaagtttatagaaaatgcgttataaatctaaatttgcatacggtatagagttgttgttaatagctctagattctctacagcaactaataaagattggatgaagatgaggaactaacctttataatcgttcctcagtcgtcagattgcaatcttgattagattgtagactaagcattaacctgaaattaaaaaaacaacaacatcattattagatgcagagaatataatagatacttaacaataatattctgatttggcaatcaatataacaataatatataattgcaatcatattaattagatatcttaacaaaagattatataatcttcaagtcatcgctaagttttattttaaactctattagttagaaaattatagttctatcgttatacaaacaatagcttaatgaagttaagaagtgccttggttgataaaggtgaaaaccacaccactccatttgctaagaggaagtgttcatcgagcaaaaacagtttctatagtcaccacaaagctaaatcatctggaaatgggtttgttattccactgaaatcaatatttgctcggttaattacggacataacaaaatccaagcctatggttttagaagagtctctttgtcctacatgaaaaattccagcacaatcttatacatgtatatcattatattctacagtatgctaattgatttatccatgtagttaagacttcactactttgttatatgtacaaaatggcttatatgttttttttccaaatgttcagttgatgagaacacctatctaacacctgtttgtgttagacaatcattgtcttcgcaagaacaatactctttatgcccgcggtccatatcaaacataacaaaatctacttctgtggttttagaagggtctctttctcctttagctaaaaatctatcagtgactgatataggtaaatcattctctctcgaagaggctaaaatatagttctatataatattgactttcgatattttcatcaatgttgtttgtggcttctcttaattttttcaggctcaattgatgagaactcatatctaacacctgtttgtgttagacaatcattgtcttctcaagaaccatattctttatgctctgtgccaattacgccatctaatgtctctcaatgccaggaatatataaattcttctggtatgttgatcgacatactatttttacaatgttttattggttaaaacataacttatgctcaaaacgatccttataaatgtatgtagaacctcttgaatgtttaacaactgatggatcaatattatctgatataccaattaaacagtcaacttcaatacttggcagcaacgattttctaacttcaatcagatcagaaacaatcaaatgtgagcattatttgtctacacccaatttttgtatatgagttttgtttagatactattgtttttcattctaacataattacttatattctgttttcagcatacagtgcaacagaaaatcatccaaatataaagactgtcagaataagccaatcttattctgaacttggttcacaaaccttcttatccgacataagaagagaatctactaaacgtgagtttctgtttgctatagtttctgactttgagcttttattcatcttaattctaatatgtaattacactctaaatctatgttctttttttgttagattccattaatcaggtttctaaacttgatacactgaaattgaattcaaatactaatagaactaagaaaagggttctaggagacatatcaaaccaacctgatagaagacgacgaggtgagccacttaaaagcagaattcagtattctacacaaaacaaagaaaatgtcacaccaaaccgtgagtatacaattatccaccatcacgaaaataataatgattgtattctatcaatattcatatgattgcagacctaagttattcattttcctgaacgttcaacagtcaaaaattcacaacagccggataaacaaagaaaaactaaaaagactaaagatttggatgactgtcgtgtaaatctgtttgagtcaatccctttagatggtaataatcgtgatttatagatttgttctttgaaatatgaattcgattttgactaataacatattgttgtcaaacagaagaagatatttctgatctcgaacaggaatatgatgttagtagtcaagaagatttggcttctgatagcagttctggatatgaaactgaaacctctgttgaaacacatgaaacaatgcatccacagaatcaaagggcaccgtgtattaaaggtagaaaagatataagtcctaagcgaagtagatatactagaggagcacctatccacaggaaaaggaaaacaggtttgtatgatcgtttaattatttttagttttagaacgaacatatgaataacatttttaaaatcgaatttgatttgtttttttttttttgcagatcctctcattgacattccttatttagatcacggtgatccaaaatggaaatgtcaatactgtggtgctatg

SEQ ID NO: 14086 - DNA, 3000 bp, Unknown
  misc_feature (1)..( 3000): cDNA_ID_3021692_gDNA_ID_2214697_Annot_ID_189549 3000 nt of promoter + ATG
gaatgagctcggctgcttctcctccacactgatttttctccgtgcctgctccgcatgcgcttcgcgcgccattggcgctttgctctcctcttattcttcattggacggttcggttcggatggacttcgccgttctttcccaactaaaaaagaaaaggctgtatcacatcgagatgtcgattcgttttccgcccccaatgagatggggaatttgtaaccccctatttctactttggggcccttcatctttctgaatctaggcccgtcccggctcgtgtcgttccaacaaccggcggggagcatctcagtatacgatcgcgcgcagtaactgggagtcctattacacctaaggcgaacttcaattcaccaaaccaaggttcatctcgtgtagtgattgtggactctactaaggatattgagtagacggttgatgtatcagactcgaccctatctttcgtagcatgcattcccatcggtgtcgcaactgattcggtaagctacgtgtccggtgcacggagaactgccttcggtcctccaaacttacttattcgtggcaaccttccggccgcccaacgacctataacgctagtcactactcccactggggctagaaagtaagccccacaacccaaagcggcgaagaacaaatagaatttgctacaaaagccggctaacgggggtattcctgcgtatgagaacatagtaatggagaaggtaatagccgaaataggattcgttttggctagagcgcccaaatccgctatatatttgacacgggtttgccgtaatgctgaaactatggcgaatgcatccatcgtcattaatgcataaataaagataccaattagtagtgattgaattccttctatggttccacatgagaaaccagtacgaatataacctacatgtccaattgaactatgagctagaggtcttttgactttcgtttgggccatggcggccagtgctcctaagatcatagaagcaatgctgcagaaaaagaagatttgttgcaatgtagctccataggaaccataaatagaaacacgtaaaatattagcagaaatagagattttaggcgcaatagaaaggaatgctgtaaccggggtgggtgaaccctcatagatatctggtgcccacatatatagagtcaaagggaatatggagtccgagggggagggggttttcttcggggctcgagagattgaatagacccacaagtttgaaattcgccactggggaattcacacgaaagggaacgaggaattctcaacgaaaaaagtgctctctgaaccgaacgtgaaagtttttttccatcagacggctgttcctgtaactccactctcgacttggattatatatccaaaaaggtccgctctcggccattccacacgctgcctagccgaggtgtggtttctgaagtggattctctcttttctagtagatgccgaacctgctgccccattgactaagaagaggggcgggcgcagcagctacatggaccccttcctttctgttgttgccagcgctttcccgggccgagccggaatttttgattattattctaatgggcaggcaaaggccgcaggctgctatcccaataggccagcgggcggaacgaggagaggctccggcaatcatagcaccgcggtcgaaaaagcgtgctcccttcagataacacgcaccgtaggctatcctcggccttcttcgttttcgatgcaaaagaaaggaaatctctcgatctccgaaagccttttccttaccccgccgcatctccctcccttcgtcgagcctttccggggttgttccttccttatcaaaacttggcgggcattctttccagccgggggatgggttttgtttgaacataggctcaaacataattttaaggtcctagctacgccatgcgttcaataccaaatctggaaagctgcagaaatgacaaaaagagggcgctttcctatgttgcactgaaaaaagaaggacctaagagcgtcttctcttaggttttttcctcccgcgcccgccgccgcctggcccccgttagaggggaaggggaagattagcaaagcgaaaaaagacagagggagggggagcagcatcttattctcttcgcgagaacttccggattgaagaagcattcggaacgggctccgcgttcatttcattggcgggaaacgatccaatccattcggggcttcggccaaaaacgaattcgacttgattcatagatagaatcaatgataaataaacaaaagatagatgaacgagatatcttttctttctataaaaaaagaggaatagaatagacatccctttctttagatgtctatctatccttccgattttatatcgttatatctgctctctcaatttttttttagagagagcagatagatcctatcccctatatcgaacactaattcctatctattgataggaagatcttcgtctaatagcggactttgcctttttttaggaatttctcatatccaaggcagcttaccacaagaaccccaccccatacaactagttgggggggctgttcgccttttgaatcaaacaaagtaagttgtaggtaggggcttcatagctactttcattctaaaggaaagcgaagaaccaatctttagtcaataggagccctacttccctcgacctcatcacttcaattgttgcgcaaacctctttcttagtcaccgggcggagcgcacctttgtcacagtagggcgagctgtttgatagtgacttcttgcgtttggtagggcgacgaaagggctacttccttcaatctaggaaacagccggaaactcgagaaggtcgcctttggaagcgttcgccagtaaccaaagcctcactccttccttttgattatgtcgtgacgctgactgaatccaatctataaaaaaacccggaaactcaacaaagtgcgttccctttcgtcaagtaggtaaagtaggcatacgaaccacttttgctttgcggaataaaacaatgaatg

SEQ ID NO: 14087 - DNA, 3000 bp, Unknown
  misc_feature (1)..( 3000): cDNA_ID_3021672_gDNA_ID_2214697_Annot_ID_189562 3000 nt of promoter + ATG
tatgttagtatctagattgagtatcataccattttccaaagaaagatagtatgctaaaatattatgctaatatggtcatttggtatgctcttatagggatagagcactatgtaagaggtctcgacgagcctccaccatactaagctaaggtctactagctatagtagctagatgggaatgtagcctagcagctagtagctctcttcttatagctcggtagttggatctttcataattcctttatggttagagcacactgggatagaagaatagatgagtttgtatctttcttcctactttttttttatcggaaaacagagctagaacaaggaacaagcaacactagcacttaaaataaggtaggcggctaaaacaattgggcatttccttgatgtccggaaatggtatatctgaaaacagaagaaagactttcttttgaaccaaaactaaagatgatccgatccgtgcaccgcttttcttctctaccctttagaatccaaggaaaaggcaaagagaaagaggttgcagagggcacctaaccttccaaagacacagcagctctagcctaacttcggattcgaaaccatacttccctgacttcctctcaacaagaagttaaggctgaaagtcctaatcttcttatcccgatgcctggagtagcgggtcttagttcggattagtaccttttgagcaaggtaagttaagtttcggcagtgaaagaaagtaaccaggatccgcttaaccagttatggatgaaggtaggtctactccaatccctcagccaataaacaataaagtaggcacatttccctcggcaaagaaagtagtccctcgctaaagagtagacttgagtatcttcgaagtcaaagccgaggaataagactcagttcgggtagagcaaccatttatattttcattattcttacccgtttacataaatgaaaaataaaagtgaattaccacggaaaatatccacctaaaaaaatttctggggttacttggcatagtcctctaaagaccctatttagatactctttcttccgagttcgagataaggaggaagaatggggcgacagataaaattaaataaagagcaaaaatgcttgactttcattttattaaatataatggtaggtagggcttcttttaggtcataaagggaatagtacttttagctcgttcatctaattctgctggtctataggagtggctcccagggctatgtgatagcacccaaaatacgacggcctgatcaagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgcctcctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagag

SEQ ID NO: 14088 - DNA, 3000 bp, Unknown
  misc_feature (1)..( 3000): cDNA_ID_3021657_gDNA_ID_2214697_Annot_ID_189568 3000 nt of promoter + ATG
ttataaaaaaaatataatccggagaaaaaccttcaaatagaatccgaatagaaagaagcattaggggtgagaatgacgccaagtgccccgagtagctatggtatccatagttaactttctttcctgcatatgtagggtaagtactttgtgctttcttcgtctagctcacacaaggtgcagagtggcgtgttgactcgagttctttgaacaagctctccccacatcaattgtgaattgacgatgcaatgctactattctgcagaagaccgaaagtgccaagaagaaaaattagtgaaagagttttctcgctagacgattctgtagaaaatagagatcatagatctggtgcgtcttagcatgtaacggactttccccaatcgagaagaagaatttaatacaatcgaagcactcattgctgacgtttaccgctttctaggcccaacgcataaactttactagagtccgagaagatcaagaaaaatgcatccggtggtggtgatcagagctgaatctcattctttttctttctagaagcatacgtcaagtgtactgactcaatcaacctatcggcctacaaaggctctccattctatacccctagccctacattaccactcttaccattatcttaaagataagataaggaccaatggcaagcatattcaagtcagtcggtcataaaagtatttaacaaagacaattgtaaggtctgcaagcctccctattacttcaaactgaaacagaatcaagggagatatgaaagaaatgaaaagaagatgtcagtccctctcacttgaacaagattactaataagaaagagaagagaaggaccaacggccagtaagttcatcctatccaccactttaaaatgaacacgggaaagggaataagaaagaataaactgctgacgcagctgaaatgcactaaaaaggagaatgtactctcgctttttcgttccgaggaatgagagaaggtatccaagtagttagcgagacttcaagaccagcagccgataagaaggtcagagtcacaatcgctttctcaattgacactgcgccagaatctaccaccccattcattgactatctcacctcacctcccatgggtctgggcgcttagcagcccctactttcacatttcttcctatgaaactacttggtctacttccatttagactgagagatggcgtctctttcgacggattgatccggacttccccacttcaacactcgcaggaaagaaagaaaagaccagaatcctactgaagctgctaacagagactgagcagatatagacctatgagatttgtacacttcggcttggcaccttcttttggttcgtgctcgcacgggccgtttctctgccaatctcgaattagaatctttgcttacccgtgggccttccaggatcactttttgagctcgcaacgttgagtttgattcctcccacccagtggatccttactaatccataatatgaagttaggttagctacttccctcagtggggataaggacagaatagaaaacccgaatgaaatgggatttttcctattatctaaaatagggctttgaaccagcctgagagaccatttttctttaaagaaagtcccgttttaatgatttacagaaatttcagttttttttgttcaattcttcaaaaaaaatacttcctgccaaagcgagcaagtcgcctatttcagggaagctaaaagcatgtcgtcccgcctatagtcgtagccagttcccttgcaggccttgattagcaaggaatagagagagcattgaaagtacgtaactctcgaacttgtttctcgagaggttgtgaacacaaactcgactgataaaggagaggtccggaggtattaactagttgatgaggtctcgacgagcgactaaaaggagaggtactgacgtgactcgagtgaaactatattgaggagagggaaggggacttatgtaactatattccgaatccttctccccgtcaaaatctgcctcccttgcccataaggagagagtctccctagtgaggaatcctttagaactgatgacgtcctagctgtgagctgacccaagagctacactgattaggaagcagattccgcacagaagaccaagcaaatctcctcttctagtcttacccccaggctgtggtgctacgagatggcaatttatcgtatagaagaatagatccgtgggcctattgattgaccatagatcatagaaccgatcgactgctatctaagagaagataagtagttcttctatcgttcaagggcaagggggagaacatgtagcggcttgcctagatctcgtatttcccacgtagtccgtaggtcaaaccaaggattctcttcacagtcttaaaggatgtatctctcctttgcgctgacttatgctctgcgagctaggagcgcatcataggggcagggcgaaaacgaacataggatcatcatcatggcccttttcttctttcttttgctgctgatctcacatcgagagcagctccttcttgttcagggtcatcagatgagagatcttcttccgactccgagaaatcggtcaaacgggaggctaccctctccttttagtcgagtaatcaatccctcgactcatctctctatccataaaaaagcccttcccagaggagagcggaagctccaggatgagtatgccctggattcccggattcattctcgtcctgatccactctggaattttcggaatctacaaaaacattctaggaaagggctcgtaatgatcttctcaaagatcacaaggtgctgaagtggcaggataggagggggatccgtaggtttttgtgaaagggatgctcttacttatcatgtctgaaaagaaaaaccgaattcctcgatttcattcgattcatccacatttccatttcttgtagaggaaggctaactgtgcttgctggctgggagctgtatgagcggtaacgtccacgtacggttccgtgagaagggcggtggacagaaatg

SEQ ID NO: 14089 - DNA, 3000 bp, Unknown
  misc_feature (1)..( 3000): cDNA_ID_3021669_gDNA_ID_2214697_Annot_ID_189563 3000 nt of promoter + ATG
agataagaaaaggcgaagcgttctcttggtttcccaacctgttgcttctagaggctgccctctctcggctggatgttggtccagcctactacgaggatcccgtatccaacaacccaacctataaaaaggacataaaaaccccttgtataggttggagctaagaagctttccttattatcagagaaaggggaaagggcttttttcagctggtgcgcaggagcgcacttccgttttccctttactagtagggtgggggtcccgtggttcctatgccgccgcgtttcccggtgcttttcttttagtgcttcgacccgaagcgatagcttctagctagttcagtggataagatggctgcgctccagctcactcaagaatgggacgacagtggtccgccggcaagctcgttctgatcttggacgcagtacattggaatcctgaagcaccaccacgaacgctaccgcgcgttcgcctgcagtgcggtaaggcaccaccctgttgtgccagcagccaactccggcgtgtcagcttagttatcctcatcaagccacttacttgatgtctagcttcccaactggtagacggttccttttcccccagatcaatgaagaaggtagaagtaagttgattcttccgaagaaccggaagcgaagcgctatgccggggtgggggggacgggaaaagaaacggctccgaagaaataaattggggttcccaatgcttctctacgcccaatgagatgcgccaaccccgggatgctttactcctaacccacaaggttccgagacggagcttaacctgagtcttggttaagaacggcgatgatctacgtttcacacgacgcacgattccatggatagtttcattcgacatcgtgatggaggacatagcttacgatcatcggctttgatcatgccgctaggcatttgattaagacattgcacaatgatccgaagactttgtcgcatctcttcgatacggatacagtaacgatcatagcgatctcctctggtacctactggtacgtcaagatccgattggtcatgaacatcgtaaggtgctgctcttcgcgaatcccagcatacccctggttgggatgggtaggcccaccacttcactttaacttaggcccgggccgagtcagtgggggaccctgtcgggctcctgccccccccaaaaaaaacaaactgtacgtgagagtttcccttcatacggctcgaatcattctcagatgcctccccgggcatcctttccttctttgttgagttggttcacgcgcgcgcaaacgagcaccagccgcaacagcaggaaactatgaccaatagagtcagacacttagctacatccgcacgcaaaaggaatgtggttctggttgagactttctttccggggcgcgggacgttcgcggagtccgttccttccgtaccaccacaagactggttgttcttgggcttaacagccccctaatcataagggataggggaaaggtagccaggcctatcatatcaaaagggttgtagaaagagaacccggccccctatttcattcgacgttccggggcaggaaaaaaaccattcgaccaactttagttttgggtaacaagaaagaaggcgagttgatctgctttgatcaaggaaaaagcccagtcagccaccaactcggtgcaggtcacgtgacctacagctcggccttcgctttttgaggcttcctctacccgcatctctaagtgctcgcagcacttccatatggagaaagataggcttaccatgttccatcaatagcacctaatctatgccggttttggcggaccgtgctccaccccggtgaactcacgcggttccgacgtgcccagaggccagaggcgaaatccgttcacggtccgtaggaccaacaccattcaaaggtgggtggctccccccgcttagaacagtcatctttgactgggcttacacacattcgctcacttacgctgtccccccccagctcaccctagccccgggccttttgctcttctaacgtaagctccaaggcttcacaccaagtcttcacttacataatatgcatgcttaagtagagtcaggcggaaccattgttgcctgatgggaacttcccccatattgctatcaatgtcttcatgtcgcacgacctcttaacattacaccactgaatccccaatcctttgcttgctgtgcagtgacagtaccaatatccactaatcgttgtttccagatacggttgccggttgacatctcttctaattcatcgatacgagaagcaaattgttgtgtgaaggaatcaatatctcgacataagccaagaggcagatcttgtgccactccacctggtcgtatgaaactggcatgcatcctggctcccgagactctttcatagaattccaacaatttctcccgctcctcaaaagcccacaggaacggagttaatgctcccacatccatagcatgagtagttaaagcaagtgaatgatttgaaattcgagttatttcacggaataacactcgtatatattgagctcgtaatggtacctcgcaattcaaaagtttctctacagctgaagaatgagcgtgttcttgggccatcatagaaacatagatagggtcgaaaacggaacgaaaaacgaaactttacgacagctttttcgtacacgttcacttgcatcacatacacaagtgctctctgaaccgtgcaataaggtcacccataacacggctctcccacttgagttactttagccccaggccatgctattcaataatattggaaaaatggcagcgtaacgtaagaactagtactgaaagctagtcttcttttgagggagggaaagcctttcaataggagccctacttccctcgaccttatcactttaattgttgcgcaaacctctttcttagtcaccgggcggagcgcgcttttgttactttgcttatagctttttaggttatgcaatagaagggaggcaacgctctgggcttgcagaaatgaatg

SEQ ID NO: 14090 - DNA, 3000 bp, Unknown
  misc_feature (1)..( 3000): cDNA_ID_3021682_gDNA_ID_2214697_Annot_ID_189556 3000 nt of promoter + ATG
agaacttgcttcgctaggaaaggaaaagggagagttggtttcaccttccctataagaactaaggtttaccaaactccctagccatctatgaaactatgatactttatacttccaaacctgaaaaggaaaaggaagactaaagcatgggactaaagctgaggaggagctagtggaactgtctacccaagaattagaacaaaagctgctcacagtacacctttgtttaactgtacgagcgagaataccagctaatcatgtaactgccaagaataaggattctaaaggaaagagttaggtgtgccagagatcctgggattacctttggagaggaaagctcctactattactattaaggagcactcaaagcttgcttcgctaggacaggacagcacagaagagtagatagcttgcttcgctaggagtgtgctaacttattctcataggcgtacccgcgtagaagaagctaccttcctcaaactcctctgcgcaacccagccataccagagagtgctatcacaaggaaattgtctggtctcagaagatgagagcttcttttttagcagaggtactgatgtcaggagagtgtcgacgcgctcttccccagtcgtgttgaagaagtttgagggaaagatggattctgaaggaaatcggctgacctatcggatgaagcagactgctgcgaaagtggtgccacgagtcgagaactcttagaattgtgctcgttcaggctctttagtgcacctaagtgcgaagctggtgctgcaagggaggatgtgggcgggagagcggtcagtcctctacctctcgctatcgatcccttttgcgtcctttctagctatcgactctatccctttttctttctagctatctcttcttccgtaaggacctttttgttcccccccacgctgatcaacaaccattgagataggatagagccaatgcaggaggtgaccgaagtagctcaataaaagaatgaagaaattgggaatggtaattcgagcaatgaaaagaaagaaagagttcgcccaatcgtatagctttttccttcaaatgcttctatctcacttgtttgctagcttgcaactgctgggcactgaaactcagtcggccgacatcgataagggagattttcttccaaccccttggaagagaggaagagaaaggagtggtgatggcttaaagaaccacgttgcataagccggaagcacagaatgttactcggaaacaagcctgagaacgactcttcaccgttagccattatgtttacctggtcaaatgccgtcgtttatgataggtcggtctagtgagagcaaatgatcaagcaagaacgtgcctacatccgttgatgcacttcgttgactagtgaagggtttttccttggggcccacgttgccactggggtcgctcatcttactctagggtagcactctctatggaaagaagagtggttgtgcttcactactagccaagtccatgcagatggggataagggggttcactgctgtctgatatcatcatatctattttgacctaaaagcttacttgggatatctaagagctaattaaatcttttctcttaaaaaaacgggtaataagaaaacacttattatctttttatttgcaagcaacatctgctcaaaaagaaaaggaagttgacttcacctccggtgaccggcttcgcgggatcgccttacgtataaggacctgatccactctaggcgaagcttttttgggcgaaagctacttactatgttatcttccaattgagttgagagagttttcaatcgaattccaatttttcgttatataagctatttataattgaatgatttaaagattgagtttcaaaaagaaaataccggagaaaaggtgatgcaaacaggaaacctgcttcgcccgttgatggtccaagcccaagtattcattccttaaggagctggacgtattgttcagcttcctatgaagctaggctggcacttaggaagattggacgagtacaagatcgaaaagaaccctataggcaggctaaaagcgctgtccgtcttcatggcctcaataatactcagtattgtactggccgaatccgtttcgcagcacggagtatacctcaatctccgttagttccgtttcggctttttccccaatttcccactccttctgtgaggcaaaacctcaccacactacacttcgacacaagagaagaggaccgggcgcttgtatcttcgggataggagttatcggtcttctttaagaaaactcaaatcaaatactccttatctcatggatcaacttattgctgatttcgtttctaggatgggtttggctctgcctgtacttttattcttgtagccgttaggtctggccaaatgatccatcaaataaatagtattaatatggaaataatcctgactgatgtagcgcgagatgcgcttcaagaaaaaatcgtgtcccaactctcaattctgttgagagtatatagggatactaatactagtgagagtgtgaccttacctttatccggagtaaatctccaagaagtcgccgctcgtagtttttttaacaacgagagcattccatggttttttcatctatttagaccttgtcaatcagggcacgaaaaaaaaccactttgcccacaagctctggagttagtgctttcgttcagttcataaggtagactttttttttctaaagcggtattcctccttgcctctaatcctcaaatctaatatgattactcggctgttcgcccaactggtatcgttatcaattgtaacttattggaatgacgctattgttgcgacaaacttttcctggctcttcataactttctttgttatgactttcacctttcgtaccttctcgcgctacttcaaaaaaccgatcatttggactttctatttttttttatgtttaatagcctttctccttctttgggcagcccgaatccatataaatatccttttctcatttgcttttggagatgtttatagcttcttc

SEQ ID NO: 14091 - DNA, 3000 bp, Unknown
  misc_feature (1)..( 3000): cDNA_ID_3021726_gDNA_ID_2214698_Annot_ID_189587 3000 nt of promoter + ATG
aaagcaagaatagatagagttgaaagaaaggcgctcgtatagagccctcgactatgtatcggacatatggcaggttgggaaagcgcgcttggaaaagaaagactatcctcgaggtaaatgtaaatcaatctatctcgcattgcccaatctgaatgctaaaggctcgtaaccccctaaaaggaaactcaccaccaaaagaaaaaggtaggttaactaacgaaactcaaaactacattttaattcttgctcaccgataatcctttataaaaaatattatacagctgtatacaggattattggtatagctgtccactagccgaaaatcggacaccaaattattgtagactgacgacctgtccttaatagaaccgatctgactctctgaacaatcggaatttcgtacttctgtcggatcctccctatctcctgatcgagcttgtgtaggtagatgttgcctggtagggccgatagtagtacactgtgtgggacggagtaagggcccctctcaactcctacgagtcgtccggcggaaaagactttctgaatggagtaaaagaacttgggatcgtcgatctcttccttcaaaatttggatgagtcgatgtcggtcgatggtgtgaaaacacttcctgatgtcgaattctaaaaaccagcgagagattccccactcttctttgatccgtcttaggaccgagtggcagccttgacccgagcggaaatgcgatgtgtctggaaactcgggatcgtaaatggattcgagtaccattctgatcgcctctttcatgatcttttctataggtagaactactgtgagcggtctaaacttcaacccttctttctttcttcatattgtaaaggggggaaaagctcgttttttgctccccttttttataatcaaaggccccctcctgccgtcgtttcagtgactcatagggcttccctcagttcagtctttttggttcttgaaaatggtcgccacctctcctcttctttcagtcgatggggttcctctccttttagtcgagtaatcaatacctctcccaggaccggaatgattatccctgcccgatgggtctacatccatccctgaatgtcgtcgggtactgttcacttccccgccattcttgtaaccgtcacctgtaatccgcgcgggtgtgtccgcacccccctgagtggacgagaaagaaaggatttctcggagcaaccccccaggttccagacccaggagtcaactttcccgtatgagcattcggtacatgtatcagtccgtgggaagaggtgaaagggtcaccactactgaggatctccccccccccctaatcttagataggtcgtctgagggttcgccgcggttcattgctgtgcttacacacaaggctacccttctccgaaagctacgcgggaccacctaccactagtcttcggccggaggggtttattgcacaaaaacggccgggacgcaggctcccgaagagggaagcccaacgaatgtcagatgcaaagttccgcacctcattaagatcatattggcatactctcccaaaaaaaaaagagcagaccccattgaagacgagagtaaggtacaacaaggccatttctgtccaccgcccttctcacggaaccgtacgtggacgttaccgctcatacagctcccagccagcaagcacagttagccttcctctacaagaaatggaaatgtggatgaatcgaatgaaatcgaggaattcggtttttcttttcagacatgataagtaagagcatccctttcacaaaaacctacggatccccctcctatcctgccacttcagcaccttgtgatctttgagaagatcattacgagccctttcctagaatgtttttgtagattccgaaaattccagagtggatcaggacgagaatgaatccgggaatccagggcatactcatcctggagcttccgctctcctctgggaagggcttttttatggatagagagatgagtcgagggattgattactcgactaaaaggagagggtagcctcccgtttgaccgatttctcggagtcggaagaagatctctcatctgatgaccctgaacaagaaggagctgctctcgatgtgagatcagcagcaaaagaaagaagaaaagggccatgatgatgatcctatgttcgttttcgccctgcccctatgatgcgctcctagctcgcagagcataagtcagcgcaaaggagagatacatcctttaagactgtgaagagaatccttggtttgacctacggactacgtgggaaatacgagatctaggcaagccgctacatgttctcccccttgcccttgaacgatagaagaactacttatcttctcttagatagcagtcgatcggttctatgatctatggtcaatcaataggcccacggatctattcttctatacgataaattgccatctcgtagcaccacagcctgggggtaagactagaagaggagatttgcttggtcttctgtgcggaatctgcttcctaatcagtgtagctcttgggtcagctcacagctaggacgtcatcagttctaaaggattcctcactagggagactctctccttatgggcaagggaggcagattttgatggggagaaggattcggaatatagttacataagtccccttccctctcctcaatatagtttcactcgagtcacgtcagtacctctccttttagtcgctcgtcgagacctcatcaactagttaatacctccggacctctcctttatcagtcgagtttgtgttcacaacctctcgagaaacaagttcgagagttacgtactttcaatgctctctctattccttgctaatcaaggcctgcaagggaactggctacgactataggcgggacgacatgcttttagcttccctgaaataggcgacttgctcgctttggcaggaagtattttttttgaagaattgaacaaaaaaaactgaaatttctgtaaatcattaaaacgggactttctttaaagaaaa

SEQ ID NO: 14092 - DNA, 3000 bp, Unknown
  misc_feature (1)..( 3000): cDNA_ID_2123774_gDNA_ID_2214698_Annot_ID_189589 3000 nt of promoter + ATG
agtaaggtaagccaggtaagccatgtcagttggtaagaaagtaatcccttccagagttgtaaggttagtaagcttttcccgtttataggaatgggtttctaagcctaggaagtcaaggaagttgtgttggtctttccctggttccttgttcccctgttgcctttctcttcatttcattgacgggttggagaaatgttcacgacgtaagtcagtggaagcaaacgggcaatcggctgcctaaaggaccccatttgtggttgaaggctaagttcattcttcgatatatatcactccgctatgctagaagactgagcagcttcagtttattaccaacctcgagttcaacaactattgggtaaagcctaaaccttactcctttccttctatcggaactggcaacagatctctagatccgatgcaactagaagtcagtcgattccgtctgaaaatggtttcagtccaaaccttttttgtcgagtgaaactccgcttcttaagagcttctttggacagactcactcccttactcgctgggttggcgtatccaaggtagcgccagcagcaagcgtaggggttactacgtaagtgcgttcgttagcgcgttacgttttctcgcttgctagacacgacaactaaggatagacgcgctgggatagcaagcaagtttgttgaaagaggggcagtagattctagatctgctgaaaaccaggttatagggctatatctttattccatggtagggctaggggcagggtggtttaaaataactccttttactttccctcctacaattacaatgggaagggacgagacaaagccttcttttaaactaaataaagtaggattccgctttcactgttctcaaggtatctcctgactcgaagattagggcttcttcccagccggaggcatccgaaactggagaatcatcaaccctcgcataaagaaacaactaaactatacgcggcaggttggtcaaaaagggaaagaaaaaggtgacatacattctattcggggacataatagtgattcctatcgagcacactctgttatatcgatcccaatcaatagtttttgggggaagtcgatggtcccccccatgctttatgacatcttttctcttctccgtagtgatcagtgtatgcacgtagcatcacagtcaatcttttatgcttggttccggtcgcgctcttcttctaactgcaggagcccgacagggctgtcttactctttttgttgctaatgaataacctttttcttggtgattcatttccaagggaataaaagaaagacctgtgactcattgtctcaatcataacttcaaacagaacctcactgtagagagggagacccccgaaagcgtaagaacgacgatttttgagcctgagggtgaggttctccatcgacgagtgagaaaagggcctggtctcggaagagatgcagctaacgtgagtaatagctgaacagttgcctaatgcatgtggtcagcatcagacaaggttataaaatacatctttacatcccggtcaaagtaacgaaaaaagacgagttttagcaactttttcatacagttttgccctcttttatataaaaaactaacttacgcaaatagtaaatgagaggaccttagcacttttcgttatggagtgattcatctaaaattcccggggttttgtgaatgaattcaactagaaaatctcaattgcacgggattcgcgattcggtgtaagttcaaaatttatcgtgctggacgaccacggttgagttttgttgtggatccaactccaagcgtttgcgggattttggatagatggaatactcttgcaacggagcttgtctgtcaaatctggtctggtatggtagcggttcataatggcagctcattttcctggaatccgggtgaaagatcttttctttccaaggtctttgctttctattcgacttagcgatggagtcgggtcggaaataaatactaagtaaaggcagacttacaataatacgcaaacaagggtcccgcgatgtcttgtacattctaagtactttgcctgctaagacgtgacaaacaatcgctgattctttactaacgagcccagtagccactaaggcgatccgaatgaggaaacgccggagtgaccgagtgtcttcaaaaacactgcgccaagagaccaagcggagcctctcggtgaatgtggtaaacaaattgaaagccatatcaatcggtataaaatgacaaaccttttggtatgtaccacaaaacactaagaaagaccccgccggttctactctccttgacccgtggacaaacgccacgtgatggacggcgcccggctctgacgaagaaccagtaagattaggtattgcctaatccgtaaggttgtcatacccttatcagctttctgaccaaacctctgtgttgccactttggtaaggaaagtccaccaaccgggcatagtacctcgttagcaggaccactattgctccttttaaagctttgtgctcaagtgatctgggagggtgtcaaacctcccccagccccttattcaggggatggtgccagggagtttgaactgttaacaaaagattttctcgatacaaagaaaagccccactcctagaatagttagccactcagtccacagattcggcttagtgaaaatagccctagaaagatcaaggtgcggaaggataatttcctccgttaatgatagctataccatagagttttccatcaaggaaagacaatgccttctcttctccatcctccaggtaccagggaagaactctatattccgggtccaaggatgatggttgcaacgccccgcgcttccaccaataagaggtgcgggggatggtgatatcccttgaaagacataactaacttacaagacttaaaatgaaaagtaaactaacggaacaaggcgccggaggaacccccttctaaaagtctaagagctagaaggcggggtacagcggttgcttcctgtaagatttgaatagtcatg

SEQ ID NO: 14093 - DNA, 3000 bp, Unknown
  misc_feature (1)..( 3000): cDNA_ID_3046155_gDNA_ID_2214698_Annot_ID_189597 3000 nt of promoter + ATG
gaatgaaagcttctttacaggacctcttctatttccctccattcttcttcctagtgacctaggagttgggttcgtgacattttttctttctgcttattcaagtagcccggtctggtaagtaaggactttgctctcaatagaagtcaaaaagccttcaacaagaccacatccgctattgaatcagctgctatagacttagctaaagaatgtcttgcacgagattcaatgttatgtgcttgattgcgatcacatttttctcgtagttgatgagctgccaacctccggaattgagggttgtaggtagagtttcctgcgttcaacttggagttggaagagttggatttggagtttataaaagctgttattagttccgactccccggtctaggcctggtacttgttagttctaaggtatcagtgtcgctactttctgtaaaaaatttcctgcgaagggaagcgggaaagacaaggtttcgaatcttggtctaagaacttacactacactacggaggcacgggccaagagatcataacagtcaaatcctcaacctcacaagcagacaagctggtggatcatctgatcttgaaataggtcatcccagctatcccgatcttttctctctttatttcgtcaggtatctgaatcatacgattcctcggatgtagcttttcacattggaccaaaacaaggcccggaaaccccgctagctttgttgatagaaagttagcttcccgtgcttgactagtagggctaatgaacgacccttaactatggaatgttacgcctttcctcggttactcacaacgtaatcaactccattggttattttccccgggggaacacctatagccccaatagactgatttagtaggtatgatgtattactaggagtctctaagttcctgctttggttgtccctgtccaggctaagcggagtttagctttggccgttaataagagcttccctccattccttcagtccagtcacgcttttcttttcggcttttgcttcagtctcttcttttcgtcctttcaggtggcatttcgcttagtcttgtcattccttccgtcatgctactgtcatgtgctataaattgatcctcccgtctagtgtttcctctctcatgttatacagaccgctcctttaatccaatgaataggcggcgagggtgacaaaggcttagaagcaggggcgggcagaagcagcattaattctttcgcccgcgcgtacatattctattgagcgtatacgatcattgagctgatcaccggtggcttcctcacttgtgatgtgaagctgctttccatttctcatttttgaggatatcgatattctcttaagagaaagggtagccttttgtcacgagctggactcgaaccagcgcgtctggcaaaaagaccatccagatttcaaccttagactgatcgtgactttggttactcggttccccacgcgaaccccacacgccatgggtacgtccgaggtagattaactacgaacttttttcaaaaaaagtgtgatatattttcctcacttactagcaaagaactggaccaggattcgtccttggctgcctacgtacccctttgggaatcaagtaaatcgtagttctcttacttattgtcttctttctaagtcttgctttcttctctctttactattgcttctttttcttttctttctataaaatgttcctcaatagcactgattcttcatatatttttgtcaaagcaattgggttcacaaagcattattttctcggtccattttccacctctttcttttgtcgaaccatgctaagcaaagatgcacggttccagtcttctttccctccccgtgtccactagcgctcctatcctctccttttcagtcgagtcactagggttcctctccttttagtcgagtcattagggttcctctccttttagtcgagtcattagggttcctctccttttagtcgagtcattagggttcctctcctttttttagttgagagttacgtcagtaccttttagtcgagtggcttctcgctcctgcccagaacgaagagaaggcgaaaaagcgccgccgaagcagcatgagcgggcttctattgctacgtaacaatagagcaggatagcattttgcgcccacatgtttgaattttagggtaaaaagctcgcttgttatacgggatccgacgcatccagcagagcgaagcagcgttccattcttttcggcggcatccttccgcattggcggcgagtggagtgccacaatcccattcatcatttttgatctacataagccaaagccctccgcactggcgacgtccccggcataaatgcaaggaggatgtatagctgatataggatcttgtggaacaggatttgattctgcaagcggttcggtacaaacaaagaaatttcgaacaaaaggatcggaactcgctgataggaaaggagagaaaaacaaagcaatgccaagagctccgtcaattcgctgttcatcgatagacgaagctctctctttatcatctcgtgccagatgcaacaaaggatgagtcctttttccttctcgcgaaccacgggagcgccaagcgtccagaggatttttaattttcctttcaggataaagcggcgcataaaaaagggctggtccgtcaaaagtccggttccttcgcgaacgaagttcagaatcaacaagggttcgtagaacgaagggagtgtacaactggtttttcaaaccactttcttgttcgtaacgagggagagataaaattgagttcttcacgaagttcgagacaaaaaaaaaaaaaagactttccctatggcctccttgttttaagacattatggctctggggtcgaccccggtaacaaagaaaaaatccataaaaatttgggatccgacaccataataaaatactaccctcatgattagaccatgttcctgagatttgataaaagaaaggtgcattagcggttaatacgttgtaattggataagttattaggaatatg

SEQ ID NO: 14094 - DNA, 3000 bp, Unknown
  misc_feature (1)..( 3000): cDNA_ID_2161890_gDNA_ID_2214699_Annot_ID_136827 3000 nt of promoter + ATG
tagtatatgtttttttatgttctttttttctttgtcattctcttgtccttcgtgacactatgtaatgattaaaagcaaataattgatgcatgagttcaaatgttctttgaaggatccatcttattagctttgtaattgttgtgatatcttaatcttattggttacgtatttcaagtgctttagaaaaaatgggcctaagagattttggggagcttttttggcttgttattttcctcacatatacaacttgcagcttattatttattgaaaatcttttcttatctagattcaaaaagatttccacaaattttaattaacgacccctgattacaaagaaacctacccaaagtcaaattttgtccataatttctatcgtgtaggacactaaaaagtaaaaactcatacctaattggtttctagtagaaacggtcagtgcactatctttctttcaggttatcgaaggaaaaaagatcagtagagtagcatcgttaatagtagagttaagaaaagcatgtaacatgtggtctactttttatttcacagaaaaataccataccatgtgataatgtcgcataaaatctttacttttccggtgttatcgatgtgtgttaatgctaaatacccgaaacaatttcaagactcaattttgaactatcgaatagaattcttctaaaatggatgaggaaaaagtcgctggtttaagtcgtgcgaccctcaaaataaagttaggaatataatcacaagctgcatactttcattaatcaatttaaaaagaaacgactaactttattctttctttgccaaactccataattagttaagtctatgaatgaatgtgaagagagagttttacatttaaaattgtaaagggcaaattatagaaaattctgtgtccaccaattaggcttggctctttaactcactgttctcaatctttaataatccccatcttcttttctcctatatgattatctctctttccttcgtgcgtgttatctctctgagccacatgccgacacttacataactgttgaccaagtctctcttccttctttatcaaatcatgcaaccttcaagaacaagagtttcattttttgaaacaggagagaccatgaagcaaagaaagaagagttatctctcaatcttcgtgatcttcttctctcttttcttcttcgggatcttcatgtacaatgacaacctcaaatcctccattgctgacttcacatcttcgaacccattctctagttcatttgtggagttgccgccggatgagtgtgatctgttcaccggtcaatgggttttcgacaacaagacatatccattgtataaagaagaagagtgtgagttcttgacggagcaagtgacttgtttaagaaacggaaggaaagattctttgtttcagaattggagatggcaacctagagactgttctttaccaaagtaaagctaatgtttcaagatgccctgtttttatccggtttgatcgaattggtatttaacaattgtctgttttatgattggtttgatgaagattcaatgcaagagtgttgttagagaagctgaggaacaagagattgatgtttgtcggtgactcgttaaaccggaaccaatgggaatcaatggtttgtttggttcaatcagtgattcctcccggtagaaaaagcttaaaccagaccggttcactcactgttttcaaaatccaggtaataaacattaatccacttgtgtgacactgacactaatgacattatttttatagtttcttactttcttgggatatgcaaaactgaaatttaaaataggactataacgcgacggtggagttttattgggcgccatttttggtggaatcaaattcagacgatccggaaaagcacagtataatcgaccgtataataatgccagagtccatcgagaagcatggagtcaactggataggcgttgactttcttgtcttcaatagttacatctggtggatgaatactgtctccatcaaagtcctgtaagtagtaatgttatagtatacacactcacacatacttatgtattgaatatcctaggattgaagatttgtgatgatggaaacagacgtggatcgttcgatgatggggacacagagtatgatgagatcaaacggccaatagcgtacgagagggtgttgaggacattgggagattgggtggaccataacattgatcctctaagtacaactgttttcttcatgagcatgtctcctcttcacatcaagtaataaatttctcccatccataacattttttttttgtatctaatgtttatatttgattgttgttctgtttttgttttaggagctcagattgggctaatcctgagggtataaggtgtgctttagagacaacaccgatcttgaacatgtctttcaacgtggcttacgggcagttttccgcggtggggacggattacaggctgtttccggtggcggaaaacgttacacagtctctaaaagttcctattcatttcctcaacattactgcattgtctgagtatcgtaaagatgcacatacttcggtttacacgatcaagcaaggcaagttgctgacgcgggagcagcaaaacgatccagccaattttgctgattgcatacactggtgcttaccaggccttcctgatacatggaatgagtttctctatacacatattatttctcgaagatgagattctttcatcctcttttttggtttaaaaaaattcttgtgatgtatataggacagagattcaagggatttgaagttagccaagtaaggctaaaaatttgttgaataaagtgtacaattcacagggaaacacagatactataatttcagtaaatgacaagattagtaggtgtgtattatcagctacatgattgtaaaagatgttgaagtagttgaagttaaaacgttttgatagaccaactacgacccaacattcattaatgtcaaaaccaattttctcatatcgccagaaaccgaacacaacgag

SEQ ID NO: 14095 - DNA, 3000 bp, Unknown; identical to SEQ ID NO: 6149
  misc_feature (1)..( 3000): cDNA_ID_3079672_gDNA_ID_2214699_Annot_ID_189611 3000 nt of promoter + ATG

SEQ ID NO: 14096 - DNA, 772 bp, Unknown
  misc_feature (1)..( 772): cDNA_ID_2706651_gDNA_ID_2214700_Annot_ID_136835 3000 nt of promoter + ATG
catactattctcaaaactcaaacaaacaaaaaaatcaattttgaaatataattatttctaattttcatatttttgtaaattgaatacacaagcgttcgtcgtatacgaccattgttttcagcgtgtaagtttagcaaaaaaaaaatcttaaaacttgtggttcatttggaaaagtaagaaaatatacacgaacgtaataaacacaaacaaacaattgaaacatgaatgtacaggtttagtgttattatctgaccacattgtgcgcgagtgtggaccatgtggacgttataagtttcatcaaaccaagcatacatatatatgtgcgtcaacgtagaccctcaagttttcttgattttcactcgaatcaataccgtatactcatgttttatcgtaacatagaaaaaaaaaaaatcatggactttctcaagaatcaccaaaaaaagcatgcagcttcataatcgaagaataagattctttaaattgattgatgagcgtctgcactatgaaatgtttcgatttcaatcttctcctccaattttcttcttcattagtcctttttcgctcccaatatccttcatgaaatttctctataaatagagacataaagcattaacatgcaatgcaacaaaacttaagaatattagagtcaaataaattttaaaagaaagttgacagtaaaaaaaagccttaaagaaaaagaattagaattagaccttataaaaaaaaaaaaaaaagaattagaaagattgttctggtgagtgagtgagggatg

SEQ ID NO: 14097 - DNA, 3000 bp, Unknown
  misc_feature (1)..( 3000): cDNA_ID_1985614_gDNA_ID_2214700_Annot_ID_136836 3000 nt of promoter + ATG
tggaaactggatcgtagattcatatacaattgagaatttaagatcatgccaaaggcgattgctgatatcatatttatgtagcttttgtactttttaatagaagtggacacaatactgatatcattagtgaataatcttttcatatctttcagtctaagtatacacaaatatatcgtatatgcataaaacgaatgtctctcattttcgtaggaaagaaaacacaattaaaaagaaatatttttaaaaagcaatgtgaaaagaagttggtaacttgaggttcacgagatccaaatgtggatgaacgttggaacagctaaatccacgtaataaaagaggacgaagcttatgattaaatttggtcagttaagattctcatcctatgcaactacctaatacaatacaattaatttgtctccctcccaaattcattcaaaatttttttttgcttggttataatctatttattttgaatctggtggctataatttttcaaaaatctatgtcaagtaacgtatcttacgaaaaaaaacactgtgattaaattcatcggaattactagtctcatactaaattctacaaatagatatcattttctcttgtaaattacacaacaataacaaaataacaacaaaaatcattattttcttctcgttgcttttattcttacgaactggatactatctttcttatatgtaaaaacaacacgtaatatctaataagtaaagtagggaaagtagacttacttatgttacatagggtcccccttattaggctacatatgtataagcaggaagtagacttggcatttgaaatagacggttgatatctccctgtcactatttatccatccttatgacctttcggcgggaaattcgaaatgacatttgcagattttcttgttttttccttttctttttttgtttgtccactccacttatatctttttttcttttggggtttttaatcgcatcctacaacatatcactcggatagggtaaattgccccaaccaaccattcattattaattaataaacctgacgaggaaaatgaatatattttggtttcaaatgttttgtggaatgaaggcagagagaaagacagcttctgtaaaagcatttgctggcagacacaaccctaaacccaccttcacttgcctcacctcaccactctctcttcctcgcgcgtgtctatcacttccataaactctcattgcccataattgcttgttttctttctatatgccaagcctgataaatctcgtagtaaattacgggaaaaaattggattccacctcacacaataaagcattttacaaaaccagctttatcattgggttttttaacagattatagtattgtgggtgctcttaatatctggtacacaatagtataaggtctatcgacaatacagagtagactccgggagacaagagaagccaactaggggcacattttttgggcgtaactagacattatatattaatttaaaacttttgagtttcttcgttgaaaaacaattatagaatatagttttgtcttcaatataaaatgagaaagaagagaagaagatctgttcccgctcttttgacttaacggtgctgtcgttttcagcaggttaacctcgaccccaccctccatttttcacttccttctttttaaattattttctctatcactaaaaatatcaaaaaggcgggaaaatcacctattatccaattcagtttataaaccggtttcggttccgtcgttaacggctgattcttctgaccaatgaaaactcgtgaagtctgacggagaagaagacggaactgttaaaatccgttacgtcagacggagaggagggagagggacggatgactgaataaatctgccgaatcctgctgaattgccacgtcagctttattcaaaattctctgagtggtcacgagatttctatggactcttttttttttgttaattaaaagtttaaaaccctacaaaataggggtcttcaatggggttaccagaaaaaaccgaacagtcgccgattccttggtttaatctttgaaccgacagtgtgaccttttaattttctaacctttgctatattattatgaaaatcagatgtaattatttagtgccattcattaacgtgattcttacttataattcctctcatgaatactaaatggagtgtatataattatatttagcagtaaaaatgtattgtattgattgttggaaagggaggaaaaaatgatgagaaggatttgcatgaggaaaagagagagaaggcgtaattatcaagtgttcgatacttttgattagcccacacatttataatattttagtgtagtagtgagatttttatttagggttttaattagaacatagtataagacattggagctgtaaatgacaacttgtttgggatttagtgggttccacctgtatttctcatgcccttacacatttccacattaatatctatcttatcttataaaaaaaagttccaaagaaaagagtgagatatacatatattagcaatatgagtttaatgtgccattcaaaataaataaataacattttgaagaatattaagagtctcaattaaaaaatatttaacttgttctttagtgagttacatccatatcttaagagacatgtgaagagttgaatccaaatgataacacaccaaaattgatggtttttaaaaaatgtgaatactattactgtttttttctttggatttccaaggcaaaatagttaagaaaagaccaaaggaaaatagttttgattttcgtccatcacgcattaattacggataattattatattaagaaggaaaaaaaaaaacaaaaaaaagcagaagtgatattaaagtgcttttgagctgtctcgtagaaaccatgaaaccttaataaaagcaaccttgtcttcaacattctccatcttcctcctcacttaatccccaagttcacacttcaaatccactctttctatttctctccttcttcttct

SEQ ID NO: 14098 - DNA, 3000 bp, Unknown
  misc_feature (1)..( 3000): cDNA_ID_2710916_gDNA_ID_2214700_Annot_ID_136838 3000 nt of promoter + ATG
tagcagctcaagataaatttgaggacaacatcattagttccattccatggttgactaaatttatttgcaaacatggatacgcatatcgtacatacgaaatgcatatctctacctactattcgttcgtacaatcatttttctccccatttttatgaagttataaaattaattaaaaaatttataaaagaaggaaaagcacaaaacacctaactgaattaaaatagaaaaacaaacagaatcatgggctcagcttaaaaagcccagtatggactatgggataggaatataaagactgtggagatgggtggctcctaaatgtgaacaacccgtggatatgtagacagatactcgtcttgagagtgctcctcatttactgccagatgcaattaagagtgctcaagtggcctctacatcaatcatatgtcttgagcttgaacatatggttgcgagggagggtcaaacactatttcaacccaatgaaactggcagagaagcggtaaaagaatgttttgaatggactttcaaggactcaatcatacctcacttgcacaacccaaatttttcgaacccaatattttcagatcccataatgacctattacccattcatcctcatgcacatcttgattcaaaactttcttgtgtgcaatttttttattacgttttattacaatgtttgagatgaaaatgattggcatctacatatcatatcaatcaataattgtactcataaaacttttgttagtcaaatttttaccaaattatattcctaccaaaataaagatggtccaaaagatgttttctcctttctctttcttttcggtgttaaaagtaattcaaagtttgcttatagaatattctagactttgttgttgtgaagtgaccttgaaactaattgcgtccacagcagtaagactcctttatggtccattattaaggcacttcacagcatctagggtataaacgagatatacttattcctaagtaatttctcaactatcatatagaaaggaacgtttgttttatgcatgttaatattactaccaagtaccaacatctaaagcggtaactcaactgcacgagtgtatgatcaatacaatatcagtaatattagccaaatcacaatttttgccttaaatgatacaggcttttgtaaccatgtaaaacttttttttggaacttaactcaatctaaaattgtcatgaatatgttcttttttcttcaaaaacaatattcatctagaaccccacttggaacaaaaactactgttaaagaaaaggaaacttcactatagtcgacaactcgatatccacatctaaatacttatttataattattttattgattggtaatctatttgtattatattctctgcaaagaattttgttttgtgtcatggtcagtgagtggcatatgatttcagtaaacacaagtcacttattatgcaatcatgtacagattgattcaaaacatatccgttaattaatttgaacagttggagatgtataaagtctgagttggtacttccaaatggtttaagatttataggaagttgtgtcctttctggcttctgccattaacctcagccaatagactgtaacttgcatggctccgcctccaatcaacttgctctctagaatatgttgtactattaaattaaacaatatatcgataaattcgatgaaaatcccaactgtaattttttctcatagtatcaattttaaactttactgtattttctaaaggcaaaagaactttctattatagataaaaaaaaaatattaaaattgtgtaaaagagaatgtattgaagttttaaatgatcgagagtcaaagacattatcatttgactagagactaaagatgcacattctgtaagatgttaacttaggtataaactttttttttaagtgtgatgtagaagttttccacgcatatcgatcagcttaaccttttatttaaactataaaacaaatcactatcaatagttttacttaacgtgtttccttctccatatcaaacttatataaataatctaagaaaaaccataaaagccaagtacaaacgtatataaatcgggtatttctcaacctagatatattttggtaaagtattaagaaaacaaaactgtatccaaaattggtagcttgagaataacatataactaaattaatatcgtaaagattgagaagatcatcacttacaaacattcaacaaggtagcttcgacaacaacacaaatctaatgtgtttagatggttccatatttttaaataaaaaatcagtttgcaaaacaaacaattagtactaaaatagtttgtttttttctcacttaaaatccatatttccctagttcacgtacattttcatttattattcgtcagcaaaattattatatcttcttgaaatgatgaattcaaataaaataagcaaaacttggcaaagactcaaaatagcacaactagacaaaaataccagctaacagaaagtaataagaaaaaactcaaataaatggaaagacattaataaggcagatatatgtttttttatattataaattgtttttttttatagtataaaaataaaaatatcggcattcttataggatcgatctctcatgcaaaacaacaaattcagacaagaaacctcaacggctcagacccaccaataccaattttttaaagagatttctgtcacaagtaagaaagaagcactaattacaaaaaaaaagaaaaagaatcaatcttttgttcttcgattcgatttctaatcaattagattgtttttgttttgtttaacatcagttgcgaatcgagctggattcttgggctcgctttttctttcaatcaaaagtttcgatattagtgaaggataaaattcgctaaaaaaagagaattttttttgttaaaaaaattataaaagctggctttctcaaaatttctccatgtggtcgacgaagaagacgaagaagacgaagaagaaagagaaagtctcttagcaaac

SEQ ID NO: 14099 - DNA, 3000 bp, Unknown
  misc_feature (1)..( 3000): cDNA_ID_1808783_gDNA_ID_2214700_Annot_ID_136839 3000 nt of promoter + ATG
gttccaattgttgttttgtttttcaatctggtttcgataagaatgtgtttgcttagatgtgtcgaaaaaagttttgttttttttaaatgtacggagattgtttccccaatttcaatttctttaatgctttttttgattaaaatatgaaaatggtatcaccaggaagaagaagtagaatctgactacttcaaaatgttgactttgatgattttaacgatgacccttttgaaaaaatgttttctttaatgatcctggaaccataagattgggaaattttcttgctttgccaaaactctgctttctataaactgagatcatgttttgggaagcttatactatgttttgtggaatgtgcagattcatggtttcaggtggcgttcgttttgaccaccggtataaacagcgcgtatgtgttgggatattcaggaacaattatggttcctttaggttggattggtggtgtggttggtcttcttattgctactgcaatctctctttatgcaaacactctaatagctaagcttcatgagtttggtggcagaagacacattcgctatagagaccttgctggattcatttacggtaaataaaagaccaaaccagctctcttaatctcttctctgttgttaccttcattggaatgatctctctttttatcaggtaggaaggcttatcatcttacatggggattgcaatatgttaatcttttcatgattaattgtggattcattatcctagctggttccgccttaaaggtagtaaaacattttcttctcttgattcttgatttcgttagacgagttagttaattttggttgtgtgttctgtttctgcaggctgtttatgtgcttttcagggatgatcataccatgaaactacctcattttatagccattgctggtttgatttgtgcgattttcgctattgggattcctcatttatcggctcttggggtctggcttggagtttcgaccttcctcagtctcatctatattgttgtggcaatcgtgctatcggttagagatggtataactaatcaaatgatcatcaagattcaacattactaatgagtttaactactgcaaaaatctaattcttgctttgttttgtttgtttctaggagtaaaaacaccttcaagagattacgagatacaaggatcatcattgagcaaactttttaccatcacaggagcagccgcaaatctggttttcgcattcaacaccgggatgcttccagaaattcaggtgacttttccctagacttcaaagttcaattgtttgtttgtgtttgcttttatgtattagtgtaccttttgttcaagtaaaacctgcatcttaaacaaagtttgtttgttaatcatattgacactataatttccacaatgttaggcaacagtgaggcaaccagttgttaaaaacatgatgaaggctctatactttcaattcacagcgggtgttttaccgatgtacgcagttacattcatcggatattgggcttatggatcctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacg

SEQ ID NO: 14100 - DNA, 3000 bp, Unknown
  misc_feature (1)..( 3000): cDNA_ID_2706056_gDNA_ID_2214700_Annot_ID_136842 3000 nt of promoter + ATG
atgtgatagtgacaacatgagacattgaactattacaaaatgtctctactttatctttggaacatataaaactatattttacagaaaactcttgaaaacctatacacatcaaacttcatgatctcatctttcattgtaatccaaaacatcatcataggtaaggcttggaagtttgaacagacgcttgctttgccaattccactggcctcttaacacatccatatgattaccaatgactccaattacgcggtgacctctttctaactcttccttttgtcttgtatcttccctgctataagataatataacctctggctttatgctactttgatgtgaataaaattagtagttgtaaaagcttattgcaaacctcataatcaaatgtgaccagtcgctgtatcctctagattttaactgctcgattgtggcgttccgctctgtttcgggtcttcttgataatagaaccattgaatagccttgtgatctaagcttagaatatagtgcaagtattagtatgcttttctgatgctttgcttcttcaatatacttcatgtagtaactatcttgttctaatctacataaagagaagaacaagaacgttaacagtttaaaaacttacaaaatgttaaatgaaaaacaaaacacttacagattggtgtcatcaatatcgatcacaacaacatcgcagttatcattcatcggtttgatggtttggaaataagtgagagccatttgaatagtgaagtttaactctctcaagtaaattccttgtttgattctgtgtaaagcaacatctctacataacagtggtaattcactttcttcatccaagctattgagctgagagtgtaaagacaagattttacagtaaccgaaactctcatcgagtctttgagcctcgacgattgcaatattccggttctcacagctttgtaacatggttgataaagcaataagaagtgttatcatcaaaactccaaatgttactagagaagctatgaagatggaagctgctaaagatgtcatgtaacatccagattctatcgaataccgactccccaattctgcaagataaacaagaagatttatcaaattcaagaaaatcattgcaataaatcaaactaaacacagatggtagaagataatgaatatattagtacataccggaattgcctcggctggatagaccggagagctccctctccatcggatgcgtataagccgacattttcaccttcttgtctaatcaaacacttacgatgatcataaaaacatcatctatagttttagaagacaaaagagtgactactaagaaagaaaaaaaaaagttccaaaatattgaagatattatggatattgttttgatattttccataccttgtagaagcttcaaaaccaaaacgaatctttattttgatcaagatccgaaaaaaaatccaaaggttcaaaatctgcctctttggtcacaagaaaacagagaacatataatacatttacacgtgactttttttttttgtgtgtcatcagatccaaagttgatatgcctcagcttatcttctttactcgatcaaataaacttctcttctcttcaatttttttttaaaaaatcttacactagtttattttattttccaaatttggcggagacataagaaaaaggaatcagaccaaacttttctttatttagctgctgatagatcgtttcatcattcctttactcgattatacaattatcaaatatatattgattagtcaacacaaaagtgaattattgaattttatgttgttggacaaagtaattttaacattctagttacaagtaaacttgcaagatggatctatatatagatggaaagatttgtgatgtgaaaaacatctactcgtatcgtatgttataacaactcatacggttgaaaatcgtgtacagtaaaacctctataaattaaaaatgttgggactgctaaattttattagtttagaaagatattaatttatgtattatacttttagtatattgaaccataatttgtacgtatttgactcttatgcatttacgacaacaattttttaaaccctatatatgttaacaagtaaataagtcattatcattaggggtttaaatatctgaacttgaagaatttgtaaaacggttctccgcgtcatcagtatgtataatatggctggccactccttagaccgaagagctcgttgtataatatgttttattttagattttctcaaatctcgcggagacatggaaaatgaaatttattaaatggatggagcaatttggtaatttaatcagtatgtctgtatgtgttttgtaatgttatagtttaagatatgtatcacaatcatctatatgtgacgtatacgacaagaatttaactgtacgtacgatacccttataattattattcacttagatttttgtttgtactttagaagaatctgaagaagggtcccggcgtcaccatgcatgtatggtcactccttaaaccagagattcgtaaataattatattgtagtttccattgttattgtcgatttatttatggtccccaatgttctcttggagtcgagggaccatacatttagcttcaaaaatcttacgattaggaaacgtgtgacaataacatttgttttgttagctacaattcctaatttcctatgatttgtacaataatttaaagattaacacagcttgtgggatgcacatggaatttgtctaatagaatttagttccatcatatttgcatacaaacaattgtcacctattaatactttcattattactttcgatgaaacattgttattgggtatataaattaaggcccggccctaaagcccatttattagccacgtgcagtaacttattatttttttcacttatcaatagtaaaaaaaaaagatcaaaatgatcactcttttgagtgtgagtgaacacacttcgtcgtctctctttcactacttttgagaagctctcttcttcgagcttcc

SEQ ID NO: 14101 - DNA, 3000 bp, Unknown
  misc_feature (1)..( 3000): cDNA_ID_2706036_gDNA_ID_2214700_Annot_ID_136843 3000 nt of promoter + ATG
tgttctgtaaacagttctgcatgtttatctggtagattcttttgatgtagtttgaattaagggtaacttgcaagcatttaaaagctcttggacttgatccaacttctggttttcagcatctagtgtttatttgttagtgcttttgattttgatattagagtgtttttccgactgatttcttgacgttttatctcctattggtcaggggtaacctgagccttatggtcttgccaacatctgacttgagactctcatttattggagacaatggtcattcagaacaactctttacctataccagcaaatctcagtgctctgcggtgtcaattgaggagataactgtggacagctctggtagatcttttgttataaggatcgcaaatggcaatgctttttactattggtgctcagagaagtcaaaacttctgggaactgaattgcgtaggaaggtttgtgaaatagtgttgttttaaaatccttgtctgtgcatctaaattttctcatcatctgttgttatcctgtgtagatgaaagacttgatcaagaagaagccatcaatctcagaattaactggaattgaagaatcacgtcttggctctgttgcttctcatctccgtttgtatctcatgggttcagtggtgcctaacatcaaaggttgtcaggtcccatctcctgattcatcatcatcttctggcttttctgaaacagctgattcctcctcgagtgcatcatcaaaatctcttagagcacgccactgtgggactcaacagacaaagacccaaggaagcctcagccctagagcaagctccttcaaagaaaacacactgagaaatgcttctctacgtatctcctctagagataaatcaaagggacacagtgaaggccatttctcaatctttgataattcatccattacctctatccccaccaatgtagagggttttatccagtcagaaggagaagttgaagaagctactgagaattataatggaatcagacaaattattgcttttgaagaagcagagtcaacaccaagtacaatgaccggacctcccccatttcctttgaagatgggtccaccagtcttttctccttattattgctggtgccctccaaccacttcatcgcttcacgcaccatctgcctcttatcagttccctccactatccattgagctaccttcccttccgccactttcctccttattaccagcatcgggatcagatggattcttgatcccgtcatcaccgctcgatctctctgacatccctccattaccattagtccaccacatacccattccaggctcatcatcatcatcatcccagcaacagatgatgattcctataatgtgcgaccctattgttcatattccagttatcgatatcttctcttcaggtcaaagctatctggtaagcgctggacccaccgggataatatccacgggcatccctccgctcccagtggagaatgattcgctggtcgagaaaggtgcaagagaaacactacgattgctcataagcggagccaatgcaacaacatctacacctttgaaccatcatggaagcagaggtctatacagtgtgagccgggatgtgagtggtgtgagcttgtttgcacctattgggttgcaacaaccgagttcagttgagggaggagatggtggtggtgagagtgtgagctcaagcgaagcagtgcctgcgcctcccagagagacttctggttaatttttttggttctttgtaagtgtggtccgagttaagtgtatagaaaactcatctctcgcctagtttttggttttgttcagcccaagtcttttggtttcaggtgtaattagtcgggttttttgtagcttgcttatattacctttgttatttccgagtttcaaatgaagctaagaaatacgatcataataaaaaagttcttttgcagtattcattttctttcatggttccctccttattcatagtcattgttgttctttctaatacttttcctgagctttttttttctattggaaaaacttttgtcactgaaagaaatttcaatgtgattggttcttttcgcaactgtaataagcactaaaagttaataatttgctgctttttaagtcttgttgctgaatgatttaatcccaaagacgttaaaaaaaagacatgtaaatagtctttgttccaaaagtaccattttgagcgctttctttcgacaattgatgttgaacttgtaccaaataaaccttgaaaatcatacatcattaaatgtagttttttgttatatacttatattcatatggtccataatatatagttaaccatattatggaccatataaattcatgcagtcaacaactttttttttcctcattaaaagctactaatactgtagaaaatttttatcttacaaaagaaaggagaattattgtatttttattttaatcacatataaagcaaccaaagataacatatactagtatttagtatttttaaattttttgcttaggattcaggttattaatactctataaagaaataattaaatctatccatcgaataaatcacacagcttattggatcagttaaatattctaataatattgtcgtgtagctgagatctgaccactgcaaaaatgaaaagaaaaacatagaagtagagagaagatcgcatctcgaccgtcaacttcagtgtatgaaataatgatcgtcccacttgatcctcaaaaatattattaaccaaacaaaatttgattccatcgtcccactttcttcttcttcctcccaatccgcctcttcttcctacgcgtgtcttcttctccctcactctctcaatctctagtcttctccgattcaccggatctttcctttcttacttctttcttctcactctggtggttatgtgtggatctgcgacctcgatttcaattcgaagtcgtcggtttcttctctaaatcgaatctttccaggattcgtttgtttttttcttttgtttttttttcgatccgatg

SEQ ID NO: 14102 - DNA, 3000 bp, Unknown
  misc_feature (1)..( 3000): cDNA_ID_2706032_gDNA_ID_2214700_Annot_ID_136844 3000 nt of promoter + ATG
gagaacagggattttttgattggatgcatcgcattatatccttttttctcgaattcaattgatactttctgctttctgcttgactctcatttggttggtttccagtggctaagatgaaatttaagaaaattgagattagagaacttgtaatgtggctcgaattctttgtgcttagttagcattagattttggaaaaccttcttgtatctaaagtatgactatagaagctgatcgatatatgtcttgtatttggataattctgaagaagatgtttggtccttgactatatgacacgtatgtagtgttgaatgcggtgttgcagctgattctgtacactaaggagaagaatgcgattttgttcacctatcctcctgaggtttggtctctgactatttagaaaagttatttcattgagaagtttcgtggtttgggctacattcttgttttgtctatgatgctacaattgtattgtatttctgtgatttaggtgcataatgtaccttttttccttgttcacttacttttaactggagctatagtttgaattctggtgtcaaacttttgcattccttttgttttgtattttgtttctgcttgcctgacatgttatgtaaagtttgcaactttgcatatcttaaggcatctttttttttttttttttttttcatttgagctctaggcaaaactacatttccctttcaatgtattgttcaattagttttagtcttcaaactttagattttgaaaaatagttgaacaaaagtttttgatgtttgcaatcgtttctgtcttgtttctcgaaacataattgttcaactaagtggaggattctggactgtaacttgggtggtttatttctcattcttaccagcttgaagaaattactcctctcatttagttagtatccgagacgatgagatttttttttccaaacatttcattctgtactcgtttagttagctctaggaaacataacaaaaagagctcagacattttgtctttctgaagccatgttaaattgatgcaataatttggttagtgggattgcttcattttgttatgtcaagactcaagatcctaaagctctctggttgatatatatttgctcactctcatttgttttgctactgttcaaacatgtatgtttagctcatcatttggtgctcctctttggaaaaatcttaaaatctgatggttgatacgcagggatcattcaccagcactggtttggtggtatcttcaaagttgcccagattctctgatcagtacactctcaccatcgacagtgctgatccaaaatcaatctcagctgggaagtcagttcagctcaccaaaagtgtcacccaatggtctctctctcggcatctttcttacaattgctcgctctgttttccttacatgagtctcattagatggtttctctgtgtgtttttcaggttcacgaaagatggagttcttgttgagggtttattctggaaagacgtagaagcactaatcaagaactatgcagaagaagaaccaaagaagaagaaatgatcatcttccagagaaatatatgcttttgaaactccatatgttggcgttttagaatactaaatcgatggtgactttgtttagagatgaaactaatatttggatttttccttatagccaactttttgaattaatccgagattttatgatcactatttagaaaagaataaaaagctttacctaagttagtaagccaatggctcacatcaagtatatgcttgtcgtttagttatttgtactagatcatacataaaaaaaaggtcaaatgcttcacgaattgtggatgatttgattcgtaatattttgtatgattgatgataaaacacctacatatgatatgagtggcttggatgactctagtctctttttagacagccttttctttctcgtatggcttgggaaagttcatttggtgattgtagttggttggagtcgcctttttttagcactttttgattagaaaattttccattttccgttataaaaaattccacagcttaacaagagatgggtctctatgattttgcaaaagtattgaataactttcttgatgtaagatgacaatccaaatttggatatacaattttaaacatataaaactccaaataaaataatgtaaagaattgtgttttaaaagataccataatttttgtttttcctgcttttcatagttctaaattctaatcatagcagcggtcaaaaaaaaaaaaaattaatataaaaatttataataaaataaatctctaaaaatatggaagctattaaaccaattttcgtttgaaaaaactttctcctcgtattaacataacgtagtggaattttaaaatattccaaatcacatgctataatccatacattttttatccattcattggccacaaaatacaacctgtccatcgccgaagatcaatttcaacgaaagaaaaatataggtttgcaataaaaaaaaacacaggcccatcctttgctagggcccattaaaagctgacgtggcaccagctcgaagtcaggttttgcaaggaacccactcctaaatttgtaggacccaccataggattcaatcaaaacgagccccggatctcaaatgttttgaataaaataaattaaataaaatcgtttcgaatccgccagaacatctaacctatataaacgtaaacgttgtgctgttttggttttcttatctttccatcttccgcgaagggcatccaaaaaaaggcacttgtttcaattaaagatatttttattctctctctctcgaaacaacatcaatcaaaaaaaaaaaaaaaaatttaattagaacaaaccctacctcttctctcaatttggatttgattctttgaaatttgaaagcactaatcaatctttaggtttttttattttgaaactcgacgaactttttttattttgtcaatttctggatcgagtttttggtttctctgacaagttaccgatacgatatttgatatg

SEQ ID NO: 14103 - DNA, 3000 bp, Unknown
  misc_feature (1)..( 3000): cDNA_ID_2710910_gDNA_ID_2214700_Annot_ID_136845 3000 nt of promoter + ATG
taattctggatctcttcctccttggcattagaatcagcgattttcgatttctcttgtttttgctcataattttgttggtgttggaatatagaaatcatgtcggacgctttgatcaatggattggctggagctggtggtgggatcattgctcagcttctcacttatcctcttcaaactgtacacgattctttcgtcacctaattcttctggataatcttcaatcgtctcgtttaaacgcgattgtgtctgtttgttaatcgttgaattaggtaaatacgcgccaacagacggagcgggatctgaagagggagaagaggaaacttggaactatcgaacacatgtgtcaggtttttttttttgttttccactctcaatctcatgatcagagattcaatacatgagtgttgctatagtatatgagccttgatttgctctgatttggttctagttttagaaagaacgtgtaatggattcttttgttgtcttacatttgtatgacctgttattaaatagctttgatttgtgttgaaggttgtcaaacaagaaggatgggagaggttatatggtggattggcgccgtctcttgctggaacggctgcatcacaggtatgttctctcattggtgtgaatatttggagaatctgtaattttagccatttttttggtatgaagtttagaatataggcttgaaagtggatgttaattttggatgagacagggtgtgtactactacttctaccaagtgtttcggaatcgagctgaagccacagctcttgcacggaagaagaaaggtttgggtgacggatcagttgggatgtttgcttcacttttagtggctgcctttgccgggtacaatagaatttcgttatgtaaatttgttttatatgctagtttttggtctgttacaatacggattagagattaccattagttaggaatgctatacagaatttcaaaatagctcttaggtgcttcagtttttctcataaacttcacattggctgtgggtgaaggctcgccacggtcacatttctaatgctatcatctatgctattatactgttacttgtctagtggagcttctaggtggatggtcttaacttttcctgtcaggtcctactgtcatagctgttttcttctttgattgtaaactttggtcgcatgtatagttcattattgtaatttgttttttttccattgtttccgttggctcatgtgaattttgataacactctcactgtgcagatcggttaatgttcttatgacgaatccgatttgggtgattgttacgcgtatgcaggtataaatggcttcatatacactagtaccgtaaagtgcttcttacgctgtccagtcaatttcaattacattttctttggtccgtggtagttttagttttgcgtttgagcatgaatctatggattttctctcctcacttttatttctcctcttgattttttgaatacttgtatgcagacccacagaaaaatgacaaaagatcaaacagcggcccccgagtcaccttcttctaatgcagaagctctggttgctgttgagccgcgtccatatgggacctttaatacggtatgaggcagcttcccgtatttaaaaactagaagaagctggctagggtcatatactcatatcaattattatgagtcaaatcaaactctataaacctctcaattaagacagtttctgtgatatttgttgaacaatgtctcagattcgagaggtttacgatgaagctggaataactggcttctggaaaggtgtaattccaacattgatcatggtacgtgagcttatgattttgaagcttctcttgtattgtttgtctaggtgcattttattaataattagatgtgtgtgtgtgtttttaacccacaggtaagtaatccgtcaatgcaatttatgttgtacgagacaatgctaaccaagctgaagaaaaagcgtgccttgaagggtagcaacaacgttaccgctttggaggttcagactctagcattttgctttcgttttttttgaataagatgtttacttgctttccaacttcccatgattgtgctttctattttccacagacatttcttctcggagctgtggcgaaactcggagctacagtcacaacttaccctctcttggttgtaaagtcgcgacttcaagccaaacaggtcacaacaggggacaaaagacaacaatacaaaggttttccctcttatcatgaaatggccaaaataactcatttgtcagttaaagctaagagttgctgtgttggttttgaattacaggaacattggacgcgattctgaaaatgattcgatatgaagggctttacgggttttataaagggatgagcacaaagattgtgcagagcgttttagctgctgcggttctgttcatgatcaaggaagagcttgtcaagggagctaagctgttgctctcaaacgctacctctagctaagtcaagtccaagccttcttgaatgaacgctagtagttagaaataaataaaaatagattaaatttccaatagttttcttgattaattattacactattgggattgttgttcatttcctgatgattgcaattgattattgtaatttctgcaagattctttagtaatgaaatctgaataaagtttggcagatttcctttgttctttcttcaatagaaagaaatcttcagcatttaagtttataatagtcaaataagggtttaattagttgacaaaaaaggtttagatgtgtcattagttgacttgactacattaagcccagcaaggcccaataaatttcatccatcaaaacgacatcataataaacgagttttgactgaaacgtcttctagctccatccaatatatcgtcttcttcctcctcgaaccaaaaacatcagtctctcctagtctcagcgctcgtgaaaatctgaaactctgcgttcgaattttcgaagaacattagagatctggtattatctggatccgatctgttcaccatg

SEQ ID NO: 14104 - DNA, 3000 bp, Unknown
  misc_feature (1)..( 3000): cDNA_ID_2710906_gDNA_ID_2214700_Annot_ID_136846 3000 nt of promoter + ATG
gaacctcgctgtggaatttcattaacaccttcgcggaggtttctagaggtgctaagaatgtgacacgtcagcctgattttacgcgggagtctgtgctaatctcaccggctgtgctcaaagtccctcaaggtggtccaaaggtgacatttgacgaaaacgcgccgttacgtgaacggatattcagtttcagtagagaatcgattcaagagcttaaagctgtggtgaacaagaagaaatggttgacggttgataacggcgaaatagacggtgttgagttgttagggaaacaaagcaacgataaacttaacggaaaagaaaacggtattttaacggaaatgttggagagtttgtttgggagaaacgacgccgtttcgaaacccgtcgcggttgagatctcgtcgtttcaatctctatgcgcgttgctttggcgtgcgatcacacgtgcgaggaagcttccgagttcgaaaacgactacgtttcgtatggctgtgaattgtcgtcaccgtttgagtcctaaactgaatccggagtatttcggaaacgcgattcaaagcgttcctacgtttgcgactgcggcagaggttttgtcacgtgatcttaaatggtgcgctgatcagcttaaccagagtgttgcggctcatcaagacgggaggattcgtagcgttgtggcggattgggaagcgaatcccaggtgttttcctcttggaaatgccgacggagcttcggttactatgggaagctctccgaggtttccgatgtatgataatgatttcgggtggggaaggccggtggcggttagaagtggacggtcgaataagtttgatgggaagatttcggcgtttccggggagggaaggaaacgggactgttgatttggaggtggttttatcgccggagactatggctgggattgaatctgacggtgagtttatgcgatacgtgactaataagtaacggagtttatgaataataacgttaacggtttttctctgtttttcttttcttgttaattaagaacttaacgatgtaagattattgtaatgtgactttgtaagttgacccttgaaaagaatgttatacatttgctatattagattgcgactagaatccaaaagtaacattagatagatcatcaatttgccttaaccagtctcgaggccaagataaacttcaagataaccaacagttacgatatttccactggtgtccaagttctgaagtttgatcttacggtacacattagcgtttgttttcatgggcaatgctgtatttgccctcccaatgaaaaatgcgtcagtgtcagctgaatttacactgaacaactccaaattgagaaaagatgaagccatgttttgaggaagatgcaaaacctcacggaactcaggatctgcgtttgttgtcacaatctttgtttggcgtggatcatcttcgttagtccaagctctcaacttgtagttgtatttttgttcaccaccgtcgccaattcctgatgctcctactaccattacgaataagtccattttttgttgttgtttctttgattttctctacacgtaagacatatataagggtgttagaatttatagtgggagagctaaaaaaagctaaattactttcataatagtattgaaaatataagctctacttagttttttttaaaacctccaattattgatgatgtgattagtttgctactgtattttgagtattacttaaccaaaacttatcataacatctatttataataagatttaacaatattttataatttgtgaaaataatttattgacaattatgattaatattaattattgttaattttcacacctgtatcaaaataaatgatggggaagtatgcacttaaatctttttaaaatggaaatatgtgtaagcacgctattagattaaaaactataaaatgccacacgcccaacctctatattaaagatacatctactcatattaatcgtgagattaaatttttcatgtacatttggtattatatccatcctgcactccaacttcattcaaatcattaacaatttatttacttctgaagttgtttattaacaattgatacctcaactgccaaagaaatgtttctctcttgttggattcttctgtccaaaagttagagatgggctttgggcctgtacaaagagctttaggcctaacctgaaaagtttaaaagaagctcaattaaagctagtaagcccatacgatggtgagagatagatagctttcgatccccaacagtcttactataaaatcaaagaagataattcgaagcaaatgaattgtaatttagttttacaaaacgagttatttaagaaaatgaggaaaatatttcagtcttaaaacatattttagtttgtctaacaatatgcataatgtagataaaactaaatcatgatttatctatgatactagtataaagcaaatatgtaaaccgagtcataccatattcagccaaacgtttaaaagttaaacaaaccacggaggcaaactaattatggaatgatatccatctttatatgctaagctgaatcaaataagaccgaacacgcagttcaagaaaaagagtcttatccagctaaaccaaactagtagtacatggaaggttaggcttccgtaatatcactcaattataagggcatatcagtcaattacatacctcctacactcctcattcctcaacgtcaacttgcgtgtctttctttcttcgaatgaacttctgaagcgaaaaaaagagagaattaaagtcattcattatttggggaatggagaagaagctcctttcctacagacgccatcattaacaacatcctcttaagcttctgcgattctctccgtttgtcggaagatttcacgacgattcttcaatccttatccgaaccggaggtaattctggatctcttcctccttggcattagaatcagcgattttcgatttctcttgtttttgctcataattttgttggtgttggaatatagaaatcatg

SEQ ID NO: 14105 - DNA, 3000 bp, Unknown
  misc_feature (1)..( 3000): cDNA_ID_1808500_gDNA_ID_2214700_Annot_ID_136848 3000 nt of promoter + ATG
ttgtagggaaacatcaaacatgtattaaaatctctagtgttgcgaatttaagtttatgctttcttgagtttctttaattgcccgtcattacgctactaaaatttcacaattttgtccgttttatacataaatatacataaacaaatacgtgatttttctctctttttctattcaattcattatagaaaataaatgacgtttttcatatttgcaactaaaacattgttttctttcagttttatgtggtacatgacacctgttatgttttacgattgttgatatatattcaaaacaccatgtgcatgattagttgaacttgtagctgtagatcgacaactatcaaaattattatatatttgcttcgatcaaaaactatctacagcttgtaaatattgctcataagtgacaacccataacgcatgactgactttcaaaaatgtatttgcagaaaattttatattcttatcgatcaacccctaaatgttatactacatcgcatatatcatcaaataaaacatttctatatatgtattaacatgttatgaacatgactgtgtgttttaactttaacttttattaaaagataatatcttaccaaaaacgagaaaatattcgatatttccttagaaatcagattactgaacattcgactaatcatcaggcatttacctttcatagaaaacagttcaaaaagcaatataaagccaaaaaacgaaaaaaagattatcctgaaattaatccacagtactggttttttttttttttaaaaaggagaccgcgtttctacgctgactttcaaatcagtcgcgtcggtattattccacacgccttttttctcgtccccatcctctatccacatttctctctatatatactctcctcgtatcctaaactcatcctcaaattcaaaatttaacacacaaacacaaacacacacaccaaaaaaaacacagaccttaaaaaaataaaaatggttgatatggattggaagaggaagatggtatcatcagatttaccaaactcacctaagctttcttcaaagcttcacgtaactattccatcaccgttcaaaatcgtccctgtttcatctccgatctcatgttcagcacctgctctttgctctgcttacgagctttaccttcgtctccctgagctaagaaagctctggtcatctcgtgattttcctcaatggacatcagagccgattctcaaaccagctcttcaagctttggagatcagtttcagattagttttcgccgtttgttctgatactagaccgtacatcaaccaccgtgaatggaaccggaggctagattctctcatcacgaagcagatccagcttgtagcagcgatctgcgaagatgaagaagaagaaggtatatcagcggaggctccggtcggcggtggacggagttcgttgagtttgttaccgcagctagctacgtggaggagatcagaggctttggggaagaagatcttatatacgatcgataacgagatgagtcggtgtaagtacacgctcggactcggtgaacaaaacatcgccggaaaaccaaatctccggtacgatgcgatttgccgaccaaacgagatctatagcctcaaggataatccatacgcagatcatatcgataatcacgagaatcaaactctctatatcattcaccagatcctcgaatcgtggatctacgcatctggaaatcttctgaatcgaatcgtctcaagtatcgaagaagagaaattcggaaaagcttcaaacgatgtttacttgctggagaagatctggaaaattttagcggagattgaagatcttcatatgttgatggatccggaagattttttgaaattgaagaaacagttacagatcaaatcgacgggtaaaaacgatgcgttttgtttcagatctaaaggattagtggagatgatgaagatgtcgaaagatctgagacagaaagtaccggcggtcttggcggttgaggtagatccaaccggaggaccaagattacaagaggcggcgatgaagctttacgcgaggaagacagagtgcgataagattcatttgcttcaggggatgcaagcggtggaagcggcggcgaagagtttcttctttgggtataggcagttagtggcggctatgatgggaagtgcggagatgaacgcgacggcgagtcaagagtcgtgtgactcactgagtcagatatttatggagccgacgtatttcccgagccttgacgcggcaaagacgtttctgggagagttttggagtcatttgggatgattaaattttaatttctgctggtataattatttaatataaatttaaattggtggtttggtttaatttagtttgtaagatagtgaaatttttggaacatttgacgatccatatttgaatacaaattcatttttatatgatttatgagattttttaacaaacgataacatttacgaatatcgtaatccatactttgaattatccacaagtcgtaattcaaatatgggtggtctactaacgagtaacgactaatctatatgctctgactaatcgtcaacaaatcaccacctatccttcgtagatgttagtgtatgagaaaaacacaatttcacacctatcctttgtagatgttaaattatgagaaaaacacaatttcactttcacagtgtataatattcaaaattcaatgataaacacacacacaaaaacgttataaaaaacccaaaccgacgatgagtaaccaaaccgatgtataaaacgacattgcctttctctgttttttgtgttcaacaaatttcattaagagaaagaagggaagtgtttgaatgagtattcattcattagtccaagaaaaacatttaatgggcctgtttgtaggcccactggcacataacctatcttctgtatcattgatgccttctcctaccttcctctgacgctcacatcggaaaccctaaatctccactctctcgcgccttttaccccttctcagaatcttaaccatg

SEQ ID NO: 14106 - DNA, 3000 bp, Unknown
  misc_feature (1)..( 3000): cDNA_ID_3021804_gDNA_ID_2214700_Annot_ID_189638 3000 nt of promoter + ATG
tggctgaagtacaagccaaccaattgcctgagaatcacaatgaagagatggctgaggaagaacaacccaatcaattggctgtggaaatacacgaagaagagaaggtgatttgtttttcttccttctcgttctctttctgtgcaggttcacaaatctgttgcttccattgttgggattcgttttgctggcattattagaaaccattgacagaattcttgaacttggtttacccaaatggtatgtaacttgcagcatgatccatcttttgtaatacaggagcaggagcaggacatgcatattgagtatggaagagaccaagctgatgagttatcaatcaatagcgaagcagtcaatgacccatcaccagcagctattcatttgggagaagcatcatcagattatgcacaaagttctgttcgaggtaataaaagcttttttactcatatccataccaatctcaacataagaaatgaaacattcttttactgcggtcaaaataattgattaggtgtggagaatcttcattgtggatggctaattgatgaggaggagacggatcctgaggaggaaacggatccagaggagaaggagaccgagccagaggatccaaaggagaaggagacggagccagaggaggatagtgatggtgatgatgatgagatcattcagcttactccagaacctctttgtgaagaacttcaagagcttctcagggaagtacgtggacagaagaggaggaagaaagagatgaggtgggacaagtaaaggagctatggagctcctgtaagtagcaaattgatatatatgttaggaagccaaatagtagtagtaagctatagtattgtggtgaaaaaaggtaaaacgacccatcttaacatctcttgagatattggtttttaataatttgtgatggagtagagaaagcagatagtctttatcagtagttgtatgagtcatacaatagtacccgaacccacttatccaaagatcaatgtcgaaagtggaaaccaaatccctctaaagtaaattgaatagccagtctaaaagttagaccaaatctgaaagtcggtttaattgcaattataccttctaaatgcaagaaccaatatcaaccggtacttcatattcttttgatttttgatttgtacatataaacttttttttgtacatataaacttaaatgcaagtatagcttgacttgtattttacacatcagcggaaaagtttgagagaggaagcatattgtatttcgtttggttacaacttttgctaacttttacaataaatggaatgaaatttttttccacttaattcctcctgaatagaaagaaattgatgcaattttgttccctttttaaatccatgagccaataagtgcatctccaattatattccaaatttcactctaaatactaatttagaaaaaatccttttaataccactatattctcaactctaaaagggagtgatgaatatggtatgatatcatctgtcacttcattttggagttaccctttactttttatttacaaaatattttcctaaatttatactcatgttcttcatttatgtgtaaacaaaattatataaatgaagaaaaagagttattgttaaccttctccatgttttcattataaattgatatgagcattggttaccgttctttcggataaaaacgaagtttatctcttgaaaacattgttcctttcatattcatatcgcatcaatatataattgaaaagttcatttatggtgatcgatcaaatatataacaaaataaaatgaaaaaatactttaacattttatatataatttttgaagacaaaagagctgtttttttgtctttaattgattggtcaactgtttacatattcatttttttggtatgaactatttacaaattcatgaatacaaaaaatatctcaaatttttttttacaagtcgatccacttagttcttaccgtttttttggtataaccattattttataaaacatcgttcccgctagatttttatcgcatcaaacatagcgtactacaaacggaaacggtcatctatggcgatcgatcaaatatacaacaccaaaatcgaatccaaaaaatagtttacttgaagtatttatatgttttgcttcactgctaattctatggttttgaaatcctttattcttctcaaaaaaaaaaaaagtttgtcaatggttgttgacatggtcttgcataatatgtggataaatatttgttttaatcattttcatcatcattgcatattcccaagtgttatcaattgtttgacaaataaagaaaaattaaaattgatacctttttattttagttaattaataacgaaactgaaaatatttctccctttgcatgcaatgtgggttttaaagacggaagctgaagagtgaagaagaacaaaagatttttgagagagaaaagtagagtcactccaaaattgttctctcgcaatcttctttctcggtttcctcttttaagaaaaagtccgccattttcactctcactcagatttcttccctcttctcacctgcaaaaacccttgtttcccgctgtttcgtttcttctccggttgaggaaccaaaacgggtcaaatacgcagctgaatcatcgaattcttaggtattttcgtcttacccaactcttatctttagatgtttttccgggaaaagagctcgatcatgactccgccgtgtttttttttgggggggggggggtttctccgaaatgggtttcaaatgtaggttactctaggtttgaaagttcggattttttggttcactgtgtgttactacagcttcgattttgtgtaaacgagtataaaaattgtatcttttacagatttgagaacttgttcttcaaagacttgatttttctttgtatcaagttagtgagctcaaatgtctttgtttctctgtttgtttacatctgataagagctaactcggtctcgctggtgtgtgattttcgctcgttagggttttttc

SEQ ID NO: 14107 - DNA, 3000 bp, Unknown
  misc_feature (1)..( 3000): cDNA_ID_2992340_gDNA_ID_2214700_Annot_ID_189637 3000 nt of promoter + ATG
ttcagaaaattcctcaacggagagaaattaaaaccagaaaggtagttttgatgaagaaacaaaatatccataaacgtaacaaagaaattctgaacgtgaaagttttaaaggtccataaaataaataggaaaggctggcaaaagataagacggtgtattttaaccgaacagatcaaatcccatgtccccatcagactcttctgcagcttcttcctcaacagctactgccaccactgctccaccagactctcctgaaaccggtgcagccactgcaactgcaaacttggttggatcctgatccataaatgtacagttaacaaacaatttcatgactactaatcccaatatctgaaacgcaaaatgaaagaggacaaacctttaggaactccttcacattctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaa

SEQ ID NO: 14108 - DNA, 3000 bp, Unknown; identical to SEQ ID NO: 14105
  misc_feature (1)..( 3000): cDNA_ID_1808500_gDNA_ID_2214700_Annot_ID_189634 3000 nt of promoter + ATG

SEQ ID NO: 14109 - DNA, 3000 bp, Unknown; identical to SEQ ID NO: 14104
  misc_feature (1)..( 3000): cDNA_ID_3021816_gDNA_ID_2214700_Annot_ID_189632 3000 nt of promoter + ATG

SEQ ID NO: 14110 - DNA, 3000 bp, Unknown; identical to SEQ ID NO: 14101
  misc_feature (1)..( 3000): cDNA_ID_2706036_gDNA_ID_2214700_Annot_ID_189629 3000 nt of promoter + ATG

SEQ ID NO: 14111 - DNA, 3000 bp, Unknown; identical to SEQ ID NO: 14100
  misc_feature (1)..( 3000): cDNA_ID_2706056_gDNA_ID_2214700_Annot_ID_189628 3000 nt of promoter + ATG

SEQ ID NO: 14112 - DNA, 3000 bp, Unknown
  misc_feature (1)..( 3000): cDNA_ID_2992578_gDNA_ID_2214700_Annot_ID_189626 3000 nt of promoter + ATG
cctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaagtcagttttcctcttttgcctttcctaaatgtagttattagtgttttgagagtttcatttagatatttagctagagagatacttgatctgaattggtcttcgttaaagtgataaagttaaaacgtgttgatggtttctgaacagctgagcaattattcatcaatggaaggagtggtgtattgtaggcctcattttgagcagcttttcaaggagtctggtagtttcagcaagaactttcagtcacgtatgtaaaactcttttcttcaccttctggtccagcttttacatgtggtcactttaattttaatcttcaaactttttttttcctttcacagctgcaaagccattgactgataagccaaccccggagctggtaaacgcttcttaacaacgatgtttttatttagttacacgacttgagatacatgactctatttctcttcttggttgttctcagaataggacacctagtcgacttgctggtatgttctctggaacgcaagacaaatgcgctacttgcactaaaaccgtgtatcctatcgaaaaggttagtatacatttaagcttgtatatgtcattaccattgctttccaatacacttttgtgttctctctgtgattgttgtcaagaaaatcacagttaaacttatttggatcatttgcaatatgagttacatggatccgaatcacataaagttgagatctctttaatacagtcaattcttatatctcattgttctgttttctaaaaattgtaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgagtttcttgtttgtgatactactacatctataataaccgaggacttttggctttgatcttggtcttttgagctggaccgaaccggaatgttagaccggacaaatctctatcgttactcgtcgttagtcatctccggtccggttcttcactaaagttaaaaatccagttaaacagaaatcaattaagaaaacacaaaacccaaattgaattgtgtaaagatatgaactttacaaaagaaaattgtcaatttcgaaaa

SEQ ID NO: 14113 - DNA, 3000 bp, Unknown; identical to SEQ ID NO: 14099
  misc_feature (1)..( 3000): cDNA_ID_1808783_gDNA_ID_2214700_Annot_ID_189625 3000 nt of promoter + ATG

SEQ ID NO: 14114 - DNA, 3000 bp, Unknown; identical to SEQ ID NO: 14098
  misc_feature (1)..( 3000): cDNA_ID_2710916_gDNA_ID_2214700_Annot_ID_189624 3000 nt of promoter + ATG

SEQ ID NO: 14115 - DNA, 772 bp, Unknown; identical to SEQ ID NO: 14096
  misc_feature (1)..( 772): cDNA_ID_3021834_gDNA_ID_2214700_Annot_ID_189620 3000 nt of promoter + ATG

SEQ ID NO: 14116 - DNA, 3000 bp, Unknown
  misc_feature (1)..( 3000): cDNA_ID_2992340_gDNA_ID_2214700_Annot_ID_136851 3000 nt of promoter + ATG
ttctcagcctgagggaaagagtactcagtagctaaggcaacagcaagaacgttcttgtaagcattgaggaacatgtgaggcgcagctgctacggttgggtaagagattgcaagagaaagcgcagtgatcatcgagacaccagctgcaaacttctcaacaaggtcgtcttcagtgaggttaagcacttcagggttaaacactgacccattatcgtagactgactcaacaacgagaccatacgaaaagggcctgattccaagcttggcaagaagcgcagcctcggatgaaccgactttgtcgcctttcttgatgagctccacaggggttatgatctcaaccgtacctttgttgattttggttggaatgttaagcacctggaagaaggaggtctgtgaagggtcaagaccagtgttgcctggttgcacgaccacatcaattggagcgactaaacctacacgagcaggagctccaacctgtcaaaaaaaggacaatgaatttctcatcaattaacagtacaagactaagttgaaaaaatcaatcaatccaacaacatgaaaggacgctacaaaaatgtgagcctaggaaactagtagactctcaagtaagtttcttgaatgtggttgcgtttcaagacagaaaatagaggttttgagttccaatttaaaccaaaatgcaaactttatcacctatccaccttacaagttaataacctaaagccataggttaaaggatgatcataaactgactaaatcatcaagtaacagtagaagctaaaaataaaccaatcaatcaaaacacaaaacagaaactacaaatgtcgtctcctcaaacctcaatgaaccaaaataactagtactataatctaatcaaccctatttgcttggaaagtgaaagtttgcatttgtgtttaaaatcgaataatacaacaccttgcattcttgcttacttagagataatcagatacagcataaaactaaccaaactaagtaataaaccaatcaatgaaaatgtaatctcctcaaagctcaacgaatcataataatctcaattagaatgtggctgcattttaagcaagaacacatatgatttcatttcaaactcaaaaatacaaactttcactttccaagctatcaatccatatttgaactctactaaagcttaacaacaacaataacatcaattgagccaaagaaacaaaccttgtacttagcaacctcttcactgacttccttcaagtcacccttagtgaagatcaacccaacattcccctgttaaatagattctaacaccaaaccaaatcaaattctccacaaaaccaaaaaatcaatactttatatccaaatgaaaacaaactattcaagacaagagaaatgaaacctgaagaagaggaaggagactgaggaaagcttgattgccagttttatcagcatgaatcctcacagatctcttcatcattgtgttcttccccatcaaaacaactgaatcacctcgtaaacctttccttatgttctgaagctgagttgatccaacattgtcagctgcaacgacaagaatctgagagtactcattcaaaagctgacaaagctttgaatcgtaaacgatcttcttctccgcctttgttgctttcaccgccatttccacttaaaaatgataaagtgagactaaagaaactaaattttggggtagagaaaatggagggcctagacgaagcttggagctcgtacaaggtggacagcgcgaattggcgctgtctctttaacctctgtaactgtttttaacagaggaaggaagagagaaagaaaaaaagctgcgtaagaatttgcttaaggttgaagaagaagtttcttgggtttatatagttatcggaagacggaaggatgaacggtcagggtttgtgggatgacctaaatctaacggcttatattatttgtagtagtatcaatgggatgggccaatattgcccaacatgtttaacattatgaatctttttcctattgggctaaaagctctttcgacccacatctcaagcccaactgagatccattcattgtaattcatactttattattttttatagtaaccaataagaaaatggttgacttaacagagaaaatggttgacccaaacaaatactatattatttttttaattcgatttcattcaaagaagcatttttgggagacgaggaggcgatccacggcttattcttaagaaaccttccacagtcgccgccgattttatcttctccgccgtaagtactctctttccctatcgaatctgaacgaaacagctcagcacattgtcatctctgtagcaaaattaagttcgtgtttttgtgttttgttgtgattctgtttaggtttcatttgggtttgaattttagggtatttttggtttatctctagtgttactgattcgggatttttgggaaagagctcaacttttgttttgtttcatctttcgttgattttgttgttacataggtttgaaaaaagggatcacttgtttggttgcctttgtttgtttgtttgattataacccaaagacttatacttttggtcctccaatttcttctgaaactacagggaattgtgagggatcaacaaatggctcccagaggaagaagaaaggtataagctgtactgttttttttgttttgtttttccaaattaaaatgctggctaacaagtaaagatatgagcttttgaatcatatagtttttagagagtatagtggaaaactaagataaaagcatagacatagacattagagtagaatgactatatagatgaagtatttgaatgacatgattgttgaagttaacattttgtttctctctacgacttctgtgtactcaacgttgagaacactgatgagataagtttacaaatacttctttttatgatgggtgttcttgtttttttccttctatgattatctctcttttctatgcttttaaattgctacttttcttttgcttttttgcagaaggctggattg

SEQ ID NO: 14117 - DNA, 3000 bp, Unknown
  misc_feature (1)..( 3000): cDNA_ID_3021804_gDNA_ID_2214700_Annot_ID_136853 3000 nt of promoter + ATG
gtgtccatttgttctaccctcagtctcttagtgctaaggcagaggttatggagctcttctctgtggagaagcaactgcttagctcacatactggacagctgattttgcagatgggtagtgattctttactgtctttgagggtaatgctggagcgggtatttctggacaaggcaactgctcaacagttagctatgtatggctctctgtccctgccaccaccagcactaaggaagtccagtaaatctggcccagcttggacagttttccagattctacagcttgcctttccagaacgtctgagttgcaaaggagacagattcctggttgatggaagtgatttgctgaagtttgatttcggggttgacgcgatggggtccatcatcaatgaaattgtaacttcaatcttcctggagaagggtccaaaggagacacttggattctttgattcgctgcagcctctattgatggaaagtctgtttgctgagggatttagtctaagtttggaagacttatccatgtctagggcagacatggatgtaattcacaacctaataatccgagagatttcacctatggtgtctcgcttgagattatcatatagagatgaattgcagctagagaacagcatccacaaagtgaaggaagtggctgctaactttatgctgaagtcatattccattcggaacttgattgatatcaagagtaactcagcaatcaccaagctggtgcagcagacaggcttcttgggtcttcagctttctgacaagaagaagttttacacgaagactctggtagaggacatggctatcttttgtaagagaaagtatggcaggatttcttcatctggtgattttggaatagtgaagggctgcttctttcatgggctggatccgtatgaagagatggctcattcaattgcagctagggaggtaattgttcgctcttcaaggggattagctgagcctggaaccctctttaagaacctgatggctgttcttcgggatatcgtgattacaaacgatggaactgtaagaaacacctgtagtaactcagtcatccagttcaaatatggagttgattctgaacgtggacatcaaggtctgtttgaagctggagaacctgttggagtattggcagctactgccatgtcaaatcctgcatataaggcagtgcttgattcctctccaaatagtaattcatcatgggagctaatgaaggtatagcaatatcaaatctgccttctgaatacagctttgttcatctgtattgttgtgtaattgttttctgtatttgttcttttcccaggaagttctgctctgcaaagtcaatttccaaaacactactaatgatcggcgcgtaatcctttatttaaacgaatgccattgtggaaaaaggttttgccaggaaaatgctgcttgcacagtcaggaacaagctgaataaagttagtcttaaagatactgcagtggaattcctagtcgagtaagaattgggttttagtaacttcagtcgctctttttagtgtttgtgttattttttttttatggttttactaaacctctttgcaatctgctttctctttacttgcatgaagatatagaaagcaaccaactatatcagaaatttttggaattgattcatgcctacatggccatattcatcttaataaggtttgaatctggttcctttactgttgaatctttctggaagcctctacctgtcatagaaacactttcctattatccttttcttgctgtgtaattggtgtttttggtttactagacattgctgcaagattggaacatcagtatgcaggatatacatcaaaagtgtgaggatgtaattaactcactaggacaaaagaaaaagaagaaagctactgatgatttcaagagaacaagtttgtctgtcaggtttgtacaatgatttgcttttcctctggatgtcgtctctggttgaatgttatgcataatttgtccagaaagcaagtctgatgttgatttctagttttccagttatcttctttccatcatttttgttcttcatagcataatgtctagctttggtttctacctgattatgattgatttattctccaatgaacagtgagtgctgctctttccgagatccttgtgggagcaaaggttcggatatgccttgtttgacgttctcctacaatgccaccgatcccgatctagaacgaactcttgatgttctttgcaatacagtttacccagttctgctggaaatagtgatcaaaggtatttgaataaaacttttcatttttgtatatttcgcttgtttccctacacttcgatttcttctttgatgggggagcagtgtatctgatagagtcttcctttcaaaattttgtagttacatggcttacgaaattttgttttttgccagaagtttaatgaaccaaaatattttctcaactagtctgattgaattttcctccaagttgtgatcgatattctgtgctactataaaagaaagcctatgttttagtaagatttctagatacatgtttttgatgatactcctgtatctaaactgagcaggtgattcacggatttgctcagcaaatataatctggaatagttcagacatgacaacgtggatccggaatcgtcatgcatcccgccgaggggaatgggttttggatgtcactgttgaaaaatctgctgtcaagcaaagtggtgatgcatggagggttgtgatagactcatgtctttcagtgcttcatctaatagacacaaaacggtcaatcccttattctgtaaaacaagtgcaagaattgcttgggttatcctgtgcttttgagcaagcagtacaggtacttactaacttaaaacgtgatccgttcctggatcttacacttaagtcatgatacttcttacatatttcatgtttggtatcacatttgctcattgtttgtgtaaggattttaaacgtaagatgttgatttgatttgcagcgtctatcagcttcagtgaga

SEQ ID NO: 14118 - DNA, 3000 bp, Unknown
  misc_feature (1)..( 3000): cDNA_ID_2710950_gDNA_ID_2214701_Annot_ID_136865 3000 nt of promoter + ATG
gggcgataattataaatatagcagaaactctataaattaataatgataggaccacataattttattaatttatataataaattaataaatattaattaataagataaattaataaatattaatttaaagaatatttacgtaaaacacaatattatttttttttaaacaatatttttaatttagattttctcgtattttgttgtttgtatattcaattatgttatatattttattttatttttgacttttttaatttattttcttacaagatattgtgttcgtatatctacgacgttaacgtatagcttaatccaatttttctttacacaaatcttaacaatgatttttcatagaaaaaaatgttacaaaaccaaatatgatggatcaaatactcaaagagttgtgtgagtacaaaagagatcataccaactgtaatctaaaaagaattgcaattgtagttttaacaaaagtttcatataaaattagtcttaaaatatttgtttaagatctatgattattaatttatgatattattggaaccatatttttacatagaaatttcaaaaaaattattatcttattatcttatcgattttgcttaatttttacattggcccgacttgagactagcaaaattaattattttattgtatttattaatttatcgagtattaatttatagagtttccactgtatgtgttttgttgttaagtaagatttgtgacagtaatggtgatagtgtgacactatttaagcagagtgatatttgaattagtaatgatttggtttgcttggttaataaattcttaaaaatgaacaagtttttttttttgcttattttattatattcatcaaacattttctgaaatttttctaacaaaaagagacgtaaacagtcaaaataaatttgttgccttgcaacgttgcaaatttcaaaatctacttgaaatctagaaatatgatttctaccacatttcgtcttccgtcgtgccaaaatctatttaaaatccaatttgatcaaatccaaaaggcaaaatttcctacatacagtatttatatatcacacatgacacatgtgcactattagtatttataaaataaatgtcaatgtcagcattttttttttgtgcaaaatcaatgtcagcatattcctctgtcctcaaatctcaatttgcttcttcttctccttcttgattacttaattaatcacaattattagtaaggtaaacttcttgtccaataatttgtgatacagtcactgttttgaagttgtcattaatgatgtcgggtatcatcgacaaatctaattcgctaactgtgttattagtattataaaattacaacaagcagtgatattgtaaatattaatatgctcatggaccacttattttgtgcaagggggataattaacaacacattcaattcaaaaacatattaataagttaacataaaaatagtagaattatcattcattgaatcttctaaccaaatgatactcatttttgtatttatttctaataaagtaactccactatgaagaaaaacaaacatatatatttgtagatgaaaactatatcaagatatgtaatatttctatgctaatctcgcagttgtgttactatctaaatttaaatttgcatattgtattatcgaattttgtggtaactcgagctctttgttttccaagaattttctttcattctttgtaatgtaggttcgtctgagccgaatagaaaaggataatgagagaatcgaacattggtaacaatccttccataagaagatcggttgatcgactatcttcttatggagtatccgattatctacgagcagtataccctcaaaatagtttgaaagtgataaaaaataatgacaattttttttcaatgattattttataccttctgatccgcttgatacctctagataaaatatagtagtacaaaaaaatttgaaaatacatttttgatacggcttttttgattaataattattaaaacattaaactctatactgcattgataccaagttatttaatttactaatcaaaacttcttttctttttcgtatctcctcagctggtatggaaaattctttcaaacttcctcatttcttcttccactagttatgtttggttttgcttgattcttaattgcataattagaaaatgtcacacaaagcatttttcctaactatttagactcctattaacaacaccattggtttaggtcaagattgtgttacaccaataaatatccattggccattgcttccaaaagaatatgtttgacctaacctaacggatgagaaagaaaactctttttgtttataatattactaatcaacaacgacacactacataaaaagatttacaactgttacaagagatagattcaaaattttgagctccaagtagctgggatgattatgatattcccattgttttactattcgacaaaaagtaatacaagtatggtcattgtgttgagtggtatagttgacatattgaaccaatcgatttaatttaatttcaactacttcttaaaaaatttaaaagcaatttaagcctattcttcttcctttttattaaatgtacacattaattgaacctatcatatcatagtatcaatttaaaaaaatacaataaaatcccatcattagtgttatctaaaataaaaacactaattatgacgtgatcttaaattaatttttagataaacaaaaacgaaaacagaatcacacaaatgatgacgtggcaattccctacgtgtaacaccacacacagtaacgttcctctcctcactctaagcccaaaaatctctctttttttttttttttatctcgcgtttataagaatcctctctctctctctctcacattattttctgtttggaatcttggatctttctttctgagatcattcgtcttttgtactgattttgagagatttcatttttgtttgtttaccgatccgccgccgtggatttttgttttccgatg

SEQ ID NO: 14119 - DNA, 3000 bp, Unknown
  misc_feature (1)..( 3000): cDNA_ID_3021839_gDNA_ID_2214701_Annot_ID_136866 3000 nt of promoter + ATG
ccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggtatgaatatgaagaaacagatt

SEQ ID NO: 14120 - DNA, 3000 bp, Unknown
  misc_feature (1)..( 3000): cDNA_ID_2686544_gDNA_ID_2214701_Annot_ID_136867 3000 nt of promoter + ATG
ccttgcaatcctctctacgcaacttcgctcaatgtcttttgaaccatgagcagcaaactctgcaagatcaatcgtcttgcatatatgtatatatttgttcgtgtgtgtctctgtacatgtcatgtgttattgcttctatattaatggatctggactttggtgtggttgttgatttgtaactgttgaataaaatctttctatggaacactaatttcttcttgttccatagatgataagtattcttgttctatattgtattttggtggctacagtctacaattctacgcattagaaagatttaatacatatcaggtgcataatgagtctccatttatcttatttgaattacagaattgttgctgaatttaatcctagcttatatactttagatagtagatttgagtgactaataaccagggtttgttatatattatccttcaaactaaatcatacttaacatgagtttctttttttcttcatttaaaattttgtcaattggtggttttgcattgaacttcttgctttaggtctgaagcttcatactgttttaatctgcataaattgcgacagatatttcaaattaggagtatgaaaatgtaaaaaaggtcttcaagatttttttttaccatagacttttttattttttcatgataacattaatatgaccttctttttttttaacatcaacataaatataccttgtcaccacaatattcttagtttcttttcaaaaataaaaatcgtaatttttctattattacatcatattttgttaattttttaaaaaacaccacatgcatattactgtagcttcacatattggagatttggttttgtatcacgacaatggttttgttgtttgagtatcagtttagataatgcatgtcaattggttcaccccacaaaaaggcagttgttcattatgtcattttcaagctacacaagtagatcatcagactctcaaccatcagcaaagcagagcaaccatgataattttaactcaatagtcacatttggattgcaagcatgggtggatgtatgttaggagtatgtgggacacgtgccccacattgattataatgttttgcgagtattagagtttacaatggctacttagcatctttggtcgtaatgtagtaaagtattaccattcccatgtttagatccctttgatgttgcaatgttttctttatgtgtttattagttatccaaataacattattctaatttcttttttggttggtctttcttataaaaatgtcaattctaagttttgttatcattattttgtattttactaatcaaaaaaatataatattgaaacaatatatatatatatatatatatatttgaaataaaacatatattttttttgtgccccatacaaaatacatgtttagatttgtcactgattctaagaacttattttgtagaaaagtaattttcttaatattctatgaatctttcgaatatgttatgcatttacgttggaactgttaggtttctcataaaacattgtaaaactaaaatataataaggggtgtgtggaattttggctcaaaaagattgtatactttgccagatttattgattttgagactatgttgtgcagcatgtgcacaaaatttgttgattttggtaatagtgacaatatagatccaaagatgatttttaaaaaaattaagtgaatatatagttcatttttatcgtaaataattggttaaattataaaattaaaatattgtataaagagaaattaaagcgattgtaccattgtagcaaccacaaccagcatatatgtttgctcaagatttttaagttgttttatacacgattcaagcatatgatcttaatatcaaaaaggatatattaagtttaatcggctttccattttagttggtagcaattgtaaaaatttaatattatatccttatttattaaatattattattacctaaccttttttgattaacaataatcataaaaaagctgaccatctcaatttgaagataaacaaatagatttaaagaagtgatcaaatcatgtattggtaatgtctaacatgttcttaccacatcttaattcacagataaacatatacatatacattgaatatgtttttatataacacatggttcaagggaacaaaggtgggataaatcctatcatattttctattcttgacttaccttcataagtatctaggttataagtttaaattttctttataaaaaataacaatataaaaagaaacagttaaatttgaaatttactactttttaacaaaaattattcatccatctgtcattcaagtatcaatatagaaaataaacaaattcatgttgtcagccatactgcatgaacatgaatttcttttatctttttactttttttcgtaaaccctcaaaataacatcagtaaaaatggatagcaacataacagataaataaaaaccaaaaacaaaaacaaatccagggtaagttaatatgaaacaaatgcattagatcaaaaacttatttattagtgtagcaacttaaacagaaataataagtctcaaagttaattttttttttaataccaaaaattatatcttttatattttgaatgaccacgaatatctttttcacttgatcgataaaattacatcatacagtacatcttttctaaattaaaacaaatctaaaacatggttaacaaaacaaacgggttaaatgtgaataaacaaaaagtatcgggtgcaaaacataaaaagacaaaaataaaagactgagtccaaaattccaaaaagtcaaagccaccttcctaacttgtctgcatagacgaagaagacaaagaagaagagattcgatcacacaagaaaaattacaattcttcttaatcctcattattatatatataaataaacttcaatctaagcttcttcgtaatttctctttcgttcaatgttattcttttagatctcgaacaaaacaaaatctccagaagaaaaaaccaaattcc

SEQ ID NO: 14121 - DNA, 3000 bp, Unknown
  misc_feature (1)..( 3000): cDNA_ID_3021876_gDNA_ID_2214701_Annot_ID_136871 3000 nt of promoter + ATG
gattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagtatggtttggtactcaagctgtagaattttgtttctgggtctgcttattttgttggcttcgagctgggttttggatagatgcgagggatttggtgaatttgggtttgaatttcatcatcgtttctccgatcaggttgttggggttttgcctggagatggtttacctaatcgagattcttctaagtattatagagtg

SEQ ID NO: 14122 - DNA, 3000 bp, Unknown
  misc_feature (1)..( 3000): cDNA_ID_2710928_gDNA_ID_2214701_Annot_ID_136873 3000 nt of promoter + ATG
tgtgaaagggtcagacttggttgcagcgcaagatccttcaagacatttaaaaacagtacaacacattggatgagactacgggtgacttaagccaggtttcttttattctcagctggaatataaatctcttgatcgtatattttaagatagcctagttagtccaacctggctttcttcttgtgaaggattgaaggaacattcattacagctagcaagctttaagcattgctggattacaccaggcatgggagctgtgggcatatggcgcagagacatagaaaccggtactctattcttgataactgtcttagagctcaagtacatgtctcatgaattggtacacgagaaaagtcctttatagttattgagctacagagtataaaaaaggttcatgtacaaaacatgctctcactggtacatacgtaactgagtttattttggtgaatggacaaaatatgcactcactaatttattttctcgacatttttatattatttgtatctaaaatatttgttggatatttgccaaccaacacgatccgataatgaagtttctaaaaaaaaaatctaaataaaaaatcaatagtatttcaagaatatattccaaattaaagggtatattatcatttgtatttctcttttaataatgtagagatagattttagaattaaaattttttccttttcttataaatatatgaacaaatttaaatttggcatgtctctcatttatgttaatgactaactttccaaaactaaaacttatataataaaattactaaatatataaatattaattaatataaaatgaatagaacaaatcattatatactatatttgtcttcacaaattataattgtattgttagagaaaaaaagaaaagaaacaacaatttatttttctatttttgtgaaaccctagatttgaacatcgctcatttcttcttcctacctctccatagatttatcatccttcaacaccaattttgttattattattcatcgcttctcctcatagatttatgatgagtaaaccgagatggtttcaagtattgacagaggaagacttagatggaaactaccaaaagcatacttgtggtttccgaaaaaacatcttcaggttcgagtcctgcgacgtagtgtgccccgagggcatagatcccaaccatattcaacctcatgttcaagtatgttctaatttttttctatatgccctaattatatatattactttatcataaattttgcatctttgaatcagtgcaggtgtgcaccatgcttgatcttaacgcctttgaactgaaccaaatctctgatctctttgattgttcccaaattcaagtaacaaaatagacaaattgttctcatccaccaatttctctaaaggtaatttatttaaacacatgattgatattttttttacagaatcatggttacgttggagggaagcagtttataatgttgaggccatggagagactgtgtaagaaatacagaaggttgcactaaacatgtccaagggattaattccaagttctgcactttcacctgcaagatcgaacatgttttggagcatgaaggtgatttgtccagcattactagactttggtcgtcggaggatgattcgagagaactgtcagaacacgttggtgatttagcaatccatccttgtggtgatccagagagaatctttccattaaagaagaggtctcgaagaagaagagagttttttgacagctactacgaagacatctatgcatcatactagtttccgagatatctcttagttctattagacattgttcacatgtttgttttgtggaaatacagtttagcatattatcaggagattgttattcttggtttaaaatctacatatagagaacccttctcttcctaacgatagctaagcaggaaacatcatacaacggtacaaactagcaagtgtgcttagtgatatgtctgaggcaaaccaaatgagacacgtgaaaaagaattagttgttttatcaaatgatggaagatagttatcacgaagggttaaataccgattagggatgaatttgagtttttggtacggtacaaagtttgttaattggttcgagggactaaacgtttaatttgtttgttataggtgcttgtgacaagattataaaggtaatgagataatgatataacgagttaactaagtgataaagaacgggaaatgaaaagtaacgtaataagaacaatgatgatgagtttgatttaccataagtggtgcaagctacgttgatggatgatgcttaacgatgatggctgcatgttttacactttttttcaaaataaatatttagctaaaaactcacgcgtaaagctaaacgcggtagaatggctaattcgtaatttgcaactcgtgcaagcagactccgacgtggcagtgaaaaaagaataatctacattcgataatacgaccaaaccatcaccgaaactctcgtgactcgtgtactctcacgatcacattagctactccactatcttcttattttcttcttctttttttggataatcactttgacctctcgttccaagactaataccttctccacaagtaccatctctgtaattcttgactttcttcaacctatgaggtgaagcatttcaacactatctcctctcttacaaaaatattctaaatttctatgattttccatgtttgttcactttgatttcactctccaagaaacatttttttctccgatgagtttacacttaaacagataaaattttcactttaagaaaaaaattcttaaaatgttctctgttttgaagatctttaacgtagtagagaattttattgtcgcagtcgaaccataatgtgattccttggtaacttcaaatctctttgttattcataatcagaatctgttcacacgaggtaaaagtctcaaactttcttatgttctgcttcgttttaggtctcaaaatttgagtttttgagctgtttttggttaggaagagaaatg

SEQ ID NO: 14123 - DNA, 3000 bp, Unknown
  misc_feature (1)..( 3000): cDNA_ID_2991474_gDNA_ID_2214701_Annot_ID_189680 3000 nt of promoter + ATG
aggaggagcagaattctgttgcgcttctcattcatatgttatataatgatgacccagaagagatgtttaaggtgcattgagctcttgcacattcagattcattaatgtgtgtcatatctttatgctgactttaggctttctagttattggcttacattaatatttttaatgtttaatggcatttattcccagttgcctttattctttgtttgtaattttcaactgagacatagattatacttatccccaggagtcatcatttccttcaaaattctattaaggttttggctttcagtgtttgaagctgtttaattgaatttcagatagtcaatgtcctgaagaagcatttcctgacaggagggccaaagcgcttaaaattcaccattcctccccttgttgtttctactctaaaggtttgatttcttaagcgaagttattctttaaagcccctcataatttatgttgagcttaatttgcgatgacatggtttggttgtttctatttatgtgccataccgcatagaagagtatctgatatagtttgttaattttgttcttcttcaaattctgtaatttttgttgtctgttttgtttaaattgtagctaatcaggcgattgccagtggaaggagacaatccttttggaaaagaggcttccgttactgctactaaaatattccaatttctaaatcaggtaagtttcataacttttcactgccttgtgtgttcagatctgtttttaggtagaacaatgtgtctcagagctacattacttttttaaaacttagccaaagttagttcatacaagctgattgacaacgttgaaaattctcaatcaacagtttgtagatattagctaaagagactgctgttattgctctgtctccactacagtcatcagttcttgtatttattgttggatttttttgcttgttgcagattatcgaagcgctacctaatgttccatcacctgacctggcattccggttgtacttgcaatgtgctgaggtaaaactacgtacctgtttatttagtatgcacttgctcggtaaaatgctcacagatctttcctatttcatcaggctgcggataagtgtgatgaagaaccaattgcatacgaatttttcacccaggcatacatcttatacgaagaagaaatttcggttagttatgttttcgcggacgttcatatgtctcgtgtctaaaccaaagcaagtaggtgagtttaactctctctcgtgcgtcaaaaacttgccttttgaacaggactcaaaggcccaggtgactgcgttacaacttataattggaactctgcagaggatgcaagtatttggtgttgagaatagagatacattaacgcacaaggctacgggggtatttcatcatgatatgataattagtctcttaccatattcaattgtctctgcttaaaggctgacaagggaaaacttatactcttgcagtatgcagcgaaacttctaaagaaacctgatcaatgtcgagctgtttatgcctgttctcatttgttctggctggaagatcgtgagaccatacaagatggagaaaggtaatactttcttctgtgcgatagaacacagtgtgtttaaaatagctcattaggtttcttacttgaaatcagggttctactttgtctgaaacgagcgcttaaaattgcaaattcggctcaacaagtggccaacacagctcggggtagtacagggtctgttaccctcttcatcgagatactaaacaagtaagcgctttttattgtttgttttacttctcattttcccagatcagcaagcagcattatgtaatgtgaattatggcaggtacctctatttctatgagaaaggggttccacagataacagttgaatcagtagaaagcctgataaaactgatcaagaacgaagaatcgatgccctctgatccatctgctgaatcattctttgcaactacgcttgagttcatggagttccaaaagcagaaagagggtgccattggtgagagataccaggcgatcaaagtatagaatctcatgttggtcaaaagaagtcggtttgtttttattaaaaaaaaaaaaagctttgctttgagtcgtttgagaatcggaaagggactgatattgtgttgcttgctgctcgaaatgtaaacccgggtttaggtctagttttattcctcggattttcaaggcggttcatggtctgtaacttgtggagtttgatgtgtgtttatacgaatctttagtattctgagtttaacattggatattacatattagataatgtccttcatgaaaaaagtattcattttatgtattctgttgaatgattattgacgcataaaaacattttcaataccattgtataacgcataattaacaacctttgtgaggcttcagccttcaaatatatcaatagaaattcagtttacgaaatcaacttaaaaaattttgaaaaaataataaaatttaaaaaaaaaacaaattgtaggttaaatttttttaaaaacaaaataaaacagaaaagaaacgagaaaaaaaaaaagcaaaacaatcggagaaagttgatggaggagattgttcgttttgtgaacgcttcaatggcataaatttccggccatcacatttcttctactttctctttctctctcccttgttgttgttctctagaattcgattcatcgttgttaacgtcgtccattcttcttctttgatcccttctttgatctctcacatttccgattccaatttagggtttcctctcttttcacatttctagggtttttcttgttccctttgtaccggagatggtgaattgaaaggaaaaataaaacgcttttgagagcttatatttgaggttgtttcctcaggttttgtagatctgaggttgctatttttgaattagagattcttttttttttttttcaaaattttgtttgttgtgatcatacatagacgtacgtagctccatttctggtggagaaggaagaagaagagaa

SEQ ID NO: 14124 - DNA, 3000 bp, Unknown
  misc_feature (1)..( 3000): cDNA_ID_3021858_gDNA_ID_2214701_Annot_ID_189679 3000 nt of promoter + ATG
cttcatgctccaaaacatgttcgatcttgcaggtgaaagtgcagaacttggaattaatcccttggacatgtttagtgcaaccttctgtatttcttacacagtctctccatggcctcaacattataaactgcttccctccaacgtaaccatgattctgtaaaaaaaatatcaatcatgtgtttaaataaattacctttagagaaattggtggatgagaacaatttgtctattttgttacttgaatttgggaacaatcaaagagatcagagatttggttcagttcaaaggcgttaagatcaagcatggtgcacacctgcactgattcaaagatgcaaaatttatgataaagtaatatatataattagggcatatagaaaaaaattagaacatacttgaacatgaggttgaatatggttgggatctatgccctcggggcacactacgtcgcaggactcgaacctgaagatgttttttcggaaaccacaagtatgcttttggtagtttccatctaagtcttcctctgtcaatacttgaaaccatctcggtttactcatcataaatctatgaggagaagcgatgaataataataacaaaattggtgttgaaggatgataaatctatggagaggtaggaagaagaaatgagcgatgttcaaatctagggtttcacaaaaatagaaaaataaattgttgtttcttttctttttttctctaacaatacaattataatttgtgaagacaaatatagtatataatgatttgttctattcattttatattaattaatatttatatatttagtaattttattatataagttttagttttggaaagttagtcattaacataaatgagagacatgccaaatttaaatttgttcatatatttataagaaaaggaaaaaattttaattctaaaatctatctctacattattaaaagagaaatacaaatgataatataccctttaatttggaatatattcttgaaatactattgattttttatttagattttttttttagaaacttcattatcggatcgtgttggttggcaaatatccaacaaatattttagatacaaataatataaaaatgtcgagaaaataaattagtgagtgcatattttgtccattcaccaaaataaactcagttacgtatgtaccagtgagagcatgttttgtacatgaaccttttttatactctgtagctcaataactataaaggacttttctcgtgtaccaattcatgagacatgtacttgagctctaagacagttatcaagaatagagtaccggtttctatgtctctgcgccatatgcccacagctcccatgcctggtgtaatccagcaatgcttaaagcttgctagctgtaatgaatgttccttcaatccttcacaagaagaaagccaggttggactaactaggctatcttaaaatatacgatcaagagatttatattccagctgagaataaaagaaacctggcttaagtcacccgtagtctcatccaatgtgttgtactgtttttaaatgtcttgaaggatcttgcgctgcaaccaagtctgaccctttcacattttgatcaggttacttgtgtgtttcgcactttctaaaaacttcatccaatacatgaagcatggcgttatagctctcttcagataaagatggctccttactcaatttcaaagaacggacacagagatctgtgccaccgttgagatactaagaatataatttctctatatttttgcatcttttatcacagttgacacatactgagaagggatactaagaatttaagttatttttctttgaatataaaataaatgtggattactatttattattcaaatatcatccatacattttatatctaaatatagaatttaatttctctacatttttgcatcttttatcacacttgacacatactgagaagggatactaagaatttaagttatttttctctaaatataaaataaatgtggattactatttattattcaaatatcatccataagattgagtgtgtaaaataataatagaatgcaaaagactgaaatgaagcaaattttattaagttaaatatcaaagaaaaaatattgattactattgtactattcaaaatttaaatattatcgatcaaaattatttttttttaccttacacccgcctaaatatgcggatcttatctagtattctataatactaagttactaacattaaagaaactaacaaaaattttggtccaagaaaaaattatcaatttttttgtttcaatgattgatcgaccatttcctagattccaaaggtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgaga

SEQ ID NO: 14125 - DNA, 3000 bp, Unknown
  misc_feature (1)..( 3000): cDNA_ID_3021862_gDNA_ID_2214701_Annot_ID_189678 3000 nt of promoter + ATG
atccctatcctttctatctttttcattcctcttgtgttttctatctttcttcacttcctcctttgccccctggatttccaaaccaatgaaagaaacaacaataagtgtccataactttcttatccagtaaacctccaaaggacaaagaaggagagtagaaacacacaaacaatgtagaaattgtcaatgacttactctacttctataagttttaggaggctattcaatttcaaccacatttgtcagtattcagtccaatgaatcaatttcatgctttgagataaattagttaactttttaagtaagatttgaattcccatctatatggcaaattacttctccatgataatcaaagtttccaactttgacaaaagattatcaaaatcaaagaagcaggaagctgagcaataaaaaaatcacatgaaccaagaacataaaaaagaaccaaagtcatggacttttaaattgctcaacaaatcaaccttgatcgattcgatcagactttctttccaaacataaccaggtggtggaaacggataacaccgagacattctcacacgatcacaaacaaacaagctcagagacgaactcgcgaaaaccctagattggtttacgagggaatcgcaattgggtttttactttgggggcttttgttatccagggatagtgataagaaaatcagattcgggagattgaagaatttggtattgaattcgagatcagagaagaacgaaggaggtaacgaaaattcccaggcttcgtagctctctccgatccagaatttttctcgttaactcgttgcttcgttatttatagaaaaaaagaggatggggttgataacgaacttaaggtgtgtttggaaacaggaatagcactaaacgatgtcgtggttttgtaggttacttgacggtgcacgcttcacatggaccattgtttcgaaccataagacccaaaagcaggcccatagaaaacaattgtttctgtttttttgacattaggcccattaaaatgttttttctattttttatacatagcaggcccataaaattttaaatagaaattagaaccatttgtataactttttttttttgtattttaaatttccattaattaaaaaagattccaagctgaacccagctaaaacaacaagaaaaggagattacaaaagcttacctacttaccaatctaacaaacaattctaaagtagacaagtgtgtaaaatggtcgatgggggaggtacctttggaatctaggaaatggtcgatcaatcattgaaacaaaaaaattgataattttttcttggaccaaaatttttgttagtttctttaatgttagtaacttagtattatagaatactagataagatccgcatatttaggcgggtgtaaggtaaaaaaaaataattttgatcgataatatttaaattttgaatagtacaatagtaatcaatattttttctttgatatttaacttaataaaatttgcttcatttcagtcttttgcattctattattattttacacactcaatcttatggatgatatttgaataataaatagtaatccacatttattttatatttagagaaaaataacttaaattcttagtatcccttctcagtatgtgtcaagtgtgataaaagatgcaaaaatgtagagaaattaaattctatatttagatataaaatgtatggatgatatttgaataataaatagtaatccacatttattttatattcaaagaaaaataacttaaattcttagtatcccttctcagtatgtgtcaactgtgataaaagatgcaaaaatatagagaaattatattcttagtatctcaacggtggcacagatctctgtgtccgttctttgaaattgagtaaggagccatctttatctgaagagagctataacgccatgcttcatgtattggatgaagtttttagaaagtgcgaaacacacaagtaacctgatcaaaatgtgaaagggtcagacttggttgcagcgcaagatccttcaagacatttaaaaacagtacaacacattggatgagactacgggtgacttaagccaggtttcttttattctcagctggaatataaatctcttgatcgtatattttaagatagcctagttagtccaacctggctttcttcttgtgaaggattgaaggaacattcattacagctagcaagctttaagcattgctggattacaccaggcatgggagctgtgggcatatggcgcagagacatagaaaccggtactctattcttgataactgtcttagagctcaagtacatgtctcatgaattggtacacgagaaaagtcctttatagttattgagctacagagtataaaaaaggttcatgtacaaaacatgctctcactggtacatacgtaactgagtttattttggtgaatggacaaaatatgcactcactaatttattttctcgacatttttatattatttgtatctaaaatatttgttggatatttgccaaccaacacgatccgataatgaagtttctaaaaaaaaaatctaaataaaaaatcaatagtatttcaagaatatattccaaattaaagggtatattatcatttgtatttctcttttaataatgtagagatagattttagaattaaaattttttccttttcttataaatatatgaacaaatttaaatttggcatgtctctcatttatgttaatgactaactttccaaaactaaaacttatataataaaattactaaatatataaatattaattaatataaaatgaatagaacaaatcattatatactatatttgtcttcacaaattataattgtattgttagagaaaaaaagaaaagaaacaacaatttatttttctatttttgtgaaaccctagatttgaacatcgctcatttcttcttcctacctctccatagatttatcatccttcaacaccaattttgttattattattcatcgcttctcctcatagatttatgatg

SEQ ID NO: 14126 - DNA, 3000 bp, Unknown; identical to SEQ ID NO: 14122
  misc_feature (1)..( 3000): cDNA_ID_3021866_gDNA_ID_2214701_Annot_ID_189677 3000 nt of promoter + ATG

SEQ ID NO: 14127 - DNA, 3000 bp, Unknown
  misc_feature (1)..( 3000): cDNA_ID_3021876_gDNA_ID_2214701_Annot_ID_189673 3000 nt of promoter + ATG
tgtccatagttgagtcacaacactttgtttctctttgtctgaagattcattatttttacctttagggtaagaacttggtttcatctatgacacaccaatgttagaaacaaatatcgaattaaagataagaaaggctagcttaagagcagaattaatccaaccaattaaaacaatgttttagagtattattgacctgattttgaatatagtgttaagattatcaacaatttgtataaatatttctggtataatattatgagagttttgaatctaataagattagaaagcaaatatatagaactttatgttaaaagttataattataagagaactaagtaagaacctgaatcgtgtagtttttgaataaaggatgatcataaattggatgattattcatatgaacgcagtctattatatctccatctggactctgtataaagattatcgaatattcacgaattaatattttaatgaaaaaaattgttaggtgtaattatttttgtgtgaaccaacaaatttcattaaccttgatagatttaagagcaggtttgttgagtttctttaagattttttctacttttgcatcacgagtatcagaaaactcactaccagaaactatcgccgctacgattagaatgctgagcacaaaacgagcaatcatcattcgattgattattaagagtatccaaaatattttttttctttggctaagtagatgattaaggtgagtgccttatatatatatctacaatgaagaattttttttgcaaagcatatgttaacaaatggtaagaaaattatacttcaaaactttttattcattagagcaagactcttaatttaaagcaaattaaagtgtatttaatttgttccttgaaatagcttaatctatttttgactaaataaattgtatatggacatgtcaaaagtcaagtaagctatttcaaggaacaaattaaattttgatttaagttttattattttatcaaaaaatacaatttttaatgaagatgaaaataagtttttatatatagaaaaatacagatttaaatgattttaaagagaaaggttgggtttttacttttgaaaccttccattcaaatagaaggtttaagtattttcagatttagccagatttgatttagtcttagtttattttcctggttttgaatttgatttgttaatttctttttaaaatgtgtttttgttttaatgaaacgaaaactgttaaaaatttaatccaaaccggttttagattagtttttaatcttgttgtggtttaggattgaaaagattcatttcatgtggttctttaaaattgtcatatctctcgtttggagtttctatagtatttctgatatagttttagttttgatgtcaacttgattttcattttaccattatacatgtagatgaaatcatattttgtgaacataattcttttttttctgccaaagattagacaattaatatcctcttgaattttgaaaaaaataatgtataacacaattaaatttagagagcggtatgctatctatgtgttacacattgaaagtgtctgtattatgctatctattaaaactatgagacgcatgcatgtatttacctaacaattaatgtccatgttactctaaacttcaagtccaagaaagcatcaccaaagcttcattcaacttgttcattttgcatttatccatgatttttaagctcattgattgtaaattacgaattgtggcattgtatcgtaactttcttcagattcacatctttaacagtttatatcactcatgccaaacaaaaatcgcatcaatcatatttctataagttttatcagtctaccaaataaactctgttgatttaatataatctattagagcatccacaacacaagttattttttcatcaaaaaaaaaaagttttgggttatggatactctaataaacacaagctattgaagtgccatcaagcccaatactatgagacaaacaagcccatgtaattagggttctctagcaagtagaagtcatccaactctccttcttcatgtgatgaaacatcaaatctagaatcatttgcttttggtgaaaatttaaagtctttccttttgctttctatgcatcttaataaagctgcaattaatgagctatttattttcagttttagatttctcctttaataagctgaatgagcataaacctatctaggtttagaaatgtcaacacaatcttttgaagtattatgaatctcttcaaactcatgtacacgctctcgaaacaacaagacaaagtaaataaagcaagacacaaccataaattaatcgagcaatattgtactatcttggtgtaatgtatggaactaattaccgactacggagatcataacacatttattaatacataattacgttttaaaaaacgagaatgacgaaaagttggtccaacactccaactacatataactaatatcaagctttaaatacttgaatgacgtgttgacgaaacaaatatttatcaatacaattgcgtaaccataataataattcaataggacttttattaatcgtgtgattacaaattttacacacacgttgaatattcgacaaatatgacttgatgtggtcctacttcgatgacttctacgttgacttttgctgtttgaggtagagaaggaaaattacctgccatcttttttttactataattaaataaaataaaataaaaactttactttattatattttcgggaaaataaattgacttcaaagtttcatcatcatacaaaggagaaaactttgaagcttcttactttctttacttcacgatccttcttttgcctaatttctcggtttcatttccaaaattctcttttgattctttcttactctttcgctagagaagatttagactgggttttgagtatttctcggaaattttcgtgttttttttttctgggaaagtttccgagatctcggtggagtactttttttggcgacgaaccagt

SEQ ID NO: 14128 - DNA, 3000 bp, Unknown
  misc_feature (1)..( 3000): cDNA_ID_3021839_gDNA_ID_2214701_Annot_ID_189668 3000 nt of promoter + ATG
gaatgtgttgttaattatcccccttgcacaaaataagtggtccatgagcatattaatatttacaatatcactgcttgttgtaattttataatactaataacacagttagcgaattagatttgtcgatgatacccgacatcattaatgacaacttcaaaacagtgactgtatcacaaattattggacaagaagtttaccttactaataattgtgattaattaagtaatcaagaaggagaagaagaagcaaattgagatttgaggacagaggaatatgctgacattgattttgcacaaaaaaaaaatgctgacattgacatttattttataaatactaatagtgcacatgtgtcatgtgtgatatataaatactgtatgtaggaaattttgccttttggatttgatcaaattggattttaaatagattttggcacgacggaagacgaaatgtggtagaaatcatatttctagatttcaagtagattttgaaatttgcaacgttgcaaggcaacaaatttattttgactgtttacgtctctttttgttagaaaaatttcagaaaatgtttgatgaatataataaaataagcaaaaaaaaaaacttgttcatttttaagaatttattaaccaagcaaaccaaatcattactaattcaaatatcactctgcttaaatagtgtcacactatcaccattactgtcacaaatcttacttaacaacaaaacacatacagtggaaactctataaattaatactcgataaattaataaatacaataaaataattaattttgctagtctcaagtcgggccaatgtaaaaattaagcaaaatcgataagataataagataataatttttttgaaatttctatgtaaaaatatggttccaataatatcataaattaataatcatagatcttaaacaaatattttaagactaattttatatgaaacttttgttaaaactacaattgcaattctttttagattacagttggtatgatctcttttgtactcacacaactctttgagtatttgatccatcatatttggttttgtaacatttttttctatgaaaaatcattgttaagatttgtgtaaagaaaaattggattaagctatacgttaacgtcgtagatatacgaacacaatatcttgtaagaaaataaattaaaaaagtcaaaaataaaataaaatatataacataattgaatatacaaacaacaaaatacgagaaaatctaaattaaaaatattgtttaaaaaaaaataatattgtgttttacgtaaatattctttaaattaatatttattaatttatcttattaattaatatttattaatttattatataaattaataaaattatgtggtcctatcattattaatttatagagtttctgctatatttataattatcgccccaaaataataaaaacagtacaggaaagtcattatgaacatcattacacaaagcccattacaaaattcgcccataagcccaatctaacaacggcagagattcagagtcagttccgacggcgctgaccaaagaaacgcgtctctctctctggagaaaatttcctcacagagaaagaagaaaaagacgagagacgtgaagaagaaatcagaattcagaattgagaagcaaacaatggcttcaacgatctacacttgcaaagaatgcggatcagatctgaatctaaaccctaacgatttatttccaccggatttctacttcgaagccggtaacaaaggaacactctcattcgccgccgtcgacgccgagaaattccgattcgagaaagaagataagatcatgcctttcttcgaaaccctaaattactggggaatccaacggaaacgaaccaagatcaagtgcactagctgcaaccacctcatcggttacatctacgacgatggtcctcctctcactggtggtattggccaatacggatttggtccgagtcaagtcattcctcgtgctcctcggtatcgattcaaaaccaaggcggttcaagtctcgtcccagacttagctaaagcagagggtttaatgcttttacatagatatgtataaacttgttaaaagggttaataggattgtagatgtttgttgcttaaaactcagatagtaaggtcgttagacttgccatcggtcttggcgcttgcttcagcgccaagacggatggcaatacggaggtttaaccgccttttggaactgatttttgttgcttgcttttgaagaaacatctacaatcatattctctcctttgtctcttgtctattgtagctagtatagttaagatatgtatgttaagtatgttgttggcttggattttgatcatatttgtagtgtttgtgtttgttgtgagtttgaatcacatggttgactgatttgttcaatgatttgggacgaatattttcgtagtttgttcaataatcatcggttgttttgtttggtgattcgagttttgtacgaggaactttagaagctgattgttttaagaacaaactctatcggcttaaagagaatgtgaagaacagaacaaaaaccaatagtgttagtttaatggaggacgtcatttgaaaatgacgttttggtgatattgattgtgatggccatttatgattcaacggctgtgattgaatgatgtaacattagttgcttcaagaccatatattttatattatccatacactacctaattgcttaaaatattgttgatgttgatgaagattggaagttacatctacttgtctacttgtcgtttcttgtatagttggagtttatagtttgtcttaacgtacaagataatttgaaaggtagacgtagacgttggatacttatttggtaggctcttaagaatcttaggtgtatctctttagtttgaaggttagattcagaatctctgtagattcattagtagctttttctgtgtgatctttgtgttgtatatatatagatcgaattgattttagctggtgaaaggtgaagttgtggt

SEQ ID NO: 14129 - DNA, 3000 bp, Unknown; identical to SEQ ID NO: 14118
  misc_feature (1)..( 3000): cDNA_ID_3021888_gDNA_ID_2214701_Annot_ID_189666 3000 nt of promoter + ATG

SEQ ID NO: 14130 - DNA, 3000 bp, Unknown
  misc_feature (1)..( 3000): cDNA_ID_2710924_gDNA_ID_2214701_Annot_ID_136874 3000 nt of promoter + ATG
gtacctcccccatcgaccattttacacacttgtctactttagaattgtttgttagattggtaagtaggtaagcttttgtaatctccttttcttgttgttttagctgggttcagcttggaatcttttttaattaatggaaatttaaaatacaaaaaaaaaaagttatacaaatggttctaatttctatttaaaattttatgggcctgctatgtataaaaaatagaaaaaacattttaatgggcctaatgtcaaaaaaacagaaacaattgttttctatgggcctgcttttgggtcttatggttcgaaacaatggtccatgtgaagcgtgcaccgtcaagtaacctacaaaaccacgacatcgtttagtgctattcctgtttccaaacacaccttaagttcgttatcaaccccatcctctttttttctataaataacgaagcaacgagttaacgagaaaaattctggatcggagagagctacgaagcctgggaattttcgttacctccttcgttcttctctgatctcgaattcaataccaaattcttcaatctcccgaatctgattttcttatcactatccctggataacaaaagcccccaaagtaaaaacccaattgcgattccctcgtaaaccaatctagggttttcgcgagttcgtctctgagcttgtttgtttgtgatcgtgtgagaatgtctcggtgttatccgtttccaccacctggttatgtttggaaagaaagtctgatcgaatcgatcaaggttgatttgttgagcaatttaaaagtccatgactttggttcttttttatgttcttggttcatgtgatttttttattgctcagcttcctgcttctttgattttgataatcttttgtcaaagttggaaactttgattatcatggagaagtaatttgccatatagatgggaattcaaatcttacttaaaaagttaactaatttatctcaaagcatgaaattgattcattggactgaatactgacaaatgtggttgaaattgaatagcctcctaaaacttatagaagtagagtaagtcattgacaatttctacattgtttgtgtgtttctactctccttctttgtcctttggaggtttactggataagaaagttatggacacttattgttgtttctttcattggtttggaaatccagggggcaaaggaggaagtgaagaaagatagaaaacacaagaggaatgaaaaagatagaaaggatagggataatgaggcggggaggagcaggaagcatcggcataagagacggcggaaagatgaaggcgccattgctagtggcaaattagtaagcagtgaggtcgagttgttagagaagagctgccagactgtggaacttgagcttcaaacatcgtctcagaattcttgtgatagcactcttcatagcaatgagagaccaaagcaaattcagagtcagccccttgatggtaggcataacataacgactctggtgagcttgtttgcttttacttgttgttgggtctgtttgcttatggtgtcattctttcttggtttaaagaaaccagcatacggactcggttacctgacaaagggcaggaagatcctgaggatggggtgatgatgaccagcaaggatcaaaaacagcgcttttcccgggaaatgttagatgcttctcaagctgctactgctcctaatgagtctgttggtcattcaagggtctgtcaagagaaaagaatagatccaacttttggttcgtcgagagagatcacaacaaaactcaacaaagagaagaagtcagttccttcgaaagataacagaaaagttagtaaagagaagaagatgccatcattatcttcatgtaaccctctggaacaagagaaaccgacctctagtcatcaagaaacccctggaccttccaagctattatgcaggaaatgccctccttccatggctgggcaactcttgaatcttatcgagaactgggctcctgatcgggttgagagcaagctcactgactctgaagatcaagaatggtggttgttcatcaagtttggagccaaaagtccacaagttagcaatcagaaaaccaaccagggaagtagttccatggtgtggccgactgctagatttcttcctgaagccgaagtacacgcattgccattcactgtcccgttctgatttcaacaaagttggtcgagagagagtgagagagagagagagagagtggttaacatgaccaacatatagttttcccaagtattttagagtagccttgaaacttaagaaactcagaattatgtgtgattctttgtagatgtactggtaatatagtaaatcaccaattacgtaaatggtaaatatatgtgctggttagatagtaaattacatgagagtttcgaacttctttggctacttccttatcaatcgtaaatcttatttacgatctttgttttttttttctcataagtgttgcctctcattataaagagtttgccaacggtacaaaagtggaacaatccactttcaaactacagacaacacattaaacagaaaacaacattggaagaccaaacaggtggtatccatgttgcagagaaaactatttataatttgatttggttcgattttaatcaaaatgcaaatcaaaaatataataaaataacaaagtagttacaatattttatattaattgatatgtttattcataatacataaaatataaaattgaaataaattttgtttatccggttcggttgagttccaatatagcagaaacgattgcggttaaaattctggattttattcggtttgatgaaatagaatatggaccgttagatctaaagttaagtagaaacaacgaacggtggatagcgaggaaaacgtacacgtgtgaagcatgacataatttttttcccatccaaagactttcacaaggtcttttttttgaaacctgaaaagtgagaaacccagagatcgagattgagatttagagaagacgaagatcagaag

SEQ ID NO: 14131 - DNA, 3000 bp, Unknown; identical to SEQ ID NO: 14123
  misc_feature (1)..( 3000): cDNA_ID_2991474_gDNA_ID_2214701_Annot_ID_136875 3000 nt of promoter + ATG

SEQ ID NO: 14132 - DNA, 287 bp, Unknown
  misc_feature (1)..( 287): cDNA_ID_2705235_gDNA_ID_2214702_Annot_ID_136876 3000 nt of promoter + ATG
ctccctacatttccgattcaaaaccattacagctacacaatggacaaacagagcaaaagtttccaaaacaagaaaaataaaacccaaaaaaaaaaaaaaaaaaaaaaaaaaccagaaaatcaccatcaccggaatccgtctagcggaacgacggagacatcttccttctttgcatgttaccgccgtttcttggccgtagaagatataaatattgatagtcgtatataaaaaaaaaacatataagacaaggtacataagaaaaaaacaatttcgttaaagaaaaaatg

SEQ ID NO: 14133 - DNA, 3000 bp, Unknown
  misc_feature (1)..( 3000): cDNA_ID_2711004_gDNA_ID_2214702_Annot_ID_136881 3000 nt of promoter + ATG
acgcatgtatttgttgaccaatattatagagagtttgtctaacctagaggatattttggtcataaacattacacacacttttttgttccttaaaaacaattctttgtattcatctctttaattttccttaacaaacgttacattacggactgcatcgaccgacccactatgtagttgtattaatggtttgtgttaacccaaaatcgattgcgtgtctcaaaagacgaaaaaaaaaacgactgtcttatacaaaattcattaattatgatccaagtcttgtgttaattacggtcaacattttaagttaaaattaattatttattatatatgtggtggatttaaataattattttcatcctgaacattaaagggttaataatttacctaaatgactcaccaaaaaattaatttacctaaatgaccatgatgaatatctaattatttaggtaaatgagcaaatgacaaacatataatcaaagaaacactttaatatatataaacatgtaaacaccaattatttaggtaaataatgtattttctatcatttgactttaatgtctttatatatatatatatatatatatatatagatacatatgtgttttgcacaatcattttattttaataaacaacgtactgtataaatcacataaataaaatagcataatatttttgctaattaaaagtcgcttatgtcatccaatacagttgagtgtgtttttaaattgttttatgtaatatataaaagttcatggttaattaggatgaatattcaaaattaaaggacaaactctgtttctattcgctacatatatagttttacggaatacactctgcacaagtcatcataaaacaactggaatggaatatgcgatgaatctctttaataataatatgtgggatctgactgtggattctaatctaatatttctattataagcaatttggacgattcgtgccattttaaaaatggttgagggatttttttatggggttgaatattgtcattgcgccttatcagaaacacaaaaacaaaaaaaatattgtcattacatgcatgatgttgatgaattatttttcaatcatataaacttgtggttgaagaaaaagcacaatatttaacaaacaaaaacataacctgaaacaatataaacttactttctaaattaataaaacatttgaccgaatggggaatctaaaagtgtgtcatataagatattgatttaaagacctagatgacgtatgggcttacataatatgtggtcaacattgaatattatagtcagagcaaacttcgcacgaacaaatcaactccaatctcacaccaatagcataagaccatgccgtagtctatatgattgccacaaaagaattattcttattggccaactttgacctagtgttatatttgtatttatatcttttaattaagtatttattgaattatgtatatacattgattgttgcattcatcttttttacttagtatgccatctattcaattagatgaacacattgtaatactataataaattacgtatgtttagttacgatagtgctttaattttgatctaaaccacatgatctagtcagaacgctttgatcgatatttgtttgtgtttattttttttgttgttgctaaattgtaaatatcagtaaggaatgaaagttggggcgtacaagaagttagacctataaatataattgctactttgccaaaaaggtataaaaacaagggaacatatacaagagaattttatgagattcaataaaagagctttagtggagccacacggttgcatcagtcttgagaagctgcgcaaatgtcgtcttgctgagattgagttacggagtaacttgtatattgttttggagtaacttgtgcttgggttcaattggtttactagtactttatgtagcaagttatagaacagttcatatctgtatatacagtttgtgagggtggcatttccacagtctctattggtattgtatgtttatgagacaattcatgttacgtatatgaattgttacaaaactttatgttgtgaccagctacaaaattagttaccaagtcaatatccatggccacgacaacacaatagcggccactatactagtgaacaaatcatcggtagctatacttcttggaaatggtaatgaatactacaaaaataaccccacaatattcttaagttttttgtgtggctacacgcctacactagcttagtcatggataaagtcgtttacatatgtgatatgtccgcctaaccaatgaggattctgatttctgaatcgggcagatttgtccggaacacgatctatgctcatgtaggtcctcatcactcttgcaatgatctttaccacaattaattcacaaattcaacttaaaatcttataagttgaaaaagctccgatcctccctctttgttcacattaaaacaaaacagaacttattgaacacatatctgcatgactgcattttaaaaagaaaactagctgtattgggctatgttgtgggcttcgctagcccatgtaggttgaatatctcttgtcatagtaatgaccatctatattgaaataaaattcttatgataacacaaaccatattaaatctgaacattgattcacgcaaatagagatagttggcaccaaaagtctaagacgcacactcatcttcataggaaacccaaaccctaagaaatggaaaattaacagcttcatagttcaaacgcagaataaaaataactacaaaggtaatattcagttttcacataaatcattttccttttttctataacaaatggatttccttttttaaacaggaaaatacctgaaaaagttaaggcaaaggtggctactaaattatttatatatctacgttcccttagctctctgaacttgagtctaagataaagaaactctcgacgacatcttgagaatcgaacgagaatgatccaaaatctgcaaaaattaccccaagacctccaatcctcggca

SEQ ID NO: 14134 - DNA, 3000 bp, Unknown
  misc_feature (1)..( 3000): cDNA_ID_2706080_gDNA_ID_2214702_Annot_ID_136883 3000 nt of promoter + ATG
cctcaatcgactgaccacccacaatagaagtcaccctaaaccctagataatgcgcaaacttaacagtttcctcctcaatctgctgagcaagctctctagtaggggccataacaacagcataaggcccctcagtctcattctcttcgctcatcggtggcaatctagagatgtaagctaacatgggtaaaacaaaagcagcagtcttaccagaaccagtctctgcaatgccgataacatcacgctgttgcagtccaagtggtatagctgccatttgaataggagaaggtttcttgtatccagctctctccacagctttcaaaagctcagaagtaagcttactctcttcccagctcctcatcggacgaggaatcctcgaacccttgtaagagatattgaaatcttctctgaaaatacgccaatccctttcagtcatctcctctaatctcttatcactccaatgcctgtcaaccctcatatcaaacgagtcataagtatcagcagcttcttctctcactctctgagcagcagcttcctctggtttctctacaataccatctttcttacgaatctcgtctcgcatctctttctcatgcttagccgcttgtttcttctgctcacgacggtccataccagcacgaaaccctctcccaaagagaagctgagcttcatgagggttttggtaaagaacgttcatatccctagaagtatcctcagtgttttcccaatcaaaagagaaacgaaacttctcgcttggcctaatgactctcttcttcggcttcttacctccaagatactgctctttaatggcgtcaagttccttctccttctctctctcaactaatttctcaacacgcgccttctccctagccttaacctcctcttccctctccttttctctatttctccgatccggttcacgatctcgttcacgacggtcacgctcacggtctctctctcgctctctatccctatccctgtctctatccctatcgcggtctcgatctcgccctctatctctctccctatctcggtcacgttctcggtctcggtcccgatctctatctcgatccttatcccgattggtatctccattggagacatcttccgtctcgggctcggggcgaccaagttgctcacgacggacacgttgctcggagatttgatcctggcggcgttttagggctaactcttcccgctgttttttggtgaggaagacaggcttcttagcaatggaggaatcgagagtattgacggaggtagatccgacgacttcgttgattgttcgcttcatcggtggttagctggagattattcgcttggtcgattagcaggaggggaaagcaaacaagacctagaacctttcttctcttcttctctcgctctgatttctttttcacttggattctctttttctacatttttccaaaaccccccaattctagcaaactctcaagggttttaggcccattagtttttcttttgcattccgaattcaaatctaattttgtttttaggcccattagtgttttttcagcggagattatgtagagtagttagattttctcttgggtgaagattacaaacccatttcaagggttagagaactcgcttgtagtagtgtggtgtgacacagttcattcatcattagggattaaaccaactacactaattctgtctttccaacatgaagttttctggtaatgcaaacgaaaccgattatcttcgacatcaatgttcagataaagttgaaaactgatataatggttgctaaggagacgacaaaatgttttttgtggaagcagagaaactaaaacctgattcgttctaattgatgctctcaaaacataaccctgcttaaatgctgatgttcctaaactcaaccctgctaaatatgctaattcatcgtataatctatacatatcacctaatcttagttaagcaattaccaaagataatgcttcaccccaaggccattgcaagtcaatatgagctccttgtactcattcaatagttcctgcaacagaagatacacagggatttatcaaactcaaaagctttggaagtagtttctctctcgaatgaaattaataactttcgtctaccgtgttgtgctcatagatacgacgcatccttttcttatcgtactcctgccttgcaattgggtcgctcaacactgttcagttacaagatcaaattctttattgctaaagtccacagaatcaatggctaaatgaaaacagattcctttcccctaaactagtaaacttctttccttcaataatacattctgcattacatagttagaagaagaccaatgaaacaaattcacattctaagcttactactacttcaaagcctagctcaacaaacaaacacaactacatctacacgatgaaagagaagcaaaaccttgataagcctcgttgatttcttgaaacctagacgtagcagaatcctcttctttaaatttgtccggatgccatttctgcaacacaactccaacacaatcatcactgaagaactcacactcagagactgtcacaaattagtgggaaaatgaagtggaaaagagaaggaaccagagcaagacggataaagctggaacgaatctcatcatcagaagcgtcacagttcaattccagaactttatagtgatcctgcaacacccaattcacaaaaaccaaaactttaacaaattcaaaaccaaacaattatcaaatttttgtttttttgtttgtttaccttgtaatcctcgaaatcgaaaaaatcgaagccatggctgtctccccaatcggaacaccacattctccagagcaaacaaacgattccaagcttcctcaaatttacgattttcctcctctcgtcactgtgggcttcttcagataaaattttattattattatgcaatttcgttttagacccctaaactattacattattacagttaaaggacatttcgcagcttccagaaacatttagagacggctgagatacacagtg

SEQ ID NO: 14135 - DNA, 3000 bp, Unknown
  misc_feature (1)..( 3000): cDNA_ID_2710982_gDNA_ID_2214702_Annot_ID_136888 3000 nt of promoter + ATG
cctcagatgattctatctttctggaacaataaatgacaaaaccatgctactagataccaagtagtgatacaaatcaaccgattgcttcagagttgagtatcaaaatcaaaagtctgaacatctaaacgttctgtatctaagaaatcaaacgagcttcatatctatcaatcaaccatttgctttctagtttaagggagacaaagagcaataccaaaaccagttgcacaatagatagctgagtgcttcagagctgatgaacaaaagactgatcattctgtatctatgaaactaaacgagcttcatatctatcaatcaaacatttgctttatagattatgaaattcaagagcataccacaaccactttcacaacagatcaaccaatatcaaaaaggctagaacaaatgatcgaacactttatctagctaaaactagttgatatttggtttgcgatacaagatccagactaatccacatataaaagagcttgatatctatcaatcgaacatatatatgctttctagtttaagcgatacatgagcataccataaccaatttcacaacagatcaaccaatatcaaatgctagaacaaatgatcaaacaccttagcttcatctagctatatctacttgataaattgatttgcgatacaagatccagatctaattcatgtaccaacgataacaattagaagaaacgctccatcaacaaatgcacatgagcgatcgacatgaatatctcgataactgcatagtgaatgatgaaatcgaagtttacataacctaatcagagagaaacatgtaacggagagatatatgacctggaaatgctttcttccttcttcttacggccatcttcgtgcgctttctctctgaattgctgcaacgccgacatgattcctttgaaatcgctacacgatcaacacggaaacacaatcgcgagtcacatttcagcaaaaaaacagaagaaacgaagaaaaagaagaagacgaagcaaaagaaaacacgagaacggacctagaaacatcgacatccaattcgtccgggagttttgctttcggtgttggcttcttgagcgattgcggcggctctggccgagttctcttagtgcctcttctggtagacgacattgcagacgaaacttagagagtgtgagattcgatgaagcgaaatcaatagctctggcgagtggcgattatctgctctctctcgctcgtgtgatttggatttgaatttgaattttgaaattctgtttgtttgttagaagacttcacacttcacaataatatatagcccacttacgtattgtggatgccgtcgtagctgatcacgtactctcactattttcgttttcttttttgatttttttttcttctttaagttatggctaacataattactattataaaaataaaaaattattctatgcatataattcttcaaattgtgggtaacaaaagtcactgttacttctatttacatcaatttttaacccaaatgaaatatgagacttgatacatcatgggcctctatttttttgtcaaaacatcattgggcctcatggcttaaaaatgcgtatgaaaacttccttcaactcaaacccaaattaactcaaattattgcatgtcgatctcattgttatcttgagattgatcattgaagtatagaaagttagaaactttcacccctaggcctagtttatggtttactctagcgtatatctgtcttacctcttctctcaaagcttaaggccattgtgtttacgtttatgtatatcttcacgctttatttttatttttttggtttaggttaataccaatcctaaaaactaaatacatatcaccgtaccatttaacgttttatcaaagttctgtggttcaacactctaaatattacatgtgacgctataccatacgtttgcgaagcttggaatttttcaaaaagtatttgatctcacatagctttattcagaacctccaaaagaattgcacttataatctccaaggcattgtatagtttaggaaatgaaatcttatgcatgacgtgaaacgatgaaagtataaatcttttttgtaaaacactagaccaaaagagtttccactattaattaacatcaatttttaatagttattttcctgatttaagaataattacacgggcattgttttaccagtttcattaaaatctagttgactttttaacgtattttatcttatcctgatctaagaataattttataggcaccgttttgctaatttaatcaaattggaaacccaaataaatagaaacagaagtgtggatattaattgaacttttaaatgtgttgtaatgtgttgaagccgcaccaggcgcatcttgttgccatgcccatgttaaggaccacaaaacatggaacatgaatgaaaactcatgcactaatactatctatatcccagatatttgcattgaaagttacactgtaaatttacatattgtccaatagaatttgtaaaattatatctatatttttttttactaactctcattaaattcacaaactataagaaattcacatatacatgactataattttctcataaaactttcaaatcataacattaatttgttgaatattaacatatatatgactaaacactgtattgaattcagctgtgatgcattcgttaattattatcttttcatcagaaaaaataaacttcaggtaggttgacgaagttttcatttattctattaaaaaaacccgggaagtgactgtactacaaatcaatatcgagtttcttgcttcaagtattcaaacctgttaggagatctaaatctaaatctttaacgggactacatcgatcggaaacttctcgccagttgtgtacatgtgctgtgtatgcctctactctctagtatctatatgaagtataaaaaattgtagcccgatatctcctataaatacacccaagtcacatcaacccaaagtcacacacacaaagaaaaacaaaagaacaaagatg

SEQ ID NO: 14136 - DNA, 3000 bp, Unknown
  misc_feature (1)..( 3000): cDNA_ID_3100679_gDNA_ID_2214702_Annot_ID_136889 3000 nt of promoter + ATG
atactcatctgcaaaattcaactctctctctcacatgaaagatggaacaagaagagaagaagaggaagtaaaagtaaccattggaagagatataaaggagccccaaacaaaagtggggaaggatcttaggtgcttaagttgttggaccactaaaatttcactcctaaggtataaaaattattagcatgttgtgtaaaaaagagtacgaacaagctttagtgctctattattttgtatatgcatacatgcatacatatgtatccttaaaacctgacgaggacccagctctattttgtagttttaagttaatgtcgatgctatgacaccaccccggtttattttgtggttgatcatgttaatgccgatgctatttcaccatgcgggttcaaatatgcatgttgtttgacaagaaaatattgagagagagaaactgagaaacactgtgaacattttgtcgcgagattagtggaaaatacatgtgaagaatatgtgctaatgtagtgattggaaaagcaagactgaacagtaaatttacattgtgtaatgttttatttttgtggtaacaagaagttgagattcgaactaaaaaacagaccaaacataccacattgcgtttttatgaatcattcgctttttttttttggtagttaaagtttctgtatcaaaaaagaataacatatttaaaagatcattcgtagtgtactattttatttttctcttatgttgttggtttaatcatggagtgactcaataatttatccaactgtaggtttgtaaaaacgttattactgaggaatatgtccactaatttgcacataaatgtgtcgtaaggtttatatttagtttcaaaaagaagtgtttacgattttatagtatagggccaccactaaattaatttgacaatttaatttcttgtttggtgtagatgataaggtcaatcaaattagctatcggggccacgaagccaaaagtggatatacaagaatggtccaaacttgaattatgtattcatttttcaattggtattatgtaaaacaaagatattagcataattaaatggtaaaaacagcaaacacaactctgttattcgagatattttcttttcgatcttgtactcaggtctcagggtacactaaagactacacatatctcgaagacactctgagactagaagcaacaaaagaaaaaaagagaggctattcttaacgtgcaaggaggtttgtggttcgtgagatttgaagatcatctctaacttaaagttcacacctaaaaccaagaaaagaaaaaaaaaaaacttgttcacaccataaaaccatgcacatatactaggttatgtcatcagctagattcatgcacatcagcacatccacatatataaataatgaggagcgtcgtcaaatattgatgccaatgctaatcaaatgttaaatgattttgccgtgttatgtcatcagctagatccatgcacatccacatatataaaatatagaaggaaatggtacagcgctatgcaaacgttttgctctatatctcttagaggtaagggacaaatctattttttgtcaccccctccttttgactatttacgaaacaaaatcaccagtttactatctccactatttagctctatttgtgtttacatcaatcgatctagtttgccctaacttattttcatagagccacttgaacgaaaatctttgttgccgaggcaggcataacataaaattgagttccacgacacttgaaataaacagaatcgaatcaatatcttgaacccaatttataaaaggaatattgttatgcacttatggtttattttctacttcttttaagttgaaataatatcttaagaaaaaatggacaaaaataaataacgtcaagattgggcagtagagtcgtcagctgtcatgacactacttatcattattgtactgcctgtcaattttttgattgtatcttttattcagcagcatcacattctccttcagtgtccttctcttcttttctttttcttttctttttctttcctcattaaacccatacaattctacggtaaatattatggatttgcatacaaactctctaattgtttgtttgggtactataatatggggtccctataatatgtgtagcttaactttaagatagaactaagtcaacaagatccggagacaccatgtcaaagttctatgttcttatgattagatgaacaaagttatgatttattcaagattatcacgattcgaactagttctaaacttgtaaacgtaaaataataaataacgtttgcaactacaacactgaacataaattaatgaagtttgcttgatgtgttggttaaaatttggaatgggacaataaaaagaagaagagaactgagagaagtggtgggggaagtgggaaccttaacttccccacgtgacactaacgagcaacgttaattgaatagtagtaggccctttttgtagtacactcttttatatatggtcaccttttaattagtttgcaaatcacatacttttaaaatcataaaagcaattaacgttgctcgttggtgtcatatgcgattgtagttagtataatcgatcttaattaaaacaaagtccatattaaaaatgaccaaagtatgtaaaaataaaatgttgaattagcatatggtcactgatcttttctattttaagatttagtaaacctaagatgtatccgcaagcctatagggtttgatgtggattactactagttacttttgtatgggcttgaagaaacttcattgggccacaaagagggaggagtgagcgaagagcccaaattcaaacaaaaggatatgagggttcaaatgttattataaaatatattgtggccaatttgtaaagaaacttgataattactttaaaagccccaacacaattatctttacagtttttacgatctggtgctggataagccttttgcttcattctcacttccttcctcatccaaaaaagctcctccatttcaatg

SEQ ID NO: 14137 - DNA, 3000 bp, Unknown
  misc_feature (1)..( 3000): cDNA_ID_2994331_gDNA_ID_2214702_Annot_ID_136890 3000 nt of promoter + ATG
gccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcagatgagt

SEQ ID NO: 14138 - DNA, 3000 bp, Unknown
  misc_feature (1)..( 3000): cDNA_ID_3593822_gDNA_ID_2214702_Annot_ID_189721 3000 nt of promoter + ATG
atgaataaaaaaacgaaagcgaagcattgaatgaaagtggggctaagttctactgcaaagagagtgagagagagagaaaaaagtagaagaagaagaagtaagtgaacagtgtctgaaacgggtaaaaagaagaccaaagaagagcaaagagagtgtgaagaatacgcgcaatgggaagagcgtgaggctcgagagactttccaaaagaagataggaaacagatgtcggggcattaaccaattgggtatttggatttgtaacccgttttgtccgggtcctgccccaatctctaaaccacttttgttgttgttgttgttgttgttgttgttgttgtgcctctctcttctatagctgtatctatctacatctacactgtctcgcgtgttcatcaaaatttaataagcaaaaacatatttcttttttatttatagagaaaaaaaaaatttgaaagaaagaaagaaaaaagtcccccctgatcctcgggttctttgtaatttatgacactcccaatttaagaccttcttctcactttttctctatttgtccttttttttgcagattctttttatcttacatttctacccttgcatgtttcttgtatttacttgtactttcattgttctcttgtttgctacattgtgcttgttgttgagatgagattcattctcacaacaatcggcaatgaaagaaaatgttgggtacttttcatgtttgctttggtttgtgtttaactctctatacatatgtacaacaatgttttgtaggaaaaagagaagatattcaaattgtggtttgatagtaagtattattagtaaaagaagttgattagtatttttagatttaaaacggtataagaatatcacttagcagagacaatagataagatatttgcatgtttgatatatgaagctaaaaagtaaaagaaaagaaaaacatttcaaatctctcgtttactttgatgccgttggaaaaatcaacgtacactgcacttaaattcaatatgttacataaatagtcttatttatgaaaagattaaatttattatcaagagatttaatgtacacaaaccatagttatatacaataaaaaacatttccgaactttattagtatgtgggaaaaaaataaacttatgagttgcgaaatatctaacacaactcaaggataaacattgtaatttctttcatatagcatcatcactagttcaagtgtaaatcgatctaattttgcatagaactgaaaggagtgaacaatgtactaggtaaagaagaacaatgtttttgtttgcatgtgtattaagctctaatttaattcaaagtgtgatatactgatatgattaggctagttcctcatctgggtagacataattataagaattttcgaaacctcatcttaccaaaaacatatataatctctaccatttgtttctctcaatatgccctaccattaatggaccctactttgtacttatgcaataattcttcctgtttttacaatagccattaggtaggtttctttagaaattcggatgacttgtgtatccatcaatttattcgccgttgataacaggttcatgcacaaatttcttaagattgtttcttcttgccttaactttatttttttatcaaaaaaaattagatctagctcacaaatcaaatttgtcacaagatacgaagttatttgtttcaaatttagtcctcgttagtcatttaatgtggttttgttattttgaatcgtttggttagaggaaaataaaatgttatttcaaatcaaatccaaatttggacacattggcaacaaaatgtgttaactttcacttgatgatggtatcaagtcattccaaccattggtttaaaaatgatgacaaatttagtaagcaaatgtgtttcttcttcataaaaaaatacaacaagaagtgaggaagaaacaatgtggtcgactatgattaatgtgatctattgggaacaatgtgattaggcgatgatgaataggtcgtattaaatcgtttactaaaatgatagatcaataacattagcacaaaccaatatatatatatatactaatgcatgatcttctaaaatatttttaaaatccatctaactagttccgaattcgaataacagcaataaacactgattatttatcacaaaggtgtaattttaatcagaaaaatatacaacccttttcaccatatactaaactactgaaaatcaaaggcatgaaagaaaactatcccccaatgtactttagaatataacggtagtccaaatcttcgccacaaaacacaaaaccacatgaactagtcatataataatggataaatgatttaaactatttcactaataatgtgcatcaatccctaaaagtatgccaccagtattcttttatttctcccacaataatatcaataaaaatgattcaaagacaaagagacaacagagacgaaattattcttttgtagatcttattatatataaatgattaactaaaaaccatatacttgtaacaataattattatatcagtactaaaatccaatagtatcaacattgcaaagaaactgttgtgtaaaagataataataatataaagagaaagcaaagaaatcaatctatttcaaaaatctaatcccatctaatgtctctctctccacgcacaaaaggtctaaaagccacaccacacacatcagtcaccagacgtagcagagagcctcactgttgcagagagcactcagtactgttctgtttctctgatacctctctctctcctctctcttttaacattgtccaaattaaaaatctaaactttttttctagttttttttttttctttaatagaaaagttttttttctccacggcttaaagactcactcatcactgtgctactactctctcttcttttggctgagagggtaaaagtcatgaagaaactcctctgagttttttttctttctttcttataataaagctcttatctttatctctgtttctctctctttaatg

SEQ ID NO: 14139 - DNA, 3000 bp, Unknown
  misc_feature (1)..( 3000): cDNA_ID_3021936_gDNA_ID_2214702_Annot_ID_189716 3000 nt of promoter + ATG
gataggaatggagttccaaagaatttaggtgctacgtactaaatctataactgagtaaaagaaggatgacataatgtacaggaatctcatcagtttgagctcatgccacaccaagtgacatttggtttgataactcagggtttaccatacttttcgacatacccctgcaaatgaacataagaattgttagcttatgcaatacttactacttaggtttttacctgctttaagtgtcttttatttccagctaagaaactcacctcgacaagtttcacaattctggttccagacaaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttg

SEQ ID NO: 14140 - DNA, 3000 bp, Unknown
  misc_feature (1)..( 3000): cDNA_ID_3021940_gDNA_ID_2214702_Annot_ID_189715 3000 nt of promoter + ATG
ccaaaaaatacattttagtagcatatatcgacaagatttaaaaacaattttacatattttttatacggatataaaattccttatttgattaaccacaacattggtaaactatctgtagtagcatctgatatacccaaataaacaaaatccaggagttttacagtgtgtttttggtaataataagtttcataaagtgagagaaagctttcaatgacacattctggctctctaattttatctggtgactctgtaagcctacacaatacaaaaccaaagccgtgtgagaaattctcaagtagtataattaacataaccggaaacatatatatgtttttgttaccttgatctgtttgagtagattcttcgcgcgtgcgtctgttttgaaatgatcacgaacaggctgccatattggtaaaggacgttaattatttgttgttgaatacaaaacttattcaaaggttttctgaataattgtgtcagtcttttttctaataccatcattaaggactcgtaaagctctaacataaaggaagttttaacttacttgcaaaatcttattcaacgcgttcatcaggcctttctttagatcgccagggtgcaactcgccgctctcatagtcagcagcaatgtcttcaaagcttttgtaggtcctaatatttggaagaaaattccacagctcaatgacttatgtaataggattatagcaatccaaattggatttttcatgcagaaaccaagcaaataaaggttttagaaaagaacaaaaaggggtaaaactcacttgttaccgccatattcttcatttctctcaactgtgaactcatcaaaccatggtagaatgatgtatttgatgtattcgaggcatggattgcccttcacgacttttggagggcagtaagctttcttgatcttcacattaacttcagcctgaggacatccagacattcaaaacaagtcaacaactgtgataactcttatctacttttgtaaacttagaattttggctaagttatagttacctcttcatcttccataaagatagcagataatggatcacttttggacatcttttcttgtccttgttggagaccaggaagcatatctgcaagtagttaacaatgataaatgattaacaacacgctagaccagttaaaacgtggtataacagaagtcaaataggaaaatgcagagcatacggtgtgacaagattatcggtttgtttttcctctttatgtcatcacagtattctctcgctagcacatttacttttctttgatccatcccaagctggcaaatatcagcctacatatgtaacgaaaatggtttaacagtagtcacagaactcatcagccagatacacaaaatgtaacattacattgataaaatctgcaatcatatacagcttatttctagcctggagcttttatcaggtgttttatcaacaatataatagactttctgctgatgtaacgcttaagctaaattttttattccgagtaactagcagcagaatcaaagacagttcataagcaagcaaaggcttaacagtacctcaaggaaaaaaatatctgcacattgcatgcatgggtaaaggatctgggcagcactcagttcatcagtctcactacgtcccataatctgcacacaccttcaaggacaagaaccagagtcattcaggtcccatcatttccctcacataattacaacgtcccaagaatggagaagatttagaaaagtaaccttaagattctagggagcttgtttttgcgagcaatgtccatcacaagaggccaatacttatctgccttagaattaatttcttcggacgaccacaaaaactctactttgtcattatccatcccagcagccttccatatctcttgaaagtattctccaaccactctgattttcttcaagtcaccacccattttgttgttcaactgagcaaaccaatcagcaatccaaatcttcactctgcaaccagctgaagtcattttgttcacattgatgactttcatcactccctattaagaaaacaacagaaccaaaatagattagccaacgcttccttcccacatatggtaatggaacaaaggaaaactaacagacctgagcaatgtgcattcttcctgatggttcaaagccgtcgtagcaaatcggagcagccttcttagcaagaagattctttagctcttcctcttgtatacattcctcaccgatactcctaacaattttgtatctcttctcaacttcttcactcatcctgaagaattagtaaaatttcaatatctaccagaccaataagcagataacaagatcttttcaattttaaattccatacttctaaattgctatagctttttcatctcttccactctaatcaaataatataatccaaatcaaaattgaagcgcgaaaatgaaaaaaattgatgattggtaagaaaactcactggaatccatcggacgaagaagatgcctgagttgatgaaacggaaacagcttccatctccgacgacagagcattgacgatctccgaactttggtctgccatcaaatttagccggcggctccttcacaaaattgcgaaattgcggaggattcttagggtttaccagtggcagtgatggagacagttaacgtgcaatatagcaccactacgcttcacgattttcacggtttgattcgattctctttaattttgttttggtttaatccggttactataaaaaggcaacgatgtgttaatttaggaaatagttggtaaaatttggaatttagtatgggccttaatactaaagctttaattatttaggaaaggcccattagatataaaatagttcggtggtctttgtaacaatggtggtttcgatataccaaacgtattctcggagatcatcaggactcaacagcgagcttcggaccccgatcacgccgcagtatttttttttatcaatttaccactctctgcgttggttacctcgccgaagacttcaagatg

SEQ ID NO: 14141 - DNA, 3000 bp, Unknown
  misc_feature (1)..( 3000): cDNA_ID_1376943_gDNA_ID_2214702_Annot_ID_189714 3000 nt of promoter + ATG
attccttcgcattgagaagcagctttgttcatgagcatagaccttctatcagttcctatttaaaaacagacatgggatctgctggaccagcctggacaggatcattatccagttctgttcctatgaatgatcgtgcttctacggtgggggattttgaaaatgggaatagtttatctggatccggatcacttccaacgctgcaaggggtagctgtttcttctgataaaggcgcagaagccaacactactagcactaaaaagaaagtttcttcagatgactgggaaccttctgaaccttttaaagcatcttttacaattccaccttatattcttccctcgtctgatgccctctacgatcctttcacggatatagagaatctaggagacagacctcttaatgattcattgtcaagtaaaggagaacatgcacggaaaagttcctgccagcagaaagatggtgattctgctagtggtccccaagcacgggattgcaagaatgatgataaaagcagttcatgcagtcaaaatcaacaccaagaaaccgtggcaaggagtttggaagcacatggagtagtggaaggggtggctacgtcagtggttgatcaaaatgatacagcaacgcctagcaaagagatttcttcggctacggctgcagagaatagagttgttttgaaaagaatcaaacctgcagggcatgattcttggcatagaagtgatgggtcttcatataaaaagacaaagaaatcagatgagatagatggtgaagtgaggtcagatgcaggaatgaaagtaatgagactattccggactgcagttgtggaaaccattaaagaaatgttgaaaccgttgtggcgtgagggtcgtctaactaaagacgtgcataacatgatagttaaaaaagctgcagaaaaggtagtcggcgccgctgtccagtttcatcaggtgccaactgacacagaatcagttgatcaatatcttggtttgtctggaaccagaattgtgaaacttgtcgaggtgagtttcttagctggaaataaaagacacttaaagcaggtaaaaacctaagtagtaagtattgcataagctaacaattcttatgttcatttgcaggggtatgtcgaaaagtatggtaaaccctgagttatcaaaccaaatgtcacttggtgtggcatgagctcaaactgatgagattcctgtacattatgtcatccttcttttactcagttatagatttagtacgtagcacctaaattctttggaactccattcctatcctttaccgataatggaataaggttggaatgggagcttggtggaggaaatgtgtacacattgtaaaactcttcaaagcttaatttatgcttaaaacagttttcttttacctttgggaatatgatttagaatgtgatctttagaagtaatgtgataaagaatggttgccttggaagcagaggaaaagagaaagaaatggaataatgttgaggtacgtttcctaactatttgataagtaatttagctttgtgaaaccaagatttttcaaattagaagttagttttagttttgtatttctccatcaatataagtaaaacctctgtaaattaatactcggtaaattaataacctctataaattaataatttcttccaatcccgaggtgagactaatggaaaaaatgacataaatcgataaattaataagataataatttttttgaaaatcctatgtaaatatatggtctcattaatatcacaaattaataattgcagaaatgtatcaactatatatacattatatgtaagaaatttctttaaaatatatttctaatatttttttttgcttaaatttgtatttattcttatttgatattgagttctaatattttattgtatcaaaaaattttggtgttgttttctaaatatgatattactttttacttgtaattgattcttaaaaaatattttctataatgaaaaaatcttaaattttttttaaaagttaataaattagaaaaatatctctataaattaattaattaatcgataaattaaaacctctataaattaatataatttttcggtcctaacattattaatttatagaagttttactgtaagtagaaagtggtttttggtttaggataaagtgcatacgttttgtgtacagttttggaattagttttatctttttcaaacattttagtgaatcatttggactatgatcattaggacatcatgaacttattatctatggtgggtttgtggaaaactatttgattagagttactgttgcttaataatattaacttcacaaaataatcaaaatatgtttgttgttcctataatacttttccacgaaagacttgggattcttttgatttaagggtccctacactttatgactcgtcgtccttatccatatctccagctctatacccaccttgcattttttttatttccacacttctccctcactgctcacgcttctcatgatcaatggtttgatctatattataacattaatgttatatattaaggtcctttaaagtaggcttatccacatcctaatttccaaagatggcgtgtattttagctctaaaccctggaagttgcatgttatattaaaatgttgtaaaatgacatattaatacataacacacaatttacaattatattatgtattcatgttgtttattgacagagaataataacattttggctaaacgtatcaaattttaacgaaaattctatgtgcaagtatataaacttcatttggtaattaagttatcaattacttgtcaattatttctagtctattatagtatttctctagatattttgtgggtcaaataaaaaatgagagaactagtcgacaaaggaaaagagatatttttacgaatagtttaaaaatgagtctataaattagatgaaggaagccctttagtaagtacttcacacttgacacaattctatccaaaatcaacccaaaaaaagaaagaaatatg

SEQ ID NO: 14142 - DNA, 3000 bp, Unknown
  misc_feature (1)..( 3000): cDNA_ID_2994331_gDNA_ID_2214702_Annot_ID_189712 3000 nt of promoter + ATG
gctgtcgccattgaaatggaggagcttttttggatgaggaaggaagtgagaatgaagcaaaaggcttatccagcaccagatcgtaaaaactgtaaagataattgtgttggggcttttaaagtaattatcaagtttctttacaaattggccacaatatattttataataacatttgaaccctcatatccttttgtttgaatttgggctcttcgctcactcctccctctttgtggcccaatgaagtttcttcaagcccatacaaaagtaactagtagtaatccacatcaaaccctataggcttgcggatacatcttaggtttactaaatcttaaaatagaaaagatcagtgaccatatgctaattcaacattttatttttacatactttggtcatttttaatatggactttgttttaattaagatcgattatactaactacaatcgcatatgacaccaacgagcaacgttaattgcttttatgattttaaaagtatgtgatttgcaaactaattaaaaggtgaccatatataaaagagtgtactacaaaaagggcctactactattcaattaacgttgctcgttagtgtcacgtggggaagttaaggttcccacttcccccaccacttctctcagttctcttcttctttttattgtcccattccaaattttaaccaacacatcaagcaaacttcattaatttatgttcagtgttgtagttgcaaacgttatttattattttacgtttacaagtttagaactagttcgaatcgtgataatcttgaataaatcataactttgttcatctaatcataagaacatagaactttgacatggtgtctccggatcttgttgacttagttctatcttaaagttaagctacacatattatagggaccccatattatagtacccaaacaaacaattagagagtttgtatgcaaatccataatatttaccgtagaattgtatgggtttaatgaggaaagaaaaagaaaagaaaaagaaaagaagagaaggacactgaaggagaatgtgatgctgctgaataaaagatacaatcaaaaaattgacaggcagtacaataatgataagtagtgtcatgacagctgacgactctactgcccaatcttgacgttatttatttttgtccattttttcttaagatattatttcaacttaaaagaagtagaaaataaaccataagtgcataacaatattccttttataaattgggttcaagatattgattcgattctgtttatttcaagtgtcgtggaactcaattttatgttatgcctgcctcggcaacaaagattttcgttcaagtggctctatgaaaataagttagggcaaactagatcgattgatgtaaacacaaatagagctaaatagtggagatagtaaactggtgattttgtttcgtaaatagtcaaaaggagggggtgacaaaaaatagatttgtcccttacctctaagagatatagagcaaaacgtttgcatagcgctgtaccatttccttctatattttatatatgtggatgtgcatggatctagctgatgacataacacggcaaaatcatttaacatttgattagcattggcatcaatatttgacgacgctcctcattatttatatatgtggatgtgctgatgtgcatgaatctagctgatgacataacctagtatatgtgcatggttttatggtgtgaacaagttttttttttttcttttcttggttttaggtgtgaactttaagttagagatgatcttcaaatctcacgaaccacaaacctccttgcacgttaagaatagcctctctttttttcttttgttgcttctagtctcagagtgtcttcgagatatgtgtagtctttagtgtaccctgagacctgagtacaagatcgaaaagaaaatatctcgaataacagagttgtgtttgctgtttttaccatttaattatgctaatatctttgttttacataataccaattgaaaaatgaatacataattcaagtttggaccattcttgtatatccacttttggcttcgtggccccgatagctaatttgattgaccttatcatctacaccaaacaagaaattaaattgtcaaattaatttagtggtggccctatactataaaatcgtaaacacttctttttgaaactaaatataaaccttacgacacatttatgtgcaaattagtggacatattcctcagtaataacgtttttacaaacctacagttggataaattattgagtcactccatgattaaaccaacaacataagagaaaaataaaatagtacactacgaatgatcttttaaatatgttattcttttttgatacagaaactttaactaccaaaaaaaaaaagcgaatgattcataaaaacgcaatgtggtatgtttggtctgttttttagttcgaatctcaacttcttgttaccacaaaaataaaacattacacaatgtaaatttactgttcagtcttgcttttccaatcactacattagcacatattcttcacatgtattttccactaatctcgcgacaaaatgttcacagtgtttctcagtttctctctctcaatattttcttgtcaaacaacatgcatatttgaacccgcatggtgaaatagcatcggcattaacatgatcaaccacaaaataaaccggggtggtgtcatagcatcgacattaacttaaaactacaaaatagagctgggtcctcgtcaggttttaaggatacatatgtatgcatgtatgcatatacaaaataatagagcactaaagcttgttcgtactcttttttacacaacatgctaataatttttataccttaggagtgaaattttagtggtccaacaacttaagcacctaagatccttccccacttttgtttggggctcctttatatctcttccaatggttacttttacttcctcttcttctcttcttgttccatctttcatgtgagagagagagttgaattttgcag

SEQ ID NO: 14143 - DNA, 3000 bp, Unknown; identical to SEQ ID NO: 14136
  misc_feature (1)..( 3000): cDNA_ID_2992886_gDNA_ID_2214702_Annot_ID_189711 3000 nt of promoter + ATG

SEQ ID NO: 14144 - DNA, 3000 bp, Unknown; identical to SEQ ID NO: 14135
  misc_feature (1)..( 3000): cDNA_ID_2710982_gDNA_ID_2214702_Annot_ID_189709 3000 nt of promoter + ATG

SEQ ID NO: 14145 - DNA, 3000 bp, Unknown
  misc_feature (1)..( 3000): cDNA_ID_3021951_gDNA_ID_2214702_Annot_ID_189708 3000 nt of promoter + ATG
ggtttaggttaataccaatcctaaaaactaaatacatatcaccgtaccatttaacgttttatcaaagttctgtggttcaacactctaaatattacatgtgacgctataccatacgtttgcgaagcttggaatttttcaaaaagtatttgatctcacatagctttattcagaacctccaaaagaattgcacttataatctccaaggcattgtatagtttaggaaatgaaatcttatgcatgacgtgaaacgatgaaagtataaatcttttttgtaaaacactagaccaaaagagtttccactattaattaacatcaatttttaatagttattttcctgatttaagaataattacacgggcattgttttaccagtttcattaaaatctagttgactttttaacgtattttatcttatcctgatctaagaataattttataggcaccgttttgctaatttaatcaaattggaaacccaaataaatagaaacagaagtgtggatattaattgaacttttaaatgtgttgtaatgtgttgaagccgcaccaggcgcatcttgttgccatgcccatgttaaggaccacaaaacatggaacatgaatgaaaactcatgcactaatactatctatatcccagatatttgcattgaaagttacactgtaaatttacatattgtccaatagaatttgtaaaattatatctatatttttttttactaactctcattaaattcacaaactataagaaattcacatatacatgactataattttctcataaaactttcaaatcataacattaatttgttgaatattaacatatatatgactaaacactgtattgaattcagctgtgatgcattcgttaattattatcttttcatcagaaaaaataaacttcaggtaggttgacgaagttttcatttattctattaaaaaaacccgggaagtgactgtactacaaatcaatatcgagtttcttgcttcaagtattcaaacctgttaggagatctaaatctaaatctttaacgggactacatcgatcggaaacttctcgccagttgtgtacatgtgctgtgtatgcctctactctctagtatctatatgaagtataaaaaattgtagcccgatatctcctataaatacacccaagtcacatcaacccaaagtcacacacacaaagaaaaacaaaagaacaaagatgggaatcattggtaagagtgtttctctaactctctttgcacttttgtgcttcacttcctctgttttcaccttaggagtgaatcaacctggttcatcagatcccttccatagccttccccaacaccttcccctacctccaatcaaactaccaactcttccaccggccaaagctcccatcaaactaccagcctacccaccagccaaagctccgatcaagctaccaactctcccaccagccaaagctccgattaagttaccaactctcccaccgatcaaacctcctgttctcccaccagtttaccctcctaagtacaacaagaccctagtggcagttagaggtgtggtctactgcaaagcttgcaagtacgcgggcgtcaacaacgtccaaggcgctaaacccgttaaaggtactcacttatatacattcatgatatgaaagtctatatattatcctaaaaatcactcgaacccttaatatacgcacctgtggaccgtggtatgtccgtatgtgaaaagtccacacttcaatcccatgcattcatactttttttttgctaaaggtatgctgcatgcatacttcatcctttacatttattttaggcatatgttatatgtatcataatctcattgtcggttgttcaaaactttttgtgtaaacttttaactatatgctaccaagcgagattagttcagagccggtcgtatcattctggtcccttcacgaattgataaacataaaatataccatggaaaactaagtaacttctttcaatgcttttgaatttaatttaattataatcaataggtttttggttaagacaatctactgtagcgaagccttgtcattgttttccccaagtttcctataataccaaatttagctcaactagtaagaaaatcttgttcaagtcatgccccttcttaaaaaaagagggtaaatttaccataactaatctaaacaaatacatgctcttgcattattttaaaacaatttctgtataacaaatctatccaagtactatattttcactttttatttcgtttgtgttatctggggatacagatgcggtggtgagacttgtgtgcaagaacaagaagaactcaatatcggagacaaagacggacaagaacggatacttcatgctcctggcccctaagacggtgaccaactacgatatcaaaggttgtcgagctttcctcgtgaagtctccagacaccaagtgcagcaaagtgtcgtcactccacgatggaggcaagggctccgttctaaagccggtcttgaaaccaggattttcctcgaccatcatgagatggttcaagtacagtgtgtacaacgttggtccattcgcattcgaacctacctgccccaaatgagatggtgttataagagctacttaaacttttattaatcaatgattgtgttgaatatgtatcagcttggtttctttgtatgggcttttctggtagtgttaatctttctaatttgcttcttaaataaaaagtggtgacgtttacatattaggtttttcttgttaattccttatcttcgtgaccccaaaagaaaaaagaaaaaaatagtttgctaaataaaagagactctgaatatgttatgtggatgttaatgaacacaaccgttgatatattagcctatatattaattcattaggaatcgaaatgaccaaatttatctccaacaccatcatatcagaacaagtattgacaagtgttgagcaactagtacaataattttctttcataattatactgtacatttgttcattttgtacgaaacctctgatg

SEQ ID NO: 14146 - DNA, 3000 bp, Unknown; identical to SEQ ID NO: 14134
  misc_feature (1)..( 3000): cDNA_ID_2706080_gDNA_ID_2214702_Annot_ID_189700 3000 nt of promoter + ATG

SEQ ID NO: 14147 - DNA, 3000 bp, Unknown; identical to SEQ ID NO: 14133
  misc_feature (1)..( 3000): cDNA_ID_2711004_gDNA_ID_2214702_Annot_ID_189697 3000 nt of promoter + ATG

SEQ ID NO: 14148 - DNA, 287 bp, Unknown; identical to SEQ ID NO: 14132
  misc_feature (1)..( 287): cDNA_ID_2705235_gDNA_ID_2214702_Annot_ID_189692 3000 nt of promoter + ATG

SEQ ID NO: 14149 - DNA, 3000 bp, Unknown
  misc_feature (1)..( 3000): cDNA_ID_2710978_gDNA_ID_2214702_Annot_ID_136891 3000 nt of promoter + ATG
gttaataaattagaaaaatatctctataaattaattaattaatcgataaattaaaacctctataaattaatataatttttcggtcctaacattattaatttatagaagttttactgtaagtagaaagtggtttttggtttaggataaagtgcatacgttttgtgtacagttttggaattagttttatctttttcaaacattttagtgaatcatttggactatgatcattaggacatcatgaacttattatctatggtgggtttgtggaaaactatttgattagagttactgttgcttaataatattaacttcacaaaataatcaaaatatgtttgttgttcctataatacttttccacgaaagacttgggattcttttgatttaagggtccctacactttatgactcgtcgtccttatccatatctccagctctatacccaccttgcattttttttatttccacacttctccctcactgctcacgcttctcatgatcaatggtttgatctatattataacattaatgttatatattaaggtcctttaaagtaggcttatccacatcctaatttccaaagatggcgtgtattttagctctaaaccctggaagttgcatgttatattaaaatgttgtaaaatgacatattaatacataacacacaatttacaattatattatgtattcatgttgtttattgacagagaataataacattttggctaaacgtatcaaattttaacgaaaattctatgtgcaagtatataaacttcatttggtaattaagttatcaattacttgtcaattatttctagtctattatagtatttctctagatattttgtgggtcaaataaaaaatgagagaactagtcgacaaaggaaaagagatatttttacgaatagtttaaaaatgagtctataaattagatgaaggaagccctttagtaagtacttcacacttgacacaattctatccaaaatcaacccaaaaaaagaaagaaatatgtgggatgaaactgtagccggacctaaaccggagcatggccttggccgcctccgcaataagatcaccacccaaccccttgacatcaaaggtatttatttttctttgtcaaccataactccgtaataaacttgcatatacagatctttgtagaaacgtatgatctcataattatatcatgtgatggtttttggaaggtgtaggagaagggagcagtagtaaaactgtggcggcggtggccgggagtcctggaactccgacgacgccaggatcggcgcgtaaggaaaacgtgtggagaagtgtgtttcatccaggaagtaacatcgccactagaggaatgggcacaaacctcttcgacaagccttctcacccaaactctcccaccgtctacgattggtacgtactcagtttctgttattattatctgaccggacggtgtagatcagatctaagatggtttgaccgttgttgtgatcccgcaggctatacagcgacgacactaggagcaagcaccgttgagccgagagggtagagtgacatgagaatgatgtaaaataattatgttctttacgccacgtgtttatgttctgtttcgtctattttggctatatgtgcaatcttttatttgcttcatgtcgtttgtgtttgttagtgaccgttgatttccaccatctgggttagtttttagcttttaacggtggcgatgcgtcttcagtgtcttgtaatatttttactgttcggtaatattacaattagcttctctaatgatttagctaacaatataacttaacttaactataattagcaaaatggaatttaacttaaccatggttgatctcatatcattatttttattttattttatttgttcatcattaaaatatctcaatcatgcatggttagatgaattcgttgtgtcaacaaacaattatgatagtgatttgattaaattttaactgaactatggttgatctcatctcattaaataacaaaaacataacaatggttaaatgcattctttgtgtcaacaaaccattatgatagtgatttaattaaagtttatacatgtctttggatacagttgtaattttttatatatatttttttgtctgatttgatataattatacaaagttacacaaaaagaaccaatccaaagctcagggatcaacctattttaatcaccatggttgatctcatctcattaaataacaaaaacataaccatggttaggtgaattctttgtgtcaacaaaccattatgatagtgatttaattaaagtttatacatgtctggatacaaatgtaatatatatttaattttttgtcatctgatttgattaaagaagaagatagaatacaaggttacacaaaaagaaccaacccaaacctgagtcctgcgggatcaacctattcaaagcacattttcaatacaaggggaatatacaaaagaagtgtctccacctacacaaaaacacacaagttcatagagaagaaagagatctttcaccattaaacacacgttacacaccttgcaaccaagagctacatacaaatggagccgtaaaagtcattagttatactttgtgcaatgagattagctcctttataagtcactttggattcactgccatcttctattcaaaaccttaaaacgagatgataatattaacacatataccacaaaaaagcattgaccatttcacatgccattcgttaatcaattgtaaacaaattttatgaaacaatctacctaaactatcataattttgtcacgattagaccgaaactatcattctaattagttcacactacacaatatagaatctatcatatatatgtagcaaccaattctttatctaaaaaaaagtaaaattttgtaacacccatataaatatttaactttcactctgaattattcatttttttttgtagaaagcaaaagacaccgtagtgaagtgaataattcttcttctgctcggtggcgttgtgggaatg

SEQ ID NO: 14150 - DNA, 3000 bp, Unknown; identical to SEQ ID NO: 14141
  misc_feature (1)..( 3000): cDNA_ID_1376943_gDNA_ID_2214702_Annot_ID_136892 3000 nt of promoter + ATG

SEQ ID NO: 14151 - DNA, 3000 bp, Unknown
  misc_feature (1)..( 3000): cDNA_ID_2710974_gDNA_ID_2214702_Annot_ID_136893 3000 nt of promoter + ATG
aaaccaagatattgatcaactgattctgtgtcagttggcacctgatgaaactggacagcggcgccgactaccttttctgcagcttttttaactatcatgttatgcacgtctttagttagacgaccctcacgccacaacggtttcaacatttctttaatggtttccacaactgcagtccggaatagtctcattactttcattcctgcatctgacctcacttcaccatctatctcatctgatttctttgtctttttatatgaagacccatcacttctatgccaagaatcatgccctgcaggtttgattcttttcaaaacaactctattctctgcagccgtagccgaagaaatctctttgctaggcgttgctgtatcattttgatcaaccactgacgtagccaccccttccactactccatgtgcttccaaactccttgccacggtttcttggtgttgattttgactgcatgaactgcttttatcatcattcttgcaatcccgtgcttggggaccactagcagaatcaccatctttctgctggcaggaacttttccgtgcatgttctcctttacttgacaatgaatcattaagaggtctgtctcctagattctctatatccgtgaaaggatcgtagagggcatcagacgagggaagaatataaggtggaattgtaaaagatgctttaaaaggttcagaaggttcccagtcatctgaagaaactttctttttagtgctagtagtgttggcttctgcgcctttatcagaagaaacagctaccccttgcagcgttggaagtgatccggatccagataaactattcccattttcaaaatcccccaccgtagaagcacgatcattcataggaacagaactggataatgatcctgtccaggctggtccagcagatcccatgtctgtttttaaataggaactgatagaaggtctatgctcatgaacaaagctgcttctcaatgcgaaggaattggcgttattaataactagagacctgttgtcagtgaaatcagcaccatacgtttgcttcaaactctctcttctaatgttttcaaatgaaggcataaagcgcatctcgttattgaacgggaaaactctctgagaacctgggggattcacaaaagacatggaggagaaaactctctgaggattcatgaaagatatatcctctctggtaggcaacgatgtcacaccgttttcgcttaactgggaaactcttacaccttctctgctgtccaaaattcttctttctgaatagacataagcaaaataaattattggttgattcagaaagagtaattaaaccccatagatattcaccggcctctatattgttggaactacctccacatagaatcacaagaataagtattcatggtacaacgtacctagatcagaccggataccaccgtttccagccatactattttccgccagttgttgactagtgcaatttgaattctctttcacatgtagaaacttgcaggacaccccattgaaacaccaccctttagcaaaaaatttgcagggaagagctgcacgtttttgttctggttcattcccaccaccgccagtgaaaaagcttcttggcggtatacccggagcaggaaatctgataaccgaatttgtcagtataaaagcttcaacctcttaacttagtttcagcaaaacttaagcagaaacttttttgccataccttggtaaagtaccattatcttgagcaaaagcttgctcctttatgatttttgattgctcatctaaaggtgttgttacagaatgcctcttcacatctacatgagacaagtttaatcagtacatattagcaaaactgctgttttgaataaacaaaagagattccttacagaaacaagcacaaaactctgagaattgaatttgcttacttggtattaaagccacaatttttacaaaagagcttcagtgaaaatctaattgccaagtctttgaacctctaatcagagctaaatctagtcaatttaacaattctctctttcttctagaacaaaattcatcaattccaaattggaaaaggtgtttccatcaataaaaacacgaacttgacagaattaatcaacaataccatgtaaccaatcacgaatttcaaatactaaccgttgtgggaattggaagcttgaattggtggtttatcaaacaattcagattctcttacaattgtatgtacttgcaccttttgttcgacctcatcatcatcaatgtccatgtcggaatcagacatcttgaagtcttcggcgaggtaaccaacgcagagagtggtaaattgataaaaaaaaatactgcggcgtgatcggggtccgaagctcgctgttgagtcctgatgatctccgagaatacgtttggtatatcgaaaccaccattgttacaaagaccaccgaactattttatatctaatgggcctttcctaaataattaaagctttagtattaaggcccatactaaattccaaattttaccaactatttcctaaattaacacatcgttgcctttttatagtaaccggattaaaccaaaacaaaattaaagagaatcgaatcaaaccgtgaaaatcgtgaagcgtagtggtgctatattgcacgttaactgtctccatcactgccactggtaaaccctaagaatcctccgcaatttcgcaattttgtgaaggagccgccggctaaatttgatggcagaccaaagttcggagatcgtcaatgctctgtcgtcggagatggaagctgtttccgtttcatcaactcaggcatcttcttcgtccgatggattccagtgagttttcttaccaatcatcaatttttttcattttcgcgcttcaattttgatttggattatattatttgattagagtggaagagatgaaaaagctatagcaatttagaagtatggaatttaaaattgaaaagatcttgttatctgcttattggtctggtagatattgaaattttactaattcttcagg

SEQ ID NO: 14152 - DNA, 3000 bp, Unknown; identical to SEQ ID NO: 14138
  misc_feature (1)..( 3000): cDNA_ID_3593822_gDNA_ID_2214702_Annot_ID_136895 3000 nt of promoter + ATG
